United States Patent 10,766,935 (PLANT TRAITS CONFERRED BY ISOLATED POLYNUCLEOTIDES AND POLYPEPTIDES) - sequence listing, part 10

SEQ ID NO: 20071 - protein, 136 aa, Pennisetum glaucum
  Sequence also found in Organisms: Setaria italica, Panicum virgatum
MSSSGGRGKAKPATKSVSRSSKAGLQFPVGRIARYLKAGKYAERVGAGAPVYLSAVLEYLAAEVLELAGNAARDNKKNRIVPRHIQLAVRNDEELSKLLGTVTIAAGGVMPNIHQTLLPKKAGGHKGDIGSASQEF

SEQ ID NO: 20072 - protein, 139 aa, Vitis vinifera
MSSTGSTKGGRGKPKASKSVSRSQKAGLQFPVGRIARFLKAGKYAERVGAGAPVYLSAVLEYLAAEVLELAGNAARDNKKNRIVPRHIQLAVRNDEELSKLLGSVTIANGGVLPNIHQTLLPKKTGKGKGEIGSASQEF

SEQ ID NO: 20073 - protein, 139 aa, Liriodendron tulipifera
MSSTATTKGGRGKPKASKSVSRSHKAGLQFPVGRIARFLKAGKYAERVGAGAPVYLSAVLEYLAAEVLELAGNAARDNKKNRIVPRHIQLAVRNDEELSKLLGAVTIANGGVLPNIHQTLLPKKQGKGKGEIGSVSQEF

SEQ ID NO: 20074 - protein, 137 aa, Zea mays
MSSTGGSGRGKAKPATKSVSRSSKAGLQFPVGRIARYLKAGKYAERVGAGAPVYLSAVLEYLAAEVLELAGNAARDNKKNRIVPRHIQLAVRNDEELSKLLGTVTIAAGGVMPNIHQNLLPKKAGHKGDIGSASQEF

SEQ ID NO: 20075 - protein, 139 aa, Medicago truncatula
MSSTGTTKGGRGKPKAAKSVSRSSKAGLQFPVGRIARFLKAGKYAERVGAGAPVYLSAVLEYLAAEVLELAGNAARDNKKNRIVPRHIQLAVRNDEELSKLLGTVTIANGGVLPNIHQTLLPKKVGKGKGEIGSASQEF

SEQ ID NO: 20076 - protein, 139 aa, Platanus occidentalis
MSSAASTKGGRGKPKASKSVSRSHKAGLQFPVGRIARFLKAGKYAERVGAGAPVYLSAVLEYLAAEVLELAGNAARDNKKNRIVPRHIQLAVRNDEELSKLLGTVTIANGGVLPNIHQTLLPKKTGKGKGEIGSASQEF

SEQ ID NO: 20077 - protein, 139 aa, Platanus occidentalis
MSSTASTKGGRGKPKASKSVSRSHKAGLQFPVGRIARFLKAGKYAERVGAGAPVYLSAVLEYLAAEVLELAGNAARDNKKNRIVPRHIQLAVRNDEELSKLLGSVTIANGGVLPNIHQTLLPKKVGKGKGEIGSASQEF

SEQ ID NO: 20078 - protein, 137 aa, Sciadopitys verticillata
MSSTGGGRGKSKSSKSVSRSQKAGLQFPVGRIARFLKAGKYAERVGAGAPVYMAAVLEYLAAEVLELAGNAARDNKKNRIVPRHIQLAVRNDEELSKLLGSVTIANGGVLPNIHGLLLPKKSGKDKGADIGSASQEF

SEQ ID NO: 20079 - protein, 136 aa, Sorghum bicolor
MSSGSGRGKPKGTKAVSRSSKAGLQFPVGRIARYLKTGKYTERVGGGAPVYLSAVLEYLAAEVLELAGNAARDNKKNRIVPCHIQLAVRNDEELSKLLGAVTIAAGGVLPNIHQTLLPKKAGGKGKAEIGSASQEF

SEQ ID NO: 20080 - protein, 138 aa, Cedrus atlantica
  Sequence also found in Organisms: Pinus pinaster, Pinus taeda, Picea glauca
MSSSGAKGGRGKAKSTKSVSRSQKAGLQFPVGRIARFLKAGKYAERVGAGAPVYLAAVLEYLAAEVLELAGNAARDNKKNRIVPRHIQLAVRNDEELSKLLGAVTIANGGVLPNIHQVLLPKKSGKDKGEIGSASQEF

SEQ ID NO: 20081 - protein, 138 aa, Abies balsamea
MSSSGAKGGRGKAKSTKSVSRSHKAGLQFPVGRIARFLKAGKYAERVGAGAPVYLAAVLEYLAAEVLELAGNAARDNKKNRIVPRHIQLAVRNDEELSKLLGAVTIANGGVLPNIHQVLLPKKSGKDKGEIGSASQEF

SEQ ID NO: 20082 - protein, 138 aa, Malus domestica
MSSPTSKGGRGKPKASKSVSRSSKAGLQFPVGRIARFLKAGKYAERVGAGAPVYLSAVLEYLAAEVLELAGNAARDNKKNRIVPRHIQLAVRNDEELSKLLGAVTIANGGVMPNIHQNLLPKKVGKGKGEIGSASQEF

SEQ ID NO: 20083 - protein, 138 aa, Podocarpus macrophillus
MSSSGAKGGRGKAKATKSVSRSQKAGLQFPVGRIARFLKAGKYAERVGAGAPVYLAAVLEYLAAEVLELAGNAARDNKKNRIVPRHIQLAVRNDEELSKLLGTVTIANGGVLPNIHQVLLPKKAGKDKGDIGSASQEF

SEQ ID NO: 20084 - protein, 138 aa, Prunus mume
MSSPTSKGGRGKPKASKSVSRSHKAGLQFPVGRIARFLKSGKYAERVGAGAPVYLSAVLEYLAAEVLELAGNAARDNKKNRIVPRHIQLAVRNDEELSKLLGTVTIANGGVLPNIHQTLLPKKIGKGKGDIGSASQEF

SEQ ID NO: 20085 - protein, 144 aa, Fagus grandifolia
  Sequence also found in Organisms: Quercus alba
MSSTGGAGGGSTKGGRGKPKASKSVSRSQKAGLQFPVGRIARFLKAGKYAERVGAGAPVYLSAVLEYLAAEVLELAGNAARDNKKNRIVPRHIQLAVRNDEELSKLLGSVTIANGGVLPNIHQTLLPKKVGKGKGDIGSASQEF

SEQ ID NO: 20086 - protein, 144 aa, Juglans hindsii x Juglans regia
MSSTGAGGGASTKGGRGKPKASKSVSRSHKAGLQFPVGRIARFLKAGKYAERVGAGAPVYLSAVLEYLAAEVLELAGNAARDNKKNRIVPRHIQLAVRNDEELSKLLGSVTIANGGVLPNIHQTLLPKKVGKGKGDIGSASQEF

SEQ ID NO: 20087 - protein, 141 aa, Rosmarinus officinalis
MSSNAAGTTKGGRGKPKASKSVSRSSKAGLQFPVGRIARFLKAGKYAERVGAGAPVYLSAVLEYLAAEVLELAGNAARDNKKNRIVPRHIQLAVRNDEELSKLLGHVTIANGGVLPNIHQTLLPKKAGGRDKEIGSASQEF

SEQ ID NO: 20088 - protein, 141 aa, Antirrhinum majus
MSSKAEGTTKGGRGKPKSSKSVSRSSKAGLQFPVGRIARFLKAGKYAERVGAGAPVYLSAVLEYLAAEVLELAGNAARDNKKNRIVPRHIQLAVRNDEELSKLLGSVTIANGGVLPNIHQTLLPKKAGGRDKEIGSASQEF

SEQ ID NO: 20089 - protein, 142 aa, Solanum melongena
MSSGAGAGKGGAGRGKPKSSKSVSRSSKAGLQFPVGRIARFLKAGKYAERVGAGAPVYLSAVLEYLAAEVLELAGNAARDNKKNRIVPRHIQLAVRNDEELSKLLGQVTIANGGVLPNIHQNLLPKKAGSGKGDIGSASQEF

SEQ ID NO: 20090 - protein, 141 aa, Humulus lupulus
MSSAAAGSTKGGRGKPKASKSVSRSQKAGLQFPVGRIARFLKVGKYAERVGAGAPVYLSAVLEYLAAEVLELAGNAARDNKKNRIVPRHIQLAVRNDEELSKLLGSVTIANGGVLPNIHQTLLPKKVGKGKGDIGSASQEF

SEQ ID NO: 20091 - protein, 142 aa, Medicago truncatula
MSSKGATTTTKGGRGKPKASKSVSRSSKAGLQFPVGRIARFLKAGKYAERVGAGAPVYLSAVLEYLAAEVLELAGNAARDNKKNRIVPRHIQLAVRNDEELSKLLGAVTIANGGVLPNIHQTLLPKKVGKGKGEIGSASQEF

SEQ ID NO: 20092 - protein, 142 aa, Capsicum annuum
MSSGAGAGKGGAGRGKPKSSKSVSRSSKAGLQFPVGRIARFLKAGKYAERVGAGAPVYLSAVLEYLAAEVLELAGNAARDNKKNRIVPRHIQLAVRNDEELSKLLGHVTIANGGVLPNIHQNLLPKKAGSGKGDIGSASQEF

SEQ ID NO: 20093 - protein, 142 aa, Populus trichocarpa
MSSKEGGASTKGGRGKPKASKSVSRSHKAGLQFPVGRIARFLKAGKYAERVGAGAPVYLSAVLEYLAAEVLELAGNAARDNKKNRIVPRHIQLAVRNDEELSKLLGSVTIANGGVLPNIHQTLLPKKVGKGKGDIGSASQEF

SEQ ID NO: 20094 - protein, 141 aa, Prunus persica
  Sequence also found in Organisms: Prunus mume
MSSKEAGSTKGGRGKPKASKSVSRSHKAGLQFPVGRIARFLKAGKYAERVGAGAPVYLSAVLEYLAAEVLELAGNAARDNKKNRIVPRHIQLAVRNDEELSKLLGSVTIANGGVLPNIHQTLLPKKVGKGKGDIGSASQEF

SEQ ID NO: 20095 - protein, 141 aa, Salvia sclarea
MSSNAAATTKGGRGKPKASKSVSRSSKAGLQFPVGRIARFLKAGKYAERVGAGAPVYLSAVLEYLAAEVLELAGNAARDNKKNRIVPRHIQLAVRNDEELSKLLGHVTIANGGVLPNIHQTLLPKKAGGRDKEIGSASQEF

SEQ ID NO: 20096 - protein, 142 aa, Solanum lycopersicum
MSSGAGAGKGGAGRGKPKASKSVSRSSKAGLQFPVGRIARFLKAGKYAERVGAGAPVYLSAVLEYLAAEVLELAGNAARDNKKNRIVPRHIQLAVRNDEELSKLLGQVTIANGGVLPNIHQNLLPKKAGSGKGDIGSASQEF

SEQ ID NO: 20097 - protein, 141 aa, Triphysaria pusilla
MSSKEAASTKGGRGKAKSTKSVSRSSKAGLQFPVGRIARFLKAGKYAERVGAGAPVYLSAVLEYLAAEVLELAGNAARDNKKNRIVPRHIQLAVRNDEELSKLLGCVTIANGGVLPNIHQTLLPKKAGGKDKEIGSASQEF

SEQ ID NO: 20098 - protein, 142 aa, Juglans hindsii x Juglans regia
MSSTGGGGSTKGGRGKPKASKSVSRSQKAGLQFPVGRIARFLKAGKYAERVGAGAPVYLSAVLEYLAAEVLELAGNAARDNKKNRIVPRHIQLAVRNDEELSKLLGSVTIANGGVLPNIHQTLLPKKVGKGKGEIGSASQEF

SEQ ID NO: 20099 - protein, 140 aa, Euphorbia peplus
  Sequence also found in Organisms: Euphorbia esula
MSSTGGSTKGGRGKPKSAKSVSRSTKAGLQFPVGRIARFLKAGKYAERVGAGAPVYLSAVLEYLAAEVLELAGNAARDNKKNRIVPRHIQLAVRNDEELSKLLGSVTIANGGVLPNIHQTLLPKKAGASKGDIGSASQEF

SEQ ID NO: 20100 - protein, 139 aa, Linum usitatissimum
MSSAAGSTKGGRGKAKAAKSVSRSSKAGLQFPVGRIARFLKAGKYAERVGAGAPVYLSAVLEYLAAEVLELAGNAARDNKKNRIVPRHIQLAVRNDEELSKLLGSVTIANGGVLPNIHNTLLPKKAGGKGDIGSASQEF

SEQ ID NO: 20101 - protein, 139 aa, Fraxinus spp
MSPNASTKGGRGKPKSSKSVSRSSKAGLQFPVGRIARFLKAGKYAERVGAGAPVYLAAVLEYLAAEVLELAGNAARDNKKNRIVPRHIQLAVRNDEELSKLLGSVTIANGGVLPNIHQNLLPKKAGGKDKEIGSASQEF

SEQ ID NO: 20102 - protein, 140 aa, Panax ginseng
MSSKEGSTKGGRGKPKSSKSVTRSSKAGLQFPVGRIARFLKNGKYAERVGAGAPVYLSAVLEYLAAEVLELAGNAARDNKKNRIVPRHIQLAVRNDEELSKLLGAVTIANGGVLPNIHQNLLPKKVGKGKGDIGSASQEF

SEQ ID NO: 20103 - protein, 140 aa, Panax ginseng
MSSKEGSTKGGRGKPKSSKSVTRSSKAGLQFPVGRIARFLKNGKYAERVGAGAPVYLSAVLEYLAAEVLELAGNAARDNKKNRIVPRHIQLAVRNDEELSKLLGAVTIANGGVLPNIHQNLLPKKVGKGKEDIGSASQEF

SEQ ID NO: 20104 - protein, 140 aa, Lupinus angustifolius
MSSKEGSTKGGRGKPKSSKSVSRSQKAGLQFPVGRIARFLKAGKYAERVGAGAPVYLSAVLEYLAAEVLELAGNAARDNKKNRIVPRHIQLAVRNDEELSKLLGSVTIANGGVLPNIHQTLLPKKVGKGKGEIGSASQEF

SEQ ID NO: 20105 - protein, 140 aa, Lupinus angustifolius
MSSKEGSTKGGRGKPKASKSVSRSQKAGLQFPVGRIARFLKAGKYAERVGAGAPVYLSAVLEYLAAEVLELAGNAARDNKKNRIVPRHIQLAVRNDEELSKLLGSVTIANGGVLPNIHQTLLPKKTGKGKGEIGSASQEF

SEQ ID NO: 20106 - protein, 138 aa, Orobanche aegyptiaca
MSSTTKGGRGKAKSTKSVSRSSKAGLQFPVGRIARFLKAGKYAERVGAGAPVYLSAVLEYLAAEVLELAGNAARDNKKNRIVPRHIQLAVRNDEELSKLLGTVTIANGGVLPNIHQTLLPSKKGGGKDKEIGSASQEF

SEQ ID NO: 20107 - protein, 140 aa, Arachis hypogaea
MSSTAGSTKGGRGKPKASKSVSRSQKAGLQFPVGRIARFLKAGKYAERVGAGAPVYLSAVLEYLAAEVLELAGNAARDNKKNRIVPRHIQLAVRNDEELSKLLGSVTIANGGVLPNIHQTLLPKKAGKGKDEIGSASQEF

SEQ ID NO: 20108 - protein, 140 aa, Trigonella foenum-graecum
MSTKATTTKGGRGKPKASKSVSRSSKAGLQFPVGRIARFLKAGKYAERVGAGAPVYLSAVLEYLAAEVLELAGNAARDNKKNRIVPRHIQLAVRNDEELSKLLGAVTIANGGVLPNIHQTLLPKKVGKGKGEIGSASQEF

SEQ ID NO: 20109 - protein, 139 aa, Acacia harpophylla
MSSAGSTKGGRGKPKSSKSVSRSQKAGLQFPVGRIARFLKAGKYAERVGAGAPVYLSAVLEYLAAEVLELAGNAARDNKRNRIVPRHIQLAVRNDEELSKLLGCVTIANGGVLPNIHQNLLPKPMGKGKGDIGSASQEF

SEQ ID NO: 20110 - protein, 138 aa, Amorphophallus konjac
MSSSGTTKGGRGKAKASKSVSRSHKAGLQFPVGRIARFLKAGKYAERVGAGAPVYLAAVLEYLAAEVLELAGNAARDNKKNRIVPRHIQLAVRNDEELSKLLGTVTIANGGVLPNIHQTLLPKKQGGKGDIGSASQEF

SEQ ID NO: 20111 - protein, 139 aa, Persea americana
MSSSASTKGGRGKPKSSKSVSRSHKAGLQFPVGRIARFLKAGKYAERVGAGAPVYLSAVLEYLAAEVLELAGNAARDNKKNRIVPRHIQLAVRNDEELSKLLGAVTIANGGVLPNIHQTLLPKKTGKGKGEIGSVSQEF

SEQ ID NO: 20112 - protein, 139 aa, Musa acuminata
MSSTTSAKGGRGKAKSSKSVSRSHKAGLQFPVGRIARFLKAGKYAERVGAGAPVYLAAVLEYLAAEVLELAGNAARDNKKNRIVPRHIQLAVRNDEELSKLLGAVTIASGGVLPNIHQTLLPSKAGKGKGDIGSASQEF

SEQ ID NO: 20113 - protein, 139 aa, Theobroma cacao
MSSTGSTKGGRGKPKSSKSVSRSQKAGLQFPVGRIARFLKAGKYADRVGAGAPVYLSAVLEYLAAEVLELAGNAARDNKKNRIVPRHIQLAVRNDEELSKLLGTVTIANGGVLPNIHQNLLPKKIGKGKGDIGSASQEF

SEQ ID NO: 20114 - protein, 139 aa, Trifolium pratense
MSSTGTTKGGRGKPKAAKSVSRSSKAGLQFPVGRIARFLKAGKYAERVGAGAPVYLSAVLEYLAAEVLELAGNAARDNKKNRIVPRHIQLAVRNDEELSKLLGSVTIANGGVLPNINQVLLPKKTGKGKDDIGSASQEF

SEQ ID NO: 20115 - protein, 139 aa, Cocos nucifera
MSSTASTKGGRGKPKSSKSVSRSQKAGLQFPVGRIARFLKAGKYAERVGAGAPVYLSAVLEYLAAEVLELAGNAARDNKKTRIVPRHIQLAVRNDEELSKLLGTVTIANGGVLPNIHQTLLPKKAGKDKGELGSASQEF

SEQ ID NO: 20116 - protein, 138 aa, Cryptomeria japonica
MSSTGGGGRGKSKATKAVSRSQKAGLQFPVGRIARYLKAGKYAERVGAGAPVYMAAVLEYLAAEVLELAGNAARDNKKNRIVPRHIQLAVRNDEELSKLLGSVTIANGGVLPNIHGVLLPKKPGKDKGAEIGSASQEF

SEQ ID NO: 20117 - protein, 139 aa, Eschscholzia californica
MSSGGSTKGGRGKPKSSKSVSRSQKAGLQFPVGRIARFLKAGKYAERVGAGAPVYLSAVLEYLAAEVLELAGNAARDNKKNRIVPRHIQLAVRNDEELSKLLGTVTIANGGVLPNIHQTLLPKKMGKGKGELGSASQEF

SEQ ID NO: 20118 - protein, 139 aa, Humulus lupulus
MSTAASTKGGRGKPKSSKSVSRSSKAGLQFPVGRIARFLKNGKYAERVGAGAPVYLSAVLEYLAAEVLELAGNAARDNKKNRIVPRHIQLAVRNDEELSKLLGTVTIANGGVLPNIHQTLLPKKVGKGKGDFGSASQEF

SEQ ID NO: 20119 - protein, 139 aa, Elaeis guineensis
MSSSASTKGGRGKPKSSKSVSRSQKAGLQFPVGRIARFLKAGKYAERVGAGAPVYLSAVLEYLAAEVLELAGNAARDNKKNRIVPRHIQLAVRNDEELSKLLGTVTIANGGVLPNIHQTLLPKKQGKGKGEIGSASQEF

SEQ ID NO: 20120 - protein, 138 aa, Platanus occidentalis
MSSSASTKGGRGKPKASKSVSRSHKAGLQFPVGRIARFLKAGKYAERVGAGAPVYLSAVLEYLAAEVLELAGNAARDNKKNRIVPRHIQLAVRNDEELSKLLGTVTIANGGVLPNIHQTLLPKKLGKGKGDGSASQEF

SEQ ID NO: 20121 - protein, 138 aa, Platanus occidentalis
MSSSASTKGGRGKPKASKSVSRSHKAGLQFPVGRIARFLKAGKYAERVGAGAPVYLSAVLEYLAAEVLELAGNAARDNKKNRIVPRHIQLAVRNDEELSKLLGTVTIANGGVLPNIHQTLLPKKVGKGKGDGSASQEF

SEQ ID NO: 20122 - protein, 139 aa, Primula obconica
MSSEGTTKGGRGKPKSAKSVSRSSKAGLQFPVGRIARFLKAGKYAERVGAGAPVYLSAVLEYLAAEVLELAGNAARDNKKNRIVPRHIQLAVRNDEELSKLLGSVTIANGGVLPNIHSTLLPSKVGKGKADINSASQEF

SEQ ID NO: 20123 - protein, 139 aa, Zostera marina
MSSPGITKGGRGKTKSTKSVSRSSKAGLQFPVGRIARFLKAGKYAERVGAGAPVYLSAVLEYLAAEVLELAGNAARDNKKNRIVPRHIQLAVRNDEELSKLLGTVTIANGGVLPNIHQNLLPKKAGKGKGEIGSASQEF

SEQ ID NO: 20124 - protein, 138 aa, Cryptomeria japonica
MSSSGAKGGRGKAKSTKSVSRSQKAGLQFPVGRIARFLKAGKYAERVGAGAPVYLAAVLEYLAAEVLELAGNAARDNKKNRIVPRHIQLAVRNDEELSKLLGTVTIANGGVLPNIHQVLLPKKAGKDKGDVGSASQEF

SEQ ID NO: 20125 - protein, 136 aa, Cucurbita pepo
MSSTKGGRGKPQATKSVTRSHKAGLQFPVGRIARFLKAGKYAERVGAGAPVYLSAVLEYLAAEVLELAGNAARDNKKNRIVPRHIQLAVRNDEELSKLLGSVTIANGGVLPNIHQTLLPKKVGKDKGDIGSASQEF

SEQ ID NO: 20126 - protein, 138 aa, Pseudotsuga menziesii
MSSSAAKGGRGKAKSTKSVSRSQKAGLQFPVGRIARFLKAGKYAERVGAGAPVYLAAVLEYLAAEVLELAGNAARDNKKNRIVPRHIQLAVRNDEELSKLLGAVTIANGGVLPNIHQVLLPKKSGKDKGEIGSASQEF

SEQ ID NO: 20127 - protein, 143 aa, Amaranthus tuberculatus
MSGKDGSGSTKGGRGKPKSSKSVSRSSKAGLQFPVGRIARFLKAGKYAERVGAGAPVYLSAVLEYLAAEVLELAGNAARDNKKNRIVPRHIQLAVRNDEELSKLLGQVTIANGGVLPNIHQTLLPKKQGGGGKGDIGSASQEF

SEQ ID NO: 20128 - protein, 142 aa, Arabidopsis thaliana
  Sequence also found in Organisms: Eutrema halophilum
MSSGAGSGTTKGGRGKPKATKSVSRSSKAGLQFPVGRIARFLKAGKYAERVGAGAPVYLSAVLEYLAAEVLELAGNAARDNKKTRIVPRHIQLAVRNDEELSKLLGSVTIANGGVLPNIHQTLLPSKVGKNKGDIGSASQEF

SEQ ID NO: 20129 - protein, 141 aa, Mimulus guttatus
MSSPAAASTKGGRGKPKSSKSVSRSSKAGLQFPVGRIARFLKAGKYAERVGAGAPVYLSAVLEYLAAEVLELAGNAARDNKKNRIVPRHIQLAVRNDEELSKLLGHVTIANGGVLPNIHQNLLPKKAGGRDKEIGSASQEF

SEQ ID NO: 20130 - protein, 141 aa, Mimulus guttatus
MSSTAAATKKGGRGKPKSSKSVSRSSKAGLQFPVGRIARFLKAGKYAERVGAGAPVYLAAVLEYLAAEVLELAGNAARDNKKNRIVPRHIQLAVRNDEELSKLLGAVTIANGGVLPNIHQTLLPKKTGGRDKEIGSASQEF

SEQ ID NO: 20131 - protein, 142 aa, Nicotiana benthamiana
MSSGGGAGKGGAGRGKPKASKSVSRSSKAGLQFPVGRIARFLKAGKYAERVGAGAPVYLSAVLEYLAAEVLELAGNAARDNKKNRIVPRHIQLAVRNDEELSKLLGQVTIANGGVLPNIHQNLLPKKAGSGKGDIGSASQEF

SEQ ID NO: 20132 - protein, 142 aa, Nicotiana benthamiana
MSSGGGAGKGGAGRGKPKASKSVSRSSKAGLQFPVGRIARFLKAGKYAERVGAGAPVYLSAVLEYLAAEVLELAGNAARDNKKNRIVPRHIQLAVRNDEELSKLLGHVTIANGGVLPNIHQNLLPKKAGSGKGDIGSASQEF

SEQ ID NO: 20133 - protein, 141 aa, Orobanche aegyptiaca
MSSKAAATTKGGRGKPKTSKSVSRSSKAGLQFPVGRIARFLKAGKYAERVGAGAPVYLAAVLEYLAAEVLELAGNAARDNKKNRIVPRHIQLAVRNDEELSKLLGTVTIANGGVLPNIHQTLLPKKTGGKDKEIGSASQEF

SEQ ID NO: 20134 - protein, 142 aa, Populus trichocarpa
MSSKEGGASTKGGRGKPKASKSVSRSQKAGLQFPVGRIARFLKAGKYAERVGAGAPVYLAAVLEYLAAEVLELAGNAARDNKKNRIVPRHIQLAVRNDEELSKLLGSVTIANGGVLPNIHQTLLPKKMGKGKGDIGSASQEF

SEQ ID NO: 20135 - protein, 141 aa, Sesamum indicum
MSSAAAAATKGGRGKPKSSKSVSRSSKAGLQFPVGRIARFLKAGKYAERVGAGAPVYLSAVLEYLAAEVLELAGNAARDNKKNRIVPRHIQLAVRNDEELSKLLGNVTIANGGVLPNIHQNLLPKKAGGRDKEIGSASQEF

SEQ ID NO: 20136 - protein, 142 aa, Helianthus annuus
MSSKGDTDSKKGGRGKSKATKSVSRSSKAGLQFPVGRIARFLKAGKYAERVGAGAPVYLSAVLEYLAAEVLELAGNAARDNKKSRIVPRHIQLAVRNDEELSKLLGSVTIANGGVLPNIHQTLLPHKVGKDKGDIGSASQEF

SEQ ID NO: 20137 - protein, 142 aa, Eutrema parvulum
MSSGAGSGTTKGGRGKPKATKSVSRSSKAGLQFPVGRIARFLKAGKYAERVGAGAPVYLSAVLEYLAAEVLELAGNAARDNKKTRIVPRHIQLAVRNDEELSKLLGCVTIANGGVLPNIHQTLLPSKSGKNKGDIGSASQEF

SEQ ID NO: 20138 - protein, 141 aa, Triphysaria pusilla
MSSKDAASTKGGRGKPKATKSVSRSSKAGLQFPVGRIARFLKAGKYAERVGAGAPVYLSAVLEYLAAEVLELAGNAARDNKKTRIVPRHIQLAVRNDEELSKLLGCVTIANGGVLPNIHQTLLPKKVGGKDKEIGSASQEF

SEQ ID NO: 20139 - protein, 140 aa, Acacia harpophylla
MSSAGGTTKGGRGKPKATKSVSKSQKAGLQFPVGRIARFLKAGKYAERVGAGAPVYLSAVLEYLAAEVLELAGNAARDNKKNRIVPRHIQLAVRNDEELSKLLGSVTIANGGVLPNIHQTLLPKKAGQGKGEIGSASQEF

SEQ ID NO: 20140 - protein, 140 aa, Amborella trichopoda
MSSSAGGGKGGRGKPKASKSVSRSQKAGLQFPVGRIARFLKAGKYAERVGAGAPVYLAAVLEYLAAEVLELAGNAARDNKKNRIVPRHIQLAVRNDEELSKLLGTVTIANGGVLPNIHQMLLPKKAGKEKGGPGSASQEF

SEQ ID NO: 20141 - protein, 141 aa, Malus domestica
MSAKEGASTKGGRGKPKASKSVSRSHKAGLQFPVGRIARFLKSGKYAERVGAGAPVYLSAVLEYLAAEVLELAGNAARDNKKNRIVPRHIQLAVRNDEELSKLLGAVTIANGGVLPNIHQTLLPKKVGKGKGDIGSASQEF

SEQ ID NO: 20142 - protein, 141 aa, Cannabis sativa
MSSAAAGSTKGGRGKPKASKSVSRSQKAGLQFPVGRIARFLKVGKYAERVGAGAPVYLSAVLEYLAAEVLELAGNAARDNKKNRIVPRHIQLAVRNDEELSKLLGSVTIANGGVLPNIHQTLLPKKVGKGKGEIGSASQEF

SEQ ID NO: 20143 - protein, 140 aa, Ricinus communis
MSSTGGSTKGGRGKPKASKSVSRSQKAGLQFPVGRIARFLKAGKYAERVGAGAPVYLSAVLEYLAAEVLELAGNAARDNKKNRIVPRHIQLAVRNDEELSKLLGSVTIANGGVLPNIHQTLLPKKIGKGKGDMNSLSQEF

SEQ ID NO: 20144 - protein, 140 aa, Cyclamen graecum
  Sequence also found in Organisms: Ananas comosus
MSSTTKGGGGGRGKPKSAKSVSRSSKAGLQFPVGRIARFLKAGKYAERVGAGAPVYLSAVLEYLAAEVLELAGNAARDNKKNRIVPRHIQLAVRNDEELSKLLGAVTIANGGVLPNIHQNLLPPKTGKGKGNMGSESQEF

SEQ ID NO: 20145 - protein, 141 aa, Fagopyrum esculentum
MSNKEAGSAKGGRGKPKSSKSVSRSSKAGLQFPVGRIARFLKAGKYAERVGAGAPVYLSAVLEYLAAEVLELAGNAARDNKKNRIVPRHVQLAVRNDEELSKLLGCVTIANGGVLPNIHQTLLPKKTGHGKGDIGSASQEF

SEQ ID NO: 20146 - protein, 141 aa, Fagopyrum esculentum
MSNKEVGSNKGGRGKPKSSKSVSRSSKAGLQFPVGRIARFLKAGKYAERVGAGAPVYLSAVLEYLAAEVLELAGNAARDNKKNRIVPRHIQLAVRNDEELSKLLGCVTIANGGVLPNIHQTLLPKKSGHGKGDIGSASQEF

SEQ ID NO: 20147 - protein, 140 aa, Linum usitatissimum
MSSAAAGSTKGGRGKGKTTKSVSRSSKAGLQFPVGRIARFLKAGKYAERVGAGAPVYLSAVLEYLAAEVLELAGNAARDNKKNRIVPRHIQLAVRNDEELSKLLGSVTIANGGVLPNIHNTLLPKKAGTKGDIGSASQEF

SEQ ID NO: 20148 - protein, 140 aa, Linum usitatissimum
MSSAAAGSTKGGRGKGKTTKSVSRSSKAGLQFPVGRIARFLKAGKYAERVGAGAPVYLSAVLEYLAAEVLELAGNAARDNKKNRIVPRHIQLAVRNDEELSKLLGSVTIANGGVLPNIHNTLLPKKAGAKGDIGSASQEF

SEQ ID NO: 20149 - protein, 139 aa, Linum usitatissimum
MSSAAGSTKGGRGKAKAAKSVSRSSKAGLQFPVGRIARFLKAGKYAERVGAGAPVYLSAVLEYLAAEVLELAGNAARDNKKNRIVPRHIQLAVRNDEELSKLLGSVTIANGGVLPNIHNTLLPKKAGGKGDIGFASQEF

SEQ ID NO: 20150 - protein, 140 aa, Actinidia deliciosa
MSSGGASTKGGRGKPKASKSVSRSQKAGLQFPVGRIARFLKAGKYAERVGAGAPVYLSAVLEYLAAEVLELAGNAARDNKKNRIVPRHIQLAVRNDEELSKLLGSVTIANGGVLPNIHQTLLPNKPGKGKGEIGSASQEF

SEQ ID NO: 20151 - protein, 141 aa, Lotus japonicus
MSSTGGNNTKGGRGKPKAAKSVSRSQKAGLQFPVGRIARFLKAGKYAERVGAGAPVYLSAVLEYLAAEVLELAGNAARDNKKNRIVPRHIQLAVRNDEELSKLLGSVTIANGGVLPNIHQTLLPKKAGKGKGEIGSASQEF

SEQ ID NO: 20152 - protein, 141 aa, Carica papaya
MSSTGGGSTKGGRGKPKASKAVSRSQKAGLQFPVGRIARFLKAGKYAERVGAGAPVYLSAVLEYLAAEVLELAGNAARDNKKNRIVPRHIQLAVRNDEELSKLLGSVTIANGGVLPNIHQTLLPKKMGKGKGEIGSVSQEF

SEQ ID NO: 20153 - protein, 140 aa, Rhizophora mangle
MSSKEETTKGGRGKPKASKAVSRSQKAGLQFPVGRIARFLKAGKYAERVGAGAPVYLSAVLEYLAAEVLELAGNAARDNKKNRIVPRHIQLAVRNDEELSKLLGSVTIANGGVLPNIHQTLLPKKSGKGKGDIGSASQEF

SEQ ID NO: 20154 - protein, 141 aa, Rosa hybrid cultivar
MSGKEGGSTKGGRGKPKATKSVSRSSKAGLQFPVGRIARFLKSGKYAERVGAGAPVYLSAVLEYLAAEVLELAGNAARDNKKNRIVPRHIQLAVRNDEELSKLLGSVTIANGGVLPNIHQTLLPKKVGKGKGDIGSASQEF

SEQ ID NO: 20155 - protein, 140 aa, Valeriana officinalis
MSSADQSTKGGRGKPKASKSVSRSSKAGLQFPVGRIARFLKAGKYAERVGAGAPVYLSAVLEYLAAEVLELAGNAARDNKKNRIVPRHIQLAVRNDEELSKLLGSVTIANGGVLPNIQSSLLPKKVGKGKGDIGSASQEF

SEQ ID NO: 20156 - protein, 138 aa, Cycas rumphii
MSSAGGGGRGKAKSSKSVSRSQKAGLQFPVGRIARFLKAGKYAERVGAGAPVYLAAVLEYLAAEVLELAGNAARDNKKNRIVPRHIQLAVRNDEELSKLLGSVTIANGGVLPNIHGVLLPKKSGKGKGPEVGSASQEF

SEQ ID NO: 20157 - protein, 139 aa, Amorphophallus konjac
MSSAASTKGGRGKPKASKSISRSQKAGLQFPVGRIARFLKAGKYAERVGAGAPVYLAAVLEYLAAEVLELAGNAARDNKKNRIVPRHIQLAVRNDEELSKLLGSVTIANGGVLPNIHQTLLPKKQGSAKGDIGSASQEF

SEQ ID NO: 20158 - protein, 139 aa, Cannabis sativa
MSTAATTKGGRGKPKSSKSVSRSSKAGLQFPVGRIARFLKNGKYAERVGAGAPVYLSAVLEYLAAEVLELAGNAARDNKKNRIVPRHIQLAVRNDEELSKLLGTVTIANGGVLPNIHQTLLPKKVGKGKGEFGSASQEF

SEQ ID NO: 20159 - protein, 139 aa, Cocos nucifera
MSSSASTKGGRGKPKASKSVSRSQKAGLQFPVGRIARFLKAGKYAERVGAGAPVYLSAVLEYLAAEVLELAGNAARDNKKNRIVPRHIQLAVRNDEELSKLLGTVTIANGGVLPNIHQTLLPKKQGKGKGEVGSASQEF

SEQ ID NO: 20160 - protein, 139 aa, Gossypium hirsutum
  Sequence also found in Organisms: Gossypium raimondii
MSSTVSTKGGRGKPKSSKSVSRSQKAGLQFPVGRIARFLKAGKYADRVGAGAPVYLSAVLEYLAAEVLELAGNAARDNKKNRIVPRHIQLAVRNDEELSKLLGTVTIANGGVLPNIHQNLLPKKIGKGKGDIGSASQEF

SEQ ID NO: 20161 - protein, 139 aa, Cucumis sativus
MSSSASTKGGRGKPKATKSVSRSQKAGLQFPVGRIARFLKAGKYAERVGAGAPVYLSAVLEYLAAEVLELAGNAARDNKKNRIVPRHIQLAVRNDEELSKLLGDVTIANGGVLPNIHQTLLPKKAGSGKGDIGSASQEF

SEQ ID NO: 20162 - protein, 139 aa, Elaeis guineensis
MSSTASTKGGRGKPKSSKSVSRSQKAGLQFPVGRIARFLKAGKYAERVGAGAPVYLSAVLEYLAAEVLELAGNAARDNKKSRIVPRHIQLAVRNDEELSKLLGTVTIANGGVLPNIHQTLLPKKVGKEKGELGSASQEF

SEQ ID NO: 20163 - protein, 138 aa, Olea europaea
SSNASTKGGRGKPKSSKSVSRSSKAGLQFPVGRIARFLKAGKYAERVGAGAPVYLAAVLEYLAAEVLELAGNAARDNKKNRIVPRHIQLAVRNDEELSKLLGSVTIANGGVLPNIHQNLLPKKAGGRDKEIGSASQEF

SEQ ID NO: 20164 - protein, 138 aa, Carica papaya
MSSGGSTKGGRGKPKSVKSVSRSQKAGLQFPVGRIARFLKAGKYADRVGAGAPVYLSAVLEYLAAEVLELAGNAARDNKKNRIVPRHIQLAVRNDEELSKLLGTVTIANGGVLPNIHQNLLPKKTGKGKDIGSASQEF

SEQ ID NO: 20165 - protein, 139 aa, Phalaenopsis aphrodite
MSSTASTKGGRGKSKPAKSVSRSNKAGLQFPVGRIARFLKAGKYSERVGAGAPVYLAAVLEYLAAEVLELAGNAARDNKKNRIMPRHIQLAVRNDEELSKLLGAVTIANGGVLPNIHQNLLPKKQGKGKGDIGSASQEF

SEQ ID NO: 20166 - protein, 139 aa, Ananas comosus
MSSSGSTKGGRGKAKATKSVSRSQKAGLQFPVGRIARFLKAGKYADRVGAGAPVYLSAVLEYLAAEVLELAGNAARDNKKNRIVPRHIQLAVRNDEELSKLLGMVTIANGGVLPNIHQTLLPKKAGKDKGELGSASQEF

SEQ ID NO: 20167 - protein, 139 aa, Platanus occidentalis
MSSTASTKGGRGKPKASKSVSRSHKAGLQFPVGRIARFLKAGKYAQRVGAGAPVYLSAVLEYLAAEVLELAGNAARDNKKNRIVPRHIQLAVRNDEELSKLLGTVTIANGGVLPNIHQTLLPKKMGKGKGETGSASQEF

SEQ ID NO: 20168 - protein, 137 aa, Vaccinium corymbosum
MSSTTKGGRGKPKAAKSVSRSHKAGLQFPVGRIARFLKAGKYADRVGAGAPVYLSAVLEYLAAEVLELAGNAARDNKKNRIVPRHIQLAVRNDEELSKLLGSVTIANGGVLPNIHQTLLPKKAGKGKGEIGSASQEF

SEQ ID NO: 20169 - protein, 136 aa, Brachypodium distachyon
MSSTGSGGRGKAKSTKVVSRSAKAGLQFPVGRIARYLKAGKYAERVGAGAPVYLSAVLEYLAAEVLELAGNAARDNKKNRIVPRHIQLAVRNDEELSKLLGTVTIANGGVLPKIHQVLLPKKAGAKGDIGSASQEF

SEQ ID NO: 20170 - protein, 138 aa, Cephalotaxus harringtonia
  Sequence also found in Organisms: Taxus baccata
MSSSGAKGGRGKAKSTKSVSRSQKAGLQFPVGRIARFLKAGKYAERVGAGAPVYLAAVLEYLAAEVLELAGNAARDNKKNRIVPRHIQLAVRNDEELSKLLGTVTIANGGVLPNIHQVLLPKKAGKDKGEVGSASQEF

SEQ ID NO: 20171 - protein, 138 aa, Allium cepa
MSSKSSKGGRGKPKSTKSVSRSSKAGLQFPVGRIARFLKTGKYAERVGAGAPVYLSAVLEYLAAEVLELAGNAARDNKKSRIVPRHIQLAVRNDEELSKLLGTVTIANGGVLPNIHSTLLPKKDGKGKGDIGSASQEF

SEQ ID NO: 20172 - protein, 137 aa, Papaver somniferum
MTSPAKGGRGKPKSSKSVSRSQKAGLQFPVGRIARFLKAGKYAERVGAGAPVYLSAVLEYLAAEVLELAGNAARDNKKNRIVPRHIQLAVRNDEELSRLLGTVTIANGGVLPNIQQTLLPKKAGKGKEGLGSASQEF

SEQ ID NO: 20173 - protein, 138 aa, Sequoia sempervirens
MSSSGAKGGRGKAKSTKSVSRSQKAGLQFPVGRIARFLKAGKYAQRVGAGAPVYLAAVLEYLAAEVLELAGNAARDNKKNRIVPRHIQLAVRNDEELSKLLGTVTIANGGVLPNIHQVLLPKKAGKDKGDVGSASQEF

SEQ ID NO: 20174 - protein, 138 aa, Fragaria vesca
MTSPTSKGGRGKAKATKSVSRSSKAGLQFPVGRIARFLKSGKYAERVGAGAPVYLSAVLEYLAAEVLELAGNAARDNKKNRIVPRHIQLAVRNDEELSKLLGTVTIANGGVLPNIHQNLLPKKTGKGKGDIGSASQEF

SEQ ID NO: 20175 - protein, 130 aa, Vicia sativa
GRGKPKASKSVSRSSKAGLQFPVGRIARFLKAGKYAERVGAGAPVYLSAVLEYLAAEVLELAGNAARDNKKNRIVPRHIQLAVRNDEELSKLLGAVTIANGGVLPNIHQTLLPKKVGKGKGEIGSASQEF

SEQ ID NO: 20176 - protein, 143 aa, Castanea mollissima
SSTGGAGGGSTKGGRGKPKASKSVSRSQKAGLQFPVGRIARFLKAGKYAERVGAGAPVYLSAVLEYLAAEVLELAGNAARDNKKNRIVPRHIQLAVRNDEELSKLLGSVTIANGGVLPNIHQTLLPKKVGKGKGDIGSASQEF

SEQ ID NO: 20177 - protein, 143 aa, Ipomoea nil
MSSSGAGAGKGGAGRGKPKASKSVSRSSKAGLQFPVGRIARFLKAGKYAERVGAGAPVYLSAVLEYLAAEVLELAGNAARDNKKNRIVPRHIQLAVRNDEELSKLLGNVTIANGGVLPNIHQNLLPKKAGSAKGDIGSASQEF

SEQ ID NO: 20178 - protein, 142 aa, Scabiosa columbaria
MSSPTKGGRGKPKSSKSVSRSSKAGLQFPVGRIARFLKAGKYAERVGAGAPVYLSAVLEYLAAEVLELAGNAARDNKKNRIVPRHIQLAVRNDEELSKLLGAVTIANGGVLPNIHQTLLPKKVGKGKGEIGSASQEFRSSVV

SEQ ID NO: 20179 - protein, 141 aa, Rosmarinus officinalis
MSSNPAATTKGGRGKPKASKSVSRSSKAGPQFPVGRIARFPKAGKYAERVGAGAPVYLSAVLEYLAAEVLELAGNAARDNKKNRIVPRHIQLAVRNDEELSKLLGHVTIANGGVLPNIHQTLLPKKAGGRDKEIGSASQEF

SEQ ID NO: 20180 - protein, 142 aa, Ambrosia trifida
MSSKGDTDSKKGGRGKSKATKSVSRSSKAGLQFPVGRIARFLKAGKYAERVGAGAPVYLSAVLEYLAAEVLELAGNAARDNKKSRIVPRHIQLAVRNDEELSKLLGSVTIANGGVLPNIHQTLLPHKVGKEKGDIGSASQEF

SEQ ID NO: 20181 - protein, 142 aa, Arabidopsis lyrata
MSSGAGSGTTKGGRGKPKATKSVSRSSKAGLQFPVGRIARFLKAGKYAERVGAGAPVYLSAVLEYLAAELLELAGNAARDNKKTRIVPRHIQLAVRNDEELSKLLGSVTIANGGVLPNIHQTLLPSKVGKNKGDIGSASQEF

SEQ ID NO: 20182 - protein, 142 aa, Cleome gynandra
MSSGGGSSSTKGGRGKPKAAKSVSRSHKAGLQFPVGRIARFLKAGKYAERVGAGAPVYLSAVLEYLAAEVLELAGNAARDNKKNRIVPRHIQLAVRNDEELSKLLGSVTIASGGVLPNIHQTLLPSKSGKGKGDIGSASQEF

SEQ ID NO: 20183 - protein, 142 aa, Flaveria ramosissima
MSSKADADSKKGGRGKSKATKSVSRSSKAGLQFPVGRIARFLKAGKYAERVGAGAPVYLSAVLEYLAAEVLELAGNAARDNKKTRIVPRHIQLAVRNDEELSKLLGSVTIANGGVLPNIHQTLLPKKVGSDKRDIGSASQEF

SEQ ID NO: 20184 - protein, 142 aa, Petunia hybrida
MSSGAGAGKGGAGRGKPKASKSVSRSSKAGLQFPVGRIARFLKAGKYAERVGAGAPVDLSAVLEYLAAEVLELAGNAARDDKKNRIVPRHIQLGVRNDEELSKLLGHVTIANGGVLPNIHQTLLPKKAGGGKGDIGSASQEF

SEQ ID NO: 20185 - protein, 142 aa, Nicotiana tabacum
MSTGGGAGKGGAGRGKPKASKSVSRSSKAGLQFPVGRIARFLKAGKYAERVGAGAPVYLSAVLEYLAAEVLELAGNAARDNKKNRIVPRHIQLAVRNDEELSKLLGHVTIANGGVLPNIHQNLLPKKAGSGKGDIGSASQEF

SEQ ID NO: 20186 - protein, 141 aa, Triphysaria pusilla
MSSKAAASTKGGRGKPKSSKSVSRSSKAGLQFPVGRIARFLKTGKYAERVGAGAPVYLSAVLEYLAAEVLELAGNAARDNKKNRIVPRHIQLAVRNDEELSKLLGCVTIANGGVLPNIHQTLLPKKTGGKDKDIGSASQEF

SEQ ID NO: 20187 - protein, 141 aa, Ceratodon purpureus
MSSPAATGGGGRGKSKASKSISRSQKAGLQFPVGRIARFLKAGKYAERVGAGAPVYLAAVLEYLAAEVLELAGNAARDNKKNRIVPRHIQLAVRNDEELSKLLGTVTIAAGGVLPNIHTVLLPKKTGKGGKDIGGSISQEF

SEQ ID NO: 20188 - protein, 141 aa, Tropaeolum majus
MSSTGAGSTKGGRGKPKTSKSVTRSTKAGLQFPVGRIARFLKAGKYAERVGAGAPVYLSAVLEYLAAEVLELAGNAARDNKKNRIIPRHIQLAIRNDEELSKLLGAVTIANGGVLPNINQTLLPKKIGKGKGDIGSASQEF

SEQ ID NO: 20189 - protein, 141 aa, Fragaria vesca
MSGKESGSTKGGRGKPKATKSVSRSSKAGLQFPVGRIARFLKSGKYAERVGAGAPVYLSAVLEYLAAEVLELAGNAARDNKKNRIVPRHIQLAVRNDEELSKLLGSVTIANGGVLPNIHQTLLPKKVGKGKGDIGSASQEF

SEQ ID NO: 20190 - protein, 140 aa, Abies balsamea
MSSTGGGGGGRGKAKSTKSVSRSQKAGLQFPVGRIARFLKAGKYAERVGAGAPVYLAAVLEYLAAEVLELAGNAARDNKKNRIVPRHIQLAVRNDEELSKLLGSVTIANGGVLPNIHGVLLPKKAGKGKGAEVGSASQEF

SEQ ID NO: 20191 - protein, 139 aa, Ricinus communis
MSSGGATKGGRGKPKSSKSVSRSQKAGLQFPVGRIARFLKAGKYADRVGAGAPVYLSAVLEYLAAEVLELAGNAARDNKKNRIVPRHIQLAVRNDEELSKLLGTVTIANGGVLPNIHQNLLPKKAKGKGDVIGSASQEF

SEQ ID NO: 20192 - protein, 139 aa, Cichorium intybus
MSSKSDAKGGRGKAKATKSVSRSSKAGLQFPVGRIARFLKAGKYAERVGAGAPVYLSAVLEYLAAEVLELAGNAARDNKKSRIVPRHIQLAVRNDEELSKLLGSVTIANGGVLPNIHSTLLPSKVGKDKGEIGSASQEF

SEQ ID NO: 20193 - protein, 140 aa, Gossypium hirsutum
MSPTEGSTKGGRGKPKSTKAVSRSHKAGLQFPVGRIARFLKAGKYAERVGAGAPVYLSAVLEYLAAEVLELAGNAARDNKKNRIVPRHIQLAVRNDEELSKLLGSVTIANGGVLPNIHQTLLPSKGGKSKGDIGSASQEF

SEQ ID NO: 20194 - protein, 140 aa, Gossypium hirsutum
  Sequence also found in Organisms: Gossypium raimondii
MSPTEGSTKGGRGKPKSTKAVSRSHKAGLQFPVGRIARFLKAGKYAERVGAGAPVYLSAVLEYLAAEVLELAGNAARDNKKNRIVPRHIQLAVRNDEELSKLLGSVTIANGGVLPNIHQTLLPSKGGKNKGDIGSASQEF

SEQ ID NO: 20195 - protein, 140 aa, Panax ginseng
MSSKEGSTKGGRGKPKSSKSVTRSSKAGLQFPVGRLARFLKNGKYAERVGAGAPVYLSVVLEYLAAEVLELAGNAARDNKKNRIVPRHIQLAVRNDEELSKLLGAVTIANGGVLPNIHQNLLPKKVGKGKEDIGSASQEF

SEQ ID NO: 20196 - protein, 139 aa, Actinidia deliciosa
MASAASSKGGRGKPKASKSVSRSHKAGLQFPVGRIARFLKAGKYAERVGAGAPVYLSAVLEYLAAEVLELARNAARDNKKNRIVPRHIQLAVRNDEELSKLLGAVTIANGGVLPNIHQNLLPKKVGKGKGEIGSASQEF

SEQ ID NO: 20197 - protein, 138 aa, Tropaeolum majus
MSSTGGSTKGGRGKPKTSKSITRSTKAGLQFPVGRIARFLKAGKYAERVGAGAPVYLSAVLEYLAAEVLELAGNAARDNKKNRISPRHIQLAVRNDEELSKLLGAVTIANGGVLPNIHQNLLPKKAGKGDIGSASQEF

SEQ ID NO: 20198 - protein, 135 aa, Allium cepa
MSSAGRGKAKSSSKSVSRSSKAGLQFPVGRIARFLKAGKYAERVGAGAPVYMAAVLEYLAAEVLELAGNAARDNKKNRIVPRHIQLAVRNDEELSKLLGTVTIANGGVLPNIHSTLLPTKPGKGKGDIGSASQEF

SEQ ID NO: 20199 - protein, 140 aa, Pseudotsuga menziesii
MSSSGGGGGGRGKAKSTKSVSRSQKAGLQFPVGRIARFLKAGKYAERVGAGAPVYLAAVLEYLAAEVLELAGNAARDNKKNRIVPRHIQLAVRNDEELSKLLGSVTIANGGVLPNIHGVLLPKKVGKGKGAEIGSASQEF

SEQ ID NO: 20200 - protein, 140 aa, Picea glauca
MSSSGGGGGGRGKAKSTKSVSRSHKAGLQFPVGRIARFLKSGKYAERVGAGAPVYLAAVLEYLAAEVLELAGNAARDNKKNRIVPRHIQLAVRNDEELSKLLGSVTIANGGVLPNIHGVLLPKKAGKGKGADIGSASQEF

SEQ ID NO: 20201 - protein, 139 aa, Citrullus lanatus
MSSSASTKGGRGKPKATKSVSRSQKAGLQFPVGRIARFLKAGKYAERVGAGAPVYLSAVLEYLAAEVLELAGNAARDNKKNRIVPRHIQLAVRNDEELSKLLGDVTIANGGVLPNIHQNLLPKKAGSGKGDIGSASQEF

SEQ ID NO: 20202 - protein, 138 aa, Cycas rumphii
MSSSGAKGGRGKAKATKSVSRSQKAGLQFPVGRIARFLKAGKYAERVGAGAPVYLAAVLEYLAAEVLELAGNAARDNKKNRIVPRHIQLAVRNDEELSKLLGTVTIANGGVLPNIHQVLLPKKAGKGKGEVGSASQEF

SEQ ID NO: 20203 - protein, 138 aa, Nuphar advena
MSSTGTKGGRGKPKSSKSVSRSQKAGLQFPVGRIARFLKAGKYAERVGAGAPVYLSAVLEYLAAEVLELAGNAARDNKKNRIVPRHIQLAVRNDEELGKLLGTVTIANGGVLPNIHQVLLPKKTGKVKSEPGSASQEV

SEQ ID NO: 20204 - protein, 137 aa, Primula obconica
SEGTTKGGRGKPKSAKSVSRSSKAGLQFPVGRIARFLKAGKYAERVGAGAPVYLSAVLEYLAAEVLELAGNAARDNKKNRIVPRHIQLAVRNDEELSKLLGSVTIANGGVLPNIHSTLLPSKVGKGKADINSASQEF

SEQ ID NO: 20205 - protein, 142 aa, Arabidopsis lyrata
MSTGAGSGTTKGGRGKPKATKSVSRSSKAGLQFPVGRIARFLKAGKYAERVGAGAPVYLSAVLEYLAAEVLELAGNAARDNKKTRIVPRHIQLAVRNDEELSKLLGSVTIANGGVLPNIHQNLLPSKVGKNKGDIGSASQEF

SEQ ID NO: 20206 - protein, 142 aa, Arabidopsis thaliana
MSTGAGSGTTKGGRGKPKATKSVSRSSKAGLQFPVGRIARFLKSGKYAERVGAGAPVYLSAVLEYLAAEVLELAGNAARDNKKTRIVPRHIQLAVRNDEELSKLLGSVTIANGGVLPNIHQTLLPSKVGKNKGDIGSASQEF

SEQ ID NO: 20207 - protein, 142 aa, Brassica napus
  Sequence also found in Organisms: Brassica juncea, Brassica oleracea, Brassica rapa, Raphanus sativus
MSTGAGSGTTKGGRGKPKATKSVSRSSKAGLQFPVGRIARFLKAGKYAERVGAGAPVYLSAVLEYLAAEVLELAGNAARDNKKTRIVPRHIQLAVRNDEELSKLLGAVTIANGGVLPNIHSNLLPSKVGKNKGDIGSASQEF

SEQ ID NO: 20208 - protein, 142 aa, Brassica juncea
  Sequence also found in Organisms: Brassica nigra
MSTGAGSGTTKGGRGKPKATKSVSRSSKAGLQFPVGRIARFLKAGKYAERVGAGAPVYLSAVLEYLAAEVLELAGNAARDNKKTRIVPRHIQLAVRNDEELSKLLGAVTIANGGVLPNIHSNLLPAKVGKNKGDIGSASQEF

SEQ ID NO: 20209 - protein, 142 aa, Solanum melongena
MSSGGGSGKGGAGRGKSKSSKSVSRSSKAGLQFPVGRIARFLKNGKYAERVGAGAPVYLSAVLEYLAAEVLELAGNAARDNKKNRIVPRHIQLAVRNDEELSKLLGQVTIANGGVLPNIHQNLLPRKAGSGKGDIASASQEF

SEQ ID NO: 20210 - protein, 142 aa, Solanum tuberosum
  Sequence also found in Organisms: Solanum phureja
MTSGAGAGKGGAGRGKPKATKSVSRSSKAGLQFPVGRIARFLKAGKYAERVGAGAPVYLSAVLEYLAAEVLELAGNAARDNKKNRIVPRHIQLAVRNDEELSKLLGHVTIANGGVLPNIHQNLLPKKAGSGKGDIGSASQEF

SEQ ID NO: 20211 - protein, 142 aa, Solanum tuberosum
  Sequence also found in Organisms: Solanum phureja
MSSGGGSGKGGAGRGKPKASKSVSRSSKAGLQFPVGRIARFLKNGKYAERVGAGAPVYLSAVLEYLAAEVLELAGNAARDNKKNRIVPRHIQLAVRNDEELSKLLGQVTIANGGVLPNIHQNLLPRKAGSGKGDIGSASQEF

SEQ ID NO: 20212 - protein, 142 aa, Eutrema parvulum
MSTGAGSGTTKGGRGKPKATKSVSRSSKAGLQFPVGRIARFLKAGKYAERVGAGAPVYLSAVLEYLAAEVLELAGNAARDNKKTRIVPRHIQLAVRNDEELSKLLGSVTIANGGVLPNIHQNLLPSKAGKNKGDIGSASQEF

SEQ ID NO: 20213 - protein, 142 aa, Solanum lycopersicum
MSSGGGSGKGGAGRGKQKASKSVSRSSKAGLQFPVGRIARFLKNGKYAERVGAGAPVYLSAVLEYLAAEVLELAGNAARDNKKNRIVPRHIQLAVRNDEELSKLLGQVTIANGGVLPNIHQNLLPRKAGSGKGDIGSASQEF

SEQ ID NO: 20214 - protein, 148 aa, Brachypodium distachyon
MSSTGGKVTGGKTGSAGGGRGKVKGSKAVSRSSKAGLQFPVGRIARYLKIGKYAQRVGAGAPVYLSAVLEYLAAEVLELAGNAARDNKKNRIVPRHIQLAVRNDEELSRLLGAVTIAAGGVLPNIHTTLLPKKAGKDKADVVSQSQEF

SEQ ID NO: 20215 - protein, 141 aa, Tropaeolum majus
MSSTGAGSTKGGRGKPKTSKSVTRSTKAGLQFPVGRIARFLKAGKYADRVGAGAPVYLSAVLEYLAAEVLELAGNAARDNKKNRIIPRHIQLAIRNDEELSKLLGAVTIANGGVLPNINQTLLPKKMGKGKGDIGSASQEF

SEQ ID NO: 20216 - protein, 140 aa, Petroselinum crispum
MSGKGATTTKGGRGVSKTKSVSRSSKAGLQFPVGRIARFLKAGKYAERVGAGAPVYLSAVLEYLAAEVLELAGNAARDNKKNRIVPRHIQLAVRNDEELSKLLGTVTIANGGVLPNIHTTLLPKKVGKGKDEIGSASQEF

SEQ ID NO: 20217 - protein, 140 aa, Cedrus atlantica
MSSSGGGGGGRGKAKSTKSVSRSQKAGLQFPVGRIARFLKAGKYAERVGAGAPVYMAAVLEYLAAEVLELAGNAARDNKKNRIVPRHIQLAVRNDEELSKLLGAVTIANGGVLPNIHGVLLPKKAGKGKGAEVGSASQEF

SEQ ID NO: 20218 - protein, 140 aa, Physcomitrella patens
MSSPAATAGGRGKSKASKSTSRSQKAGLQFPVGRIARFLKAGKYAERVGAGAPVYLAAVLEYLAAEVLELAGNAARDNKKNRIVPRHIQLAVRNDEELSKLLGTVTIAAGGVLPNIHTILLPKKTGKGGKDIGGSISQEF

SEQ ID NO: 20219 - protein, 140 aa, Physcomitrella patens
MSSPGATPGGRGKSKASKSISRSAKAGLQFPVGRIARFLKAGKYAERVGAGAPVYLAAVLEYLAAEVLELAGNAARDNKKNRIVPRHIQLAVRNDEELSKLLGTVTIAAGGVLPNIHTILLPKKTGKGGKDIGGSISQEF

SEQ ID NO: 20220 - protein, 140 aa, Picea glauca
MSSSGGGGGGRGKAKSTKSVSRSHKAGLQFPVGRIARFLKSGKYAERVGAGAPVYLAAVLEYLAAEVLELAGNAARDNKKNRIVPRHIQLAVRNDEELSKLLGSVTIANGGVLPNIHGVLLPKKAGKGKGAEIGSASQEF

SEQ ID NO: 20221 - protein, 138 aa, Hordeum vulgare
MSSPGAGAGGRGKAKATKSVSRSSKAGLQFPVGRIARYLKAGKYAERVGAGAPVYLSAVLEYLAAEVLELAGNAARDNKKTRIVPRHIQLAVRNDEELSKLLGSVTIANGGVMPNINQVLLPKKAGAKGEIGSISQEF

SEQ ID NO: 20222 - protein, 139 aa, Citrus clementina
  Sequence also found in Organisms: Citrus sinensis
MSSAGSTKGGRGKPKSTKSISRSHKAGLQFPVGRIARFLKAGKYADRVGAGAPVYLSAVLEYLAAEVLELAGNAARDNKKNRIVPRHIQLAVRNDEELSKLLGTVTIANGGVLPNIHQNLLPRKMGKGREDIGSASQEF

SEQ ID NO: 20223 - protein, 139 aa, Panax ginseng
MTSTGTTKGGRGKPKSTKSVSRSQKAGLQFPVGRIARFLKAGKYAERVGAGAPVYLSAVLEYLAAEVLELAGNAARDNKKNRIVPRHIQLAVRNDEELSKLLGTVTIANGGVLPNIHQNLLPKKSGKGNDGIGSASQEF

SEQ ID NO: 20224 - protein, 134 aa, Allium cepa
MSSAGRGKAKSSSKSVSRSSKAGLQFPVGRIARFLKAGKYAERVGAGAPVYMAAVLEYLAAEVLELAGNAARDNKKNRIVPRHIQLAVRNDEELSKLLGTVTIANGGVLPNIHSTLLPTKPGKGKGDGSASQEF

SEQ ID NO: 20225 - protein, 135 aa, Allium cepa
MSSAGRGKAKSSSKSVSRSSKAGLQFPVGRIARFLKAGKYAERVGAGAPVYMAAVLEYLAAEVLELAGNAARDNKKNRIVPRHIQLAVRNDEELSKLLGTVTIANGGVLPNIHSTLLPTKPGKGKGEIGSASQEF

SEQ ID NO: 20226 - protein, 139 aa, Phalaenopsis aphrodite
MSSTASTKGGRGKSKPAKAVSRSNKAGLQFPVGRIARFLKAGKYSERVGSGAPVYLAAVLEYLAAEVLELAGNAARDNKKNRIMPRHIQLAVRNDEELSKLLGAVTIANGGVLPNIHQNLLPKKQGKGKGDIGSASQEF

SEQ ID NO: 20227 - protein, 139 aa, Vinca minor
MSSTTTTKGGRGKPKSSKSVSRSSKAGLQFPVGRIARFLKAGKYAERVGAGAPVYLSAVLEYLAAEVLELAGNAARDNKKTRIVPRHIQLAVRNDEELSKLLGAVTIANGGVLPNIHSNLLPKKAGAGKGDINSVSQEF

SEQ ID NO: 20228 - protein, 138 aa, Triticum aestivum
MSSTGAGVAGRGKAKATKSVSRSSKAGLQFPVGRIARYLKAGKYAERVGAGAPVYLSAVLEYLAAEVLELAGNAARDNKKTRIVPRHIQLAVRNDEELSKLLGSVTIANGGVMPNINQVLLPKKAGPKGDLGSASQEF

SEQ ID NO: 20229 - protein, 137 aa, Vitis vinifera
MSSSNKGGRGKPKATKSVSRSAKAGLQFPVGRIARFLKAGKYAERVGAGAPVYLSAVLEYLAAEVLELAGNAARDNKKSRIVPRHIQLAVRNDEELSKLLGTVTIANGGVLPNIHQNLLPKKTGAGKGEIGSASQEF

SEQ ID NO: 20230 - protein, 144 aa, Nicotiana benthamiana
MSSDGGSGKGKGGAGRGKPKASKSVSRSSKAGLQFPVGRIARFLKAGKYAERVGAGAPVYLSAVLEYLAAEVLELAGNAARDNKKNRIVPRHIQLAVRNDEELSKLLGQVTIANGGVMPNIHQNLLPKKAGSGKGDIGSASQEF

SEQ ID NO: 20231 - protein, 142 aa, Brassica juncea
MSTNAATGTTKGGRGKPKATKSVSRSSKAGLQFPVGRIARFLKAGKYAERVGAGAPVYLSAVLEYLAAEVLELAGNAARDNKKTRIVPRHIQLAVRNDEELSKLLGAVTIANGGVLPNIHSNLLPSKVGKNKGDIGSASQEF

SEQ ID NO: 20232 - protein, 142 aa, Brassica napus
  Sequence also found in Organisms: Brassica oleracea, Brassica rapa
MSTGAASGTTKGGRGKPKATKSVSRSSKAGLQFPVGRIARFLKAGKYAERVGAGAPVYLSAVLEYLAAEVLELAGNAARDNKKTRIVPRHIQLAVRNDEELSKLLGAVTIANGGVLPNIHSNLLPSKVGKNKGDIGSASQEF

SEQ ID NO: 20233 - protein, 141 aa, Brassica rapa
MSTGAGSGTTKGGRGKPKATKSVSRSSKAGLQFPVGRIARFLKAGKYAERVGAGAPVYLSAVLEYLAEVLELAGNAARDNKKTRIVPRHIQLAVRNDEELSKLLGAVTIANGGVLPNIHSNLLPSKVGKNKGDIGSASQEF

SEQ ID NO: 20234 - protein, 141 aa, Daucus carota
MSGKGATATTKGGRGVSKTKSVSRSSKAGLQFPVGRIARFLKAGKYAERVGAGAPVYLSAVLEYLAAEVLELAGNAARDNKKNRIVPRHIQLAVRNDEELSKLLGTVTIANGGVLPNIHSTLLPKKVGKGKDEIGSASQEF

SEQ ID NO: 20235 - protein, 141 aa, Daucus carota
MSGKGATTTTKGGRGVSKTKSVSRSSKAGLQFPVGRIARFLKAGKYAERVGAGAPVYLSAVLEYLAAEVLELAGNAARDNKKNRIVPRHIQLAVRNDEELSKLLGTVTIANGGVLPNIHSTLLPKKVGKGKDEIGSASQEF

SEQ ID NO: 20236 - protein, 142 aa, Centaurea maculosa
  Sequence also found in Organisms: Cirsium arvense
MSSKSDADAKKGGRGKPKSTKSVSRSSKAGLQFPVGRIARFLKAGKYAERVGAGAPVYLSAVLEYLAAEVLELAGNAARDNKKTRIIPRHIQLAVRNDEELSRLLGSVTIANGGVLPNINQTLLPKKIGKDKGEIGSASQEF

SEQ ID NO: 20237 - protein, 142 aa, Cynara scolymus
MSSKSDADAKKGGRGKPKSTKSVSRSSKAGLQFPVGRIARFLKAGKYAERVGAGAPVYLSAVLEYLAAEVLELAGNAARDNKKTRIIPRHIQLAVRNDEELSRLLGSVTIANGGVLPNINQTLLPKKVGKDKGEIGSASQEF

SEQ ID NO: 20238 - protein, 142 aa, Eutrema halophilum
MSTGAGSGTTKGGRGKPKATKSVSRSSKAGLQFPVGRIARFLKAGKYAERVGAGAPVYLSAVLEYLAAEVLELAGNAARDNKKTRIVPRHIQLAVRNDEELSKLLGSVTIANGGVLPNIHSNLLPSKVGKNKGDIGSASQEF

SEQ ID NO: 20239 - protein, 140 aa, Daucus carota
MSGKGAITKGGRGQQAKTKSVSRSSKAGLQFPVGRIARFLKSGKYAERVGAGAPVYLSAVLEYLAAEVLELAGNAARDNKKNRIVPRHIQLAVRNDEELSKLLGTVTIANGGVLPNIHQTLLPKKMGKGKDEIGSASQEF

SEQ ID NO: 20240 - protein, 139 aa, Catharanthus roseus
MSSTGSTKGGRGRTKASKSVSRSQKAGLQFPVGRIARFLKAGKYAERVGGGAPVYLSAVLEYLAAEVLELAGNAARDNKKNRITPRHIQLAVRNDEELSKLLGAVTIANGGVMPNIHQNLLPKKAGTGKGDINSASQEF

SEQ ID NO: 20241 - protein, 139 aa, Lactuca sativa
MSTEGSTKGGRGKSKITKSVSRSQKAGIQFPVGRIARFLKAGKYAERVGAGAPVYLAAVLEYLAAEVLELAGNAARDNKKNRIVPRHIQLAVRNDEELSKLLGTVTIANGGVLPNIHHNLLPKKFGKGKDEIGSASQEF

SEQ ID NO: 20242 - protein, 135 aa, Allium cepa
MSSAGRGKAKSSSKSVSRSSKAGLQFPVGRIARFLKAGKYAERIGAGAPVYMAAVLEYLAAEVLELAGNAARDNKKNRIVPRHIQLAVRNDEELSKLLGTVTIANGGVLPNIHSTLLPTKPGKGKGEIGSASQEF

SEQ ID NO: 20243 - protein, 144 aa, Nicotiana tabacum
MSSDGGSGKGKGGAGRGKPKASKSVSRSSKAGLQFPVGRIARFLKAGKYAERVGAGAPVYLSAVLEYLAAEVLELAGNAARDNKKNRIVPRHIQLAVRNDEELSKILGQVTIANGGVMPNIHQNLLPKKAGSGKGDIGSASQEF

SEQ ID NO: 20244 - protein, 143 aa, Ipomoea nil
MSSSGAGAGKGGAGRGKPKATKSVSRSSKAGLQFPVGRIARFLKAGKYAERVGGGAPVYLAAVLEYLAAEVLELAGNAARDNKKNRIVPRHIQLAVRNDEELSKLLGDVTIANGGVLPNIHQTLLPKKAGSGKGEIGSASQEF

SEQ ID NO: 20245 - protein, 143 aa, Raphanus sativus
MSSTGAGSGTTKGGRGKPKATKSVSRSSKAGLQFPVGRIARFLKAGKYAERVGAGAPVYLSAVLEYLAAEVLELAGNAARDNKKTRIVPRHIQLAVRNDEELSKLLGAVTIANGGVLPNIHSNLLPSKVGKNNGDIGSASQEF

SEQ ID NO: 20246 - protein, 142 aa, Amorphophallus konjac
MSTTGTTKGGRGKPKASKAVSRSQKAGLQFPVGRIARFLKVGKYADRVGAGAPVYLAAVLEYLTAEVLELAGNAARDNKKNRIVPRHIQLAVRNDEELSRLLGAVTIASGGVLPNIHQTLLPKKQGAGKGAKGDIGSASQEF

SEQ ID NO: 20247 - protein, 142 aa, Catharanthus roseus
MSSKETGASKGGRGKPKASKSVSRSSKAGLQFPVGRIARFLKAGKYAERIGSGAPVYLSAVLEYLAAEVLELAGNAARDNKKNRIVPRHIQLAVRNDEELSKLLGSVTIANGGVLPNIHQNLLPKKVGKGGKGEIGSLSQEF

SEQ ID NO: 20248 - protein, 142 aa, Centaurea maculosa
MSSKSDADTKKGGRGKPKSTKSVSRSSKAGLQFPVGRIARFLKAGKYAERVGAGAPVYLSAVLEYLAAEVLELAANAARDNKKTRIIPRHIQLAVRNDEELSRLLGSVTIANGGVLPNINQTLLPKKIGKDKGEIGSASQEF

SEQ ID NO: 20249 - protein, 142 aa, Cleome spinosa
MSSTGGAGSTKGGRGKPKSTKSVSRSHKAGLQFPVGRIARFLKAGKYAEHVGAGAPVYLSAVLEYLAAEVLELAGNTARDNKKNRIVPRHIQLAVRNDEELSKLLGSVTIANGGVLPNIHQHLLPTKAGKGKGDIGSASQEF

SEQ ID NO: 20250 - protein, 142 aa, Carthamus tinctorius
MSSNSDADVQKGGRGKPKSTKSVSQSSKAGLQFPVGRIARFLKAGKYAERVGAGAPVYLSAVLEYLAAEVLELAGNAARDNKKTRIIPRHIQLAVRNDEELSRLLGSVTIANGGVLPNINQTLLPKKIGKDKGEIGSASQEF

SEQ ID NO: 20251 - protein, 142 aa, Tabernaemontana elegans
MSSKEGGASKGGRGKPKASKSVSRSQKAGLQFPVGRIARFLKAGKYAERIGSGAPVYLSAVLEYLAAEVLELAGNAARDNKKNRIMPRHIQLAVRNDEELSKLLGSVTIANGGVLPNIHQNLLPKKVGKDGKGQIGSLSQEF

SEQ ID NO: 20252 - protein, 141 aa, Amorphophallus konjac
MNSAASTKGGRGRPKASKAVSRSHKAGLQFPVGRIARFLKTGRYAERVGAGAPVYLSAVLEYLAAEVLELAGNAARDNKKNRIVPRHIQLAVRNDEELSRLLGAVTIASGGVLPNIHQTLLPKKQGKGKSDAGNASQSQEF

SEQ ID NO: 20253 - protein, 140 aa, Cirsium arvense
FQIRFRCQEGGRGKPKSTKSVSRSSKAGLQFPVGRIARFLKAGKYAERVGAGAPVYLSAVLEYLAAEVLELAGNAARDNKKTRIIPRHIQLAVRNDEELSRLLGSVTIANGGVLPNINQTLLPKKVGKDKGEIGSASQEF

SEQ ID NO: 20254 - protein, 139 aa, Cichorium intybus
MAPTSDAKGGRGKAKATKSVSRSSKAGLQFPVGRIARFLKAGKYAERVGAGAPVYLSAVLEYLAAEVLELAGNAARDNKKSRIVPRHIQLAVRNDEELSKLLGSVTIANGGVLPNIHSTLLPSKVGKDKGEIGSASQEF

SEQ ID NO: 20255 - protein, 139 aa, Lactuca sativa
MAPKSDAKGGRGKPKTTKSVSRSSKAGLQFPVGRIARFLKAGKYAERVGAGAPVYLSAVLEYLAAEVLELAGNAARDNKKSRIVPRHIQLAVRNDEELSKLLGSVTIANGGVLPNIHSTLLPSKVGKDKGEIGSASQEF

SEQ ID NO: 20256 - protein, 139 aa, Marchantia polymorpha
MSSAGGSSGGRGKTKGSKAVSRSQKAGLQFPVGRIARFLKAGKYAERVGAGAPVYLAAVMEYLAAEVLELAGNAARDNKKTRIIPRHIQLAVRNDEELSKLLGSVVIASGGVLPNIQSSLLPKKSGKSKGDIGSMSQEF

SEQ ID NO: 20257 - protein, 139 aa, Physcomitrella patens
MSSTGATGGRGKSKASKSISRSQKAGLQFPVGRIARFLKSGKFAERVGAGAPVYLAAVLEYLAAEVLELAGNAARDNKKNRIVPRHIQLAVRNDEELSKLLGTVTIAAGGVLPNIHTVLLPKKTDKGGRDIGGSISQEF

SEQ ID NO: 20258 - protein, 135 aa, Pteridium aquilinum
MGSGGRGKAKTSSKSVSRSHKAGLQFPVGRIARFLKAGKYAERVGAGAPVYLAAVLEYLAAEVLELAGNAARDNKKNRIVPRHIQLAVRNDEELSKLLGAVTIANGGVLPNIHNVLLPKKTGKVKGEVGSASQEF

SEQ ID NO: 20259 - protein, 139 aa, Triticum aestivum
MAIAGSGRGKAKPAASAKSVSRSSKAGLQFPVGRVARYLKVGKYAQRVGAGAPVYLAAVLEYLAAETLELAGNAARDNKKNRIVPRHIQLAVRNDEELSRLLGSVTIAAGGVLPSIHTTLLPKKAGKGKGDIGSASQEF

SEQ ID NO: 20260 - protein, 128 aa, Castanea mollissima
GKPKSSKSVSRSQKAGLQFPVGRIARFLKAGKYAERVGAGAPVYLSAVLEYLAAEVLELAGNAARDNKKNRIVPRHIQLAVRNDEELSKLLGTVTIANGGVLPNIHQNLLPKKIGKGKGDIGSASQEF

SEQ ID NO: 20261 - protein, 134 aa, Pteridium aquilinum
MSSGGRGKKPSSKSVSRSHKAGLQFPVGRIARFLKAGKYAERVGAGAPVYLAAVLEYLAAEVLELAGNAARDNKKNRIVPRHIQLAVRNDEELSKLLGTVTIANGGVLPNIHSVLLPKKSGKGKGEVGSVSQEF

SEQ ID NO: 20262 - protein, 138 aa, Zamia vazquezii
MSSSGRAGGRGKGKAAKAVSRSHRAGLQFPVGRIARFLKAGKYAQRVGAGAPVYLAAVLEYLAAEVLELAGNAARDNKKNRIVPRHIQLAVRNDEELSKLLGMVTIANGGVLPNIHQVLLPKKSGKSKVEAGSASQEF

SEQ ID NO: 20263 - protein, 142 aa, Lippia dulcis
MSSTAAAASTKGGRGKPKSSKSVSRSSKAGLQFPVGRIARFLKNGKYAERVGAGAPVYLSAVLEYLAAEVLELAGNAARDNKKNRIVPRHIQLAVRNDEELSKLLGNVTIANGGVLPNIHQNLLPKKAGGRDKEIGSASQEF

SEQ ID NO: 20264 - protein, 142 aa, Parthenium argentatum
MTSKADNDSKKGGRGKPKASKSVSRSSKAGLQFPVGRIARFLKAGKYAERVGAGAPVYLSAVLEYLAAEVLELAGNAARDNKKSRIVPRHIQLAVRNDEELSKLLGSVTIANGGVLPNIHQTLLPHKAGKEKGDIGSASQEF

SEQ ID NO: 20265 - protein, 140 aa, Amsonia hubrichtii
MSSKEGGAPKGGRGKPKSSKSVSRSQKAGLQFPVGRIARFLKAGKYAERIGSGAPVYLSAVLEYLAAEVLELAGNAARDNKKNRIVPRHIQLAVRNDEELSKLLGSVTIANGGVLPNIHQNLLPKKGKGGKEINSLSQEF

SEQ ID NO: 20266 - protein, 141 aa, Musa acuminata
MSSTGGTAAKGGRGKPKASKTISRSQKAGLQFPVGRIARYLKDGKYADRVGAGAPVYLSAVLEYLAAEVLELAGNAARDNKKNRIVPRHIQLAIRNDEELSKLLGTVTIANGGVLPNIHQTLLPKKQGKGQGELGSASQEF

SEQ ID NO: 20267 - protein, 141 aa, Fagopyrum esculentum
MAGKEGGSTKGGRGKPKSTKSVTRSSKAGLQFPVGRIARFLKAGKYAERVGAGAPVYLSAVLEYLAAEVLELAGNAARDNKKTRIVPRHILLAVRNDEELSKLLGSVTIANGGVMPNIHQTLLPKKVGKGGAEIGSASQEF

SEQ ID NO: 20268 - protein, 141 aa, Papaver somniferum
MSSPATKSTKGGRGKPKATKSVTRSSKAGLQFPVGRIARFLKAGKYAERVGGGAPVYLAAVLEYLAAEVLELAGNAARDNKKNRIVPRHIQLAVRNDEELSKLLGAVTIANGGVLPNIHQNLLPKKAGKGKGEVGSASQEF

SEQ ID NO: 20269 - protein, 132 aa, Cephalotaxus harringtonia
GGRGRSKGSKAISRSHKAGLQFPVGRIARFLKAGKYAERVGAGAPVYLAAVLEYLAAEVLELAGNAARDNKKNRIVPRHIQLAVRNDEELSKLLGSVTIANGGVLPNIHGVLLPKKSGKDKGAEIGTASQEF

SEQ ID NO: 20270 - protein, 139 aa, Secale cereale
MAIAGSGRGKAKPAASAKSVSRSSKAGLQFPVGRVARYLKVGKYAQRVGAGAPVYLAAVLEYLAAETLELAGNAARDNKKNRIVPRHIQLAVRNDEELSKLLGSVTIAAGGVLPSIHTTLLPKKAGKGKGDIGSASQEF

SEQ ID NO: 20271 - protein, 139 aa, Secale cereale
MAIAGSGRGKAKPAASAKSVSRSSKAGLQFPVGRVARYLKVGKYAQRVGAGAPVYLAAVLEYLAAETLELAGNAARDNKKNRIVPRHIQLAVRNDEELSKLLGSVTIAAGGVLPSIHTTLLPKKAGKAKGDIGSASQEF

SEQ ID NO: 20272 - protein, 136 aa, Allium cepa
MSPKKGGRGKPKSTKSVSRSSKAGLQFPVGRIARFLKAGRYAQRVGAGAPVYLSAVLEYLAAEVLELAGNAAKDNKKSRIIPRHIQLAVRNDEELSKLLGRVTIANGGVLPNINAVLLPKKAGKDKAEIGSASQEF

SEQ ID NO: 20273 - protein, 144 aa, Nicotiana tabacum
MTSDGGSGKGKGGAGRGKPKATKSVSRSSKAGLQFPVGRIARFLKAGKYAERVGAGAPVYLSAVLEYLAAEVLELAGNAARDNKKNRIVPRHIQLAVRNDEELSKLLGQVTIANGGVMPNIHQNLLPKKTGSGKGDIGSASQEF

SEQ ID NO: 20274 - protein, 142 aa, Beta vulgaris
MSGKESGATTKGGRGKPKATKSVSKSSKAGLQFPVGRITRFLKAGKYAERVGAGAPVYLAAVLEYLAAEVLELAGNAARDNKKNRIVPRHIQLAVRNDEELSKLLGQVTIANGGVLPNIHQTLLPKKAGGSKGDIGSASQEF

SEQ ID NO: 20275 - protein, 147 aa, Musa acuminata
MSSSGAAAAATTTKGGRGKPKASKSVSRSQKAGLQFPVGRIARFLKAGRYAERVGAGAPVYLSAVLEYLAAEVLELAGNAARDNKKNRIIPRHIQLAVRNDEELSRLLGAVTISNGGVVPNIHQVLLPKKQTGGKGKGDIGSASQEF

SEQ ID NO: 20276 - protein, 141 aa, Elaeis guineensis
MSSTGATKGGRGRPKASKAVSRSQKAGLQFPVGRIARFLKAGRYAERVGAGAPVYLSAVLEYLAAEVLELAGNAARDNKKNRIIPRHIQLAIRNDEELSRLLGGVTISNGGVLPNIHQVLLPKKQGGKGKGGEIGSMSQEF

SEQ ID NO: 20277 - protein, 139 aa, Fagopyrum esculentum
GKEGGSTKGSRGKPKSTKSVTRSSKAGLQFPVGRIARFLKAGKYAERVGAGAPVYLSAVLEYLAAEVLELAGNAARDNKKTRIVPRHILLAVRNDEELSKLLGSVTIANGGVMPNIHQTLLPKKVGKGGAEIGSASQEF

SEQ ID NO: 20278 - protein, 139 aa, Panax ginseng
MSSIGTTKGGIGKQKSTKSVTRSSKAGLQFSVGRIARFLKNDKYSERVGAGAPVYLSTVLEYLAAEVLELAGNAARDNKKNRIVPRHIQLAVRNDEELSKLLGTVTIANGGVLPNIHQTLLPKKSEKGKDEIGSASQEF

SEQ ID NO: 20279 - protein, 138 aa, Tropaeolum majus
MTSPATTKGGRGKSKSAKSVTRSTKAGLQFPVGRIARFLKAGKYAERVGAGAPVYLSAVLEYLAAEVLELAGNAARDNKKTRIIPRHIQLAVRNDEELSKLLGTVTIANGGVLPNINQTLLPKKSNKGGDIASASQEF

SEQ ID NO: 20280 - protein, 144 aa, Taraxacum officinale
MSSKSKSVADSTKGGRGKPKATKSVSRSSKAGLQFPVGRIARFLKAGKYAQRVGAGAPVYLSAVLEYLAAEVLELAGNAARDNKKTRIVPRHIQLAVRNDEELSKLLGSVTIANGGVLPNIHSTLLPKKVGKEKGDIGSASQEF

SEQ ID NO: 20281 - protein, 137 aa, Silene vulgaris
IGTAAAIGGRGKPKSAKSVSRSSKAGLQFPVGRIARFLKSGKYADRVGAGAPVYLSAVLEYLAAEVLELAGNAARDNKKTRIVPRHIQLAVRNDEELSKLLGQVTIANGGVMPNIHSTLLPKKAAGKGDIGSASQEF

SEQ ID NO: 20282 - protein, 141 aa, Silene vulgaris
MAGKDIGAIPKGGRGKPKSSKSVSRSSKAGLQFPVGRVARFLKSGKYADRVGAGAPVYLSAVLEYLAAEVLELAGNAARDNKKTRIVPRHIQLAVRNDEELSKLLGQVTIANGGVMPNIHQTLLPKKQGGKGDIGSASQEF

SEQ ID NO: 20283 - protein, 141 aa, Prunus mume
MSSTAAATTKSGRGKVRGTKSVSRSQKAGLQFPVGRVARFLKAGRYAQRVGSGSPVYLSAVLEYLAAEVLELAGNAARDNKKNRIVPRHIQLAVRNDEELSKLLGTVTIANGGVLPNIHQTLLPKKIGKGKGDIGSASQEF

SEQ ID NO: 20284 - protein, 140 aa, Panax ginseng
MSSTAGKGIAGRGKSKVTKSVSRSSKAGLQFPVGRIARFLKAGRYAQRVGSGSPVYLSAVLEYLAAELLELAGNAARDNKKSRIIPRHIQLAVRNDEELSKLLGSVTIANGGVLPNIHSTLLPKKAGKGKGEIGSVSQEF

SEQ ID NO: 20285 - protein, 140 aa, Panax ginseng
MSSTVGKGIAGRGKSKVTKSVSRSSKAGLQFPVGRIARFLKAGRYAQRVGSGSPVYLSAVLEYLAAELLELAGNAARDNKKTRIIPRHIQLAVRNDEELSKLLGSVTIANGGVLPNIHSTLLPKKAGKGKGEIGSVSQEF

SEQ ID NO: 20286 - protein, 138 aa, Vitis vinifera
MSSAAPAKGGRGHSKAKSVSRSQKAGLQFPVGRIARFLKKGRYAQRVGSGSPVYLSAVLEYLAAEVLELAGNAARDNKKNRIIPRHIQLAVRNDEELGKLLGGVTIASGGVLPNIHQNLLPKKTGKGKGEIGSASQEF

SEQ ID NO: 20287 - protein, 133 aa, Allium cepa
SAGRGKAKSSSKSVSRSSKAGLQFPVGRIARFLKAGKYAERVGAGAPVYMAAVLEYLAAEVLELAGNAARDNKKNRIVPRHIQLAVRNDEELSKLLGTVTIANGGVLPNIHSTLLPTKPGKGKGEAGSASQEF

SEQ ID NO: 20288 - protein, 133 aa, Helianthus annuus
KKGGRGKPKASKSVSRSSKAGLQFPVGRIARFLKAGRYAQRVGAGAPVYLAAVLEYLAAEVLELAGNAARDNKKSRVGPRHIQLAVRNDEELSKLLKSVTIANGGVLPNIHSTLLPKKGGKEKGEIGSASQEF

SEQ ID NO: 20289 - protein, 142 aa, Conyza canadensis
MSGGDSESKKGGRGKQKTTKSVSRSSKAGLQFPVGRIARFLKAGKYAERVGAGAPVYLSAVLEYLAAEVLELAGNAARDNKKSRIVPRHIQLAVRNDEELSKLLGSVTIANGGVLPNINSVLLPKTHGKDKADLHASASQEF

SEQ ID NO: 20290 - protein, 142 aa, Echinacea purpurea
MAPKTDTEAKKGGRGKPKTSKSVSRSSKAGLQFPVGRIARFLKAGRYAQRVGAGAPVYLSAVLEYLAAEVLELAGNAARDNKKSRIVPRHIQLAVRNDEELSKLLGSVTIANGGVLPNINSVLLPKKAGKDKGDIGSASQEF

SEQ ID NO: 20291 - protein, 141 aa, Mimulus guttatus
MGEKTTAAKSIAGRGKSKSKSVSRSSKAGLQFPVGRIARFLKKGRYAERVGSGSPVYLSAVLEYLAAEVLELAGNAARDNKKNRIVPRHIQLAVRNDEELSKLLGSVTIANGGVLPNINQILLPKKSGKGKAEIGSASQEF

SEQ ID NO: 20292 - protein, 141 aa, Chenopodium quinoa
MSGKEVGASTKGGRGKPKASKSVSRSSKAGLQFPVGRIARFLKAGKYAERVGAGAPVYLSAVLEYLAAEVLELAGNAARDNKKSRIVPRHIQLAVRNDEELSKLLGQVTIANGGVLPNIHQTLLPKKIGGGKGDNTQSQEF

SEQ ID NO: 20293 - protein, 142 aa, Silene vulgaris
MAGKDIGAIPKGGRGKPKSSKSVSRSSKAGLQFPVGRVARFLKSGKYADRVGAGAPVYLSAVLEYLAAEVLELAGNAARDNKKTRIVPRHIQLAVRNDEELSKLLGQVTIANGGVMPNIHQTLLPKKLGGSKGDIGSTSQEF

SEQ ID NO: 20294 - protein, 142 aa, Helianthus annuus
MAGKSDAEVKKGGRGKPKASKSVSRSSKAGLQFPVGRIARFLKAGRYAQRVGAGAPVYLAAVLEYLAAEVLELAGNAARDNKKSRVGPRHIQLAVRNDEELSKLLKSVTIANGGVLPNIHSTLLPKKAGKDKGDIGSASQEF

SEQ ID NO: 20295 - protein, 141 aa, Castanea mollissima
  Sequence also found in Organisms: Quercus alba
MSSAAETTTKGGRGKPKATKSVSRSHKAGLQFPVGRVARFLKTGRYAQRVGSGSPVYLSAVLEYLAAEVLELAGNAARDNKKNRIIPRHIQLAVRNDEELSRLMGSVTIANGGVLPNIHQNLLPKKAGKGKGDIGSASQEF

SEQ ID NO: 20296 - protein, 141 aa, Euonymus alatus
MSSAAATTTKGGRGKPKATKSVSRSQKAGLQFPVGRIARFLKTGKYAERVGSGSPVYLSAVLEYLAAEVLELAGNAARDNKKSRIVPRHIQLAVRNDEELSKLLGSVTIANGGVLPNIHQNLLPRKSGVGKGEIGSASQEF

SEQ ID NO: 20297 - protein, 141 aa, Humulus lupulus
MDSTAAATKKGGRGKPKATKSVSRSSKAGLQFPVGRIARFLKKGRYAQRVGSGSPVYLSAVLEYLAAELLELAGNAARDNKKNRIVPRHIQLAVRNDEELSKLLGAVTIANGGVLPNIHQTLLPKKVGKGKGEIGSASQEF

SEQ ID NO: 20298 - protein, 137 aa, Picea glauca
MSSSGGGGGGRGKAKSTKSVSRSHKAGLQFPVGRIARFLKSGKYAERVGAGAPVYLAAVLEYLAAEVLELAGNAARDNKKNRIVPRHIQLAVRNDEELSKLLGSVTIANGGVLPNIHGVLLPKKSWKRGKGAEIGSA

SEQ ID NO: 20299 - protein, 142 aa, Spinacia oleracea
MSGKEGGGSTKGGRGKPKASKSVSRSSKAGLQFPVGRIARFLKAGKYAERVGAGAPVYLSAVLEYLAAEVLELAGNAARDNKKSRIVPRHIQLAVRNDEELSKLLGQVTIANGGVLPNINPTLLPRKLAGGGKDNNTLSQEF

SEQ ID NO: 20300 - protein, 144 aa, Cichorium intybus
MSSKSKPVTDSKKGGRGKPKTTKSVSRSSKAGLQFPVGRIARFLKAGKYAQRVGAGAPVYLSAVLEYLAAEVLELAGNAARDNKKTRIVPRHIQLAVRNDEELSKLLGSVTIANGGVLPNIHSTLLPKKAGKEKGDIGSASQEF

SEQ ID NO: 20301 - protein, 144 aa, Lactuca sativa
MSSKTKAVSDSKKGGRGTPKTTKSVSRSSKAGLQFPVGRIARFLKAGKYAQRVGAGAPVYLSAVLEYLAAEVLELAGNAARDNKKTRIVPRHIQLAVRNDEELSKLLGSVTIANGGVLPNIHSTLLPKKAGKEKGDIGSASQEF

SEQ ID NO: 20302 - protein, 136 aa, Allium cepa
MSPKKGGRGKPKNTKSVSRSSKAGLQFPVGRIARFLKVGRYAQRVGAGAPVYLSAVLEYLAAEVLELAGNAAKDNKKSRIIPRHIQLAVRNDEELSKLLGRVTIANGGVMPNIHSALLPKKAGKVKSEIGSASQEF

SEQ ID NO: 20303 - protein, 144 aa, Populus trichocarpa
MSSKGAAVASTRGGRGKPKASKAVSRSQKAGLQFPVGRIARFLKTGKYAERLGAGSPVYLSAVLEYLAAEVLELAGNAARDNKKNRIIPRHIQLAVRNDEELGKLLGSVTIANGGVLPNINQTLLPKKAGKGKGGDIGSASQEF

SEQ ID NO: 20304 - protein, 143 aa, Guizotia abyssinica
MAPKADATETKKGGRGKAKATKSVSRSSKAGLQFPVGRIARFLKAGRYAQRVGAGAPVYLSAVLEYLAAEVLELAGNAARDNKKSRIGPRHIQLAVRNDEELSKLLGSVTIANGGVLPNIHSTLLPKKGGKEKGDIGSASQEF

SEQ ID NO: 20305 - protein, 143 aa, Ipomoea nil
MSSAAAEVKSTGGGRGKPKASKSVTRSSKAGLQFPVGRVARYLKKGRYAQRVGSGSPVYLSAVLEYLAAEVLELAGNAARDNKKNRIVPRHIQLAVRNDEEFSKLLGSVTIANGGVLPNINQCLLPKKNGKGKGEIGSASQEF

SEQ ID NO: 20306 - protein, 142 aa, Flaveria ramosissima
MASKSDAETKKGGRGKPKATKAVSRSSKAGLQFPVGRIARFLKAGRYAQRVGAGAPVYLSAVLEYLAAEVLELAGNAARDNKKSRIGPRHIQLAVRNDEELSKLLGSVTIANGGVLPNIHSTLLPKKVGKEKGEIGSASQEF

SEQ ID NO: 20307 - protein, 142 aa, Populus trichocarpa
MSSNEGRASTKGGRGRAKASKAVSRSQKAGLQFPVGRVARFLKTGKYAERLGAGSPVYLSAVLEYLAAEVLELAGNAARDNKKNRIVPRHIQLAVRNDEELGKLLGSVTIANGGVLPNIHQTLLPKKVGKGKGDIGSVSQDF

SEQ ID NO: 20308 - protein, 135 aa, Utricularia gibba
MSSAAASTTKGGRGRQKSAKAVSRSSKAGLQFPVGRIARFLKAGKYAERVGAGAPVYLSAVLEYLAAEVLELAGNAARDNKKNRIVPRHIQLAVRNDEELSKLLGNVTIANGGVMPNIHQTLLPKKAGGRDKEIG

SEQ ID NO: 20309 - protein, 142 aa, Vinca minor
MSGKESGASKGGRGKPKASKSVSRSSKAGLQFPVGRIARFLKAGKYAQRIGSGAPVYLSAVLEYLAAEVLELAGNAARDNKKNRIVPRHIQLAVRNDEELSKLLGSVTIANGGVLPNIHSNLLPKKIGKGGKGEIGSMSQEF

SEQ ID NO: 20310 - protein, 143 aa, Chrysanthemum coronarium
MGGKSVEDMKKGGRGKTKSSAKSVSRSSKAGLQFPVGRIARFLKQGKYAQRVGAGAPVYLSAVLEYLAAEVLELAGNAARDNKKTRIVPRHIQLAVRNDEELSKLLGSVTIANGGVLPNIHSTLLPKKAGKDKGDIGSASQEF

SEQ ID NO: 20311 - protein, 140 aa, Gossypium hirsutum
  Sequence also found in Organisms: Gossypium raimondii
MSSAAATTTKGGRGKSKAKAVSRSSKAGLQFPVGRVARFLKKGRYAERVGSGSPVYLSAVLEYLAAEVLELAGNAARDNKKNRIIPRHIQLAVRNDEELSKLLGGVTIANGGVLPNIHQNLLPKKASKGKGEIGSVSQEF

SEQ ID NO: 20312 - protein, 141 aa, Euonymus alatus
MSSAAATTTKGGRGKPKATKSVSRSQKAGLQFPVGRIARFLKTGKYAERVGSGSPVYLSAVLEYLAAEVLELAGNAARDNKKSRIVPRHIQLAVRNDEELSKLLGSVTIANGGVLPNIHQNLLPRKSAVGKGEIGSASQEF

SEQ ID NO: 20313 - protein, 140 aa, Panax ginseng
MSSTAGKGIAGRGKSKGTKSVSRSQKAGLQFPVGRIARFLKTGRYAQRVGAGSPVYFSAVLEYLAAELLELAGNAARDNKKSRIIPRHIQLAVRNDEELSKLLGTVTIANGGVLPNIHSTLLPNKVGKGKGEIGSVSQEF

SEQ ID NO: 20314 - protein, 140 aa, Secale cereale
MATAAAGGGRGKPKGSKSVSRSVKAGLQFPVGRVARHLKVGRYAKRVGAGAPVYLCAVLEYLAAEALELAGNAARDNKKTRISPRHIQLAVRNDEELSRLLGGVTIAAGGVLPNIHSVLLPKKVGKAAGTGGSASQSQEF

SEQ ID NO: 20315 - protein, 140 aa, Triticum aestivum
MATAAAGGGRGKPKGSKSVSRSVKAGLQFPVGRVARHLKVGRYAKRVGAGAPVYLCAVLEYLAAEALELAGNAARDNKKTRISPRHIQLAVRNDEELSRLLGGVTIAAGGVLPNIHSVLLPKKAGKGAGTGGSASQSQEF

SEQ ID NO: 20316 - protein, 129 aa, Rosmarinus officinalis
MSSTGSTKGGRGKPKSSKSVSRSQKAGLQFPVGRIARFLKAGKYAERVGAGAPVYLSAVLEYLAAEVLELAGNAARDNKKNRIAPRHIQLAVRNDEELSKLLGSVTIANGGVLPNIHQNLLPKKAGSGK

SEQ ID NO: 20317 - protein, 139 aa, Fagus grandifolia
MSSAASTKGGRGKPKSSKSVSRSQKAGLQFPVGRIARFLKAGKYAERVGAGAPVYLSAVLEYLAAEVLELAGNAARDNKKNRIVPRHIQLAVRNDEELSKLLGTVTIANGGVLPNIHQNLYRRRLGKGKAILDRPPKSF

SEQ ID NO: 20318 - protein, 129 aa, Pinus pinaster
MSSAGGGGGRGKAKSSKSVSRSHKAGLQFPVGRIARFLKSGKYAERVGAGAPVYMAAVLEYLAAEVLELAGNAARDNKKNRIVPRHIQLAVRNDEELSKLLGAVTIANGGVLPNIHGVLLPKRLEGKGR

SEQ ID NO: 20319 - protein, 132 aa, Vinca minor
SKGGGRGKPKASKSVSRSSKAGLQFPVGRIARFLKAGKYAQRIGSGAPVYLSAVLEYLAAEVLELAGNAARDNKKNRIVPRHIQLAVRNDEELSKLLGSVTIANGGVLPNIHSNLLPKKVGKGGKGEIGSMS

SEQ ID NO: 20320 - protein, 143 aa, Petroselinum crispum
MGNKEGKSTGGRGKTAPARGSKSVSRSSKAGLQFPVGRIARFLKAGKYSQRVGAGAPVYLAAVLEYLAAEVLELAGNAARDNKKNRVVPRHIQLAVRNDEELSKLLGAVTIANGGVMPNIHQNLLPKKVGKGKGDIGSASQEF

SEQ ID NO: 20321 - protein, 141 aa, Linum usitatissimum
MSSVAAAGLAKSGRGKPKSKAVSRSQKAGLQFPVGRIARFLKRGRYAERVGSGSPVYLSAVMEYLAAEVLELAGNAARDNKKTRIVPRHIQLAVRNDEELSKLLGGVTIANGGVLPKIHQSLLPKKAGKDKGEIGSASQEF

SEQ ID NO: 20322 - protein, 142 aa, Helianthus annuus
MAGKSDAEVKKGGRGKPKASKSVSRSSKAGLQFPVGRIARFLKAGRYAQRVGAGAPVYLAAVLEYLAAEVLELAGNAARDNKKSRVGPRHIQLAVRNDEELSKLLRSVTIANGGVLPNIHSTLLPKKAGKEKGEIGSASQEF

SEQ ID NO: 20323 - protein, 141 aa, Daucus carota
MGNKEGKSTGGRGKTAPATKSVSRSSKAGLQFPVGRIARFLKAGKYSQRVGAGAPVYLAAVLEYLAAEVLELAGNAARDNKKTRVIPRHIQLAVRNDEELSKLLGSVTIANGGVMPNIHQNLLPKKVGKGKGDIGSASQEF

SEQ ID NO: 20324 - protein, 141 aa, Petunia hybrida
MSSTIEKKSVGGRGKPKASKSVSRSAKAGLQFPVGRIARYMKKGRYAERLGSGSPIYLSAVLEYLAAEVLELAGNAARDNKKNRIVPRHIQLAVRNDEELSKLLGTVTIANGGVLPNIHQNLLPKKTGKGKPEVGSESQEF

SEQ ID NO: 20325 - protein, 141 aa, Prunus mume
MSSTAAATTKSGRGKVRGTKSVSRSQKAGLQFPVGRVARFLKAGRYAQRVGSGSPVYLSAVLEYLAAEVLELAGNAARDNKKNRITPRHIQLAVRNDEEFTRLLGSVTIANGGVLPNIHQNLLPKKGGKAKGEIGSASQEF

SEQ ID NO: 20326 - protein, 128 aa, Gossypium hirsutum
MSSTGGSAKGGRGKPKSSKAVSRSHKAGLQFPVGRIARFLKAGKYAERVGAGAPVYLSAVLEYLAAEVLELAGNAARDNKRNRIVPRHIQLAVRNDEELSKLLGSVTIANGGVLPNIHQTLLPKKTGR

SEQ ID NO: 20327 - protein, 140 aa, Triticum aestivum
MATTAAGGGRGKPKGSKSVSRSVKAGLQFPVGRVARHLKVGRYAKRVGAGAPVYLCAVLEYLAAEALELAGNAARDNKKTRISPRHIQLAVRNDEELSRLLGGVTIAAGGVLPNIHSVLLPKKAGKGAGTGGSASQSQEF

SEQ ID NO: 20328 - protein, 136 aa, Allium cepa
MSPKQGGRGKPKNTKSVSRSSKAGLQFPVGRIARFLKVGRYAQRVGAGAPVYLSAVLEYLAAEVLELAGNAAKDNKKSRIIPRHIQLAVRNDEELSKLLGRVTIANGGVMPNIHSALLSKKAEKVKSEIGSASQEF

SEQ ID NO: 20329 - protein, 136 aa, Allium cepa
MSPKKGGRGKPKNTKSVSRSIKAGLQFPVGRIARFLKVGRYARRVGAGAPVYLSAVLEYLAAEVLELAGNAAKDNKKSRIIPRHIQLAVRNDEELSKLLGRVTIASGGVMPNIHSALLPKKAAKVKSEIGSASQEF

SEQ ID NO: 20330 - protein, 129 aa, Tripterygium wilfordii
RGKPKATKSVSRSQKAGLQFPVGRIARFLRTGKYAERLGSGSPVYLSAVLEYLAAEVLELAGNAARDNKKNRIVPRHIQLAVRNDEELSKLLGGVTIANGGVLPNIHQNLLPKKIGKGKGEIGSASQEF

SEQ ID NO: 20331 - protein, 141 aa, Ricinus communis
MSSTATNTPKGGRGKSKAKAVSRSSKAGLQFPVGRVARFLKKGRYAQRVGSGSPVYLSAVLEYLAAEVLELAGNAARDNKKNRIIPRHIQLAVRNDEELSKLLGAVTIASGGVLPNIHQNLLPKKSAKGGKGEIGSVSQEF

SEQ ID NO: 20332 - protein, 142 aa, Cucurbita pepo
MSSTDVPTKGGRGKKSAAKAVSRSHKAGLQFPVGRIARYLKKGRYAQRVGSGSPVYLSAVLEYLAAEVLELAGNAARDNKKNRIIPRHIQLAVRNDEELSKLLGSVTIASGGVMPKIHQSLLPKKAGNAKDKAEIGSASQEF

SEQ ID NO: 20333 - protein, 142 aa, Flaveria ramosissima
MATKSDAETKKGGRGKPKATKAVSRSSKAGLQFPVGRIARFLKAGRYAQRVGAGAPVYLSAVLEYLAAEVLELAGNAARDNKKSRIGPRHIQLAVRNDEELSKLLGSVTIANGGVLPNIHSTLLPKKVGKEKGEIGSASQEF

SEQ ID NO: 20334 - protein, 142 aa, Ipomoea batatas
MSSAAAEAKSTGGRGKPKASKSVTRSSKAGLQFPVGRVARYLKKGRYAQRVGSGSPVYLSAVLEYLAAEVLELAGNAARDNKKNRIVPRHIQLAVRNDEEFSKLLGSVTIANGGVLPNINQCLLPKKNAKGKGEIGSMSQEF

SEQ ID NO: 20335 - protein, 142 aa, Cucumis melo
MSSTEVSTKGGRGRKASTKSVSRSHKAGLQFPVGRIARYLKKGRYAQRVGSGSPVYLSAVLEYLAAEVLELAGNAARDNKKNRIIPRHIQLAVRNDEELSKLLGSVTIASGGVMPKIHQSLLPKKAGNAKDKAEIGSASQEF

SEQ ID NO: 20336 - protein, 142 aa, Helianthus annuus
MAGKSDAEAKKGGRGKPKASKCVSRSSKAGLQFPVGRIARFLKAGRYAQRVGAGAPVYLSAVLEYLAAEVLELAGNAARDNKKSRVGPRHIQLAVRNDEELSKLLGSVTIANGGVLPNIHSTLLPKKAGKEKGEIGSASQEF

SEQ ID NO: 20337 - protein, 141 aa, Tabernaemontana elegans
MSSTATATKSTTGRGKPKATKSVSRSSKAGLQFPVGRIARYLKKGRYAQRVGSGSPVYLSAVLEYLAAEVLELAGNAARDNKKNRIVPRHIQLAVRNDEELSKLLGAVTIANGGVLPNIHQNLLPKKTGKGKEIGSQSQEF

SEQ ID NO: 20338 - protein, 141 aa, Daucus carota
MSSTGAGKGIAGRGKSKGTKSVSRSQKAGLQFPVGRIARFLKAGRYAQRVGSGSPVYLSAVLEYLAAELLELAGNAARDNKKSRIIPRHIQLAVRNDEELSKLLGSVTIASGGVLPNINSVLLPKKVAKGKDQIGSVSQEF

SEQ ID NO: 20339 - protein, 141 aa, Daucus carota
MGNKEGKSTGGRGKTAPATKSVSRSSKAGLQFPVGRIARFLKAGKYSQRVGAGAPVYLAAVLEYLAAEVLELAGNAARDNKKTRVIPRHIQLAVCNDEELSKLLGSVTIANGGVMPNIHQNLLPKKVGKGKGDIGSASQEF

SEQ ID NO: 20340 - protein, 141 aa, Tropaeolum majus
MSSTAATVTKGGRGKSKSAKAVTRSSKAGLQFPVGRIARYLKKGRYAQRVGSGSPVYLSAVLEYLAAEVLELAGNAARDNKKSRIIPRHIQLAVRNDEELSKLLGSVTIANGGVLPKIHSSLLPKKGGKDKGEIGTVSQEF

SEQ ID NO: 20341 - protein, 140 aa, Panax ginseng
MNSTAGKGIAGRGKPKGTKSVSRSQKAGLQFPVGRIARFLKAGRYAQRIGAGSPVYFSAVLEYLAAELLELAGNAARDNKKSRIIPRHIQLAVRNDEELSKLLGTVTIANGGVLPNIHSTLLPNKVGKGKGEIGSVSQEF

SEQ ID NO: 20342 - protein, 134 aa, Secale cereale
GGGRGKPKGSKSVSRSVKAGLQFPVGRVARHLKVGRYAKRVGAGAPVYLCAVLEYLAAEALELAGNAARDNKKTRISPRHIQLAVRNDEELSRLLGGVTIAAGGVLPNIHSVLLPKKVGKAAGTGGSASQSQEF

SEQ ID NO: 20343 - protein, 329 aa, Glycine max
MATNIGIMDAAYFVGRSEILSWINSTLQLNLSKVEEACSGAVHCQLLDAAHPGIVPMHKVNFDAKSEYEMIQNYKVLQDVFNKLKITKHIEVSKLVKGRPLDNLEFMQWMKRYCDSVDSGLQYNYNPLERREVCKGGRETSKKSANSQASTKGSTAQRPHSSHNARRNEVSNANPTNQAAKVARAAPSAGNPAPVYEEKITELKLSIDSLEKERDFYFAKLRDIEILCQTPEIEHSPIVAAIQKILYATDDNGMAVVEAQAMISVGRKEIEGLSPIAEVSEEKSSSETHKRKNIANIDFDVAGLATLSPRQRLSDVSDVHCSESPLMTC

SEQ ID NO: 20344 - protein, 326 aa, Cajanus cajan
MATNIGIMDAAYFVGRSEILSWINSTLQLSLSKVEEACSGAVHCQLLDAAHPGIVPMHKVNFDAKNEYEMIQNYKVLQDVFNKLKITKHIEVSKLVKGRPLDNLEFMQWMKRYCDSVNSGLQHSYNPMERREVCKGGRETSKKAVNSQSSTKGSAAQRPQSSHNARRNEVSNANPTNHAAKVTKPSAGGGPVYEEKITELKLSIDSLEKERDFYFAKLRDIEILCQTPEIEHSLIVGAIQKILYATDDDGTAVAEAQAMISVGHKEIEGLSPIAEVSEEKCSSETHKRKNIANIDFDVAGIANLSPRQRLSDVSDVHCSESPLMTC

SEQ ID NO: 20345 - protein, 326 aa, Phaseolus vulgaris
MATNIGIMDAAYFVGRSEILSWINSTLQLSLSKVEEACSGAVHCQLLDAAHPGIVPMHKVNFDAKNEYEMIQNYKVLQDVFNKLKITKYIEVSKLVKGRPLDNLEFMQWMKRYCDSVNSGQNNYNALERREVCRGGRETSKKSANSQASTKGSTSQRPQSSHNSRRTEVLNANPTNQAVKVARAPIAAGGPAYEEKITELKLSIDSLEKERDFYFAKLRDIEILCQTPEIEHSPIVEAIQKILYATDDDGTAVAEAQALLSAGHKEIEGLSPIAEVSEEKSSSETNKRKNISNIDFDAAGIATLSPRQRLSDVSDVHCSGSPLMTC

SEQ ID NO: 20346 - protein, 328 aa, Cicer arietinum
MATNIGIMDAAYFVGRSEILAWINSTLQLNLSKVEEACSGAVHCQLLDAAHPGIVPMHKVNFDAKNEYEMIQNYKVLQDVFNKLKITKHIEVNKLVKGRPLDNLEFMQWMKRYCDSVNSGQHNYNPLERREVCKGGREVSKKSAHSQPSNKGGSTAQRPPSSHARRNDVSSTGNPANQAAKVTRPSPAAAAAPAYDEQITGLKLSIDSLEKERDFYFAKLRDIEILCQTPGIEHSPVFAAIQKILYATDDNGNELAEAQAMISGCLQEPEPLSPIAEVSEEKSSSETHKRKIITNPEFDAAGSANLSPRQRLSDVSDVHHSGSPLMTC

SEQ ID NO: 20347 - protein, 329 aa, Lupinus angustifolius
MATNIGIMDSAYFVGRSEILAWINSTLQLNLSKVEDACSGAVHCQLLDAAHPGTVPMHKVNFDAKNEYDMIQNYKVLQDVFNKLKITKHIEVSKLVKGRPLDNLEFMQWMKRYCDSVNSGLHHNYNPVERREVCKGGRETTKKSAQSQASTKASTTSRPHSSHNARRNDGSSAANARNQAPKVTSTRPSSAGGPAYDEQITGLKLSVDSLEKERDFYFAKLRDIEILCQIPEIEQSPVVAAIQKILYATDDDGTAVAEAQAMISGGQKEAEQLSPIAEASEEKSCSETRKRKIIANLDFDAAGTTNLSPRQRLSDVSDVHCSESPLMTC

SEQ ID NO: 20348 - protein, 327 aa, Trifolium pratense
MATNIGIMDAAYFVGRSEIISWINSTLQLNLSKVEEACTGAVHCQLLDAAHPGIVPMHKVNFDAKNEYEMIQNYKVLQDVFNKLKITKHIEVSKLVKGRPLDNLEFMQWMKRYCDSVNSGQHTYNPLERREVCKGGGREVSKKSAHSQPSNKGGSTSHRPQPSHAARRNDVSTANPANHAAAKATRPPAAAVSPAYDQQITELKLSIDSLEKERDFYFAKLRDIEILCQTPEVEHSPVFAAIQKILYATDDNGSELAEAQAMLTAGLQEPEPLSPIAEVSEEKSSETHKRKNFANPEVDAAGVSNLSPRRRLSDISNVHHSESPLMT

SEQ ID NO: 20349 - protein, 327 aa, Trifolium pratense
MATNIGIMDAAYFVGRSEILSWINSTLQLNLSKVEEACTGAVHCQLLDAAHPGIVPMHKVNFDAKNEYEMIQNYKVLQDVFNKLKITKHIEVSKLVKGRPLDNLEFMQWMKRYCDSVNSGQHTYNPLERREVCKGGGREVSKKSAHSQPSNKGGSTSHRPQPSHAARRNDVSTANPANHAAAKATRPPAAAVSPAYDQQITELKLSIDSLEKERDFYFAKLRDIEILCQTPEVEHSPVFAAIQKILYATDDNGSELAEAQAMLTAGLQEPELLSPIAEVSEEKSSETHKRKNFANPEVDAAGVSNLSPRRRLSDVSNIHHSGSPLMT

SEQ ID NO: 20350 - protein, 333 aa, Trigonella foenum-graecum
MATNIGIMDAAYFVGRSEILSWINSTLQLNLSKVEEACSGAVHCQLLDAAHPGIVPMHKVNFDAKNEYEMIQNYKVLQDVFNKLKITKHIEVSKLVKGRPLDNLEFMQWMKRYCDSVNSGQHIYNPLERREVCRGGGREVSKKSAHSQPSNKGGSTSHRPPQSSHTARRNDVSTANHANPAAAKVARPAAAAAAAAAAPAYDQQITELKLSIDSLEKERDFYFAKLRDIEILCQTPEVEHSPVFAAIQKILYATDDNGSELAEAQAMLTAGLQESEPLSPIAEDSEEKSSSENHKRKNFANPEVDAAGVENLSPRRRLSDVSNVHHNGSPLMT

SEQ ID NO: 20351 - protein, 328 aa, Trifolium pratense
MATNIGIMDAAYFVGRSEILSWINSTLQLNLSKVEEACTGAVHCQLLDAAHPGIVPMHKVNFDAKNEYEMIQNYKVLQDVFNKLKITKHIEVSKLVKGRPLDNLEFMQWMKRYCDSVNSGQNSYNPLERREVCKGGGREVSKKSAHSQPSNKGGSTSHRPQPSHAARRNDVSTANPANQVAAKPTRPSAAAAVAPAYDQQITELKLSIDSLEKERDFYFAKLRDIEILCQTPEVEDSPVFAAIQKILYATDDNGSELAEAQAMLTAGLQEAVPLSPIAEVSEEKSSETHKRKNFANPEVDAAGVSNLSPRRRLSDVSNIHHSGSPLMT

SEQ ID NO: 20352 - protein, 996 aa, Glycine max
MSNPQDQKPWKAEYAKSGRSSCRTCKSPIASETLRLGKMVQSTKFDGLVPMWNHAACVLKKANQIKLVEDVENLESLRWEDQQKIRKYIESGGGGGSSSGGGSAAKSDSKTVKDTKCGIEVSQNSRATCKDCGQKIIKGEVRISTKQGGQGAKGLAWHHAKCLIDLSPSIEVDKLSGWNNLSSSDQSAVIDFAKKGGSDTKIETEEGKESTPQQTSKGGIKRGKDVDSERKSKVAKAKGDVSVGSAMSVKSGEACDLEKKMETQSKELWDLKDDLKKHVTTTELREMLEASGQDSTGSELDLRDRCADGMMFGALDLCPICSGFLRYSGGMYRCHGYISEWSKCSYSTCEPKRIEGKWKIPKETNNQYLKKWFKSQKGKKPVRILPLPSPRKSAESQMIASQHQSSNSGNLRDLKVAICGLPNDSIAEWKCKIDGICGMFHAKVNKDTNCLVVGGSLNYEAEMRKARRMKIPIVREDYLIDCLARKKRLPFDMYKVEMIGEASSMVTIKVKGHSAVHEASGLQDSGHILEEGKSIYNTTLNMSDLSTGINSYYILQIIQEDKGSDCYVFRKWGRVGNDKIGGTKLEEMSKSDAVCEFKRLFYEKTGNPWDAWEQKTIQKQPGRFFPLDIDYGVNKQVSKKEKNDVDSKLPPPLIELMKMLFNVETYRAAMMEFEINMSEMPLGKLSKSNIQKGFEALTEIQNLLKISNPDPSVKESLLINASNRFFTMIPSVHPHIIRDEDDFKSKVKMLEALQDIEIASRLVGFDANNDDSIDDNYKKLHCDISPLPHDSEEFCLIEKFLHNTHAPTHTDWSLELEEVFSLEREGEFDKFAPYRDKLGNRMLLWHGSRLTNFVGILSQGLRIAPPEAPATGYMFGKGVYFADLVSKSAQYCFTDKKNPVGLMLLSEVALGNVYELKKAKYMDKPPEGKHSTKGLGKKMPQESEYVKWRGNVTVPCGKPVPSNVKSSELMYNEYIVYNTAQVKMQFLLKVRFHHKR

SEQ ID NO: 20353 - protein, 1004 aa, Glycine max
MSVDPAAPATPDKCLLMKKQGMYERYAALFALRNDGGNDAVAAIIDSLGSKSALLCHEMWNHAACVLKKANQIKLVEDVENLESLRWEDQQKIRKYIESGGGGGSSSGGGSAAKSDSKTVKDTKCGIEVSQNSRATCKDCGQKIIKGEVRISTKQGGQGAKGLAWHHAKCLIDLSPSIEVDKLSGWNNLSSSDQSAVIDFAKKGGSDTKIETEEGKESTPQQTSKGGIKRGKDVDSERKSKVAKAKGDVSVGSAMSVKSGEACDLEKKMETQSKELWDLKDDLKKHVTTTELREMLEASGQDSTGSELDLRDRCADGMMFGALDLCPICSGFLRYSGGMYRCHGYISEWSKCSYSTCEPKRIEGKWKIPKETNNQYLKKWFKSQKGKKPVRILPLPSPRKSAESQMIASQHQSSNSGNLRDLKVAICGLPNDSIAEWKCKIDGICGMFHAKVNKDTNCLVVGGSLNYEAEMRKARRMKIPIVREDYLIDCLARKKRLPFDMYKVEMIGEASSMVTIKVKGHSAVHEASGLQDSGHILEEGKSIYNTTLNMSDLSTGINSYYILQIIQEDKGSDCYVFRKWGRVGNDKIGGTKLEEMSKSDAVCEFKRLFYEKTGNPWDAWEQKTIQKQPGRFFPLDIDYGVNKQVSKKEKNDVDSKLPPPLIELMKMLFNVETYRAAMMEFEINMSEMPLGKLSKSNIQKGFEALTEIQNLLKISNPDPSVKESLLINASNRFFTMIPSVHPHIIRDEDDFKSKVKMLEALQDIEIASRLVGFDANNDDSIDDNYKKLHCDISPLPHDSEEFCLIEKFLHNTHAPTHTDWSLELEEVFSLEREGEFDKFAPYRDKLGNRMLLWHGSRLTNFVGILSQGLRIAPPEAPATGYMFGKGVYFADLVSKSAQYCFTDKKNPVGLMLLSEVALGNVYELKKAKYMDKPPEGKHSTKGLGKKMPQESEYVKWRGNVTVPCGKPVPSNVKSSELMYNEYIVYNTAQVKMQFLLKVRFHHKR

SEQ ID NO: 20354 - protein, 1004 aa, Cajanus cajan
MSNPQNQKPWKAEYAKSGRSSCRTCKSPIASETLRLGKMVQSSKFDGLMPMWNHAACILKKANQIKLVEDVENIESLRWDDQQKIRKYIESGTGTGTGTGSGSASKSNSKAVKDTECGIEVSQTSRATCRDCGQKIIKGEVRISTKPDGQGARGLAWHHAKCLVELSPSIQVDKLSGWNSLSSSDQSTVSDLAKKGHSLTKGGGSGINIKTEEGKESTQHTSKGGIKRGKDADGERKSKVAKAKGDVSASSTASVKNEPGEARDLENRLEAQSKELWALKDDIKEHVTTAELRIMLDANGQDSTGSELDLRDRCADGMMFGGLGLCPICSGFLRYSGGMYRCNGYISEWSRCSYSTCEPKRNEGKWKIPEETNNQYLKKWFKSQKGKKPVRILPLPSPRKSAESQITASQHQSSNTENLQDLKVSICGLPNDSIEEWKCKIGGIGGVFHAKVKKDTNCLVVGGTLNDEAEMRKARRMKIPIVREDYLIDCLERKKRLPFDMYKVEMIGEASSMVTIKVKGHSAVHEASGLQDSGHILEEGKSIYNTTLNMSDLSTGINSYYILQIIQEDKGSDCYVFRKWGRVGNDKIGGSKLEEMSKPDAVCEFKRLFYEKTGNPWEAWEQKTIQKQPGRFFPLDIDYGVNKQVSKKKKNDADSKLPPPLIELIKMLFNVETYRAAMMEFEINMSEMPLGKLSKSNIQRGFEALTEIQNLLKNGNPDPSVKESLLINASNRFFTMIPSIHPHIIRDEDDFKSKVKMLEALQDIEIASRLVGFDANSDDSIDDNYKKLHCDISPLSHDSEDFCLIEKFLHNTHAPTHTDWSLELEEVFSLEREGEFDKFAPYREKLGNRMLLWHGSRLTNFVGILSQGLRIAPPEAPATGYMFGKGVYFADLVSKSAQYCYTDKKNPVGLMLLSEVALGNVYELKKAKYMDKPPEGKHSTKGLGKKMPLESEYAKWRGDVTVPCGKPVPSNVKSSELMYNEYIVYNTAQVKMQFLLKVRFHHKR

SEQ ID NO: 20355 - protein, 1002 aa, Phaseolus vulgaris
MSNPQDQKPWKAEYAKSGRSSCRTCKNPIATESLRLGKMVKSFKFDGIMPMWNHAACVLEKANQIKLVDDVENLESLRWEDQQNIRKYIESGGSSSTATKSGSKDVKETECAIEVSQTSRATCRDCSQKIIKGEVRISTKPDGSGARGLAWHHAKCLMELSPSIQVDKLSGWNSLSSSDQSAVSDFANKGHPMNKGGVSGTNIETEKGEESTQLHTSRGGIKRGKDADSERKSKVAKVKGDVSASSAVSVKNYNETGEACDLEKKMEIQSKEIWALKDDLKKNVTTPELREMLEANDQDSTGSELDLRDRCADGMMFGALGLCPICSGFLRHSGGMYRCNGYISEWSKCSYSTCESKRVEGKWKIPEETKNQYLKKWFKSQKGKKPVRILPLPSPRKSAESQITASQHQSSHSENFRDIKVAICGLANDTIKEWKSKISAMGGMFHAKVKKDTNCLVVGGVLNDEAEMGKARRMKIPIVREDYLIDCIQRKKRLPFDMYKVEMIGEASSMVTIKVKGQSAVHEASGLQESGHILVEGKSIYNTTLNMSDLSTGINSYYILQIIQEDKGSDCSVFRKWGRVGNDKIGGSKLVNEMSKSDAICEFKRLFFVKTGNPWEAWEQKTIQKQPGRFFPLDIDYGVNKQMSKKKRNDNDSKLPVPLIELIKMLFNVETYRSAMMEFEINMSEMPLGKLSKSNIQKGFEALTEIQNLLKTTSPDPSVKESLLINASNRFFTMIPSIHPHIIRDEDDFKSKVKMLEALQDIEIASRLVGFDANNEDSIDDSYKKLHCDISPLPHDSEDFCLIEKFLHNTHAPTHTDWSLELEEVFSLEREGEFDKFAPYRDKLGNRMLLWHGSRLTNFVGILSQGLRIAPPEAPATGYMFGKGVYFADLVSKSAQYCFTDKKNPIGLMLLSEVALGNIYELKKAKYMDKPPEGKHSTKGLGKKMPQESECAKWRGNVTVPCGKPVPSNVKASELMYNEYIVYNTAQVKMQFLLKVRFHHKR

SEQ ID NO: 20356 - protein, 1011 aa, Cicer arietinum
MSNPQSQKPWKAEYAKSGRSSCRSCKTPIATEKLRLGKMVQSSKFDGLMPMWNHAECILKKPKQIKSVDDVENLESLRWEDQQNIRKYIESSGGGSGGGSGGGTTKSNTPAKSNAGKNVEYGIEVSQTSRATCKPCGQKIIKGEVRISTKPDGQGPRGLAWHHAKCLLELSPSIEVDSLSGWNSLSSSDQSALSDLVMKGRPTNKGGGSGTKVEVEEVKESTKQSSSKGGTKRGKEAEGEQKSKAAKVKGDVSVGRVAAMKNADDSGEASDLEKRLEAQSKELWDLKDDLKKHVTTAELREMLETNGQDSTGSELDLRDRCADGMMFGGLSHCSLCSGFLRYSGGMYRCTGFISEWSKCSNSTCEPKRTEGKWRIPKETDNQYLKKWFKSQKGKKPIRIMPPPSSRTSAESQISAGQHQSSHSESLADLKVAISGLPKDSFEDWKRKIDGVGGVLHAKVKKDTNCLVVSGALKDEAEMRKARRMKIPIVREDYLVDCMERKKKLPFDMYKVEMIGEASSMVTIKVKGHSAVHDASGLQDSGHILEEGKSIYNTTLNMSDLSTGVNSYYILQIIEEDKGSDCYVFRKWGRVGNEKIGGFKLEEMSKSDAIREFKRLFFEKTGNPWEAWEQKTIQKQPGRFFPLEIDYGVNKQVSKKNKNNADSKLPPPLIELMKILFNVETYRAAMMEFEINMSEMPLGKLSKSNIQKGFEALTDIQNLFKISNPDPSARESLLIDASNRFFTMIPSIHPHIIRDEDDFKSKVKMLEALQDIEIASRLVGFDANNDDSIDDNYKKLHCGISPLPHDSEDFRLVEKYLHTTHAPTHVDWSLELEEVFSLEREGEFDKFAPYRDKLGNRMLLWHGSRLTNFVGILNQGLRIAPPEAPATGYMFGKGIYFADLVSKSAQYCYTDKKNPVGLMLLSEVALGNVYELKKAKYMDKPPEGKHSTKGLGKKMPLESEYVKWRGDVVVPCGKPVSSNVKASELMYNEFIVYNTAQVKLQFLLKVRFHHKK

SEQ ID NO: 20357 - protein, 1006 aa, Medicago truncatula
MSNPQNAKPWKAEYAKSGRSSCRSCKSPIATEKLRLGKMVQSSKFDGLMPMWNHAECILKKANQIKLVDDVENLESLRWEDQQKIRKYIESGGGGGSGTPKSNAASKSTAGKNIEYGIEVSQTSRATCKHCGQKIIKGEIRISTKPDGQGARGLAWHHAKCLLELSPSIEVDNLPGWNSLSSSDQSAVSELATKDHPTNRGGGSGTNVEAEDVKESTQQSSSKGGTKRGKDAEGEQKSKAAKVKGDVSASRVAAVKNADDSGAARDLENRLEAQSKDLWALKDDLKKHVTTAEMREMLDANGQDSTGSELDLRDRCADGMMFGGLSPCSLCDGFLRYSGGMYRCTGYISEWSKCSYSTCEPKRAQGKWKIPKETDNQYLKKWFKSQKGKKPTRILPPPSSRTSAESQISAGQHQPSNSETLADLRVAISGLPEDSIVEWKRKIDAVGGVLHAKVKKDTNCLVVSGALKDEVEMRKARRMKIPIVREDYLVDCMERKKKLPFDMYKVEMIGEASSMVTIKVKGQSAVHDASGLQDSGHILEEGKSIYNTTLNMSDLSTGINSYYILQIIEEDNGSDCYVFRKWGRVGNDKIGGNKLEEMSKSDAIREFKRLFFEKTGNPWEAWEQKTIQKQPGRFFPLEIDYGVNKQVVKKSKNNADSKLPPPLIELIKMLFNVETYRSAMMEFEINMSEMPLGKLSKSNIQKGFEALTDIQNLFKSSNADPSVRDSLLIDASNRFFTVIPSIHPHIIRDEDDFKSKVKMLEALQDIEIASRLVGFDANNDDSIDDNYKKLHCDISPLPHDSEDFRLVEKFLHTTHAPTHTDWSLELEEVFSLEREGEFDKYAPYRDKVGNRMLLWHGSRLTNFVGILNQGLRIAPPEAPATGYMFGKGIYFADLVSKSAQYCFTDKKNPVGLMLLSEVALGNVYELKKAKYMDKPPQGKHSTKGLGKKMPLESEYAKWRDDVVVPCGKPVSSNVKASELMYNEYIVYNTAQVKLQFLLKVRFHHKR

SEQ ID NO: 20358 - protein, 1002 aa, Lupinus angustifolius
MANLQNQKPWKAEYAKSGRSSCRTCKSPIASEDLRLGKMVQSTKFDGLMPMWHHATCILKKANQIKETDDVENLELLRWEDQQKIRKYIEDGGGSSAPSKSKATKDGGSAPPKSNATKDAECGIEVSQTSRATCRDCGQKIIKGEVRISIKPDGQGARGLAWHHAKCLMELSPSIQVDKLSGWDSLSPSDQSSVSDLAKKGGSSATNVEAEEVKESTSKGGMKRGKDADGGQKSKVAKAEGDVAASRTASVKNANDSEEARDLESRLETQSIELWALKDELKKHVTNAEMREMLEANDQDSSGSELDLRDRCADGMMFGGLGHCPICASFLRYSGGMYRCTGFSSEWSKCSYSTTEPKRLEGKWKIPVETTNEFLKKWFKSQKGKKPVRVLPLQSPKKPVDGQTSASQHQSSNSESLRDLKISICGLPKDSIVEWKRKIDDIGAVFHAKVKKDTNCLVVSGTLNDEAEMRKARRMKIPIVREDYLVDCIEKKKKLPFDMYKVEMIGESSSMVTIKVKGQSAVHDASGLADSGHILEEGKSIYNTTLNMSDLSTGVNSYYVLQIIEEDKGSDCYVFRKWGRVGNDKIGGSKLDGMPKSDAIHEFKRLFFEKTANPWEAWEQKTIKKQPGRFFPLDIDYGVNKQVSKKKSNNEDSKLAPPLIELMKMLFNVETYRAAMMEFEINMSEMPLGKLSKSNIQKGFEALTDIQNLLKTDNPDPSMLESLLIDASNRFFTMIPSIHPHIIRDEDDFKSKVKMLEALQDIEIASRLVGFDANNDDSIDDNYKKLNCDISPLPHDSEDYRLIEKFLHNTHAPTHTEWSLELEEVFALEREGEFDMFVPYREKLGNRMLLWHGSRMTNFVGILSQGLRIAPPEAPATGYMFGKGVYFADLVSKSAQYCFTDKKNPVGLMLLSEVALGNVYELNKAKYMDKPPRGKHSTKGLGKKVPNESEYAKWKGDVTVPCGKPVPSSVKASELMYNEYIVYNTAQVKMQFLLKVRFHHKR

SEQ ID NO: 20359 - protein, 1003 aa, Trifolium pratense
MSNPQNQKPWKAEYAKSGRSSCRTCKIPIASENLRLGKMVQSSKFDGLMPMWNHAECILKKGNQIKSVDDVENLESLRWDDQQKIRKYIESGGGGSGGTPKSNAASKSTASKNIEYGIEVSQTSRATCKHCGQKIIKGEVRISAKPEGQGARGLAWHHAKCLLELSPSIQVNNLSGWNSLSSSDQSAVSGLDRKGHPTNKGGGSSSNVEVEESTAQPSSKGGTKRGKEAEGEQKSKAAKVKGDVSVSRVAAGKNADDSGEARDLENRLETQSKDLWALKDDLKKHVTTTELREMLDANGQGSTGSELDLRDHCADGMMFGGLGHCPLCSGSLRYSGGMYRCTGYISEWSKCSYSTCEPKRTEGKWKIPKETDNQYLKNWFKSQKGKKPVRLLPPPSSRTSAESQISAGQHQPSNSESLSDLKVAISGLPKESIEEWKHKIDAIGGVLHAKVKKDTDCLVVSGALKDEAEMRKARRMKVPIVREDYLVDCMERKKKLPFDLYKVEMIGEASSMVTIKVKGQSSVHDASGLQDSGHILEDGKSIYNTTLNMSDLSTGINSYYILQIIEEDKGSDCYVFRKWGRVGNDKIGGSKLEEMSKSDAIREFKRLFLEKTGNPWEAWEQRTIQKQPGRFFPLEIDYGVNRQVPKKNRNNAVSKLPPPLIELIKMLFNVETYRSAMMEFEINMSEMPLGKLSKSNIQKGFEALTDIQNLFRSSNHDPSLRDSLLIDASNRFFTMIPSIHPHIIRDEDDFKSKVKMLEALQDIEIASRLVGFNANSDDSIDDNYKKLHCGISPLPHDSEDFRLVEKYLQNTHAPTHMDWSLELEEVFSLEREGEFDKYAPYRDKVGNRMLLWHGSRLTNFVGILNQGLRIAPPEAPATGYMFGKGIYFADLVSKSAQYCFTDKKNPVGLMLLSEVALGNVYELKKATYMDKPPQGKHSTKGLGKKMPLESEYVKWRDDVVVPCGKPVSSNVKASELMYNEYIVYNTAQVKLQFLLKVRFHHKK

SEQ ID NO: 20360 - protein, 1003 aa, Trifolium pratense
MSNPQNQKPWKAEYAKSGRSSCRTCKIPIASESLRLGKMVQSSKFDGLMPMWNHAQCILKKANQIKSVDDVENIESLRWDDQQKIRKYIESGGGSGGGTPKSNAASKSNASKNIEYGIEVSQTSRATCKHCGQKIIKGEVRISAKPDGQGARGLAWHHAKCLLELSPSIQVNNLSGWDSLSSSDQSVVGDLARKGHPTSKEGGSSSNVKVEESTLQPSSKGGTKRGKDAEGEQKSKAAKIKGDVSVGRVAAGKNADDSGETRDFENRLETQSKDLWALKDDLKKHVTTTELREMLDANRQGSTGSELDLRDRCADGMMFGGLSHCPLCSGFLRYSGGMYRCTGYISEWSKCSYSTCEPKRTEGKWKIPKETDNQYLKKWFNSQKGKKPIRLLPPASSRTSAESQISAGQHQPSNSESLSDLKVAISGLPKESIEEWKHKIDAIGGVLHAKVKKDTDCLVVSGALKDEAEMRKARRMKVPIVREDYLVDCMERKKKLPFDLYKVEMIGEASSMVTIKVKGQSSVHDASGLQDSGHILEDGKSIYNTTLNMSDLSTGINSYYILQIIEEDKGSDCYVFRKWGRVGNDKIGGSKLEEMSKSDAIREFKRLFSEKTGNPWEAWEQRTIQKQPGRFFPLEIDYGVNRQVSKKNRNNADSKLPPPLIELIKMLFNVETYRSAMMEFEINMSEMPLGKLSKSNIQKGFEALTDIQNLFKSSNPDPSLRDSLLIDASNRFFTMIPSIHPHIIRDEDDFKSKVKMLEALQDIEIASRLVGFDANNDDSIDDNYKKLHCDISPLPHDSEDFRLVEKYLHTTHAPTHTDWSLELEEVFSLEREGEFDKYAPYRDKVGNRMLLWHGSRLTNFVGILNQGLRIAPPEAPATGYMFGKGIYFADLVSKSAQYCFTDKKNPVGLMLLSEVALGNVYELKKATYMDQPPQGKHSTKGLGKKMPLESEYVKWRDDVVVPCGKPVSSNVKASELMYNEYIVYNTAQVKLQFLLKVRFHHKK

SEQ ID NO: 20361 - protein, 997 aa, Trifolium pratense
MSNPQNQKPWKAEYAKSGRSSCRTCKIPIASESLRLGKMVQSSKFDGLMPMWNHAQCILKKASQIKSVDDVENIESLRWDDQQKIRKYIESGGGGTPKSNAASKSNASKNIEYGIEVSQTSRATCKHCGQKIIKGEVRISAKPDGQGARGLAWHHAKCLLELSPSIQVNNLSGWDSLSSSDQSVVGDLARKGHPTGGSSSNVKVEESTLQPSSKGGTKRGKDAEGEQKSKAAKIKGDVSVGRVAAGKNADDSGEARDFENRLETQSKDLWALKDDLKKHVTTTELREMLDANRQGSTGSELDLRDRCADGMMFGGLSHCPLCSGFLRYSGGMYRCTGYISEWSKCSYSTCEPKRTEGKWKIPKETDNQYLKKWFNSQKGKKPIRLLPPASSRTSAESQISAGQHQPSNSESLSDLKVAISGLPKESIEEWKHKIDAIGGVLHAKVKKDTDCLVVSGALKDEAEMRKARRMKVPIVREDYLVDCMERKKKLPFDLYKVEMIGEASSMVTIKVKGQSSVHDASGLQDSGHILEDGKSIYNTTLNMSDLSTGINSYYILQIIEEDKGSDCYVFRKWGRVGNDKIGGSKLEEMSKSDAIREFKRLFSEKTGNPWEAWEQRTIQKQPGRFFPLEIDYGVNRQVSKKNRNNTDSKLPPPLIELIKMLFNVETYRSAMMEFEINMSEMPLGKLSKSNIQKGFEALTDIQNLFKSSNPDPSLRDSLLIDASNRFFTMIPSIHPHIIRDEDDFKSKVKMLEALQDIEIASRLVGFDANNDDSIDDNYKKLHCDISPLPHDSEDFRLVEKYLHTTHAPTHTDWSLELEEVFSLEREGEFDKYAPYRDKVGNRMLLWHGSRLTNFVGILNQGLRIAPPEAPATGYMFGKGIYFADLVSKSAQYCFTDKKNPVGLMLLSEVALGNVYELKKAKYIDQPPQGKHSTKGLGKKMPLESEYVKWRDDVVVPCGKPVSSNVKASELMYNEYIVYNTAQVKLQFLLKVRFHHKK

SEQ ID NO: 20362 - protein, 1003 aa, Trifolium pratense
MSNPQNQKPWKAEYAKSGRSSCRTCKIPIASESLRLGKMVQSSKFDGLMPMWNHAQCILKKANQIKSVDDVENIESLRWDDQQKIRKYIESGGGSGGGTPKSNAASKSNASKNIEYGIEVSQTSRATCKHCGQKIIKGEVRISAKPDGQGARGLAWHHAKCLLELSPSIQVNNLSGWDSLSSSDQSVVGDLARKGHPTSKEGGSSSNVEVEESRPQSSSKGGTKRGKDAEGEQKSKAAKIKGDVSVGRVATGKNADDSGETRDFENRLEIQSKDLWALKDDLKKHVTTAELREMLDANGQGSTGSELDLRDRCADGMMFGGLSRCPLCSGFLRYSGGMYRCTGYISEWSKCSYSTCEPKRTEGKWKIPKETDNQYLKKWFNSQKGKKPIRLLPPASSRTSAESQISAGQHQPSNSESLSDLKVAISGLPKESIEEWKHKIDAIGGVLHAKVKKDTDCLVVSGALKDEAEMRKARRMKVPIVREDYLVDCMERKKKLPFDLYKVEMIGEASSMVTIKVKGQSSVHDASGLQDSGHILEDGKSIYNTTLNMSDLSTGINSYYILQIIEEDKGSDCYVFRKWGRVGNDKIGGSKLEEMSKSDAIREFKRLFSEKTGNPWEAWEQRTIQKQPGRFFPLEIDYGVNRQVSKKNRNNADSKLPPPLIELIKMLFNVETYRSAMMEFEINMSEMPLGKLSKSNIQKGFEALTDIQNLFKSSNPDPSLRDSLLIDASNRFFTMIPSIHPHIIRDEDDFKSKVKMLEALQDIEIASRLVGFDANNDDSIDDNYKKLHCDISPLPHDSEDFRLVEKYLHTTHAPTHTDWSLELEEVFSLEREGEFDKYAPYRDKVGNRMLLWHGSRLTNFVGILNQGLRIAPPEAPATGYMFGKGIYFADLVSKSAQYCFTDKKNPVGLMLLSEVALGNVYELKKAKYIDQPPQGKHSTKGLGKKMPLESEYVKWRDDVVVPCGKPVSSNVKASELMYNEYIVYNTAQVKLQFLLKVRFHHKK

SEQ ID NO: 20363 - protein, 450 aa, Glycine max
MSASRAPPAANPPDQIMHSMKRQLPFSSMKPPFVAAGDYHRHDAAEAIVVKTPLLKRKSEVADFEADSGDRMTAGFTEAANSPFQTPVSGKTGKGGKSSRLTKGNRVGTQTPGSNIGSPAGSNLTPAGPCRYDSSLGLLTKKFINLIKQAEDGILDLNKAADTLEVQKRRIYDITNVLEGIGLIEKKLKNRIQWKGLDVSRPGEADDSFASLQAEVENLTMKERQLDEQIREMQERLRDLSEDENNDKLLFVTEEDIKNLPCFQNETLIAIKAPHGTTLEVPDPDEAVDYLQRRYRIVLRSTMGPIDLYLVSQFEEKFEEINGADVAPKLPSSPDVTKQQSTVVPEDRGKHIEVQGQAAPGPSSDFTPSQDFVSGIMKIVPSDVASEADYWLLSDADVSITDMWRTEPGVEWNELEPLQEDYCMTDENTTTPSHPSNVGEVSSASKPTGG

SEQ ID NO: 20364 - protein, 463 aa, Cajanus cajan
MSASRAPPAAAATNPSDQIMHSMKRQLPFSSMKPPFLAAGDYHRFAPDHRRALDQEPEAIVVKTPQLKRKSEVADFEADSGDRMTPGSAEAANSPFQTPVSGKMGKGGKSSRLTKCNRPGAQTSGSNIGSPAGNNLTPAGPCRYDSSLGLLTKKFINLIKQAEDGILDLNKAADTLEVQKRRIYDITNVLEGIGLIEKKLKNRIQWKGLDVSRPGEADDSFASLQAEVENLTMEEHRLDEQIREMQERLRDLSEDENNEKLLFVTEEDIKNLPCFQNETLIAIKAPHGTTLEVPDPDEAVDYPQRRYRIVLRSTMGPIDVYLVSQFEEKFEEINGVDISPKLPSSPDVNKHQSTMVPEDRGKDIEVQGQEVQGPSSDFAASQDFVSGIMKIVPSDVASESDYWLLSEAEVCITDMWRTEPEVEWNELDPLQGDCCITRENTTTPSQPSNVAEVSSAPKPTVGG

SEQ ID NO: 20365 - protein, 474 aa, Glycine max
MSASRAPPAANPPDQIMHSMKRQLPFSSMKPPFVAAGDYHRHDAAEAIVVKTPLLKRKSEVADFEADSGDRMTAGFTEAANSPFQTPVSGKTGKGGKSSRLTKGNRVGTQTPGSNIGSPAGSNLTPAGPCRYDSSLGLLTKKFINLIKQAEDGILDLNKAADTLEVNIISSAQMIPCCKVLLFSFRYPQVQKRRIYDITNVLEGIGLIEKKLKNRIQWKGLDVSRPGEADDSFASLQAEVENLTMKERQLDEQIREMQERLRDLSEDENNDKLLFVTEEDIKNLPCFQNETLIAIKAPHGTTLEVPDPDEAVDYLQRRYRIVLRSTMGPIDLYLVSQFEEKFEEINGADVAPKLPSSPDVTKQQSTVVPEDRGKHIEVQGQAAPGPSSDFTPSQDFVSGIMKIVPSDVASEADYWLLSDADVSITDMWRTEPGVEWNELEPLQEDYCMTDENTTTPSHPSNVGEVSSASKPTGG

SEQ ID NO: 20366 - protein, 462 aa, Cicer arietinum
MSANRAPPAASSSNPPDQIMQSMKRQLPFSSMKPPFVASGDYHRFGPNNRRNLDQETEAIVVKTPQLKRKSETADFEADSGDRMTPESTEAANSPSQTPASGKTGKAGKSSRLTKCNRSGTQTPGSNIGSPPGNNLTPAGPCRYDSSLGLLTKKFIHLIKQAEDGILDLNKAADTLEVQKRRIYDITNVLEGIGLIEKKLKNRIQWKGLDVSKPGEADDSFASLQAEVENLTIEERRLDEQIREMQERLRELSEDENNEKLLFVTEEDIKNLPCFQNETLIAIKAPHGTTLEVPDPDEAVDYPQRRYRIVLRSTMGPIDVYLVSQFEEKFEEINGVDVAPKFPSSPEVDKQQSTLVPEDKGKEVEVQGQDGEGPSSDFTNSHDFVSGIMKIVPSDVASDADYWLLSDADVSITDMWRTEPTVEWNELNKLQEDYCTAPEHTTTPSHPSNIGEVSSASNPPDG

SEQ ID NO: 20367 - protein, 464 aa, Trifolium pratense
MSGNRAPPSTAAPSNSSDQIMQSMKRQLPFSSMKPPFVASGDYHRFAPDHRRNLDHETEAIVVKTPPLKRKSEAADSEADSGDRMTPGSTQAANSPFQTPVSGKMGKGGKSSRLTKFNRSGTQTPGSNIGSPSGNNLTPAGPCRYDSSLGLLTKKFINLIKQAEDGILDLNNAADTLEVQKRRIYDITNVLEGIGLIEKKLKNRIQWKGLDVSKPGEADDSFASLQAEIENLTMEERRLDEQIREMQEKLRDLSEDENNEKLLFVTEEDIKNLPCFQNETLIAIKAPHGTTLEVPDPDEAVDYPQRRYRIVLRSTMGPIDVYLVSQFEEKFEEINGVDVAPKIPSSLEVNMHLSTTVVPEDKGKEIEVQAQDGEGPSSDPTNSHDFVSGIMKIVPSDVASDADYWLLSDADVSITDMWRTEPGVEWNELDALQEDFCMAREHPTTPNHASNIGEASSASNPTEG

SEQ ID NO: 20368 - protein, 460 aa, Trifolium pratense
MSGNRAPPPAASPSPDQIMQSMKRQLPFSSMKPPFLASSDYHRFAPDHRRNLDQETEAIVVKTPPLKRKSEAADLEADSGDRMTPGSTQAANSPFQTPVSGKMGKGGKSSRLTKANRSGTQTAGSNIGSPSGNNLTPAGPCRYDSSLGLLTKKFINLIKQAEDGILDLNNAADTLEVQKRRIYDITNVLEGIGLIEKKLKNRIQWKGLDVSKPGEADDSFASLQAEIENLTMEERRLDEEIREMQEKLRDLSEDENNEKLLFVTEDDIKNLPCFQNETLIAIKAPHGTTLEVPDPDEAVDYPQRRYRIVLRSTMGPIDVYLVSQFEEKFEEINGVDVAPKVPSSLEVNMHQSTVVPEDKGKEIEVQPQDEGPSSDPTNSHDFVSGIMKIVPSDVATDADYWLLSDAGVSITDMWRTEPGVEWNELNSFQEDFCMAREHTTTPNNASNIGEVSSTSNPTVG

SEQ ID NO: 20369 - protein, 460 aa, Medicago truncatula
MSGTRTPPATAAPDQIMQQRQLPFSSMKPPFLAAADYHRFAPDHRRNQDLETEAIVVKTPQLKRKSEAADFEADSGDRMTPGSTAAANSSVQTPVSGKAGKGGKSSRMTKCNRSGTQTPGSNIGSPSGNNLTPAGPCRYDSSLGLLTKKFIALIKQAEDGILDLNNAADTLEVQKRRIYDITNVLEGIGLIEKKLKNRIQWKGLDVSKPGEADDSFASLQAEIENLTIEERRLDEQIREMQERLRNLSEDENNEKFLFVTEEDIKNLPCFQNETLIAIKAPHGTTLEVPDPDEAVDYPQRRYRIVLRSTMGPIDVYLVSQFEEKFEEINGVDVASKFPPSPEVNKVNKDQSTVVPEDKGKEIEVQRQDGEGPSSDLNNNHDFVSGIMKIVPSDVASDADYWLLSDADVSITDMWRTEPGVEWNELEALQEEYCMAREQSTTPNHASNIGEVPSASNPTVG

SEQ ID NO: 20370 - protein, 609 aa, Glycine max
MDLGVVGLEGVVGSESGCVFGSSLASDPETKHKWYGSGLLKQERSAIATEDDEWRISKVAKTDHDMSSASKAMFFQQRNNSLLRSNNATLFSDGHHQSQMLNFSSPKSETLLVDKAFSNATLPFSYHQLSSYSRNTGYNSGSISMHGALASVRGPFTPSQWMELEHQALIYKYITANVPVPTHLLIPIRKALDSVGFCNFSSGLLRSNSLGWGGFHLGFSNSTDPEPGRCRRTDGKKWRCSRDAVVDQKYCERHMNRGRHRSRKPVEGQSGHALTTTNTPNASSNSTVVPGNHNNNTFAHINVHHPLPPHSSPANTINRMFMSNNKENNNTSERMKDGLALPMLPPTLELKPKDNNNSFMVHKHQEPYDESSRNKNEFGLVTSDSLLNPSQKRSFDSSSSSSQKDDSSESQQQHSLRHFIDDSPKPQSHHNHNHRSSSSIWPELDNMQSDRTQLSISIPISSSDHFMSFATSSPSNEKLTLSPLRLSREFDPIQMGLGVGSASNEANTRQANWIPITWESSMGGPLGEVLNLSNNNNNSNASDQCGKNNNNTSALNLMKDDDDDDGWDNSPPPIGSSPTGVLQKTAFGSLSNSSAGSSPRGAPENNNKE

SEQ ID NO: 20371 - protein, 599 aa, Glycine max
MDLGVVGLEGVVGSESCCVFGSSLASDPETKHKWYGSGVLKQERSAIASEDDEWRTSKVAKTDHDMSSASKAMLFQQRNNSLLRSNATLFSDGHHHQSQMLSFSSPKSESLLVDKASSNATLPFSYHQLSSNTRNAGYSSGSISMHGALAGVRGPFTPSQWMELEHQALIYKYITSNVPVPTHLIPIRKALDSLGFCNFSTGLLRPNALGWGGFHLGFSNNTDPEPGRCRRTDGKKWRCSRDAVVDQKYCERHMNRGRHRSRKPVEGQLGHALTTTTTTNTPNASSNSTVVPRNTTTTTTFAHNNVHHPLPPHSSQANTINRMFTSNKENNSTSERLQDPALPMLPPTLELKPKENNPFMIHKHHIPADEYSRNSNEFGLVTSDSLLNPTQKRSFTSSQKDDSESQQQHSLRHFIDDSPKPQSHNHHHHHHSSSIWPELDSMQSDRTQLSISIPISSSDFMSFTTSSPSNEKLTLSPLGHSRELDPIQMELGMGSGASNEANTRQANWIPITWESSMGGPLGEVLNLSNNSNASDQCGKNNNTSALNLMKDGWDNNPPLGSSPTGVLQKSAFGSLSNSSAGSSPRAENNKEGATLCNAL

SEQ ID NO: 20372 - protein, 600 aa, Glycine max
MDLGVVGLEGVVGSESGCVFGSSLVSDPETKHKWYGSGLLKQERSAIATEDDEWRISKVAKTDHDMSSASKAMLFQQRNNSLLRSNNATLFSDGHHQSQMLSFSSPKSDSLLIDKASSNATLPFSSHQLSSYTRNTGYNSGSISMHGALASVRGPFTPSQWMELEHQALIYKYITANVPVPTHLLIPIRKALDSVGFCNFSAGLLRPNSLGWGGFHLGFSNNTDPEPGRCRRTDGKKWRCSRDAVVDQKYCERHMNRGRHRSRKPVEGQSGHALTTTTSNTPNASSNSVVPGNNNNTFAHNNVHHPIPPHSSPVNTITRMFTSNKENNNSTSERMQDPALPMLPPTLELKPKENNPFMIHKHQIPSDEYSSRNNNEFGLVTSDSLLNPSEKRSFTSSQKNDSSESQQQHSLRHFIDDSPKPQSNHHHRSSSIWPELDNMQSDRTQLSISIPISSSDHFMSFTTSLPSNEKLTLSPLRLSRELDPIQMGLGVGSAPNEANTRQANWIPITWESSMGGPLGEVLNLSNNNNSNASDQCGKNNNNTSALNLMKDGWDNNPPSGSSPTGVLQKSAFGSLSNSSAGSSPRGAENNKEGATLCNAL

SEQ ID NO: 20373 - protein, 608 aa, Phaseolus vulgaris
MDLGVVGLEGLVGSDSSCAFGSSLASDPETKHKWYGSGVLKQERSGAASEDEWRTSKVPKTDDNMSAASKAMLFHQRNSLLRSNVTLFSEGHNQPQMLSFSSPKSEPLLVDKASLNATLPFSYHQLSSYSRNTGYSSGSISMHGALSGMRGPFTPSQWMELEHQALIYKYITANVPVPTHLLIPIRKALDSAAFCNFSTGLLRPNTLGWGGFHLGFSNNTDPEPGRCRRTDGKKWRCSRDAVVDQKYCERHMNRGRHRSRKPVEGQSGHALTTTTTTTTTTTPPNASSNSIVVPGNNNNNNTFAHNNVHHPLPSHSSSANTINRMFMSNKENNNNASERMQDGPALPMVPPTLELKPKDPFMIHKHQLPYDESSSRNNNEFGLVTSDSLLNPSQKRSFGSSSSQKDDSESQQQHHPLRHFIDDSPKPQSHHHHHRSSVWPELDNMQSDRTQLSISIPISSSDFMSFATSSPSNEKLTLSPLRLSRELDPIQMGLGVGSGAPNESNTRQANWIPITWESSMGGPLGEVLNLSSSNNNSNGSDHCGKNTSALNLMKDGWDNSPPLGSSPNGVLQKTAFGSLSNSSAGSSPRADNNNNKESASATTLCNAL

SEQ ID NO: 20374 - protein, 546 aa, Glycine max
MGKKGSGSSWLTAVKRAFRSPTKDSDKRSGRRREDCDQEEDEEKKREKRRWIFRKTHMSHEGGNNNNNTQQKLKHDVAASGGGSRTDQDQKHAVAVAVATAEAAMATAQAAVEVARLSKPASHAREHYAAVVIQTAFRGYLARRALRALKGLVKLQALVRGHNVRKQAKMTLRCMQALVRVQARVLDQRIRSSLEGSRKSTFSDTASVWDSRYLQDISDRKSISREGSSITDDWDERHHTVEEVKAMLMQRKEAAAMKRDKTLSQAFSQQIWRNGRTSSIGNEDELEERPKWLDRWMATKPWENRGRASTDQRDHIKTVEIDTSQPYSYLGTNYRRSHPNYQYNPNHHQPQRHSIASPLHRSHQNGSSLHQSPATPSPAKSRPIQVRSASPRCIRDDRSYHTSQTPSLRSNYHYAGNLYQNGRVVGTGTSNGGATATLPNYMAATESAKARIRSQSAPRQRPSTPERDRVGSAKKRLSFPAPDPYGVGVSYGNYGHSLRSPSFKSVSGSHFGGLEQQSNYSSCCTESIGGGQVSPSSTGDLRRWLR

SEQ ID NO: 20375 - protein, 546 aa, Phaseolus vulgaris
MGKKGSGSSWLTAVKRAFRSPTKDTDKRSGRRREDCDQEEDEEKKREKRRWIFRKTHMSHEGVSSGHNTQQKLKHDVTATTEGSRTDQDQKHALAVAVATAEAAMATAQVAVEVARLTKPASHAREHYAAVVIQTAFRGYLAKRALRALKGLVKLQALVRGHNVRKQAKMTLRCMQALVRVQARVLDQRIRSSLDGSRKSTFSDTASVWDSRYLQDISDRKSISREGSSIADDWDERPHTVEEVKAMLQQRKEAAMKRDKTLSQAFSQQIWRNGRTSSIGNEDELEERPKWLDRWMATKPWENRGRASTDQRDPIKTVEIDTSQPYSYLGTNYRRSHPNYQYNPNHHQPQRHSIASPLHRSHQNGSLHQSPATPSPAKSRPIQVRSASPRCIREDRNYPTSQTPSLRSNYHYTGNLYQNGRAVGSGTSSGGGGGGGATLPNYMAATESAKARIRSQSAPRQRPSTPERDRVGSAKKRLSFPAPDPYSVGVSYGNYGHSLRSPSFKSVSGSHFGLEQQSNYSSCCTESLGGGEVSPSSTGDLRRWLR

SEQ ID NO: 20376 - protein, 549 aa, Cicer arietinum
MGKKGSSSWLNAVKRAFRSPTKDSDKKSGRRREDCDQEEDEEKKREKRRWIFRKPVSHETVNNNSAQSTTTPTKLKNDVVVTATSGVSRTDQDQKHALAVAMATAEAARATAQAAVEVARLTKPSNHAREHFAAVVIQTSFRGYLARRALRALKGLVKLQALVRGHNVRKQAKMTLRCMQALVRVQARVLDQRVRSSSHEGSRKSTFSDTTSVWDSRYLQDISDRKSMSREGSSVADDWDERPHTVEEVKAMLQQRKEAAMKREKSLSQAFSQQIWRNGRTSSIGNEDELEERPKWLDRWMATKPWENRGRASTDQRDPIKTVEIDTSQPYSYLGTNYRRSHPNYQYNPHHQPQRHSIASPLHRTHQNGSIHQSVTTPSPSKSRPIQVRSSSPRCVREDRSYHTSQTPSLRSNYHYNGNLYQNSRVGTSNSAATTAATTTLPNYMQATESAKARIRSQSAPRQRPSTPERDRAGSVKKRLSFPAPDPYNVGGVSYGNYGHSLRSPSFKSVNVVSHFGLEQQSNYSSCCTESLGGEVSPSSTGDLRRWLR

SEQ ID NO: 20377 - protein, 507 aa, Cajanus cajan
MGKKGSGSSWLTAVKRAFRSPTKDTDKRSGRRREDCDQEEDEEKKREKRRWIFRKTHMSHEGVNNNTQQKLKHDAAVEVARLTKPASHVGEHRAAVTIQTAFRGYLARRALRALKGLVKLQALVRGHNVRKQAKMTLRCMQALVRVQARVLDQRIRSSLEGSRKSTFSDTASVWDSRYLQDISDRKSMSREGSSIADDWDERPHTVEEVKAMLQQRKEAAMKRDKNLSHAFSQQIWRNGRTSSIGNEDELEERPKWLDRWMATKPWENRGRASTDQRDPIKTVEIDTSQPYSYLATNYRRSHPNYQYNPHHHQPQRHSIASPIHRSHQNGSLQSPATPSPAKSRPIQIRSASPRCIREDRSYHTSQTPSLRSNYHYTGSLYQNGRVGTSSGSGNGGGATLPNYMAATESAKARIRSQSAPRQRPSTPERDRVGSAKKRLSFPAPDPYSVGASYGNYGHSLRSPSFKSVSGSHFGLEHQSNYSSCCTESIGGGEVSPSSTGDLRRWLR

SEQ ID NO: 20378 - protein, 552 aa, Medicago truncatula
MGKKGSSSWLTAVKRAFRSPTKDSEKRSGRRREDCDQEEDEEKKREKRRWIFRKPVNHETVNNTQQSTPTKLKHDVVTATSVASRTDQDEKHALAVAMATAEAARATAQAAVEVARLTKSSNHAREHYAAVVIQTSFRGYLARRALRALKGLVKLQALVRGHNVRKQAKMTLRCMQALVRVQARVLDQRIRSTSHEGSRKSTFSDTASVWDSRYLQDISDRKSLSREGSSIADDWDDRPHTVEEVKAMLQQRKEAAMKREKSLSQAFSQQIWRNGRTSSIGNEDELEERPKWLDRWMATKPWENRGRASTDQRDSIKTVEVDTSQPYSYLGANYRRSHPNYQYNPHHQPQRHSIASPLHRSHQNGSVHNQSTTTPSPAKSRPIQVRSSSPRCVREDRSYHHTSQTPSLRSNYHYNGNLYQNSRGGTSNGSTNSIASTTASATLPNYMQATESAKARIRSQSAPRQRPSTPERDRSGSVKKRLSFPAPDPYNVGGVGYGNYGHSLRSPSFKSVNVAASHYGLEQNSNYSSCCTESLGGEVSPSSTGDLRRWLR

SEQ ID NO: 20379 - protein, 539 aa, Lupinus angustifolius
MGKKGSSSWLTAVKRAFRSPTKDSDKSSRRREDYDHEEDEEKKREKRRWIFRKNHETVNTQQTPTKLKHDVATTTNTSVTSRTDQDQNHALAMAVATAEAAMATAQAAVEVARLTKPISTTNHHARDHFAAIVIQTAFRGYLARRALRALKGLVKLQALVRGHNVRKQAKMTLRCMQALVRVQARVLDQRIRSSLDGSRKSTFSDTTSVWESRYLQDISDRKSVSREGSSIADDWDERPHTVEEVKAMLQQRKEAAMKREKSLSQAFSQQIWRNDRTSSIGNEGELEERPKWLDRWMSTKPWEGRGRASTDQRDPIKTVEIDTAQPYSYLGASYRRSHPNYQYNPHLQPQRHSIASPIHGTHQNGSIHQSTATPSPAKSRPIQVRSASPRCVREDRTIHTSQTPSLRSTYNYTGSLYQNGRVGTSNAAAAALPNYMAATESAKARIRSQSAPRQRPSTPERDRGAGSVKKRLSFPAPDPYNVGAGYGNYGQNLRSPSFKSVGASHFGTERQSNYSSCCTESNGGEISPSSTGDLRRWLR

SEQ ID NO: 20380 - protein, 537 aa, Lupinus angustifolius
MGKKGSSSWLTAVKRAFRSPTKDSNRRREDYDHEEDEEKKREKRRWIFRKNHETENIQQSPTKSKHVVAATTNASVGSRTEQNQKHALEMAMATAEAAMATAQAAVEVARLTKPSTTTNHHSRDHFAAIVIQTAFRGYLARRALCALKGLVKLQALVRGHNVRKQAKMTLKCMQALVRVQARVLDQRIRYSLDGSRKSTFSDTASVSELRYLQEISDRKSVSREGSSIADDWDHRPHTVEEVKAMLQQRKEAAMKREKSLSQAFSQQIWRNGRKSSIGNEDELEERPKWLDRWMATKPWEGRGRASTDQRDPIKTVEIDTAQPYSYLGGSNYRRSHPNYQYNPHHQPQRHSIASPIHRTHQNGSIRQSPSTPSPAKSRPVQVRSASPRCVREDRNLHISQTPSLRSTYSYTGNLYQNGRAGTSNSGAAALPNYMAATESAKARIRSQSAPRQRPSTPERERGAGSVKKRLSFPAPDPYNVGAGYGNYGQNLRSPSFKSVCASHFGMEQQSNYSSCYTESIGGEISPSSTSDLRRWLR

SEQ ID NO: 20381 - protein, 592 aa, Glycine max
MREQNVESFYAKLRQTALSSSSSPVLIFPSTSDVDSLCALKIIFHILESDSIQYACYPVSSFHEIHKYTNSSSNDEPLSVVLVNWGNHRDLSNTLNLPSNARVFVVDSHRPIHLRNLSDQNDAVVVLFTKEDEGQSDLAYDFDLTTLANAATTVDSDSDSESESESDSDSDSGSERTGSRKRRKKNPQDDDDGDDEDPIKLYRKLKKGYYKLGTFHGKPSGCLMYELADKLRKNTNELLWIACISLTDQFVHERLSDERYHDGVMELEQHINSSGNLDAVTSVTLKDGTKIRAPNSLRITYEDQPRLMLLQEWSLFDSMMCSSYIATKLKTWSENGIKKLKLLFGTMGFALGDCQQKFQHMNLEVKRKMKKEFERFLPEYGLTDFYYRSFIRTLKYSSKISAADVVYGVTALLESFVRSDGSCASKQFGVAYDALSLNNIDNLRTGMHHAIKIQRAILRQGSAAITKNGCIRSGRSFRWLKLEDSNDATLLGYPQALTKFCYFIMDALREKGAKMKPLICACVSQEPGKVLIVGVCGRPRLGGAQGNAFGIAFRTAAEEIGTEFFHELFESSWIVLDASAVNSFMVRLTKKL

SEQ ID NO: 20382 - protein, 588 aa, Cajanus cajan
MREQRVESFYAKLRQSATSSSSSSPVLIFPSTSDVDSLCALKIILHILQSDSIQYACYPVSSFHEIHKYVSSASNDHPLSVVLVNWGNHRDLRKTLNLSPNARVFVVDSHRPIHLRNLSDRNDAVTVLFTKDDEQQSDLAYDFDLTTLANAGNENSESESESESESESESDSEAESERDGSRKRRRKNPEEDPIKLYRKLKKDYYRLGTFHGKPSGCLMYELAHFLRRNTNELLWLACVSLTDQFVHERLSEERYHDGVMELEQHINSSGNLDAPTSVTLKDGTKIRAPNSSRITYEDQPRLMLLQEWNLFDSMMCSSYIATKLKTWSENGVKKLKLLFGRMGFALADCQQQFQYMNVEVKRKMKQEFERFLPEYGLTDFYYRSFMRVYRYSRVSAADVVFGVTALLESFVKSDGSCASQKFGEAYDALLSLDNINKELQKGMQDAIKIQRAILRQGSAAITKSGCIRSGRSFRWLKLEDSRDAKLLGYPQALTKFCYFLMDALKEKGATMKPLLCACLSQEAGKVLIVGVCGRPRLAGARGNAFGIAFRTAAEEIGTQFFHELFESSWIVLDASAVNSFMVRLIEKL

SEQ ID NO: 20383 - protein, 756 aa, Glycine max
MGTNLHQVLRSLCLNTHWNYAIFWKLKHRARMILTWEDAYYSNPDDYDSSENKHCQKTLEQIGCGKFSHSALELAVAKMSYHAYSLGEGIIGQVAVTGKHRWICADNQVAGSGLSFEFADGWQSQFSAGIRTIAVVAVVPLGVVQLGSLNKVIEDMEFVTHIRNLFLSTQNYSILRPSQIQGSLKSSSELDTLKENLSSDIMPTCFYDTQKSMKSETADVLMPLQCSGTGRNYTPSAHEKMSDNVAKQEGPELYNDESSILLQSISNMMNVDCKEFEEMKPLYGMKYEGGSSGDCKDMRLESEKNVSSYLNDFVTDNASFNDLICPSEKVRVDSACFPSVFLDTVVCESDKLHYADINQKGALNFAQPSEANSQQHIEKSKFHTEPCYKDISDFQTEPCYKDASQMLNFPAGCELHEALGPAFSKVGKCFDWPTQVNQEMKPVEMSDEISTSQLTSESCPEHLLEAMLVNINHSNNDVNSELSFCTSKQSAMASAKNHEASIHNVHTINSEGYLMDQLSLVREDKHHSLSSSSGICGVMSSKGVSSTFHSSNSGQLERSSEPSKNSKKRARPGESCRPRPRDRQLIQDRIKELRELVPNGAKCSIDSLLERAIKHLLFLQSITKHADKLTDFADTKSKLHHKEADILGSSSYDQGSSWAMEVGGHLKVHSILVENLGKNGQMLVEMLCEECSHFLEIAEAIRSLGLTILKGATKAHGEKIWICFVVEGQNNKNVHRLDILWPLVQILQSKSTVYSQ

SEQ ID NO: 20384 - protein, 756 aa, Glycine max
MGTNLHQVLRSLCLNTHWNYAIFWKLKHRARMILTWEDAYYSNPDDYDSSENKHCQKTLEQIGCGKFSPSALELAVAKMSYHAYSLGEGIIGQVAVTGKHRWICADNQVAGSGLSFEFADGWQSQFSAGIRTIAVVAVVPLGVVQLGSLNKVIEDMEFVTHIRNLFLSTQNYSILRPSQIQGSLKSSSELDTLKENLSSDIMPTCFYDTQKSMKSETADVLMPLQCSGTGRNYTPSAHEKMSDNVAKQEGPELYNDESSILLQSISNMMNVDCKEFEEMKPLYGMKYEGGSSGDCKDMRLESEKNVSSYLNDFVTDNASFNDLICPSEKVRVDSACFPSVFLDTVVCESDKLHYADINQKGALNFAQPSEANSQQHIEKSKFHTEPCYKDISDFQTEPCYKDASQMLNFPAGCELHEALGPAFSKVGKCFDWPTQVNQEMKPVEMSDEISTSQLTSESCPEHLLEAMLVNINHSNNDVNSELSFCTSKQSAMASAKNHEASIHNVHTINSEGYLMDQLSLVREDKHHSLSSSSGICGVMSSKGVSSTFHSSNSGQLERSSEPSKNSKKRARPGESCRPRPRDRQLIQDRIKELRELVPNGAKCSIDSLLERAIKHLLFLQSITKHADKLTDFADTKSKLHHKEADILGSSSYDQGSSWAMEVGGHLKVHSILVENLGKNGQMLVEMLCEECSHFLEIAEAIRSLGLTILKGATKAHGEKIWICFVVEGQNNKNVHRLDILWPLVQILQSKSTVYSQ

SEQ ID NO: 20385 - protein, 758 aa, Cajanus cajan
MGTHLHQVLRSLCFNTHWNYAIFWKLKHRARMILTWEDAYYNNPDDYDSSENKHCQKTLEQIGCGKFSHSALGLAVAKMSYHAYSLGEGIVGQVAVTGKHRWICADNQITGSGLSFEFADGWQSQFSAGIRTVAVVAVVPLGVVQLGSLNKVIEDMEFVNHIRNLFLSTQNYSIGQCPNQIQASLKSSSSSLDTLKENMSSDIVPTCFYNTQKSMKSETADVLMPLQCSGRNYAPHSGCEKMSDNVAKQEGPGFCSDESSILLQSISNMMNVEHQEFEEMKPLHGRKCEGGSSGCEDMKLESEKNISSLLNEFVTDNASFNDLIYPSEKVRVDSACLPSVFHDTVVSESDKLHCVDINQKGKLNFVQPSDANTQQLTEKSKFHTEPCYKDNSYFQTEPCYKDTSHMLKFPAGCELHEALGPAFLKGNKSFDWSTHVNQDVKTVEMSDEIATSQLTSESLAEHLLEAMVANICHSNNNVNSELSFCTSTSMQSAMDSGKNHEASIYNVHAINSEGYSIDQLSLVREDKHRSLSSSSGICGAMSSKGVSSTFPSSNSGQLERSSEPSKNSKKRARPGESCRPRPRDRQLIQDRIKELRELVPNGAKCSIDSLLERAIKHMLFLQSITKHADKLTDFSDTKSKLHHMEPEILGSSSYEQGSSWAMEVGGHLKVHSILVENLSKNGQMLVEMLCEECSHFLEIAEAIRSLGLTILKGATKAHGEKIWICFVVEGQNNRNVHRLDILWPLVQILQSKSTVYSQ

SEQ ID NO: 20386 - protein, 733 aa, Phaseolus vulgaris
MGTNLHQVLRSLCLNTHWNYAIFWKLKHRARMILTWEDAYYNNPDDYDSSENKHCRNIVEQIGCGKFSHNALGLAVAKMSYHAYSLGEGIVGQVAVTGKHRWICADNQVAGSGLSFEFADGWQSQFSAGIRTVAVVAVAPLGVVQLGSLNKVIEDTGFVTHIRNLFLSTQNYSIAQCPSQMQGSLKSSLSQLDILKENLSSDVMPTGFYNSQKSMKSETSDVLMPLQCSGRNDAPHSACVKMSDDVAKQEGPELYSDESSILLQSISNMMNVEHQDFEEMKPLYGRKGEEGSSGCKDVRLESENNVLSFLSDFVTDNDLICPSEKVKIDSAYFPSAFLDTVVCETDKLHYQKGVLNFTQPSDANSQHVEKSKFCSEPSYKDMSHVLNFPVGCELHEALGPSFLKGSKCFDWPAQVNQDMKTVEMSDEISQLTSESRPEHLLEAMVANICHSNNDVNSELSFCPSMQSAMASGKNHEASTHNVYAINSEGCSIDQFSLVKEDKHHSLSSSSGICGVMSSKAVSSTFPSSSSGQLERSSEPSKNSKKRARPGESCRPRPRDRQLIQDRIKELRELVPNGAKCSIDSLLERAIKHMLFLQSITKHADKLADFGDTKSKLHHMEADILGSSSYEQGSSWAMEVGGHLKVHSVLVENLSKNGQMLVEMLCEECSHFLEIAEAIRSLGLTILKGGTKVHGEKIWICFVVEGQNNRNVHRLDILWPLVQILQSKSKVHSQ

SEQ ID NO: 20387 - protein, 609 aa, Solanum phureja
MAAKVAAAGMVHQSNALNFGGGGSSKVTTATLKRKTPSELRGEQLKKKNIVELVDESIVSNGPKRCDVSKNPRYVDTRVDELFPARKSSIRLKLVSRKENGKENVQAENSGNTKNCSVPSAFPAENQQRSKCPKFSLASTVTGKDHATETCSTSERCSENTFRSVTELSLGSVDVHGLFTVDMDKALRGLATHEHLGAAAKIAESSETDGGIRSKHFCSEFHVPCKMTPLDLAMKTNIRVVSSSSINWFHRLINCGANNVVARSSVNCFTKLKMTCLSEVTSVSQATNPMSLHSWMYPQSPLPPSVISALTLSASAGGQLDFLSERQLAWQDSFRSLYYMLRKNVCSIFYVCTAQFVIMFTSSYSEENKHVCNAYISQSTRGLRSLLKEHDVSYSMPLCHSKLEELNTEELVELSEIEKQNLGQTRRRSAMSDVDNRPDSLLAFTGNKNVHSLYDFLLNYRYFLTSLTGVDVPELYSPIPFENAALTAPESNVTCVPNQQPSSGMCYSVEIKGRYLAPWVTSAICDAFSSNSTSFEASFISEPASVNLNASLGITGKYSDPEVSATEALDKDNLCFGIQNTKFCSQINSGFLKGLKYNGGCYTAFLSPV

SEQ ID NO: 20388 - protein, 635 aa, Capsicum annuum
MVKVAAAGLVHQSTGLKFGGGGGSKVTTTTLKRKTPSELRGEQLKRKNIVELVDESTASNGGSWSAVLPGPKRCDVSKNPRYVDTRVDELFPARKSSIRLNLASRKETGKENIPAEDSGSTKNCYVPSAFPAEHQQRSKCPEFSLASTVTGKNREAETCGTSERCSENTFRSVTELSLGSEDVHGLSTVDMDKALRGLATHEHLGVAAKISESSETDDGRRAKFFCSEFHVPCKMTPLDLTMKTNIRVLSSSSINWFHRLINCDTSSVVARSSVKCFKRQKMTSLSEVNSVSQAINPVSLHSWMYPQSPIPPSVISALTLSASVGGQLDFLSERQLTWQDSFRSLYYMLRKNVCSIFYVCTAQFVIMFTSSCSEENKCVCNSYISQSTRGLRSLLKEHDVSYSMPLCHSKLEELSTEELVELSEIEKQNLGQTRRRSAMSDVDNRPDSLLAFTGNKNVHSLYDFILNYRYFLTSLTGVDVPVLYSPVPFENAALTAPEVRCKEVRRVDQVAFQGMESNGACEPNQQPSSGMCYSVEIKGRYLAPWVTSAICDAFSSNSTSFEASFITEPTSVNLNTSLDITGKCSDPEVSATEDMDKGSLCFGIPNTKFYSQIHSCFLKGLKYNVGSYTAFLSPV

SEQ ID NO: 20389 - protein, 929 aa, Solanum phureja
MGSVEEKNKPGSLVSGAHTLLEEMKLLKGMQDHTGGGRKHISSELWHACAGPLVTLPQVGSLVYYFPQGHSEQVAVSTNRTATSQIPNYPNLASQLLCQVHNVTLHADKETDEIYAQMSLQPVNSEKDVFPIPDFGLKPNKHPTEFFCKTLTASDTSTHGGFSVPRRAAEKLFPPLDYSMQPPTQELVVRDLHDNTWTFRHIYRGQPKRHLLTTGWSMFVGAKRLRAGDSVLFIRDEKSQLLLGVRRANRQQTSLPSSVLSADSMHIGVLAAAAHAAANRSTFTIFYNPRACPSEFVIPLAKYRKSVYNTQLSVGMRFGMMFETEESGKRRYMGTISGISDLDPLRWPGSKWRCLQVEWDEPGCGDKQNRVSPWEVETPESLFIFPSLTAGLKRPYQSTFLGAPTEWDSLMQHRPFMRVPENVYGDLQSSSISNLWSEQLMKMLIRPPPGLTGLQCGVPTVQDIKVALPQEARNVIQPAGNQKPELITVEATPAQSETNSEVILNQPVGVVNSISSQQATLQAKSQPLEKVETDVIGKSYEPRKETCNSSVKLDQFQCNEDKVTIKPASPHDLPTASATASHHNSFSQLQATPWLIPHNPQIDSAGSNNILQCPTNNEWNLSSLQSAAGLLRYPVSTSTLTKHDNSFMLPDTIGHGLAPIGQDLWDHQLNDVKCFSQTNLQVPLDITNMQFLPDSYDFKDLSEESHNQSDIYSCLNFDSNSGSTVIDNSVSSTVLDEFCNLKHTDFQNPSDFLLGNISSSQDVQSQITSASLADSQNFSVQEFADNSGGASSSNVNFDECNLLQNSSWQQVAPRVRTFTKIQKTGSVGRSIDVSGFKNYEELRSEIERMFGLEGLLNDTRGSSWKLVYVDFEHDVLLVGDDPWEEFVGCVRCIRILSPTEVQQMGEEGMQLLNSAGLQGINGSTSEFPN

SEQ ID NO: 20390 - protein, 928 aa, Nicotiana benthamiana
MGSVEEKHKPGSLVSGAHTLLEEMKLLKEMQDHSGGGGKLINSELWHACAGPLVTLPQVGSLVYYFPQGHSEQVAVSTNRTATSQIPNYPNLASQLLCQVHNVTLHADKETDEIYAQMSLQPVNSERDVFPIPDFGLKPSKHPTEFFCKTLTASDTSTHGGFSVPRRAAEKLFPPLDYSMQPPTQELVVRDLHDNTWTFRHIYRGQPKRHLLTTGWSMFVGAKRLRAGDSVLFIRDEKSQLMLGVRRANRQQTSLPSSVLSADSMHIGVLAAAAHAAANRSTFTIFYNPRACPSEFVIPLAKYRKSVYGTQLSVGMRFGMMFETEESGKRRYMGTIVGISDLDPLRWPGSKWRCLQAEWDEPGCGDKQSRVSPWEVETPESLFIFPSLTAGLKRPYQSSFLGGQTEWDSLMHRPFMRVPENVYGELQSSSISNLWSEQLMKMLARPPGVTGLQWGVPTVQDIKVVIPQESRNLIHAAGNQKPELSTVEDTSVQSERNPLVILNQPCVVNSISSSQATLQPKSQPPEKVGSDTVGISTEPAKETSVSVDRLDQCPSLGQCSEEKVTIKPASPLILPTDATASHQNSLSQLQSSPWRQIESASANNILQGSNNNEWNLPSFQSTAGLVRSPVSNSTLTKYEHSFMLPDSVIGPGLAPIGQDLWDHQLNDVKCFSQTNLQVPLLTQDITNMQFLPESYGFKDLSEESHNQSDIYSCLNFDSNSGSTVIDNSVSSTVLDEFCTLKHTDFQSPSDFLLGNFSSSQDVQSQITSASLADSQNFSVQDFADNSGGASSSNVNFDESNLLQNSSWQQVAPRVRTYTKIQKAGSVGRSIDVSSFKTYHELRSEIERMFGLEGLLNDTKGSGWKLVYVDYENDVLLVGDDPWEEFVGCVRCIRILSPTEVQQMGEEGMQLLNSAGLQGINGSTSEFPN

SEQ ID NO: 20391 - protein, 553 aa, Solanum phureja
MALYLLYESASGYGLFLAHGIDEIGQNTEAVRNSITDLNRFGKVVKLEAFNPFESALDALNQCNAVSEGQMTEELQNFLERSLPKVKEGKKAKFSLGLAEPKLGSHIHEVTKIPCQSNEFVLEILRGVRLHFEKFIENLKHGDLEKAQLGLSHSYSRAKVKFNVNRVDNMVTQAIVLLDTLDKDINTFSMRVREWYSWHFPELVKIVNDNYLYAKVAKFVDDKSQLSEDKISALTEIVGDEDKAKEIVEAAKASMGQDLSPVDLINVKLFAQRVMDLVEYRKNLYDYLVAKMHDIAPNLAALIGEVVGARLISHAGSLTNLAKCPSSTLQILGAEKALFRALKTKGNTPKYGLIFHSSFIGRASARNKGRMARYLANKCSIASRLDCFLDKSTTTFGEKLREQVEERLDFYDKGVAPRKNLDVMKAAIETVEDKDTEMDVDELSTKKSKKKKSKVDVVEYAQPMIEDKPLETNGDASEEPKSEKKKKKKEKRKSEQEAEHEEDQTVDNGNGVHEDGTAKKKKKKKNKEDNGEELQAAVEIKKKKKKSKVQDDE

SEQ ID NO: 20392 - protein, 547 aa, Nicotiana benthamiana
MALYLLYESASGYALFLAHGIDEIGQNTEAVRNSITDLNRFGKVVKIEAFNPFESALDALNQCNAVSEGQMTEELRNFLERSLPKVKEGKKAKFSLGLAEPKLGSHIHEVTKIPCQSNEFILELLRGVRLHFEKFIENLKPGDLEKAQLGLSHSYSRAKVKFNVNRVDNMVTQAIVLLDTLDKDINTFAMRVREWYSWHFPELVKIVNDNYLYAKVAKFVDDKSQLCENKIPDLIEIVGDEDKAKEIVEAAKASMGQDLSPVDLINVKMFAQRVMDLVEYRKDLYDYLVAKMHDIAPNLASLIGEVVGARLISHAGSLTNLAKCPSSTLQILGAEKALFRALKTKGNTPKYGLIFHSSFIGRASARNKGRMARYLANKCSIASRLDCFLDTSTTTFGEKLREQVEERLDFYDKGVAPRKNIDVMKSAIETVEGKDTEMDVDETSAKKSKKKKSKVEVVEYAQPIIEDKPLANGDASEEPKSEKKKKKKEKRKTEQEPEHEEDQTNGASEDGTAKKKKKKSKEENGEELQAASEVKKKKKKSKVQDDE

SEQ ID NO: 20393 - protein, 549 aa, Nicotiana benthamiana
MALYLLYESASGYALFLAHGIDEIGQNTEAVRNSITDLNRFGKVVKIEAFNPFESALDALNQCNAVSEGQMTEELRNFLERSLPKVKEVKEGKKAKFSLGLAEPKLGSHIHEVTKIPCQSNEFILELLRGVRLHFEKFIENLKPGDLEKAQLGLSHSYSRAKVKFNVNRVDNMVTQGIVLLDTLDKDINTFAMRVREWYSWHFPELVKIVNDNYLFAKVAKFVDDKSQLSEDKIPDLTEIVGDEDKAKEIVEAAKASMGQDLSPVDLINVKMFAQRVMDLVEYRKDLYDYLVAKMHDIAPNLAALIGEVVGARLISHAGSLTNLAKCPSSTLQILGAEKALFRALKTKGNTPKYGLIFHSSFIGRASARNKGRMARFLANKCSIASRLDCFLDTSTTTFGEKLREQVEERLDFYDKGVAPRKNIDVMKSAIETVEGKDAEMDVDEPSAMKSKKKKSKVEVVEYAQPMIEDQPLVTNVDASEEPKSEKKKKKKKRKTEQEREHEEDQTNGAPEDGTAKKKKKSKEENGEELQAASEVKKKKKKSKVQDDE

SEQ ID NO: 20394 - protein, 548 aa, Nicotiana tabacum
MPLYLLYESASGYALFLAHGLDEIGQNTEAVRNSLTDLNRFGNLLNLAAFTPFDSALDALNQCNAVSEGQMTDELRNFLEPTLPKVKEGKKPKFSLGLAEPNLGSHIHEVTKIPCQSNEFILELLRGVRLHFEKFIENLKPGDLEKAQLGLSHRYSRAKVKFNVNRVDNMVTQAIVLLDTLDKDINTFAMRVREWSSWHFPELVKIVNDNYLYAKVAKFVDDKSQLSEDKIPDLTEIVGDEDKAKEIVEAAKASMGQDLSPVDLINVKMFAQRVMDLVEYRKNLYDYLVAKMHDIAPNLAALIGEVVGARLISHAGSLTNLAKCPSSTLQILGAEKALFRALKTKGNTPKYGLIFHSSFIGRASARNKGRMARYLANKCSIASRLDCFLDTSTTTFGEKLREQVEERLDFYDKGVAPRKNIDVMKSAIETVKGKDTEMDVDEPSAKKSKKKKSKVEVVEYAQPMIEDKPLVTNDDAFEEPKSEKKKKKKEKRKTEQEPEHEEDQTNGAPEDGTAKKKKKKSKEENGEELQAASEIKKKKKKSKVQDDE

SEQ ID NO: 20395 - protein, 547 aa, Amsonia hubrichtii
MALYLLYESASGYSVFLAHGLDEIGQNTVDVRNSVFDLNRFGKVVKLAAFSPFESALDALKQCNAVSEGQMTDELRNFLELTLPKVKEGKKPKFSLGLAEPKLGSHIHEETKIPCQSNEFVLELLRGVRLHFDRFIENLKAGDLEKAQLGLGHSYSRAKVKFNVNRVDNMVIQAIFLLDTLDKDINSFSMRVREWYSWHFPELVKIVNDNYLYAKVAKFVDDKSELSEDKIPGLTEIVNDEDKAKEIVEAAKASMGQDLSPIDLINVKQFAQRVIDLAEYRKNLYDYLVAKMNDIAPNLAALIGEVVGARLISHAGSLTNLAKCPSSTLQILGAEKALFRALKTRGNTPKYGLIFHSSFIGRASARNKGRMARYLANKCSIASRIDCFLEQNTNAFGEKLREQVEERLDFYDKGVAPRKNIDVMKSVLENALTKEMDVDEDEPSVKKSKKKKSKTQVAEDKPAAVRNGDATEEPKTEKKKKKEKRKSEEPDPDEAAGTANGENGSNAEDGTAKKKKKKKSQDDGENIAAASEGKKKRKKKSKTEDDE

SEQ ID NO: 20396 - protein, 557 aa, Tabernaemontana elegans
MALYLLYESASGYAVFLAHGLDEIGQNTEAVRNSVLDLNRFGKVVNLAAFSPFESALDALKQCNSVSEGQMTDELRNFLELTLPKVKEGKKLKFSLGVAEPKLGSHIHEETKIPCQSNEFVLELLRGVRLHFDRFIENLKAGDLEKAQLGLGHSYSRAKVKFNVNRVDNMVIQAIFLLDTLDKDINSFSMRVREWYSWHFPELVKIVNDNYIYAKVAKFVDDKSQLSEDKIPGLTEIVGDEDKAKEIVEAAKASMGQDLSPIDLINVKQFAQRVIDLAEYRKTLYDYLVAKMNDIAPNLAALIGEVVGARLISHAGSLTNLAKCPSSTLQILGAEKALFRALKTRGNTPKYGLIFHSSFIGRASARNKGRMARYLANKCSIASRIDCFLEKNTNAFGEKLREQVEERLDFYDKGVAPRKNIDVMKSALENAQTKEMDVDEDDEPSVKKSKKKKSKASKAQVTEDGEPKAEDKSAALTNGDAVEVPKTEKKKKKKKRKSEEEPHPDDAAENANGFNAEDGTAKKKKKKESRDNDGENTAAASEVKKKKRKKSKTEDDE

SEQ ID NO: 20397 - protein, 554 aa, Vinca minor
MSLYLLYESASGYAVFQAHGLDEIGQNTEAVRNSVTDLNRFGKVVQLAAFSPFESALDALNQCNSVSEGQMTDELRNFLELTLPKVKEGKKPKFSLGISEPKLGSHILEETKIPCQSNEFVLELLRGVRLHFDRFIENLKAGDLEKAQLGLSHSYSRAKVKFNVNRVDNMVIQAIFLLDTLDKDINSFSMRVREWYSWHFPELVKIVNDNYLYAKVAQFVDDKSQLSEDMLPGLTEIVGDEDKAKEVVEAAKASMGQDLSPIDLINVKQFAQRVINLAEYRKTLYDYLVAKMNDIAPNLAALIGEVVGARLISHAGSLTNLAKCPSSTLQILGAEKALFRALKTRGNTPKYGLIFHSSFIGRASARNKGRMARYLANKCSIASRIDCFLDKNTKAFGEKLREQVEERLDFYDKGVAPRKNIDMMKSVLENAETKEMDVDVDEDEPSVKKNKKKKSKSQVAEDGEPMAEDKPAAVTNGDDTEEPRTEKKKKKKEKRKSEKDAEPEKASGANGFNAAEDGTAKKKKKKSQDDGESIGAAVSEGKRKKKKSKTEDDE

SEQ ID NO: 20398 - protein, 556 aa, Vitis vinifera
MALYLLYESASGYALFLAHGLDEIGQNTEAVRSSVSDLNRFGKVVKLAAFHPFESALDALNQCNSVSEGLMTDELRSFLELNLPKVKEGKKPKFSLGTAEPKIGSHIFEDTKIPCQSNEFVLELLRGVRLHFDRFIKDLKPGDLEKAQLGLGHSYSRAKVKFNVNRVDNMVIQAIFLLDTLDKDINSFSMRVREWYSWHFPELVKIVNDNYLYAKVAKFVENKLELSEDKIPGLTEILGDEDKAKEIVEAAKASMGQDLSPIDLINVQQFAQRVMDLSEYRKKLYEYLVTKMNDIAPNLASLIGEVVGARLISHAGSLTNLAKCPSSTLQILGAEKALFRALKTRGNTPKYGLIFHSSFIGRASARNKGRMARYLANKCSIASRIDCFAESNTTVFGEKLREQVEERLEFYDKGIAPRKNIDVMKAAIEITQNNDTEDKATTEPSAKKSKKKKSKVEAAEDGEPMVEDKPTAATNGDASEEPKTEKKKKKEKRKLVEEEEQVQAVENSIGVNGVNTEDGTAKKKKKKKSKDEDGEGLAAASEGKKKKKKSRSEDDD

SEQ ID NO: 20399 - protein, 1015 aa, Capsicum annuum
MSDIRKWFMKQHDKGTGNGSMSKNSAAEKPSPATPKAESLVQEGQETAGRRKTSKYFATDKVKPKEEKVEEVSAKRKAQNDGGSSSANEKPPAAKRIHKAEDDDDFVLSSSATGSRDVTPSKRLVSGSGRGSARKNVISDDSDDDLKSKKSDVKPAGRGRGGRAAQTGGKRAPLDESDDDASAVKDTKSGGRGRGGKAPSAAPSGGRGRGGGGRGGFMNFGERKDPPHKGEKEVPEGAPDCLAGLTFVISGTLDSLEREEAEDLIKRHGGRVTGSVSRKTNYLLCDEDIEGRKSSKAKELGTAFLTEDGLFEMIRSSNKSKSATQPESKKSLDTVVSSPKRKLQNTSDGTGSTAAKILAAKQLASSASLAKSSASPAKGSASPAKRKSQVKESLLPWTEKYRPKAIVDIIGNKSLVEQIQRWLESWDEHFLKAASKGKGKKQNDSGAKKAVLLSGMPGIGKTTSAKVVSQLLGFQTIEVNASDSRGKADSKIEKGIGGSTANSIKELVSNESLSANIGRSHHQKTVLIMDEVDGMSAGDRGGVADLIASIKISKIPIICICNDRYSQKLKSLVNYCLPIVFRKPTKQQMAKRLKQVANAEGIQVNEIALEELADRVGGDMRMALNQLQYMSLSKSVIQYDDIRQRLLSSSKDEDISPFKAIEKLFDFNAKNLKIDQRIDLSMSDPDLVPLLVQENYLNYKPSSAGKDDSDLKRMSLIACAADSIANSDLINVQIRRYQQWQLSPAGCISSCIIPASLLHGQRQTLEQGERNFNRFGGWLGKNSTMGKNYRILEDLHVHLLASRESYLGRANLRLDYFTLLGKKLTDPLRVLPKDEAVENVVDFMDSYSISQDDFDNIVEISKFKGCPTLLDGVQPAVKAALTKAYNKGSKSRVIRTADLITLPGIKKAPKKRVAAMLEPLDEGVAAEENDETLAEDEENSSETEDTADVEKKLQSDLQSLSSKGIQVNMDLKGGKKPSAGRGRGRGSSNSSDKGSAESSGKRGGRGSGAAAKRKR

SEQ ID NO: 20400 - protein, 998 aa, Nicotiana benthamiana
MSDIRKWFMKQHDKGTGNGSMSKYSAPEKPSAEKPSPGNLVQEGQETAGRRKTSKYFATDKVKTKEEKVEEVSAKRKAQNAGGSSSVNEKPPAAKRIHKPEDDDDFVLPTSAMGSRGATPTKKSASGSGRGSARKSVISDESDDDLKDTKSDLKPTGRGRGGRAAQTGGKGIPLDESDDDASADKDTKSGGRGRGGKGPSAAPSGGRGRGGGGRGGFMNFGERKDPPHKGEKEVPEGAPNCLAGLTFVISGTLDSLEREEAEDLIKRHGGRVTGSVSKKTNYLLCDEDIEGRKSSKAKELGTAFLTEDGLFDMIRSSKKSKSATQPESKKSVHTVVSPAKRNSQNTSDGTGSTATKILADKELTPSASPTKRKGQAKESSLPWTEKHRPKAIVDIIGNKSLVEQIQRWLDSWDEHFLNVAGKGKGKKQNDSGAKKAVLLSGMPGIGKTTSAKVVSQLLGFQTIEVNASDSRGKADSKIAKGIGGSTANSIKELVSNESLGANIGRSHHQKTVLIMDEVDGMSAGDRGGVADLIASIKLSKIPIICICNDRYSQKLKSLVNYCLPIVFRKPTKQQMAKRLKQVANAEGLQVNEIALEELAERVGGDMRMALNQLQYMSLSKSVIQYDDIRQRLLSSSKDEDISPFKAVELLFDFNAKNLKIDRRIDLSMSDSDLVPLLIQENYLNYKPSSVGKDDDGLKRMSLIARAADSIANGDLINVQIRRYQQWQLSPAGCLSSCIIPASLLHGQRQTLEQGERNFNRFGGWLGKNSTMGKNYRILEDLHVHLLASRESYLGRANLRLDYFTLLTKKLTDPLKLLPKDEAVENVVDFMDSYSISQDDFDNIVEISKFKGHPNPLDGVQPVVKAALTRAYNKGSKSRVIRTADLISLPGIKKAPKKRVAAMLEPLDEGLAEENGEAIAEDEENSSEPEDIDVEKKLESDLQSLNSKGIQVNVVLKGAGGKKPSAGRGRGSSNSREKGGAESSGKRGGRGSGATKRKR

SEQ ID NO: 20401 - protein, 924 aa, Nicotiana benthamiana
KRKAQNAGGSSSVNEKPPAAKRIHKPEDDDDFVLPASAMGSRGATPAKKSASGSGRGSARKSVISDESDDDLKDTKSDPKPTGRGRGGRAAQTGGKGIPLDESDDDASADKDTKSGGRGRGGKGPSAAPSGGRGRGGGGRGGFMNFGERKDPPHKGEKEVPEGAPNCLAGLTFVISGTLDSLEREEAEDLIKRHGGRVTGSVSKKTNYLLCDEDIEGRKSSKAKELGTAFLTEDGLFDMIRSSKKSKSATQPESKKSVDTVVSPAKRNSQNTSDGIGSTATKILAAKELTPSASPAKRKGQAKESSLPWTEKYRPKAIVDIIGNKSLVEQIQRWLESWDEHFLNAASKGKGKKQNDSGAKKAVLLSGMPGIGKTTSAKVVSQLLGFQTIEVNASDSRGKADSKIEKGIGGSTANSIKELVSNESLGANIGRSHHQKTVLIMDEVDGMSAGDRGGVADLIASIKLSKIPIICICNDRYSQKLKSLVNYCLPIVFRKPTKQQMAKRLKQVANAEGLQVNEIALEELAERVGGDMRMALNQLQYMSLSKSVIQYDDIRQRLLSSSKDEDISPFKAVELLFDFNAKNLKIDRRIDLSMSDPDLVPLLIQENYLNYKPSSVGKDDDGLKRMCLIASAADSIANGDLINVQIRRYQQWQLSPAGCLSSCIIPASLLHGQRQTLEQGERNFNRFGGWLGKNSTMGKNYRILEDLHVHLLASRESYLGRANLRLDYFTLLTKKLTDPLKVLPKDEAVENVVDFMDSYSISQDDFDNIVEISKFKGHPNPLDGIQPVVKAALTRAYNKGSKSRVIRTADLISLPGIKKAPKKRVAAMLEPLDEGLAEENGEAIAEDEENSSEPEDIDVEKKLESDLQSLNSKGIQVNLDLKGAGGKKPSAGRGRGSSSSREKGGAESSGKRGGRGSGATKRKR

SEQ ID NO: 20402 - protein, 1007 aa, Solanum phureja
MSNKEKGVNVQVLLRCRPFSNDELRSNAPQVVTCNEFQREVAVSQNIAGKHIDRIFTFDKVFGPSAQQRDLYDQAIIPIVNEVLEGFNCTIFAYGQTGTGKTYTMEGECKRSKSGPNGELPLGAGVIPRAVKQIFDTLESQNAEYSVKVTFLELYNEEITDLLAPEDLSKVALEDRQKKQLPLMEDGKGGVLVRGLEEEIVTSASEIFTLIERGSSKRRTAETLLNKQSSRSHSLFSITIHIKEATPEGEELIKCGKLNLVDLAGSENISRSGAREGRAREAGEINKSLLTLGRVINALVEHLGHIPYRDSKLTRLLRDSLGGRTKTCIIATVSPAVHCLEETLSTLDYAHRAKNIRNKPEVNQKMMKSTLIKDLYGEIERLKGEVYAAREKNGVYIPKERYYQEESERKAMADQIEQMGVSIENQQKQLEELQSRHDCQVQQCSDLTCKLDATQKQLNQTSKLLAYTEEQLRQNLYTLKERDFIISEQKKAENALAHQACVLRADLEKSIQENASLFQKIAREDKLSTDNRSVVDNFQTELAKQLGSLSTTVATSVSRQNEHLHHVEKICHNFLESHEKAALDLTNKIHSSKALYISHFEAMQNVVKLHKATANAALEEISSLASSNSISTKEFLDAESVEANLIFDELQSTLSTHQGEMAHFARELRQRFNDSTEHLTNISEIIQGFFDKLLEESKRLERHSTTADEIQTKSIAEFEKAYEEQSRSDAEKLIAEVTSLVSNHMRRQKELVGARLGDLRETVSGNKTFLDGHVSSMEGITTDTKRKWQDFYTQAEGETKENADFSAAKHCRMELLMQKCVSTTETTVKRLQSTHELAKDMGNQHVSTMHSVVRNICDSNEQHVIEFDSTREAAEEAVKRNSEDIIKSIDGLSGEERGSISGILDTASAHSETLDELKKDHCTQSTSIEQKALETFQQKFMDYEPTGTTPIRSEPDVPSKGTIESLRAMPMETLLEEFRENNSFESFQVKDLKPSLIPRSPLSLINN

SEQ ID NO: 20403 - protein, 1007 aa, Capsicum annuum
MSNKEKGVNVQVLLRCRPFSNDELRSNAPQVVTCNELQREVAVSQNIAGKHIDRIFTFDKVFGPSAQQRDLYDQAIIPIVNEVLEGFNCTIFAYGQTGTGKTYTMEGECKRSKSGPNGELPQDAGVIPRAVKQIFDTLEGQNAEYSVKVTFLELYNEEITDLLAPEDLSKVALEDRQKKQLPLMEDGKGGVLVRGLEEEIVTSANEIFTLLERGSSKRRTAETLLNKQSSRSHSLFSITIHIKEATPEGEELIKCGKLNLVDLAGSENISRSGAREGRAREAGEINKSLLTLGRVINALVEHLGHIPYRDSKLTRLLRDSLGGRTKTCIIATVSPAVHCLEETLSTLDYAHRAKHIRNKPEVNQKMMKSTLIKDLYGEIERLKGEVYAAREKNGVYIPKERYYQEESERKAMADQIEQMGVSIENLQKQLEELQSRHDSQVQQCSDLTSKLDATQKQLNQTSKVLSYSEEQLRQCQYTLKERDFIISEQKKAENALAHQACVLRADLEKSIQENASLFQKIAREDKLNTDNRSVVDTFQSELAKQLGSLSSTVAMSVSRQNEHLQRVEKICRDFLESHDKAALDLTRKINSSKALYKSHFEAMQNVVRLHKATSNAALEEISTLASSNSISTKEFLDAESAEANLIFDELQSTLSTHQGEMAKFARELRQRFNDSTEHLTNISEIIQGFFDKLLDESKSLERHSTTADEIQTKSIAEFEKAYEDQSRSDAEKLIAEMTSLISNHMRRQKELVGARLVDLRETVSANKTFLDGHVSSMEGITTDAKRKWQDFYTQAEGGTKENADFSAAKHCRMELLMQKCVNTTETALKRWQSTHESVKDMGNQHVSTMHSVVRNICDSNDQHVNEFDSTKEAAEEDVKRNSEDIIKSIDGLSGEERASISGILGTASAHSETLEELKKNHCTQSTSIEQKALETFQQKFMDYEATGTTPIRCEQDVPSKGTIDSLRAMPMETLLEEFRENNSFESFQLKELKPSLIPRSPLSLINN

SEQ ID NO: 20404 - protein, 1006 aa, Nicotiana benthamiana
MSNKEKGVNVQVLLRCRPFSNDELRNNAPQVVTCNDYQREVAVSQNIAGKHIDRIFTFDKVFGPSAQQRDLYDQAIVPIVNEVLEGFNCTIFAYGQTGTGKTYTMEGECKRSKSGPNGELPQEAGVIPRAVKQIFDTLESQNAEYSVKVTFLELYNEEITDLLAPEDLKVALEDRQKKQLPLMEDGKGGVLVRGLEEEIVTSANEIFTLLERGSAKRRTAETLLNKQSSRSHSLFSITIHIKEATPEGEELIKCGKLNLVDLAGSENISRSGAREGRAREAGEINKSLLTLGRVINALVEHLGHIPYRDSKLTRLLRDSLGGRTKTCIIATVSPAVHCLEETLSTLDYAHRAKNIKNKPEVNQKMMKSTLIKDLYGEIERLKTEVYAAREKNGVYIPKERYYQEENERKAMADQIEQMGVSIENHQKQFEELQSRHDSQVQQCSDLTCKLDATQKQLNQTSKLLAYTEEQLRQSQYNLKERDFIISEQKKAENALAHQACVLRADLEKSIQENASLFQKIAREDKLSTDNRSLVNNFQAELAKQLGSLSSTLATSVCRQTEHLHCVEKFCHNFLESHDKAVLNLKRKINSSKALYISHFEAMQNVVRLYKATSNATLEEISTLASSNSISTKEFLDAETVEANSMFDELQSTLSTHQGEMAHFARELRQRFNDSTEHLTNISVVIQGFFDKLLDESKRLEKHATTVDEIQTKSIAEFEKAYEEQSRSDAEKLIADVTSLVSNHMRRQKELVGARLVDLRETVSGNRTFLDGHVSSMEGITTDAKRKWQDFYMQAEGETKENADFSAAKHCRMESLMQKCVSTAETALKRWQSTHELVNDMGNQHVSTMHSVVRNICDNNEQHVTDFDSTRESAEEDVKRNSEDIIISIDSLSGEERGTISGVLDTTSAHSETLDVLKKDHCMQSTSIEQIALETFQQKYMDYEPTGTTPIRSEPDVPSKVKIESLRAMPMEALLEEFRENNSFESFQVKELKPSLIPRSPFSQINN

SEQ ID NO: 20405 - protein, 1006 aa, Nicotiana tabacum
MSNKEKGVNVQVLLRCRPFSNDELRNNAPQVVTCNDYQREVAVSQNIAGKHIDRIFTFDKVFGPSAQQRDLYDQAIVPIVNEVLEGFNCTIFAYGQTGTGKTYTMEGECKRSKSGPNGELPQEAGVIPRAVKQVFDTLESQNAEYSVKVTFLELYNEEITDLLAPEDLKVALEDRQKKQLPLMEDGKGGVLVRGLEEEIVTSANEIFTLLERGSAKRRTAETLLNKQSSRSHSLFSITIHIKEATPEGEELIKCGKLNLVDLAGSENISRSGAREGRAREAGEINKSLLTLGRVINALVEHLGHIPYRDSKLTRLLRDSLGGRTKTCIIATVSPAVHCLEETLSTLDYAHRAKNIKNKPEVNQKMMKSTLIKDLYGEIERLKAEVYAAREKNGVYIPKERYYQEENERKAMADQIEQMGVSIENHQKQFEELQSRHDSQVQQCSDLTCKLDVTQKQLNQTSKLLAYTEEQLRQSQYTLKERDFIISEQKKAENALAHQACVLRADLEKSIQENASLFQKIAREDKLSTDNRSLVNNFQAELAKQLGSLSSTLATSVCRQTEHLQCVEKFCHNFLDSHDKAVLDLKRKINSSMALYISHFEAMQNVVRLHKATSNATLEEVSTLASSNSISTKEFLDAEAVEANSMFDELQSTLSTHQGEMAHFARELRQRFNDSTEHLTNISAIIQRFFDKLLDESKRLEKHATTVDEIQTNSIAEFEKAYEEQSKSDAEKLIADVTSLVSNHMRRQKELVGARLVDLRETVSGNRTFLDGHVSSMEGITTDAKRKWQDFYMQAEGETKENADFSAAKHCRMESLMQKCVSTAETALKRWQSTHELVNDMGNQHVLTMHSVVRNICDNNEQHVTDFDSTRESAEEDVKRNSEDIIKSIDSLSGEERGSISGVLDTTSAHSETLDVLKKDHCMQSTSIEQIALETFQQKYMDYEPTGATPIRSEPDVPSKVTIESLRAMPMEVLLEEFRENNSFESFQVKEVKPSLIPRSPFSQINN

SEQ ID NO: 20406 - protein, 1005 aa, Nicotiana benthamiana
MSNKEKGVNVQVLLRCRPFSNDELRNNAPQVVTCNDYQREVAVSQNIAGKHIDRIFTFDKVFGPSAQQRDLYDQAIVPIVNEVLEGFNCTIFAYGQTGTGKTYTMEGECKRSKSGPNGELPPEAGVIPRAVKQIFDTLESQNAEYSVKVTFLELYNEEITDLLAPEDLKVALEDRQKKQLPLMEDGKGGVLVRGLEEEIVTSANEIFTLLERGSAKRRTAETLLNKQSSRSHSLFSITIHIKEATPEGEELIKCGKLNLVDLAGSENISRSGAREGRAREAGEINKSLLTLGRVINALVEHLGHIPYRDSKLTRLLRDSLGGRTKTCIIATVSPAVHCLEETLSTLDYAHRAKNIKNKPEVNQKMMKSTLIKDLYGEIERLKAEVYAAREKNGVYMPKERYYQEENERKAMADQIEQLGVSIENHQKQLEELQSRHDSQVQQCSDLTCKLDATQKQLNQTSKLLAYTEEQLRQSQYTLKERDFIISEQKKAENALAHQACVLRADLEKSIQENASLFQKIAREDKLSTDNRSLVNNFQSELAKQLGSLSSTLATSVCRQTEHLQCVEKFCHTFLESHDTAVLDLKRKINSSKALCISHFEAMQNVVRLHKATSNATLEEISTLASTNSIFTKEFLDAEAVEANSMFDELQRTLSTHQGEMAHFARELRQRFNDSTVHLTNISEIIQGFFDKLLDESKRLEKHATTVDEIQTKSIAEFQKAYEEQSRSDSEKLIADMTSLVSNHMHRQKELVGARLVDLRETVSGNRTFLDGHVSSMEGITADAKRKWQDFYMQAEGETKDNADFSAAKHCRMESLMQNVSTAETALNWWQSTHESVSNMDNEHVSIMNSVVRNICDNNDQHVTDFDATRESAEEDVKRNSEDIIKSIDSLSAEEKGSISGVLDTTSAHSETLDVLENDHCMQSSSIEHKSLETFQQKYMDYEPTGTTPIRSEPDVPSKVTIESLRAMPMEALLEEFRENNSFESFQVKELKPSLIPRSPFSQINN

SEQ ID NO: 20407 - protein, 1010 aa, Solanum lycopersicum
MSNRHEKEKSVNVQVLLRCRPFSEDEVRNNAPQVVTCNEYQKEVAVSQNIAGKHIDRVFTFDKVFGPSAQQRDLYDQAIIPIVNEVLEGFNCTIFAYGQTGTGKTYTMEGECKRSKSGHNSELPPGAGVIPRAVKQIFDMLESQNAEYSVKVTFLELYNEEITDLLAPDDLSKVSVEDRQKKQLPLMEDGKGGVLVRGLEEEIVTSASEIFALLERGSAKRRTAETLLNKQSSRSHSLFSITIHIKEANTEGEELIKCGKLNLVDLAGSENISRSGAREGRAREAGEINKSLLTLGRVISALVEHLGHVPYRDSKLTRLLRDSLGGRTKTCIIATVSPAVHCLEETLSTLDYAHRAKNIKNKPEVNQKMMKSTLIKDLYGEIDRLKAEVYATREKNGVYIPKDRYYQEENERKAMTDQIEQMGVTLENQLKQLEELQSRYDHQVHLCSDLTCKLDATQKHLNQTTTLLSNAEEELRQSKYTLKERDFIICEQKKAENALAQQACSLRAQLEKSLIDNASLFLKIDREDKLSADNRSVVNNFQTDLAKQLGFLSNSVATSVCRQNEHLQCVEKFCHGFLESHDKAVVDLKRKTRASRALYVSHLEAMQNVVKLHKASSSAALEEISALASSNSISIKEFLDAEDVEANSLFEELQSTLSTHQGEMALFAGELRQKFHDSTEHLANISEIIQGYFDKLVEESKKLERHALTVDEIQTKCIAEFEAAYEEQARAEAQKLIADMTTMVSNHLHRQKELVGTRLVDLRGTVTGNKTFLDGHVSSMEGITTVAKRKWQDYSTQAGSSMEENADFSAAKHCRMELLMQKCVSTTETAHKLWRSTNESVNDMGSQHVLTMHSVVRNMCDSNEQHVTEFDSTKDAAEEVVTRNSEDAVQSFDSLSEKERASISGILETANTHSETIGVLEHNHASQCTSIEQKALETFQQRYMDYEPTGSTPVRSEPDVPSKGTIESLRTMPMESLLEEFRENNSFESFQVKEVKQSLVPRPPLSQINH

SEQ ID NO: 20408 - protein, 1022 aa, Solanum phureja
TRLLISLSPKKWINFVDLMYYRPFSEDEVRNNAPQVVTCNEYQKEVAVSQNIAGKHIDRVFTFDKVFGPSAQQRDLYDQAIIPIVNEVLEGFNCTIFAYGQTGTGKTYTMEGECKRSKSGHNSELPPGAGVIPRAVKQIFDMLESQNAEYSVKVTFLELYNEEITDLLAPDDLSKVSVEDRQKKQLPLMEDGKGGVLVRGLEEEIVTSASEIFALLERGSAKRRTAETLLNKQSSRSHSLFSITIHIKEANTEGEELIKCGKLNLVDLAGSENISRSGAREGRAREAGEINKSLLTLGRVISALVEHLGHVPYRDSKLTRLLRDSLGGRTKTCIIATVSPAVHCLEETLSTLDYAHRAKNIKNKPEVNQKMMKSTLIKDLYGEIDRLKAGEYFFVLANCEVYATREKNGVYIPKDRYYQEENERKAMTDQIEQMGVTLENQLKQLEELQSRYDHQVHQCSDLTCKLDATQKHLNQTTFFLSNAEEELRQSKYTLKERDFIICEQKKAENALAQQACSLRAQLEKSLKDNTSLFLKIDREDKLSADNRSVVNNFQTDLAKQLGFLSNSVATSVCRQNEHLQCVEKFCHDFLESHDKAVVDLKRKTRASRALYVSHLEAMQNVVKLHKASSTAALEEISALASSNSISIKEFFDAEDVEANSLFEELQSTLSTHQGEMALFAGELRQKFHDSTEHLANISEIIQGFFDKLVEESKKLERHASTVDEIQTKCIAEFEAAYEEQSRAEAEKLIADMTTMVSNHLHRQKELVGTRLVDLRETVTGNKTFLDGHVSSMEGITTVAKRKWQDYSTQAGSSTKENADFSAAKHCRMELLMQKCVSTTETAHKQWQSTNESVNDMGSQHVLTMHSVVRNMCDSNEQHVTEFDSTKDAADEVVTRNSEDAVQSFDSLSEKERASISGILDTANTHSETIGVLEHDHASQCTSIEQKALETFQQRYMDYEPTGSTPVRSEPDVPSKGTIESLRTMPVESLLEEFRENNTFESFQVKEVKPSLVPRSPLSQINH

SEQ ID NO: 20409 - protein, 273 aa, Solanum phureja
MGRLGVKTDYEELRNAQILENKARLASLGLQKTVAELRSIRSKPQSEKRKYNKVDYFSTPLRRSSRLKGNSSELNSCGTAPLAKSLYLWKLGLFDEEDDEDDIEKRPANAPLLRVKYGLMLRLTPEALTRRCTSKDRGTLYDPYLGICCHFCRQKKLCGEEDCKRCGDSDMDQPCLGKTDCSICHSSQGVLCRGCLKVRYGEEMEDVRANKEWICPHCTEEKGINPYWICNSSLCLKKRKMAPTGIAIFKAREMGYKSVAHLLMDQLQGAVKG

SEQ ID NO: 20410 - protein, 187 aa, Phaseolus vulgaris
MLKQAIGRICRTSAYAFEGNRVFPCIHVPSCFFHNGQTHMAPRSFFGVEDFLDDDNSRPYTYQKGKKSKNPHKHISFKQRTIAYMEPFTLDVFISKRFVSASLTHRMTSKQVAVAGTNSKDIKAVLRSRSDIPACISVGKILSERAREADVYTASYTPRERDKFEGKIRAVVQSLIDNGIDVKVYLD

SEQ ID NO: 20411 - protein, 187 aa, Cajanus cajan
MLKQAISRICRTSFYAWEGNTVLPCIYVPSCFLHNGQAHMAPRSFFGVEDFLDDDNSRPYTYQKGKKSKNPNKHVSFKQRTIAYMEPFTLDVFISKRFVSASLTHRVTSKQVAVAGTNSKDIKAVLRSRSDIPACIAIGRILSERAREADVYTASYTPRDRDKFEGKIRAVVQSLIDNGIDVKVYLD

SEQ ID NO: 20412 - protein, 187 aa, Glycine max
MLKQVIGRICRTDVYACEGNRVLPWIYVPSCFFHHGQAHMAPRSFFGVEDFLDDDNSRPYTYQKGKKSKNPNKHISFKQRTIAYMEPFTLDVFISKRFVSASLTHRVTSKQVAVAGTNSKDIKAVLRSRSDIPACIAIGRILAERAKEADVYTGSYTPRDRDKFEGKIRAVVQSLIDNGIDIKVYLD

SEQ ID NO: 20413 - protein, 187 aa, Glycine max
MLKQAIGRIFRTGVYACEGNRVLPWIYVPSSFFHHGQAHMAPRSFFGVEDFLDDDNSRPYTYQKGKKSKNPNKHISFKQRTIAYMEPFTLDVFISKRFVSASLTHRVTSKQVAVAGTNSKDIKAVLRSRSDIPACIAIGRILAERAKEADVYTGSYTPRDRDKFEGKIRAVVQSLIDNGIDIKVYLD

SEQ ID NO: 20414 - protein, 187 aa, Medicago truncatula
MLKQAIGRICRTNAYACEGNKVLPWSYVSSCCFHNGQAHMAPRSFFGVEDFVDDDNSRPYTYQKGKKSKNPNKHISFKQRTVAYMEPFTLDVFISKRFVSASLTHRVTSKQVAVAGTNSKDIKAVLRSRSDIPACIAIGRILAERAMEADVYTASYTPRDRDKFEGKIRAVVQSLIDNGIDLKVYLD

SEQ ID NO: 20415 - protein, 188 aa, Vicia sativa
MLKQAIGRICSRTNVYSCEGNRVLPWIYVPSCFFHNGQANMAPRSFFGVEDFVDDDNSRPYTYQKGKKSKNPNKHISFKQRTVAYMEPFTLDVFISKRFVSASLTHRVTSKQVAVAGTNSKDIKAVLRSRSDIPACIAIGRILAERAVEADVYTASYTPRERDKFEGKIRAVVQSLIDNGIDLKVYLD

SEQ ID NO: 20416 - protein, 187 aa, Cicer arietinum
MLKQAIGRICRANVYSCEGNRVLPWFYVPSCFFHNGQVHNAPRSFFGVEDFIDDDNSRPYTYQKGKKSKNPNKHISFKQRTVAYMEPFTLDVFISKRFVSAALTHRVTSKQVAVAGTNSKDIKAVLRSRSDIPACIAIGRILAERAREADVYTASYTPRDRDKFEGKIRAVVQSLIDNGIDLKVYLD

SEQ ID NO: 20417 - protein, 187 aa, Lupinus angustifolius
MSKQAIGRFFRSNVYACEGNRVLPWIYMPSCYFHNGQAHMAPRSFFGVEDFLDDDNSKPYTYQKGKKSKNPNKHISFKQRTIAYMEPFTLDVFISKRFVSSSLTHRVTSKQVSVAGTNSKDIKAVLRSRSDIPACIAIGRILAERAREADVYTASYTPRDRDKFEGKIRAVVQSLIDNGIDVKVYLD

SEQ ID NO: 20418 - protein, 188 aa, Trigonella foenum-graecum
MLKQAIGRICSRTNVYACEGNRVLPWIYVPSCCFHNGQANMAPRSFFGVEDFVDDDNSRPYTYQKGKKSKNPNKHISFKQRTVAYMEPFTLDVLISKRFVSASLTHRVTSKQVAVAGTNSKDIKAVLRSRSDIPACIAIGRILAERAMEADVYTASYTPRDRDKFEGKIRAVVQSLIDNGVDLKVYLD

SEQ ID NO: 20419 - protein, 189 aa, Trifolium pratense
MLKQAIGRICSSRVNVYAYEGNRILPFIYVPSCCFHNGQANMAPRSFFGVEDFVDDDNSRPYTYQKGKKSKNPNKHISFKQRTVAYMEPFTLDVFISKRFVSASLTHRVTSKQVAVAGTNSKDIKAVLRSRSDIPACIAIGRILAERAMEADVYTASYTPRDRDKFEGKIRAVVQSLIDNGIDLKVYLD

SEQ ID NO: 20420 - protein, 188 aa, Trifolium pratense
MLKQAIGRICSRANVYVYEGNRILPSIYVPSCCFHNGQANMAPRSFFGVEDFVDDDNSRPYTYQKGKKSKNPNKHISFKQRTVAYMEPFTLDVFISKRFVSASLTHRVTSKQVAVAGTNSKDIKAVLRSRSDIPACIAIGRILAERAMEADVYTASYTPRDRDKFEGKIRAVVQSLIDNGVDLKVYLD

SEQ ID NO: 20421 - protein, 202 aa, Glycine max
MLLLIRRSCYWVLRNMLKQVIGRICRTDVYACEGNRVLPWIYVPSCFFHHGQAHMAPRSFFGVEDFLDDDNSRPYTYQKGKKSKNPNKHISFKQRTIAYMEPFTLDVFISKRFVSASLTHRVTSKQVAVAGTNSKDIKAVLRSRSDIPACIAIGRILAERAKEADVYTGSYTPRDRDKFEGKIRAVVQSLIDNGIDIKVYLD

SEQ ID NO: 20422 - protein, 189 aa, Arachis hypogaea
MLKQAVGRIWKSSSGYALEGGTKILAWSYVPSIYFHNTQAHTAPRSFFGVEDFLDDDNSKPYTYQKGKKSKNPHKHVSFKQRTVAYMEPFTLDVFISKRFVSASLTHRVTSKQVAVSGTNSKDIKAVLKSRSDIPACIAIGRILAERAREADVYTASYTPRDRDKFEGKIRAVVQSLIDNGIDVKVYLD

SEQ ID NO: 20423 - protein, 189 aa, Arachis hypogaea
MLKQAVGRIWKSSSGYASEGGTKILAWSYVPSFYFHNTQAHTAPRSFFGVEDFLDDDNSKPYTYQKGKKSKNPDKHVSFKQRTVAYMEPFTLDVFISKRFVSASLTHRVTSKQVAVSGTNSKDIKAVLKSRSDIPACIAIGRILAERAREADVYTASYTPRDRDKFEGKIRAVVQSLIDNGIDVKVYLD

SEQ ID NO: 20424 - protein, 188 aa, Ricinus communis
MLKQVLGKIIHRGPFLNGGDKLRLSLYVPGSCFHNGQVHYSPRSFFGVEDFLDDDNSRPYTYQKEKKSKNPNNKHMSFKQRTKAYMEPFTLDVFISKRFVSASLTHRVTSKQVAVAGTNSKDIKAALRSRSDIPACLAIGRILSERAREADVYTASYTPRERDKFEGKIRAVVQSLIDNGIDIKVYLD

SEQ ID NO: 20425 - protein, 182 aa, Centaurea maculosa
MLKRVCSMSYTHGSERTKLCLKAITRHFHSGQPHSAARSFFGVEDFLDDDNSRPYTYQKEKKSKNPNKHISFKQRTIAYMEPFTLDVFISKRFVSASLTHRVTSKQVAVAGTNSKDIKAALKSRSDIPACLAIGKILSERAREADVFTASYTPRERDKFEGKIRAVVQSLIDNGIDVKIYLD

SEQ ID NO: 20426 - protein, 187 aa, Populus trichocarpa
MLKQVFGKVLNKGFFANGGDKLRPGLYVPNTGFHNGQAHCAPRSFFGVEDFLDDDNSRPYTYQKGKKSKNPNKHLSFKQRTVAYMEPFTLDVFISKRFVSASLTHRVTSKQVAVAGTNSKDIKAVLKSRSDIPACLAVGQILADRAREADVYTASYTPRERDKFEGKIRAVVQSLIDNGIDVKIYLD

SEQ ID NO: 20427 - protein, 187 aa, Juglans hindsii x Juglans regia
MLKYVLGKAWNKGINGFGGDKVRPPFFVLTSSFHNGQVHFAPRSFLGVEDFLDDDNSRPYTYQKGKKSKNPTKHISFKQRTVAYMEPFTLDVFISKRFVSASLTHRVTSKQVAVAGTNSKDIKAVLKSRSDIPACLAVGAILADRAREADVYTASYTPRERDKFEGKIRAVVQSLIDNGIDVKIYLD

SEQ ID NO: 20428 - protein, 1370 aa, Glycine max
MNQYHIYEAIGRGRYSTVYKGRKKKTIEYFAIKSVDKSQKTKVLEEVRILHTLGHVNVLKFYDWYETSAHLWLVLEYCVGGDLLSILRQDSQLPEDSVYDFAYDIVKALQFLHSNGIIYCDLKPSNILLDENGCAKLCDFGLARKLKDISKAPSSSLPRAKRGTPSYMAPELFEDSGVHSYASDFWALGCVLYECYAGRPPFVGREFTQLVKSIISDPTPPLPGNPSRPFVNLINSLLVKDPAERIQWPELCGHAFWRTKFTLVSLPAQPAFDDMIGLHAKPCLSERNGDKSSHNRTPTKYREKDVKGFLRKDENSVLGSRGIETPTRATPIGHRTQTKGSGRIHEVKQKDNSNISKGVNLLRLSRIAKTNLQRENEKENYRRPLPNNSENDSEVKIENTDMELDFNENAEDDAHEETDGAEQTTPVPDEKMVNHFLNQGKAEEVENNTHQLDTPSVHPPVSDDPRSFDHESTPDHPDISAISPSVSPQVKKHRTKEDSGSGLDSDSSRLSNNLSQVLWHASDLSVRPVMPSRKVDKVSEVIPSLPFEALQASDFVKMPKEQLEAVHNRILSILNGNTSIGEKQNVIRYLEMLSSNADAANILTNGPIMLMLVKLQRQSKASALRVQLASLIGLLIRHSTFVDDSLASSGILGALTDGLRDRQEKVRRFSMAALGELLFYISTQNADCRDNNQLESPSKDNRNAHGWQVPNSLISLVSSILRKGEDDITQLYALRTIENICSQGGSWVGRLSSQDVISNLCYIYRASGKQESMRLTAGSCLVRLVRFNPPSIQSVIEKLSFKDLSSALVKGSPREQQISLNLLNMAMLGSHMFTNIGRYLVSLAEDKNLIPSLLGLVEQGSEVLRGKALVLVALLCKHGRRWLPHFFCSQKLLSVVDRLGKEKDAYVRQCLDAFVHIVASSIPGLLDIITGDIQQMMGGRRHGHISALTSRSAPKPNIHLFPVVLHLLGTSTFKHKVVTPQVLRQLANLIKLVETSFQGRDDFQITLLRIFESLTEESPVIIGNPDIFIREILPSLTVLYKGNKDGDARFLCLKILFDVMIILLSEPIEEEQRLTDLKFVSNTRFLPLYPTLIEDEDPIPIYAQKLLVMLMEFSFITIPDILHLKTISQCFEFLLGDLSNANVNNVKLCLALASAPEMESKLLSQLKVVRRIGNFLEFVYAKGMEDLLEPTLGLCKAFLARSVSCTKGFSYTTELILLGDCPPELSGGAVDPQQCIKDIADFGSNVGVLLELSASAETSIADIASECVVLLLKAAPREATTGILTNLPKVTVILESWSRGIPHLIIQRMLHALGYACKQYLLHAMILSISKPEISRTEVIVSELKNSGVPALAKTAGLAALELQRLPRCI

SEQ ID NO: 20429 - protein, 1371 aa, Glycine max
MNQYHIYEAIGRGRYSTVYKGRKKKTIEYFAIKSVDKSQKTKVLEEVRILHTLDHANVLKFYDWYETSAHLWLVLEYCVGGDLLSILRQDSQLPEDSVHGFAYNLVKALQFLHSNEIIYCDLKPSNILLDENGCAKLCDFGLARKLKDISKAPSSSLPRAKRGTPSYMAPELFEDGGVHSYASDFWALGCVLYECYAGRPPFVGREFTQLVKSIISDPTPPLPGNPSRPFVNLINSLLVKDPAERIQWPELCGHAFWRTKFTLLPLPAQPAFDDMIELHAKPCLSERNGDKSSHNRTPTKYREKDVKGALRKDENSVLGSRGIETPARATPIGHRTQTKGSGRIHEVKQKDNSNISKGVNLLRLSRIAKTNLQRENEKENYRRPLPNNSENDSEVKIENTDMELDFNENTEDDAHEETDGTEQTTPVPDEKTDNHFLNQGKAEEIENNTHQLDTPSVVHPPVSDDPRSFDHESTPDLPDISAISPSVSPQVKKHRTKEDAGSGLDFDSSRLSNNLSQVLWHPSDLSVRPVMPSRKIDKASEVIPSLPFEALQASDFVKMPKEKLEAIHNRILSILNGNTSIGEKQNVIRYLEMLSSNADAANILTNGPIMLMLVKLQRQSKASALRVQLASLIGLLIRHSTFVDDSLASSGILGALTDGLRDRQEKVRRFSMAALGELLFYISTQNADCRDNNQLESPSKDNRTTHGWQVPNSLISLVSSMLRKGEDDITQLYALRTIENICSQGGSWVGRLSSQYVISNLCYIYRASGKQESMRLTAGSCLVRLVRFNPPSIQLVIEKLSFKDLASALVKGSPREQQISLNLLNMAMLGSHMFTNIGRCLVSLAEDKNLIPSLLGLVEQGSEVLRGKALVLVALLCKHGRRWLPHFFCSQKLLSVVDRLGKEKDAYVRQCLDAFVHIVASSIPGLLDIITGDVQQMMGGRRQGHISALTSRSAPKTSIHLFPVVLHLLGTSTFKHKVVTPQVLRQLANLIKLVETPFQGRDDFQITLLRIFESLTEESPVILGNPDIFIREILPSSTVLYKGNKDGDARFLCLKILFDVMIILLSEPIEEEHRLKDLKFVSNTHFLPLYPTLIEDEDPIPIYAQKLLVMLMEFSFITIPDILHLKTISQCFEFLLGDLSNANVNNVKLCLALASAPEMESKLLSQLKVVRRIGNFLEFVYAKGMEDLLDPTLGLCKAFLARSVSCTKGFSYTTEPILLGDCPPELSGGAVDPQQCIKDIADFGSNVGVLLELSASAETSIADIASECVVLLLKAAPREATTGILTNLPKVTVILESWNRGIPHLMVQRMLHALGYACKQYLLHAMILSISKPEISRTEVIVSELKSSGGSALAKTAGLAALELQRLPRCI

SEQ ID NO: 20430 - protein, 1371 aa, Glycine max
MNQYHIYEAIGRGRYSTVYKGRKKKTIEYFAIKSVDKSQKTKVLEEVRILHTLDHANVLKFYDWYETSAHLWLVLEYCVGGDLLSILRQDSQLPEDSVHGFAYNLVKALQFLHSNEIIYCDLKPSNILLDENGCAKLCDFGLARKLKDISKAPSSSLPRAKRGTPSYMAPELFEDGGVHSYASDFWALGCVLYECYAGRPPFVGREFTQLVKSIISDPTPPLPGNPSRPFVNLINSLLVKDPAERIQWPELCGHAFWRTKFTLLPLPAQPAFDDMIELHAKPCLSERNGDKSSHNRTPTKYREKDVKGALRKDENSVLGSRGIETPARATPIGHRTQTKGSGRIHEVKQKDNSNISKGVNLLRLSRIAKTNLQRENEKENYRRPLPNNSENDSEVKIENTDMELDFNENTEDDAHEETDGTEQTTPVPDEKTDNHFLNQGKAEEIENNTHQLDTPSVVHPPVSDDPRSFDHESTPDLPDISAISPSVSPQVKKHRTKEDAGSGLDFDFSRLSNNLSQVLWHPSDLSVRPVMPSRKIDKASEVIPSLPFEALQASDFVKMPKEKLEAIHNRILSILNGNTSIGEKQNVIRYLEMLSSNADAANILTNGPIMLMLVKLQRQSKASALRVQLASLIGLLIRHSTFVDDSLASSGILGALTDGLRDRQEKVRRFSMAALGELLFYISTQNADCRDNNQLESPSKDNRTTHGWQVPNSLISLVSSMLRKGEDDITQLYALRTIENICSQGGSWVGRLSSQYVISNLCYIYRASGKQESMRLTAGSCLVRLVRFNPPSIQLVIEKLSFKDLASALVKGSPREQQISLNLLNMAMLGSHMFTNIGRCLVSLAEDKNLIPSLLGLVEQGSEVLRGKALVLVALLCKHGRRWLPHFFCSQKLLSVVDRLGKEKDAYVRQCLDAFVHIVASSIPGLLDIITGDVQQMMGGRRQGHISALTSRSAPKTSIHLFPVVLHLLGTSTFKHKVVTPQVLRQLANLIKLVETPFQGRDDFQITLLRIFESLTEESPVILGNPDIFIREILPSSTVLYKGNKDGDARFLCLKILFDVMIILLSEPIEEEHRLKDLKFVSNTHFLPLYPTLIEDEDPIPIYAQKLLVMLMEFSFITIPDILHLKTISQCFEFLLGDLSNANVNNVKLCLALASAPEMESKLLSQLKVVRRIGNFLEFVYAKGMEDLLDPTLGLCKAFLARSVSCTKGFSYTTEPILLGDCPPELSGGAVDPQQCIKDIADFGSNVGVLLELSASAETSIADIASECVVLLLKAAPREATTGILTNLPKVTVILESWNRGIPHLMVQRMLHALGYACKQYLLHAMILSISKPEISRTEVIVSELKSSGGSALAKTAGLAALELQRLPRCI

SEQ ID NO: 20431 - protein, 1370 aa, Lupinus angustifolius
MNQYHIYEAIGRGKYSTVYKGRKKQTIEYFAIKSVDKSQKNKVLQEVRILHSLDHQNVLKFYSWYETSAHLWLVLEYCVGGDLLSILRQDTQLPEDSVHDLAFDLVKALQFLHSNGIIYCDLKPSNILLDENGRTKLCDFGLARKLRDISKAPSSSLPQAKRGTPSYMAPELFEDGGVHSYASDFWALGCVLYECYTGRPPFLGREFTQLVKSIISDPTPPLPGNPSRPFVNLINSLLVKDPAERIQWPELCGHAFWSTKLTMVPLPAQLAFDDMIELHAKPCIPERNGDKSSHNKTPPKYREKDVKGVMKKDENSILGSRGIETPTRATPNGHRTQAKVSGKIAEAKQKGPSKISKVVNLLRLSRIAKSNLQKENEKENYRRPLPNNSENDSEVKIENTDMELDFNENTEDDAPEETDGLEHTTSIPDEKMDNSDQKQGKIEETANNIHQLDTPSIVNTPVSHDPRSVDQESTPDYSDISAISPSVSPQVKKHRVKEEAGSGLDSESSRSSNNLSQVLWHPSDLSVRPVMPSRKVDKVSEVIPSLPFEALQASDFVKLPKEQLDAILNRIIAILNGNASIGEKQNLVRYLELLSSNADAANILTNGPIMLILVKLLRQSKALALRVQLASLIGLLIRHSTFVDDSLANSGILGSLTDGLRDKQEKVRRFSMAALGELLFYISTQNADCRDNNPLESPSKDNRTSVGWQVPNSLISFVSSMLRKGEDDLTQLYALRTVENVCSQGGTWVGRLSSQDVISNLCYIYRASGKQESMRLTAGSCLVRLVRFNPPSIQSVMEKLSFKDLASALVKGSPREQQISLNLLNMAMLGSHMFTNMGRYLLPLAEDKNLIPSLLAFVEQGSEVLKGKALVLVALLCKHGRRWLSLFFCSQKLLSVVDRLGKEKDAYVHQCLDAFVHVVASTIPGLLDTITGDIQQMMGGRRQGHVSALTSRSAPKTNIHVFPVVLHLIGSSILKHKVVTPHVLQQLASLIKLTETPFQGRDDFQITLLRVLECLTEESLVVLGNPDIFVREILPSLTVLYKGNKDGDARFLCLKILFDVMIIVLSEPVEEEQRLKDLKFISNARFLPLYPTLIEDEDPIPIFAQKLLVMLLEFNFITIQDILHIKTISQCFEFLLGDLSNANVNNVKICLALASAPGMESKILSQLKVVRRIGNFLEFVYAKGMEDLLEPTLGLCKAFLARSVTCAKGFNYSTEPTLLCDNPSEMSGAVDPQQCIRDIADLASNVGVLLELSASIETNIVDIASECVVLLLKAAPREATTGLLTNLPKVSVILESWSRGTPHLLVQRMLHALGYACKQYLLHAMILSISIPEISRIEVIVSELKSSGVPGLTKAATLAALELQRLPRCI

SEQ ID NO: 20432 - protein, 1284 aa, Cajanus cajan
MNQYHIYEAIGRGKHSTVYKGRKKKTIEYFAIKSVDKLQKTKVLEEVRILHTLDHVNVLKFHEWYETSAHLWLVLEYCVGGDLLSILQQDSQLPEDSVHDLAYDLVKALQFLHSNGIIYCDLKPSNILLDENGCAKLCDFGLARKLKDISKAPSPLLSSRAKRGTPYYMAPELFEDGGVHSYASDFWALGCVLYECYTGKPPFVARELTQLVKSIISDPTPPLPGNPSRPFVNLINSLLVKDPAERIHWPELCGHAFWRTKFTLVPLPAQPAFDDMIGLHAKPCLSEQNEKENYRRPLPNNSENDSEVKIENTDMELDFNENTEDDAHEDSDGAEQTTPVPSEKMDNHFLNQGKVEEIENNTHQLDTPSVVNTPASDDPRSFDHESAPDCPDISAISPSVSPQVKKHRGVKEDSGSGLESDSSRLSNNLSQVLWHPSDLSVRPVMPSRKVDKVLEVIPSLPFEALQASDFVKMPKEQLEAVLNRILAILNGNTSIGEKQNVIRYLEMLSSNADAANILTNGPIMLMLVKLLRQSKASALRVQLASLIGLLIRHSTFVDDSLANSGILGALTDGLRDRQEKVRRFSMAALGELLFYISTQNADGKDNSQLESPSKDNRTTYGWQVPNSLISFVSSILRKGEDDITQLYALRTIENICSQGGFWVGRLTSQDVISNLCYIYRAAGKQESMRLTAGSCLVRLVRFNPPSIQSVIEKLSFKDLASALVKGSPREQQISLNLLNMAILGNTFTNIGRYLLPLAEDKNLIPSLLALVEQGTEVLRGKALVLVALLCKHGRRWLPHFFCSQKLLSVVDRLGKEKDAYVRQCLDAFVPIVASSIPGLLDIITGDVQQMMGARRHGHISALASRSASKTNIHLFPVVLHLLGSSTFKHKVVTPQVLRQLANLIKLVETPFQGRDDFQITLLRIFESLTEESPVILGNPDIFIREILPSLTVLYKGNKDGDARFLCLKILFDVMIVLLSEPIEEEQRLKDLKFISNTRFLPLYPTLIEDEDPIPIYAQKLLVMLLEFSFITIPDILHLKTISQCFEFLLGDLSNANVNNVKLCLALASAPEMESKILSHLKVVRRIGNFLEFVYAKGMDDLLEPTLGLCRAFLARSVSCTKGFSYTTEPTLLGKCPPELSGGAIDPQQCIKDIADFGSNVSILLELSASTETTIADMASECVVLLLKAAPREATTGILTNLPKVTVILETWNRGIPHLMVQRMLHALGYACKQYLLHAMILSISIPEISRIEVIVSELKSSGVPALAKTAGLAAMELQRLPRCI

SEQ ID NO: 20433 - protein, 1358 aa, Medicago truncatula
MNQYHIYEAIGRGRYSTVYKGRKKKTIEYFAIKSVDKSQKNKVLQEVRILHTLDHQNVLKFYSWYETSAHLWLVLEYCVGGDLLSILRQDSQLPEDSVNELACDLVRALQYLHSNGIIYCDLKPSNILLDENGRTKLCDFGLARRLKEISKVPSSSLPQAKRGTPSYMAPELFEDGGVHSYASDFWALGCVLYECYTGRPPFVGREFTQLVKSIISDPTPPLPGNPSPPFVNLINSLLVKDPAERIQWHELCGHGFWKTKFTLVSLPPQPAFDDMTELHAKQCLSERNGDKSSHNRTPPKSREKDGKGARAIETPTRATPNGHRTQTKGSGRTVEAKQKDPSIIKKGLNLLRMSRIAKSNLQKENEKENYRRPLPNGSEKDVDVKIENTDMELDFNENNEEDALDENDGSEHTPSVANEKMESNFQNQGKADDTENDIHRLDTPSVTTPASDDSRTFVHESTPDRSDISAISPSVSPLVKKQRLKDDLGSGLDSDSSRSSNDISQVSWHPSDLSVRPVMPSRKVDKGSEVIPSLPFEALQAPEFVKMPKEQLEALHNRIIAILNGSTAIGEKQNAVRYLEMLSTNADAANILTNGPIMLILIKLLRQSKASALRVQLASLIGLLIRHSTFVDDSLANSGILGSLTDGLRDRQEKVRRFSMAALGELLFYISTQSADSRDNTPLESPSKDNRTAHGWQVPNSLISLVSSVLRKGEDDITQLYALRTIENICSQGGAWVGRLISQDVISNLCYIYRAVGKLESMRLTAGSCLVRLVRFNPPSIQSVIEKLSFKDLASALVKGSPREQQISLNLLNTAMLGSHMLTNVGRYLMQLAEDKNLIPSLLAFVEQGSKVLKGKALVFVALLCKHGRRWLPQFFCSHKLLSVVDRLGKEKDAFVRQCLDAFLHIVASTIPGLLDIITGDIQQMMGGRRHGHISSLTSRSAPKSNIHLFPVVLHLLESSAFKHKVATLPVLRQLANLIKLAEAPFQGRDDFQITLLRILESLTEESSVILANPDIFLREILPSLTVLYKGNKDGDARFLCLKIFFDVMIILLSEPIEEEQRLNDLKFVSNTHFLPLYPTLIEDEDPIPIFAQKLLVMLLEFSFISIPDILHLKTISQCFEFLLGDLSNANVNNVKLCLALASAPEMESKLLSQLKVVRRIGNFLEFVCAKGMEDLLEPTLGLCRAFLARSVSCTKGFSYTTEPTLLGDSPPEVSGAVDPQQCIRDITDFGNNVGVFLELSGSRETSVADIASQCVVLLLKAAPREATTGLLTNLPKVTVILESWSKGTPHLTVQRMLHALGYACKQYLLHAMILSISIPEISRIEVIVTELKSSSVPALAKTAGLAALELQRLPRCI

SEQ ID NO: 20434 - protein, 983 aa, Fragaria vesca
MASTTTSFAAPGVVALRLPQSKCCTKASLFPHPNPSVSLRARPHFLRGLTSCRFDPNSPFQTGSGRMTRSPNQFVVRAMASSAGRGQITQQDFTEMAWQAVVSSPEVAKENKHQIVETEHLMKALLEQKNGLARRIFAKAGVDNTQLLEATDKYIQRQPKILGETAGSMLGRDLEALLERARDYKKEYGDSFVSVEHLVLGFIQDQRFGKQLFKEFQISKQSLKSAIESIRGRQSVIDQDPEGKYESLEKYGKDLTAMARQGKLDPVIGRDDEIRRCIQILSRRTKNNPVLIGEPGVGKTAISEGLAQRIVQEDVPQALMNRKLISLDMGSLIAGAKYRGEFEDRLKAVLKEVTESEGQIILFIDEIHTVVGAGATSGAMDAGNLLKPMLGRGELRCIGATTLDEYRKYIEKDPALERRFQQVYVDQPTVEDTISILRGLRERYELHHGVRISDGALVEAAILSDRYISGRFLPDKAIDLVDEAAAKLKMEITSKPTALDEINRSVLKLEMERLSLTNDTDKASRERLNRLEAELSVLKEKQSQLSEQWEHEKSVMTRIQSIKEEVDRVNLEIQQAEREYDLNRAAELKYGSLNSLQRQLLSAEKELDEYIRSGKSMLREEVTGNDISEIVSKWTGIPVSKLLQSEREKLLHLEEELHKRVVGQDPAVKSVAEAIQRSRAGLSDPHRPIASFMFMGPTGVGKTELAKTLASYMFNTEEALVRIDMSEYMEKHAVSRLIGAPPGYVGYEEGGQLTEVVRRRPYSVILFDEIEKAHSDVFNVFLQILDDGRVTDSQGRTVSFTNTVIIMTSNVGSQYILNGDDDVSPKELGYETIKQRVMEAARSVFRPEFMNRVDEYIVFQPLDRDQINNIVRIQLERVQRRIADRKMKIQVSDAAVQLLGSLGYDPNYGARPVKRVIQQYVENELAKGILRGEFQEEGTILVDTEVTAYGNGQLPQQKLVFKTLETGSESPAAENKGALSGAV

SEQ ID NO: 20435 - protein, 979 aa, Cocos nucifera
MAASLSAHQHHLLRLVPLPSKSSGRSPSVAALFPVSSNGPRSQSALRALRWSGTLGRSDRFVSKRAGRSGSGSRSVVIRCEASKDGRITQQEFTEMAWQAIVSSPEVAKESKHQIVETEHLMKALLEQRNGLARRIFSKAGIDNSRLLDATDKFIQRQPKVLGETAGSMLGRDLEALIQRAREYKKEYGDSFVSVEHLVLGYADDRRFGKQLFKDFQISLQTLQSAIKAIRGNQTVIDQDPEGKYEALEKYGKDLTAMAREGKLDPVIGRDDEIRRCIQILSRRTKNNPVLIGEPGVGKTAISEGLAQRIVQGDVPQALMNRRLISLDMGALIAGAKYRGEFEDRLKAVLKEVTESDGQIILFIDEIHTVVGAGATNGAMDAGNLLKPMLGRGELRCIGATTLDEYRKYIEKDPALERRFQQVYVDQPSVEDTISILRGLRERYELHHGVRISDSALVEAAILSDRYISGRFLPDKAIDLVDEAAAKLKMEITSKPTALDEINRSVLKLEMERLSLTNDTDKASKDRLSRLEAELALLKEKQAELTEQWEHEKSVMTRIQSIKEEIDRVNVEIQQAEREYDLNRAAELKYGSLNTLQRQLEIAEKELDEYQSSGKSMLREEVTGNDIAEIVSKWTGIPVSKLQQSEREKLLHLEEELHKRVVGQDPAVRAVAEAIQRSRAGLSDPHRPIASFMFMGPTGVGKTELAKALASYMFNTEEALVRIDMSEYMEKHAVSRLIGAPPGYVGYEEGGQLTETVRRRPYAVILFDEIEKAHSDVFNAFLQILDDGRVTDSQGRTVSFTNTVIIMTSNVGSQYILNMNDETESKDSAYEAIKQRVMEAARSIFRPEFMNRVDEYIVFQPLDREQINSIVRLQLERVQKRVADRKIKIEVTDAAVEFLGSLGYDPNYGARPVKRVIQQNVENELAKGILRGDFKEEDTISVDTEVCAFSNGQLPQQKLVFRRLDPDSSDKPASEEQKA

SEQ ID NO: 20436 - protein, 967 aa, Eutrema parvulum
MATAATAAFSDVVGVGSESRQISSFSHLQPSVAFPAKPSSFKALKLKQSARLTRRLEHRPFVIRCEASSNGRLTQQEFTEMAWQSIVSSPDVAKENKQQIVETEHLMKALLEQKNGLARRIFSKIGVDNTKVLEATEKFIQRQPKVYGEAAGSMLGRDLEGLFQRARQYKKDLGDSYVSVEHLVLAFAEDKRFGKQLFRDFQISEKSLKSAIESIRGKQSVIDQDPEGKYEALEKYGKDLTAMAREGKLDPVIGRDDEIRRCIQILSRRTKNNPVLIGEPGVGKTAISEGLAQRIVQGDVPQALMNRKLISLDMGALIAGAKYRGEFEDRLKAVLKEVTDSEGQTILFIDEIHTVVGAGATNGAMDAGNLLKPMLGRGELRCIGATTLDEYRKYIEKDPALERRFQQVYVDQPTVEDTISILRGLRERYELHHGVRISDSALVEAAILSDRYISGRFLPDKAIDLVDEAAAKLKMEITSKPTALDELDRAVIKLEMERLSLTNDTDKASRERLNRIETELLLLKEKQAELTEQWEHERSVMSRLQSIKEEIDRVNLEIQQAEREYDLNRAAELKYGSLNSLQRQLNEAEKELNEYLSSGKSMFREEVLGSDIAEIVSKWTGIPVSKLQQSERDKLLHLEEELHKRVVGQNPAVTAVAEAIQRSRAGLSDPGRPIASFMFMGPTGVGKTELAKALASYLFNTEEALVRIDMSEYMEKHAVSRLIGAPPGYVGYEEGGQLTETVRRRPYSVILFDEIEKAHGDVFNVFLQILDDGRVTDSQGRTVSFTNTVIIMTSNVGSQFILNNTDDDAKELAYDTIKQRVMDAARSIFRPEFMNRVDEYIVFQPLDREQINSIVRLQLARVQKRIVDRKMKIEITDAAVDLLGSLGYDPNYGARPVKRVIQQNIENELAKGILRGDFKEEDGILIDTEVTAFSNGQLPQQKLIFKNIESETADAEKEKEAFSKQRN

SEQ ID NO: 20437 - protein, 973 aa, Brassica rapa
MATAKTTATAAFSGIVGGVGSDSRKVSSFSHLQPSVAFPAKPTSFKALKLKQSARLTRRLQHQPFVVRCEASSNGRLTQQEFTEMAWQSIVSSPDVAKENKQQIVETEHLMKALLEQKNGLARRIFSKIGVDNTKVLEATDKFIQRQPKVYGEAAGSMLGRDLEGLFQRARQYKKDLGDSYVSVEHLVLAFVDDKRFGKQLFRDFQISEKSLKTAIESIRGKQSVIDQDPEGKYEALEKYGKDLTAMAREGKLDPVIGRDDEIRRCIQILSRRTKNNPVLIGEPGVGKTAISEGLAQRIVQGDVPQALMNRKLISLDMGALIAGAKYRGEFEDRLKAVLKEVTDSEGQTILFIDEIHTVVGAGATNGAMDAGNLLKPMLGRGELRCIGATTLDEYRKYIEKDPALERRFQQVYVDQPTVEDTVSILRGLRERYELHHGVRISDSALVEAAILSDRYISGRFLPDKAIDLVDEAAAKLKMEITSKPTALDELDRAVIKLEMERLSLTNDTDKASRERLNRIETELVLLKEKQAELTEQWEHERSVMSRLQSIKEEIDRVNLEIQQAEREYDLNRAAELKYGSLNSLQRQLNEAEKELNEYLSSGKSMFREEVLGSDIAEIVSKWTGIPVSKLQQSERDKLLHLEEELHRRVIGQNPAVTAVAEAIQRSRAGLSDPGRPIASFMFMGPTGVGKTELAKALASYLFNTEEALVRIDMSEYMEKHAVSRLIGAPPGYVGYEEGGQLTEVVRRRPYSVILFDEIEKAHGDVFNVFLQILDDGRVTDSQGRTVSFTNTVIIMTSNVGSQYILNNNADDEGSELGYETIKQRVMDAARSIFRPEFMNRVDEYIVFQPLDREQINSIVRLQLARVQKRIADRKMKIEITDAAVDLLGSLGYDPNYGARPVKRVIQQNIENELAKGILRGDFKEEDGILIDTEVTAFSNGQLPQQKLTFKKIASETADAEKEEEEAFSKQSN

SEQ ID NO: 20438 - protein, 972 aa, Arabidopsis lyrata
MATATTTATAAFSGVVSVGTKTRRISTFSHLQPSVAFPAKPNSFKLLKFKQSARLTRRLEHRPFFVRCEASSSNGRLTQQEFTEMAWQSIVSSPDVAKENKQQIVETEHLMKALLEQKNGLARRIFSKIGVDNTKVLEATEKFIQRQPKVYGDAAGSMLGRDLEGLFQRARQFKKDLGDSYVSVEHLVLAFADDKRFGKQLFKDFQISEKSLKSAIESIRGKQSVIDQDPEGKYEALEKYGKDLTAMAREGKLDPVIGRDDEIRRCIQILSRRTKNNPVLIGEPGVGKTAISEGLAQRIVQGDVPQALMNRKLISLDMGALIAGAKYRGEFEDRLKAVLKEVTDSEGQIILFIDEIHTVVGAGATNGAMDAGNLLKPMLGRGELRCIGATTLDEYRKYIEKDPALERRFQQVYVDQPTVEDTISILRGLRERYELHHGVRISDSALVEAAILSDRYISGRFLPDKAIDLVDEAAAKLKMEITSKPTALDELDRSVIKLEMERLSLTNDTDKASRERLNRIETELVLLKEKQAELTEQWEHERSVMSRLQSIKEEIDRVNVEIQQAEREYDLNRAAELKYGSLNSLQRQLNEAEKELNEYLSSGKSMFREEVLGSDIAEIVSKWTGIPVSKLQQSERDKLLHLEEELHKRVVGQNPAVTAVAEAIQRSRAGLSDPGRPIASFMFMGPTGVGKTELAKTLASYLFNTEEALVRIDMSEYMEKHAVSRLIGAPPGYVGYEEGGQLTETVRRRPYSVILFDEIEKAHGDVFNVFLQILDDGRVTDSQGRTVSFTNTVIIMTSNVGSQFILNNTDDDANELVYETIKERVMNAARSIFRPEFMNRVDEYIVFQPLDREQINRIVRLQLARVQKRIADRKMKINITDAAVDLLGSLGYDPNYGARPVKRVIQQNIENELAKGILRGDFKEEDGILIDTEVTAFSNGQLPQQKLTFKKIESETADAEQEEEEAFSKQSR

SEQ ID NO: 20439 - protein, 959 aa, Brassica napus
MATAKTTATAAFSGIVGGVGSDSRKVSSFSHLQPSVAFPAKPTSFKALKLKQSARLTRRLQHQPFVVRCEASSNGRLTQQEFTEMAWQSIVSSPDVAKENKQQIVETEHLMKALLEQKNGLARRIFSKIGVDNTKVLEATDKFIQRQPKVYGEAAGSMLGRDLEGLFQRARQYKKDLGDSYVSVEHLVLAFVDDKRFGKQLFRDFQISEKSLKTAIESIRGKQSVIDQDPEGKYEALEKYGKDLTAMAREGKLDPVIGRDDEIRRCIQILSRRTKNNPVLIGEPGVGKTAISEGLAQRIVQGDVPQALMNRKLISLDMGALIAGAKYRGEFEDRLKAVLKEVTDSEGQTILFIDEIHTVVGAGATNGAMDAGNLLKPMLGRGELRCIGATTLDEYRKYIEKDPALERRFQQVYVDQPTVEDTVSILRGLRERYELHHGVRISDSALVEAAILSDRYISGRFLPDKAIDLVDEAAAKLKMEITSKPTALDELDRAVIKLEMERLSLTNDTDKASRERLNRIETELVLLKEKQAELTEQWEHERSVMSRLQSIKEEIDRVNLEIQQAEREYDLNRAAELKYGSLNSLQRQLNEAEKELNEYLSSGKSMFREEVLGSDIAEIVSKWTGIPVSKLQQSERDKLLHLEEELHRRVIGQNPAVTAVAEAIQRSRAGLSDPGRPIASFMFMGPTGVGKTELAKALASYLFNTEEALVRIDMSEYMEKHAVSRLIGAPPGYVGYEEGGQLTEVVRRRPYSVILFDEIEKAHGDVFNVFLQILDDGRVTDSQGRTVSFTNTVIIMTSNVGSQYILNNNADDEGSELGYETIKQRVMDAARSIFRPEFMNRVDEYIVFQPLDREQINSIVRLQLARVQKRIADRKMKIEITDAAVDLLGSLGYDPNYGARPVKRVIQQNIENELAKGILRGDFKEEDGILIDTEVTAFSNGQLPQQKLTFKKIASETAD

SEQ ID NO: 20440 - protein, 405 aa, Sorghum bicolor
MAAAAAAATAKAAEEMVEVLDEETLALMGVSSAATAAPVAVGAEWETFKENVRPLKRGRDVSKLNHALKAHADPAQRAALLETRKKMIEAIDQYQGEDPLQPWLDCIKWVQESFPTGGECSGLVVLYEQCVRTFWHDGRYKDDLRFLKVWLEYAGNCADAEVIYRFLEANQIGQGHAIYYMAYASLMESKNKLRKAKEIFDLGIARKAKPMEKLEAVYRTFLRRSTKRREQEPDNTADDDLPNRSFGTNLKRDENRNHQAGNSGLGRPRALQRIDPNRPLSIYKDERPLLNQGLDGVRNRENNTSWRTLPTQADRNKENSMMPAKWTSHKIPQKLGARGAVQSTRTSSIEVFVEEDTAQEPAQPVPKTPNPSVLKLRQATSKSLKKETELLKENPLRNFPLSSLR

SEQ ID NO: 20441 - protein, 399 aa, Panicum virgatum
MAAAAGAEEMVAVLDEETLALMGISNAAAVAPPVAVGAEWETFKENVRPLKRGRDVSKLNRALKAQVDPAQRAALLEARRRMIEAIYEYQGEDPLQPWLDCIKWVQESFPTGGECSGLVVLYEQCVRTFWHDERYKEDLRFLKVWLEYAGNCTDAEVIYRFLEANQIGQSHAIYYMSYASLLESKNKLRKANEIFHLGISRKAKPLEKLEAVYRTFLRRSTKKSEHAEQDDTTDDLPIRSFGTNLKRDENRNQQADNSHLGRPRALQRIDVNKPLSVYKDEKSLPNQGIDSTRNKENMSWRTLGTQADRNKENNMMPAKWTCHKVPQKLGARGAVQPTRATSIEVFVDEECAQEPARKVPKSPNPSVLKLRQATSKSIKKETELLKENPLRNFPLSSLR

SEQ ID NO: 20442 - protein, 88 aa, Glycine max
  Sequence also found in Organisms: Cicer arietinum, Cyamopsis tetragonoloba, Glycyrrhiza uralensis, Lotus japonicus, Lupinus angustifolius, Vicia sativa
MASTKVQRVMTQPINLIFRFLQSKARIQIWLFEQKDLRIEGRIIGFDEYMNLVLDDAEEVNVKKKSRKTLGRILLKGDNITLMMNTGK

SEQ ID NO: 20443 - protein, 88 aa, Cajanus cajan
MASTKVQRVMTQPINLIFRFLQSKARIQIWLFEQKDLRIEGRIIGFDEYMNLVLDDAEEVNVKKNSKKTLGRILLKGDNITLMMNTGK

SEQ ID NO: 20444 - protein, 88 aa, Cajanus cajan
MASTKVQRVMTQPINLIFRFLQSKARIQIWLFEQKDLRIEGRIIGFDEYMNLVLDDAEEVNIKKKSKKTLGRILLKGDNITLMMNTGK

SEQ ID NO: 20445 - protein, 88 aa, Glycine max
MASTKVQRVMTQPINLIFRFLQSKARIQIWLFEQKDLRIEGRIIGFDEYMNLVLDDAEEVNIKKKSRKTLGRILLKGDNITLMMNTGK

SEQ ID NO: 20446 - protein, 88 aa, Phaseolus vulgaris
MASTKVQRVMTQPINLIFRFLQSKARIQIWLFEQKDLRIEGRIIGFDEYMNLVLDDAEEVNVKKKSRKTLGRILLKGDNITLMMSTGK

SEQ ID NO: 20447 - protein, 88 aa, Fagus grandifolia
MASTKVQRIMTQPINLIFRFLQSKARIQIWLFEQRDLRIEGRIIGFDEYMNLVLDDAEEVNVKKKSKKTLGRILLKGDNITLMMNTGK

SEQ ID NO: 20448 - protein, 88 aa, Cicer arietinum
MASTKVQRVMTQPINLIFRFLQSKARIQIWLFEQKDLRIEGRIIGFDEYMNLVLDDAEEVNVKKKSRKTLGRILLKGDNITLMMNTAK

SEQ ID NO: 20449 - protein, 88 aa, Vigna unguiculata
MASTKVQRVMTQPINLIFRFLQSKARIQIWLFEQKDLRIEGRIIGFDEYMNLVLDDAEEVNIKKKSKKTLGRILLKGDNITLMMSTGK

SEQ ID NO: 20450 - protein, 88 aa, Cucurbita pepo
MASTKVQRIMTQPINLIFRFLQSKARIQIWLFEQKDLRIEGRIIGFDEYMNLVLDDAEEVNVKKKSKKSLGRILLKGDNITLMMNTGK

SEQ ID NO: 20451 - protein, 88 aa, Lotus japonicus
  Sequence also found in Organisms: Trigonella foenum-graecum
MASTKVQRVMTQPINLIFRFLQSKARIQIWLFEQKDLRIEGRIIGFDEYMNLVLDDAEEVNVKKNSRKTLGRILLKGDNITLMMNTGK

SEQ ID NO: 20452 - protein, 88 aa, Momordica charantia
MASTKVQRIMTQPINLIFRFLQSKARIQIWLFEQKDLRIEGRIIGFDEYMNLVLDDAEEVNVKKKSRKTLGRILLKGDNITLMMNTGK

SEQ ID NO: 20453 - protein, 88 aa, Petunia hybrida
MASTKVQRIMTQPINLIFRFLQSKARIQIWLFEQKDLRIEGRIIGFDEYMNLVLDDAEEVNVKKKSKKQLGRILLKGDNITLMMNTGK

SEQ ID NO: 20454 - protein, 88 aa, Glycine max
MASTKVQRVMTQPINLIFRFLQSKARIQIWLFEQKDLRIEGRIIGFDEYMNLVLDDAEEVSIKKKSRKTLGRILLKGDNITLMMNTGK

SEQ ID NO: 20455 - protein, 88 aa, Amaranthus tuberculatus
MASTKVQRIMTQPINLIFRFLQSKARIQIWLFEQKDLRIEGRIIGFDEYMNLVLDDAEEVNVKKKTKKTLGRILLKGDNITLMMNTAK

SEQ ID NO: 20456 - protein, 88 aa, Ricinus communis
MASTKVQRIMTQPINLIFRFLQSKARIQFWLFEQKDLRIEGRIIGFDEYMNLVLDDAEEVNVKKKSRKTLGRILLKGDNITLMMNTGK

SEQ ID NO: 20457 - protein, 88 aa, Cucumis sativus
  Sequence also found in Organisms: Cucumis melo, Citrullus lanatus
MASTKVQRIMTQPINLIFRFLQSKARIQIWLFEQKDLRIEGRIIGFDEYMNLVLDDAEEVNVKKKSRKTLGRILLKGDNITLMMNSGK

SEQ ID NO: 20458 - protein, 88 aa, Cucumis sativus
MASTKVQRIMTQPINLIFRFLQSKARIQIWLFEQKDLRIEGRIIGFDEYMNLVLDDAEEVNVKKKSKKALGRILLKGDNITLMMNSGK

SEQ ID NO: 20459 - protein, 88 aa, Linum usitatissimum
MASTKVQRIMTQPINLIFRFLQSKARIQIWLFEQKDLRIEGRIIGFDEYMNLVLDDAEEVNVKKKSRKSLGRILLKGDNITLMMNTGK

SEQ ID NO: 20460 - protein, 88 aa, Humulus lupulus
MASTKVQRIMTQPINLIFRFLQSKARIQIWLFEQKDLRIEGRIIGFDEYMNLVLDDAEEVNVKKKSSKTLGRILLKGDNITLMMNSGK

SEQ ID NO: 20461 - protein, 88 aa, Cucumis melo
MASTKVQRIMTQPINLIFRFLQSKARIQIWLFEQKDLRIEGRIIGFDEYMNLVLDDAEEVNVKKKSKKALGRILLKGDNITLMMNAGK

SEQ ID NO: 20462 - protein, 88 aa, Nicotiana benthamiana
  Sequence also found in Organisms: Nicotiana tabacum
MASTKVQRIMTQPINLIFRFLQSKARIQIWLFEQKDLRIEGRIIGFDEYMNLVLDDAEEVNVKKKSRKQLGRILLKGDNITLMMNTGK

SEQ ID NO: 20463 - protein, 88 aa, Orobanche aegyptiaca
MASTKVQRIMTQPINLIFRFLQSKARIQIWLFEQKDLRIEGRIIGFDEYMNLVLDDAEEVNVKKKSRKHLGRILLKGDNITLMMNTGK

SEQ ID NO: 20464 - protein, 88 aa, Arachis hypogaea
MASTKVQRVMTQPINLIFRFLQSKARIQIWLFEQKDLRIEGRIIGFDEYMNLVLDDAEEVNVKKNTRKTLGRILLKGDNITLMMNTGK

SEQ ID NO: 20465 - protein, 88 aa, Arachis hypogaea
MASTKVQRVMTQPINLIFRFLQSKARIQIWLFEQKDLRIEGRIIGFDEYMNLVLDDAEEVNVKKNIRKTLGRILLKGDNITLMMNTGK

SEQ ID NO: 20466 - protein, 88 aa, Citrullus lanatus
MASTKVQRIMTQPINLIFRFLQSKARIQIWLFEQKDLRIEGRIIGFDEYMNLVLDDAEEVHVKKKSKKALGRILLKGDNITLMMNTGK

SEQ ID NO: 20467 - protein, 88 aa, Phaseolus vulgaris
MASTKVQRVMTQPINLIFRFLQSKARIQIWLFEQKDLKIEGRIIGFDEYMNLVLDDAEEVNIKKKSRKTLGRILLKGDNITLMMSTGK

SEQ ID NO: 20468 - protein, 88 aa, Ricinus communis
MASTKVQRIMTQPINLIFRFLQSKARIQIWLFEQKDLRIEGRIIGFDEYMNLVLDDAEEVNVKKKTRKTLGRILLKGDNITLMMNSGK

SEQ ID NO: 20469 - protein, 88 aa, Gossypium hirsutum
  Sequence also found in Organisms: Castanea mollissima, Gossypium raimondii, Quercus alba
MASTKVQRIMTQPINLIFRFLQSKARIQIWLFEQKDLRIEGRIIGFDEYMNLVLDDAEEVNVKKKSRKSLGRILLKGDNITLMMNSGK

SEQ ID NO: 20470 - protein, 88 aa, Cleome gynandra
MASTKVQRIMTQPINLIFRFLQSKARIQIWLFEQKDLRIEGRIIGFDEYMNLVLDDAEEVNIKKKTRKTLGRILLKGDNITLMMNTGK

SEQ ID NO: 20471 - protein, 88 aa, Solanum lycopersicum
  Sequence also found in Organisms: Solanum melongena, Solanum tuberosum
MASTKVQRIMTQPINLIFRFLQSKARIQIWLFEQKDLRIEGRIIGFDEYMNLVLDDAEEVNVKKKTSKQLGRILLKGDNITLMMNTGK

SEQ ID NO: 20472 - protein, 88 aa, Linum usitatissimum
MASTKVQRIMTQPINLIFRFLQSKARIQIWLFEQKDMRIEGRIIGFDEYMNLVLDDAEEVNVKKKSRKSLGRILLKGDNITLMMNTGK

SEQ ID NO: 20473 - protein, 88 aa, Fraxinus spp
MASTKVQRIMTQPINLIFRFLQSKARIQIWLFEQKDTRIEGRIIGFDEYMNLVLDDAEEVNVKKKSRKQLGRILLKGDNITLMMNTGK

SEQ ID NO: 20474 - protein, 88 aa, Vitis vinifera
MATTKVQRIMTQPINLIFRFLQSKARIQIWLFEQKDLRIEGRIIGFDEYMNLVLDDAEEVNVKKNTKKTLGRILLKGDNITLMMNTGK

SEQ ID NO: 20475 - protein, 88 aa, Ipomoea batatas
  Sequence also found in Organisms: Ipomoea nil, Sesamum indicum
MASTKVQRIMTQPINLIFRFLQSKARIQIWLFEQKDLRIEGRIIGFDEYMNLVLDDAEEVNVKKNSRKQLGRILLKGDNITLMMNTGK

SEQ ID NO: 20476 - protein, 88 aa, Tropaeolum majus
MASTKVQRIMTQPINLIFRFLQSKARIQIWLFEQKDLRIEGRIIGFDEYMNLVLDDAEEVNIKKKSRKTLGRILLKGDNITLMMSTGK

SEQ ID NO: 20477 - protein, 88 aa, Nicotiana benthamiana
MASTKVQRIMTQPINLIFRFLQSKARIQIWLFEQKDLRIEGRIIGFDEYMNLVLDDAEEVSVKKKSRKQLGRILLKGDNITLMMNTGK

SEQ ID NO: 20478 - protein, 88 aa, Carica papaya
MASTKVQRIMTQPINLIFRFLQSKARIQIWLFEQKDLRIEGRIIGFDEYMNLVLDDAEEVNIKKKSRKSLGRILLKGDNITLMMNTGK

SEQ ID NO: 20479 - protein, 88 aa, Capsicum annuum
MASTKVQRIMTQPINLIFRFLQSKARIQIWLFEQKDLRIEGRIIGFDEYMNLVLDDADEVNVKKKSRKQLGRILLKGDNITLMMNTGK

SEQ ID NO: 20480 - protein, 88 aa, Petunia hybrida
MASTKVQRIMTQPINLIFRFLQSKARIQIWLFEQKDSRIEGRIIGFDEYMNLVLDDAEEVNVKKKSRKQLGRILLKGDNITLMMNTGK

SEQ ID NO: 20481 - protein, 88 aa, Rhizophora mangle
MASTKVQRVMTQPINLIFRFLQSKARIQIWLFEQKDLRIEGRIIGFDEYMNLVLDDAEEVSVKKKTRKALGRILLKGDNITLMMNTGK

SEQ ID NO: 20482 - protein, 88 aa, Sarracenia psittacina
MATTKVQRIMTQPINLIFRFLQSKARIQIWLFEQKDLRIEGRIIGFDEYMNLVLEDAEEVNVKKKSRKTLGRILLKGDNITLMMNTGK

SEQ ID NO: 20483 - protein, 88 aa, Juglans hindsii x Juglans regia
MASTKVQRIMTQPINLIFRFLQSKARIQIWLFEQRDLRIEGRIIGFDEYMNLVLDDAEEVNVKKKSRKSLGRILLKGDNITLMMNTGK

SEQ ID NO: 20484 - protein, 88 aa, Rosmarinus officinalis
MASTKVQRIMTQPINLIFRFLQSKARIQIWLFEQKDLRIEGRIIGFDEYMNLVLDDAEEVHMKKKSRKQLGRILLKGDNITLMMNTGK

SEQ ID NO: 20485 - protein, 88 aa, Chenopodium quinoa
  Sequence also found in Organisms: Spinacia oleracea
MASTKVQRIMTQPINLIFRFLQSKARIQIWLFEQKDARIEGRIIGFDEYMNLVLDDAEEVNVKKKTRKSLGRILLKGDNITLMMNTGK

SEQ ID NO: 20486 - protein, 88 aa, Acacia harpophylla
MASTKVQRIMTQPINLIFRFLQSKARIQIWLFEQKDLRIEGRIIGFDEYMNLVLDDAEEVNIKKKSRKSLGRILLKGDNITLMMNTFK

SEQ ID NO: 20487 - protein, 88 aa, Antirrhinum majus
MASTKVQRIMTQPINLIFRFLQSKARIQIWLFEQKDLRIEGRIIGFDEYMNLVLDDAEEVSVKKNSRKQLGRILLKGDNITLMMNTGK

SEQ ID NO: 20488 - protein, 88 aa, Beta vulgaris
MASTKVQRIMTQPINLIFRFLQSKARIQIWLFEQKDLRIEGRIIGFDEYMNLVLDDAEEVNVKKKTNKPLGRILLKGDNITLMMNSGK

SEQ ID NO: 20489 - protein, 88 aa, Bruguiera gymnorhiza
MASTKVQRIMTQPINLIFRFLQSKARIQIWLFEQKDLRIEGRIIGFDEYMNLVLDDAEEVNVKKRSRKSLGRILLKGDNITLMMNMGK

SEQ ID NO: 20490 - protein, 88 aa, Bupleurum chinense
  Sequence also found in Organisms: Daucus carota
MASTKVQRIMTQPINLIFRFLQSKARIQIWLFEQKDLRIEGRIIGFDEYMNLVLDDAEEVSIKKKSRKSLGRILLKGDNITLMMNTGK

SEQ ID NO: 20491 - protein, 88 aa, Theobroma cacao
MASTKVQRIMTQPINLIFRFLQSKARIQIWLFEQKDLRIEGRIIGFDEYMNLVLDDAEEVNIKKKSRKSLGRILLKGDNITLMMNAGK

SEQ ID NO: 20492 - protein, 88 aa, Theobroma cacao
MASTKVQRIMTQPINLIFRFLQSKARIQIWLFEQKDLRIEGRIIGFDEYMNLVLDDAEEVNIKKKSRKSLGRILLKGDNITLMMNSGK

SEQ ID NO: 20493 - protein, 88 aa, Manihot esculenta
MASTKVQRIMTQPINLIFRFLQSKARIQIWLFEQKDQRIEGRIIGFDEYMNLVLDDAEEVNVKKKTRKSLGRILLKGDNITLMMNTGK

SEQ ID NO: 20494 - protein, 88 aa, Castanea mollissima
  Sequence also found in Organisms: Quercus alba
MASTKVQRIMTQPINLIFRFLQSKARIQIWLFEQRDLRIEGRIIGFDEYMNLVLDDAEEVNVKKKSRKSLGRILLKGDNITLMMNSGK

SEQ ID NO: 20495 - protein, 88 aa, Citrus clementina
  Sequence also found in Organisms: Citrus sinensis
MASTKVQRIMTQPINLIFRFLQSKARIQIWLFEQKDLRIEGRIIGFDEYMNLVLDEAEEVSVKKKSRKPLGRILLKGDNITLMMNTGK

SEQ ID NO: 20496 - protein, 88 aa, Cleome spinosa
MATTKVQRIMTQPINLIFRFLQSKARIQIWLFEQKDLRIEGRITGFDEYMNLVLDDAEEVNVKKKTSKTLGRILLKGDNITLMMNTGK

SEQ ID NO: 20497 - protein, 88 aa, Cynodon dactylon
MASTKVQRIMTQPINLIFRFLQSKARIQIWLFEQKDLRIEGRIIGFDEYMNLVLDDAEEINVKKNTRKTLGRILLKGDNITLMMNTGK

SEQ ID NO: 20498 - protein, 88 aa, Solanum melongena
MASTKVQRIMTQPINLIFRFLQSKARIQIWLFEQKDLRVEGRIIGFDEYMNLVLDDAEEVNVKKNSRKQLGRILLKGDNITLMMNTGK

SEQ ID NO: 20499 - protein, 88 aa, Eucalyptus grandis
MASSKVQRIMTQPINLIFRFLQSKARIQIWLFEQKDLRIEGRIIGFDEYMNLVLDDAEEVNVKKKTRKTLGRILLKGDNITLMMNSGK

SEQ ID NO: 20500 - protein, 88 aa, Euphorbia peplus
  Sequence also found in Organisms: Euphorbia esula
MASTKVQRIMTQPINLIFRFLQSKARIQIWLFEQKDSRIEGRIIGFDEYMNLVLDDAEEVNVKKKTRKSLGRILLKGDNITLMMNTGK

SEQ ID NO: 20501 - protein, 88 aa, Fagopyrum esculentum
MASTKVQRIMTQPINLIFRFLQSKARIQIWLFEQKDLRIEGRIIGFDEYMNLTLDDAEEVNVKKKTRKSLGRILLKGDNITLMMNTGK

SEQ ID NO: 20502 - protein, 88 aa, Fraxinus spp
MASTKVQRIMTQPINLIFRFLQSKARIQIWLFEQKDTRIEGRIIGFDEYMNLVLDDAEEVNVKKNSRKQLGRILLKGDNITLMMNTGK

SEQ ID NO: 20503 - protein, 88 aa, Panax ginseng
  Sequence also found in Organisms: Valeriana officinalis
MASTKVQRIMTQPINLIFRFLQSKARIQIWLFEQKDLRIEGRIIGFDEYMNLVLDDAEEVSIKKKSRKQLGRILLKGDNITLMMNTGK

SEQ ID NO: 20504 - protein, 88 aa, Actinidia deliciosa
MATTKVQRIMTQPINLIFRFLQSKARIQIWLFEQKDSRIEGRIIGFDEYMNLVLDDAEEVNVKKKSRKALGRILLKGDNITLMMNTGK

SEQ ID NO: 20505 - protein, 88 aa, Olea europaea
MASTKVQRIMTQPINLIFRFLQSKARIQIWLFEQKDARIEGRIIGFDEYMNLVLDDAEEVNVKKNSRKQLGRILLKGDNITLMMNTGK

SEQ ID NO: 20506 - protein, 88 aa, Olea europaea
MASTKVQRIMTQPINLIFRFLQSKTRIQIWLFEQKDTRIEGRIIGFDEYMNLVLDDAEEVNVKKKSRKQLGRILLKGDNITLMMNTGK

SEQ ID NO: 20507 - protein, 88 aa, Petroselinum crispum
MASTKVQRIMTQPINLIFRFLQSKARIQIWLFEQKDLRIEGRIIGFDEYMNLVLDDAEEVSIKKKSRKPLGRILLKGDNITLMMNTGK

SEQ ID NO: 20508 - protein, 88 aa, Lippia dulcis
MASTKVQRIMTQPINLIFRFLQSKARIQIWLFEQKDLRIEGRIIGFDEYMNLVLDDAEEVNIKKNSRKQLGRILLKGDNITLMMNTGK

SEQ ID NO: 20509 - protein, 88 aa, Populus trichocarpa
MASTKVQRIMTQPINLIFRFLQSKARIQIWLFEQKDLRIEGRIIGFDEYMNLVLEDAEEVNIKKKSRKSLGRILLKGDNITLMMNTGK

SEQ ID NO: 20510 - protein, 88 aa, Solanum lycopersicum
  Sequence also found in Organisms: Solanum tuberosum, Solanum phureja
MASTKVQRIMTQPINLIFRFLQSKARIQIWLFEQKDQRIEGRIIGFDEYMNLVLDDAEEVNVKKNSRKQLGRILLKGDNITLMMNTGK

SEQ ID NO: 20511 - protein, 88 aa, Primula obconica
MASTKVQRIMTQPINLIFRFLQSKARIQIWLFEQKDLRIEGRIIGFDEYMNLVLDEAEEVNVKKKTRKALGRILLKGDNITLMMNTGK

SEQ ID NO: 20512 - protein, 88 aa, Solanum phureja
MASTKVQRIMTQPINLIFRFLQSKARIQIWLFEQKDLRIEGRIIGFDEYMNLVLDDAEEVNVKKKTSKQLGRILLKGDNITLMMNSGK

SEQ ID NO: 20513 - protein, 88 aa, Tabernaemontana elegans
MASTKVQRIMTQPINLIFRFLQSKARIQIWLFEQKDLRIEGRIIGFDEYMNLVLDDAEEVNIKKKTRKQLGRILLKGDNITLMMNTGK

SEQ ID NO: 20514 - protein, 88 aa, Tabernaemontana elegans
MASTKVQRIMTQPINLIFRFLQSKARIQIWLFEQKDLRIEGRIIGFDEYMNLVLDDAEEVHIKKKSRKQLGRILLKGDNITLMMNTGK

SEQ ID NO: 20515 - protein, 88 aa, Tamarix hispida
MASTKVQRIMTQPINLIFRFLQSKARIQIWLFEQKDLRIEGRIIGFDEYMNLVLDEAEEVNVKKKTRKSLGRILLKGDNITLMMNTGK

SEQ ID NO: 20516 - protein, 88 aa, Triphysaria pusilla
MASTKVQRIMTQPINLIFRFLQSKARIQIWLFEQKDLRIEGRIIGFDEYMNLVLDEAEEVNVKKKSRKQLGRILLKGDNITLMMNTGN

SEQ ID NO: 20517 - protein, 88 aa, Oryza sativa
MASTKVQRIMTQPINLIFRFLQSKARIQIWLFEQKDLRIEGRIIGFDEYMNLVLDDAEEINVKKDTRKSLGRILLKGDNITLMMNTGK

SEQ ID NO: 20518 - protein, 88 aa, Spinacia oleracea
MASTKVQRIMTQPINLIFRFLQSKARIQIWLFEQKDARIEGRIIGFDEYMNLVLEDAEEVNVKKKTRKSLGRILLKGDNITLMMNTGK

SEQ ID NO: 20519 - protein, 88 aa, Amsonia hubrichtii
MASTKVQRIMTQPINLIFRFLQSKARIQIWLFEQKDLRIEGRIIGFDEYMNLVLDDAEEVSIKKKTRKQLGRILLKGDNITLMMNTGK

SEQ ID NO: 20520 - protein, 88 aa, Musa acuminata
MASTKVQRIMTQPINLIFRFLQSKARIQIWLFEQKDLRIEGRIIGFDEYMNLVLEEAEEVNVKKKTRKPLGRILLKGDNITLMMNTGK

SEQ ID NO: 20521 - protein, 88 aa, Ocimum basilicum
MASTKVQRIMTQPINLIFRYLQSKARIQIWLFEQKDLRIEGRIIGFDEYMNLVLDDAEEVNIKKNSRKQLGRILLKGDNITLMMNTGK

SEQ ID NO: 20522 - protein, 88 aa, Bupleurum chinense
MASTKVQRIMTQPINLIFRFLQSKARIQIWLFEQKDLRIEGRIIGFDEYMNLVLDDAEEVSIKKKTRKSLGRILLKGDNITLMMNTGK

SEQ ID NO: 20523 - protein, 88 aa, Catharanthus roseus
MASTKVQRIMTQPINLIFRFLQSKARIQIWLFEQKDLRIEGRIIGFDEYMNLVLDDAEEVHMKKKTRKQLGRILLKGDNITLMMNTGK

SEQ ID NO: 20524 - protein, 88 aa, Cyclamen graecum
  Sequence also found in Organisms: Ananas comosus
MASTKVQRIMTQPINLIFRFLQSKARIQIWLFEQKDLRIEGRIIGFDEYMNLVLDEAEEVNVKKKTRKALGRILLKGDNITLMMNTAK

SEQ ID NO: 20525 - protein, 88 aa, Cyclamen graecum
MASTKVQRIMTQPINLIFRFLQSKARIQIWLFEQKDLRIEGRIIGFDEYMNLVLDEAEEVNVKKKTRKALGRILLKGDNITLMMNTGN

SEQ ID NO: 20526 - protein, 88 aa, Euonymus alatus
MASTKVQRIMTQPINLIFRFLQSKARIQIWLFEQKDLRIEGRIIGFDEYMNLVLDDAEEVSIKKKSRKPLGRILLKGDNITLMMNTGV

SEQ ID NO: 20527 - protein, 88 aa, Fagopyrum esculentum
MASTKVQRIMTQPINLIFRFLQSKARIQIWLFEQKDMRIEGRIIGFDEYMNLVLEDAEEVNVKKKTRKTLGRILLKGDNITLMMNTAK

SEQ ID NO: 20528 - protein, 88 aa, Setaria italica
MASTKVQRIMTQPINLIFRFLQSKARIQIWLFEQKDLRIEGRIIGFDEYMNLVLDDAEEINVKKNIRKSLGRILLKGDNITLMMNTGK

SEQ ID NO: 20529 - protein, 88 aa, Panax ginseng
MATTKVQRIMTQPINLIFRFLQSKARIQIWLFEQKDLRIEGRIIGFDEYMNLVLDDAEEVSIKKKSRKSLGRILLKGDNITLMMNTGK

SEQ ID NO: 20530 - protein, 88 aa, Panax ginseng
MASTKVQRIMTQPINLIFRFLQSKARIQIWLFEQKDLRIEGRIIGFDEYMNLVLEDAEEVSIKKKSRKQLGRILLKGDNITLMMNTGK

SEQ ID NO: 20531 - protein, 88 aa, Heritiera littoralis
MASTKVQRIMTQPINLIFRFLQSKARIEIWLFEQKDLRIEGRIIGFDEYMNLVLDDAEEVNIKKKSRKSLGRILLKGDNITLMMNSGK

SEQ ID NO: 20532 - protein, 88 aa, Hevea brasiliensis
MASTKVQRIMTQPINLIFRFLQSKARIQIWLFEQKDMRIEGRIIGFDEYMNLVLDDAEEVNIKKKTRKSLGRILLKGDNITLMMNTGK

SEQ ID NO: 20533 - protein, 88 aa, Carpinus betulus
MASTKVQRIMTQPINLIFRFLQSKARIQIWLFEQRDLRIEGRIIGFDEYMNLVLDDAEEVHIKKKSRKTLGRILLKGDNITLMMSTGK

SEQ ID NO: 20534 - protein, 88 aa, Jatropha curcas
MASTKVQRIMTQPINLIFRFLQSKARIQIWLFEQKDLRIEGRIIGFDEYMNSVLDDAEEVNVKKKTRKSLGRILLKGDNITLMMNSGK

SEQ ID NO: 20535 - protein, 88 aa, Nicotiana benthamiana
MTSTKVQRIMTQPINPIFRFLQSKARIQIWLFEQKDLRIEGRIIGFDEYMNLVLDDAEEVNIKKKSRKQLGRILLKGDNITLMMNTGK

SEQ ID NO: 20536 - protein, 88 aa, Sorghum bicolor
  Sequence also found in Organisms: Saccharum officinarum
MASTKVQRIMTQPINLIFRFLQSKARIQIWLFEQKDLRIEGRIIGFDEYMNLVLDDAEEINVKKNTRKSLGRILLKGDNITLMMNTGK

SEQ ID NO: 20537 - protein, 88 aa, Panicum virgatum
MASTKVQRIMTQPINLIFRFLQSKARIQIWLFEQKDLRIEGRIIGFDEYMNLVLDDAEEINVKKSTRKSLGRILLKGDNITLMMNTGK

SEQ ID NO: 20538 - protein, 88 aa, Tripterygium wilfordii
MASTKVQRIMTQPINLIFRFLQSKARIQIWLFEQKDLRIEGRIIGFDEYMNLVLDDAEEVSIKKKSRKPLGRILLKGDNITLMMNTGA

SEQ ID NO: 20539 - protein, 88 aa, Tripterygium wilfordii
MASTKVQRIMTQPINLIFRFLQSKARIQIWLFEQKDLRIEGRIIGFDEYMNLVLDEAEEVSIKKKSRKTLGRILLKGDNITLMMNTGT

SEQ ID NO: 20540 - protein, 90 aa, Scabiosa columbaria
  Sequence also found in Organisms: Valeriana officinalis
MASTKVQRIMTQPINLIFRFLQSKARIQIWLFEQKDLRIEGRIIGFDEYMNLVLDDAEEVSIKKKSRKQLGRILLKGDNITLMMNTGKQG

SEQ ID NO: 20541 - protein, 88 aa, Rosmarinus officinalis
MASTKVQRIMTQPINLIFRYLQSKARIQIWLFEQKDLRIEGRIIGFDEYMNLVLDEAEEVNIKKNSRKQLGRILLKGDNITLMMNTGK

SEQ ID NO: 20542 - protein, 88 aa, Brachypodium distachyon
MASTKVQRIMTQPINLIFRFLQSKARIQIWLFEQKDLRIEGRIIGFDEYMNLVLEDAEEINVKKNTRKSLGRILLKGDNITLMMNTGK

SEQ ID NO: 20543 - protein, 88 aa, Citrus clementina
  Sequence also found in Organisms: Citrus sinensis
MASTKVQRIMTQPINLIFRFLQSKARIQIWLFEQKDLRIEGRIIGFDEYMNLVLDDAEEVHIKKNTRKPLGRILLKGDNITLMMNTGK

SEQ ID NO: 20544 - protein, 88 aa, Cleome spinosa
MASTKVQRIMTQPINLIFRFLQSKARIQIWLFEQKDLRIEGRITGFDEYMNLVLDDAEEVSIKKKTRKSLGRILLKGDNITLMMNTGK

SEQ ID NO: 20545 - protein, 88 aa, Coffea canephora
MASTKVQRIMTQPINLIFRFLQSKARIQIWLFEQKDLRIEGRIIGFDEYMNLVLEDAEEVNIKKKTTKQLGRILLKGDNITLMMNSGK

SEQ ID NO: 20546 - protein, 88 aa, Echinochloa colona
MASTKVQRIMTQPINLIFRFLQSKARIQIWLFEQKDLRIEGRIIGFDEYMNLVLDDAEEINVKKNTRKSLGRILLKGDNITLMMNSGK

SEQ ID NO: 20547 - protein, 88 aa, Epimedium sagittatum
MATTRVQRIMTQPINLIFRFLQSKARIQIWLFEQKDLRIEGRIIGFDEYMNLVLDDAEEVNVKKQTKKALGRILLKGDNITLMQNTGK

SEQ ID NO: 20548 - protein, 88 aa, Euonymus alatus
MASTKVQRIMTQPINLIFRFLQSKARIQIWLFEQKDLRIEGRIIGFDEYMNLVLEDAEEVSIKKKSRKSLGRILLKGDNITLMMNTGT

SEQ ID NO: 20549 - protein, 88 aa, Euonymus alatus
MASTKVQRIMTQPINLIFRFLQSKARIQIWLFEQKDLRIEGRIIGFDEYMNIVLDDAEEVSIKKKSRKSLGRILLKGDNITLMMNTGT

SEQ ID NO: 20550 - protein, 88 aa, Zea mays
MASTKVQRIMTQPINLIFRFLQSKARIQIWLFEQKDLRIEGRIIGFDEYMNLVLEDAEEINVKKNTRKTLGRILLKGDNITLMMNSGK

SEQ ID NO: 20551 - protein, 88 aa, Mimulus guttatus
MASTKVQRIMTQPINLIFRFLQSKARIQIWLFEQKDVRIEGRIIGFDEYMNLVLDEAEEVNVKKNTRKELGRILLKGDNITLMMNTGK

SEQ ID NO: 20552 - protein, 86 aa, Mimulus guttatus
MASTKVQRIMTQPINLIFRFLQSKARIQIWLFEQKDLRIEGRIIGFDEYMNLVLDDAEEVNVKKSSRKQLGRILLKGDNITLMMNS

SEQ ID NO: 20553 - protein, 88 aa, Allium cepa
MATTRVQRIMTQPINLIFRFLQSKARIQIWLFEQKDLRIEGRIIGFDEYMNLVLDDAEELNVKKSTRKTLGRILLKGDNITLMMNTGK

SEQ ID NO: 20554 - protein, 88 aa, Ananas comosus
MASTKVQRIMTQPINLIFRFLQSKARIQIWLFEQKDLRIEGRIIGFDEYMNLVLDEADEINVKKKTKKPLGRILLKGDNITLMMSTGK

SEQ ID NO: 20555 - protein, 88 aa, Prunus persica
  Sequence also found in Organisms: Prunus mume
MASTKVQRIMTQPINLIFRFLQSKARIQIWLFEQKDLRIEGRIIGFDEYMNLVLDEAEEVSIKKKTRKSLGRILLKGDNITLMMNTGK

SEQ ID NO: 20556 - protein, 88 aa, Rosa hybrid cultivar
  Sequence also found in Organisms: Fragaria vesca
MASTKVQRIMTQPINLIFRFLQSKARIQIWLFEQKDVRIEGRIIGFDEYMNLVLDDAEEVSIKKNTRKTLGRILLKGDNITLMMNTGK

SEQ ID NO: 20557 - protein, 88 aa, Silene vulgaris
MASAKVQRIMTQPINLIFRFLQSKARIQIWLFEQKDLRIEGRIIGFDEYMNLTLDDAEEVNIKKKTRKSLGRILLKGDNITLMMNTGK

SEQ ID NO: 20558 - protein, 88 aa, Utricularia gibba
MASTKVQRIMTQPINLIFRFLQSKAKIQIWLFEKKDLRIEGRIIGFDEYMNLVLDDAEEVSVKKNSRKQLGRILLKGDNITLMMNTGK

SEQ ID NO: 20559 - protein, 88 aa, Oryza sativa
MASTKVQRIMTQPINLIFRFLQSKARIQIWLFEQKDLRIEGRIIGFDEYMNLVLDEAEEINIKKDTRKSLGRILLKGDNITLMMNTGK

SEQ ID NO: 20560 - protein, 88 aa, Rosmarinus officinalis
MTSTKVQRIMTQPINLIFRYLQSKARIQIWLFEQKDLRIEGRIIGFDEYMNLVLDEAEEVNIKKNSRKQLGRILLKGDNITLMMNTGK

SEQ ID NO: 20561 - protein, 88 aa, Musa acuminata
MASTKVQRIMTQPINLIFRFLQSKARIQIWLFEQKDLRIEGRIIGFDEYMNLVLEEAEELNVKKKTRKPLGRILLKGDNITLMMSTGK

SEQ ID NO: 20562 - protein, 86 aa, Catharanthus roseus
STKVQRIMTQPINLIFRFLQSKARIQIWLFEQKDLRIEGRIIGFDEYMNLVLDDAEEVSIKKKTRKQLGRILLKGDNITLMMNTGK

SEQ ID NO: 20563 - protein, 86 aa, Echinochloa colona
MASTKVQRIMTQPINLIFRFLQSKARIQIWLFEQKDLRIEGRIIGFDEYMNLVLDDAEEINVKKNTRKSLGRILLKGDNITLMMNT

SEQ ID NO: 20564 - protein, 88 aa, Gnetum gnemon
MASTKVQRIMTQPINLIFRFLQSKARIQIWLFEQKDLRIEGRIIGFDEYMNLVLDDAEEISVKRKTRKPLGRILLKGDNITLMMNTNK

SEQ ID NO: 20565 - protein, 88 aa, Zea mays
MASTKVQRIMTQPINLIFRFLQSKARIQIWLFEQKDLRIEGRIIGFDEYMNLVLEDAEEINVKKNTRKSLGRILLKGDNITLMMNSGK

SEQ ID NO: 20566 - protein, 88 aa, Nuphar advena
MATTKVQRIMTQPINLIFRFLQSKARIQIWLFEQKDLRIEGRIIGFDEYMNLVLDDAEEVNLKKHTRKSLGNILLKGDNITLMMNTGK

SEQ ID NO: 20567 - protein, 88 aa, Elaeis guineensis
MASTKVQRIMTQPINLIFRFLQSKARIQIWLFEQRDLRIEGRIIGFDEYMNLVLDDADELNVKKNTRKPLGRILLKGDNITLMMNTGK

SEQ ID NO: 20568 - protein, 88 aa, Allium cepa
MATTRVQRIMTQPINLIFRFLQSKARIQIWLFEQKDLRIEGRIIGFDEYMNLVLDDAEELNVKKNTRKTLGRILLKGDNITLMMNSGK

SEQ ID NO: 20569 - protein, 85 aa, Primula obconica
TKVQRIMTQPINLIFRFLQSKARIQIWLFEQKDLRIEGRIIGFDEYMNLVLDEAEEVNVKKKTRKALGRILLKGDNITLMMNTGK

SEQ ID NO: 20570 - protein, 88 aa, Prunus mume
MASTKVQRIMTQPINLIFRFLQSKARIQIWLFEQKDLRIEGRIIGFDEYMNLVLDEAEEVSIKKNTRKALGRILLKGDNITLMMNTGK

SEQ ID NO: 20571 - protein, 88 aa, Prunus persica
MASTKVQRIMTQPINLIFRFLQSKARIQIWLFEQKDLRIEGRIIGFDEYMNLVLDEAEEVSIKKNTRKSLGRILLKGDNITLMMNTGK

SEQ ID NO: 20572 - protein, 88 aa, Sequoia sempervirens
MATTRVQRIMTQPINLIFRFLQSKARIQIWLFEQKDLRIEGRIIGFDEYMNLVLDDAEEVSIKKKTRKVLGRILLKGDNITLMMNTGK

SEQ ID NO: 20573 - protein, 88 aa, Tripterygium wilfordii
MASTKVQRIMTQPINLIFRFLQSKARIQIWLFEQKDLRIEGRIIGFDEYMNLVLDEAEEVSIKKKSRKPLGRILLKGDNITLMMNAGT

SEQ ID NO: 20574 - protein, 88 aa, Vinca minor
MATTKVQRIMTQPINLIFRFLQSKARIQIWLFEQKDLRIEGRIIGFDEYMNLVLDDAEEVSIKKKTRKQLGRILLKGDNITLMMNTAK

SEQ ID NO: 20575 - protein, 90 aa, Cyclamen graecum
MASTKVQRIMTQPINLIFRFLQSKARIQIWLFEQKDLRIEGRIIGFDEYMNLVLDEAEEVNVKKKTRKALGRILLKGDNITLMMNTASRD

SEQ ID NO: 20576 - protein, 87 aa, Ambrosia trifida
  Sequence also found in Organisms: Arnica chamissonis, Parthenium argentatum, Helianthus annuus
MATKVQRIMTQPINLIFRFLQSKARIQIWLFEQKDLRIEGRIIGFDEYMNLVLDEAEEVSIKKKTRKALGRILLKGDNITLMMNAGK

SEQ ID NO: 20577 - protein, 88 aa, Malus domestica
MASAKVQRIMTQPINLIFRFLQSKARIQIWLFEQKDLRIEGRIIGFDEYMNLVLDEAEEVSIKKKTRKSLGRILLKGDNITLMMSTGK

SEQ ID NO: 20578 - protein, 88 aa, Arabidopsis thaliana
  Sequence also found in Organisms: Arabidopsis lyrata
MASTKVQRIMTQPINLIFRFLQSKARIQIWLFEQKDLRIEGRITGFDEYMNLVLDEAEEVSIKKKTRKPLGRILLKGDNITLMMNAGK

SEQ ID NO: 20579 - protein, 88 aa, Arabidopsis thaliana
  Sequence also found in Organisms: Brassica napus, Arabidopsis lyrata, Brassica juncea, Brassica oleracea, Brassica rapa, Raphanus sativus, Eutrema halophilum
MASTKVQRIMTQPINLIFRFLQSKARIQIWLFEQKDLRIEGRITGFDEYMNLVLDEAEEVSIKKNTRKPLGRILLKGDNITLMMNTGK

SEQ ID NO: 20580 - protein, 88 aa, Aristolochia fimbriata
MATTRVQRIMTQPINLIFRFLQSKARIQIWLFEQKDMRIEGRIIGFDEYMNLVLDDAEELNVKKNTKKSLGRILLKGDNITLMMNSGK

SEQ ID NO: 20581 - protein, 88 aa, Brassica napus
  Sequence also found in Organisms: Brassica oleracea, Brassica rapa, Raphanus sativus
MASTKVQRIMTQPINLIFRFLQSKARIQIWLFEQKDLRIEGRITGFDEYMNLVLDEAEEVSIKKNTRKQLGRILLKGDNITLMMNTGK

SEQ ID NO: 20582 - protein, 88 aa, Brachypodium distachyon
  Sequence also found in Organisms: Avena sativa, Secale cereale, Triticum aestivum
MASTKVQRIMTQPINLIFRFLQSKARIQIWLFEQKDMRIEGRIIGFDEYMNLVLEDAEEINIKKNTRKSLGRILLKGDNITLMMNTGK

SEQ ID NO: 20583 - protein, 87 aa, Centaurea maculosa
  Sequence also found in Organisms: Cichorium intybus, Cirsium arvense, Lactuca sativa, Senecio madagascariensis
MATKVQRIMTQPINLIFRFLQSKARIQIWLFEQKDLRIEGRIIGFDEYMNLVLDEAEEVSIKKKTRKPLGRILLKGDNITLMMNSGK

SEQ ID NO: 20584 - protein, 88 aa, Cephalotaxus harringtonia
  Sequence also found in Organisms: Taxus baccata
MATTRVQRIMTQPINLIFRFLQSKARIQIWLFEQKDLRIEGRIIGFDEYMNLVLEDAEEVSIKKKTRKVLGRILLKGDNITLMMNTGK

SEQ ID NO: 20585 - protein, 87 aa, Chelidonium majus
MATRVQRIMTQPINLIFRFLQSKARIQIWLFEQKDLRIEGRIIGFDEYMNLVLDDAEEVNVKKNTRKSLGKILLKGDNITLMQNTGK

SEQ ID NO: 20586 - protein, 87 aa, Chrysanthemum coronarium
  Sequence also found in Organisms: Gerbera hybrid cultivar
MATKVQRIMTQPINLIFRFLQSKARIQIWLFEQKDLRIEGRIIGFDEYMNLVLDEAEEVSIKKKTRKALGRILLKGDNITLMMNSGK

SEQ ID NO: 20587 - protein, 88 aa, Distylium racemosum
MATTRVQRIMTQPINLIFRFLQSKARIQIWLFEQKDLRIEGRIIGFDEYMNLVLDDAEEISLKKKTHKPLGRILLKGDNITLMMNTGK

SEQ ID NO: 20588 - protein, 87 aa, Echinacea purpurea
MATKVQRIMTQPINLIFRFLQSKARIQIWLFEQKDLRIEGRIIGFDEYMNLVLDEAEEISVKKKTRKALGRILLKGDNITLMMNAGK

SEQ ID NO: 20589 - protein, 88 aa, Adiantum capillus-veneris
MATTKVQRIMTQPINLIFRFLQSKSRIQFWLFEQKDLRIEGRIIGFDEYMNLVLDDAEEVSIKKKTRKPLGRILLKGDNITLMMNTGK

SEQ ID NO: 20590 - protein, 88 aa, Festuca arundinacea
  Sequence also found in Organisms: Lolium multiflorum
MASTKVQRIMTQPINLIFRFLQSKARIQIWLFEQKDMRIEGRIIGFDEYMNLVLEDAEEINIKKDTRKSLGRILLKGDNITLMMNTGK

SEQ ID NO: 20591 - protein, 85 aa, Panax ginseng
MASTKVQRIMTQPINLIFRFLQSKARIQIWLFEQKDLRIEGRIIGFDEYMNLVLDGAEEVSIKKKSRKQLGRILLKGDNITLMMN

SEQ ID NO: 20592 - protein, 88 aa, Liriodendron tulipifera
MATTRVQRIMTQPINLIFRFLQSKARIQIWLFEQKDLRIEGRIIGFDEYMNLVLDDADEFNVKKNIRKPLGRILLKGDNITLMMNTGK

SEQ ID NO: 20593 - protein, 88 aa, Marchantia polymorpha
MATTKVQRIMTQPINLIFRFLQSKSRIQIWLFEQKDLRIEGRIIGFDEYMNLVLEDAEEISLKKKTKKPLGRILLKGDNITLMMNTGK

SEQ ID NO: 20594 - protein, 88 aa, Pennisetum glaucum
MASTKVQRIMTQPINLIFRFLQSKARIQIWLFEQKDLRIEGRIIGFDEYMNLVLEDAEEINIKKNTRKSLGRILLKGDNITLMMNSGK

SEQ ID NO: 20595 - protein, 87 aa, Physcomitrella patens
MATKVQRIMTQPINLIFRFLQSKSRIQIWLFEQKDLRIEGRIIGFDEYMNLVLDEAEEVSLKKKTRKPLGRILLKGDNITLMMNTGK

SEQ ID NO: 20596 - protein, 88 aa, Platanus occidentalis
MATTRVQRIMTQPINLIFRFLQSKARIQIWLFEQKDLRIEGRIIGFDEYMNLVLDEAEEVHVKKNTRKPLGRILLKGDNITLMMNTGK

SEQ ID NO: 20597 - protein, 88 aa, Salvia sclarea
MASTKVQRIMTQPINLIFRYLQSKARIQIWLFEQKDLRIEGRIIGFDEYMNLVLDEAEEVNIKKNTRKQLGRILLKGDNITLMMNTAK

SEQ ID NO: 20598 - protein, 88 aa, Vinca minor
MATTKVQRIMTQPINLIFRFLQSKARIQIWLFEQKDLRIEGRIIGFDEYMNLTLDDAEEVSIKKKTRKQLGRILLKGDNITLMMNTAK

SEQ ID NO: 20599 - protein, 88 aa, Vinca minor
MATTKVQRIMTQPINLIFRFLQSKAKIQIWLFEQKDLRIEGRIIGFDEYMNLVLDDAEEVHIKKKTRKQLGRILLKGDNITLMMNTAK

SEQ ID NO: 20600 - protein, 88 aa, Triticum aestivum
MASTKVQRIMTQPINLIFRFLQSKARIQIWLFEQKDARIEGRIIGFDEYMNLVLEDAEEINIKKNTRKSLGRILLKGDNITLMMNTGK

SEQ ID NO: 20601 - protein, 88 aa, Taraxacum officinale
MATKVQRIMTQPINLIFRFLQSKARIQIWLFEQKDLRIEGRIIGFDEYMNLVLDEAEEVSIKKKTRKPLGRILLKGDNITLMMNSGKQ

SEQ ID NO: 20602 - protein, 88 aa, Abies balsamea
  Sequence also found in Organisms: Pseudotsuga menziesii, Picea glauca
MATTRVQRIMTQPINLIFRFLQSKARIQIWLFEQKDLRIEGRIIGFDEYMNLVLEDAEEISVKRKTHKPLGRILLKGDNITLMMNTGK

SEQ ID NO: 20603 - protein, 88 aa, Cocos nucifera
MASTKVQRIMTQPINLIFRFLQSKARIQIWLFEQRDLRIEGRIIGFDEYMNLVLDDADELNIKKNTRKPLGRILLKGDNITLMMSTGK

SEQ ID NO: 20604 - protein, 88 aa, Cryptomeria japonica
MATTRVQRIMTQPINLIFRFLQSKARIQIWLFEQKDMRIEGRIIGFDEYMNLVLDDAEEVSIKKNTRKVLGRILLKGDNITLMMNTGK

SEQ ID NO: 20605 - protein, 88 aa, Eschscholzia californica
MATTRVQRIMTQPINLIFRFLQSKARIQIWLFEQKDMRIEGRIIGFDEYMNLVLDDAEEVNVKKNTRKSLGKILLKGDNITLMQNTGK

SEQ ID NO: 20606 - protein, 87 aa, Flaveria ramosissima
MATKVQRIMTQPINLIFRFLQSKARIQIWLFEQKDLRIEGRIIGFDEYMNLVLDEAEEISIKKKTRKALGRILLKGDNITLMMNAGK

SEQ ID NO: 20607 - protein, 88 aa, Phalaenopsis aphrodite
MATTKVQRIMTQPINLIFRFLQSKARIQIWLFEQKDLRIEGRIIGFDEYMNLVLEDADELNIKKNTRKPLGRILLKGDNITLMMNTGK

SEQ ID NO: 20608 - protein, 87 aa, Helianthus annuus
MATKVQRIMTQPINLIFRFLQSKARIQIWLFEQKDLRIEGRIIGFDEYMNLVLDEAEEVSIKKKTRKALGKILLKGDNITLMMNAGK

SEQ ID NO: 20609 - protein, 88 aa, Cycas rumphii
MATTRVQRIMTQPINLIFRFLQSKARIQIWLFEQKDLRIEGRIIGFDEYMNLVLDDAEEISLKRKTRKSLGRILLKGDNITLMMSTGK

SEQ ID NO: 20610 - protein, 85 aa, Artemisia annua
MATKVQRIMTQPINLIFRFLQSKARIQIWLFEQKDLRIEGRIIGFDEYMNLVLDEAEEVSIKKKTRKPLGRILLDNITLMMNSGK

SEQ ID NO: 20611 - protein, 88 aa, Persea americana
MATTRVQRIMTQPINLIFRFLQSKARIQIWLFEQKDTRIEGRIIGFDEYMNLVLDDADELNIKKNTRKPLGRILLKGDNITLMMNTGK

SEQ ID NO: 20612 - protein, 86 aa, Brassica juncea
  Sequence also found in Organisms: Eutrema halophilum
MASTKVQRIMTQPINLIFRFLQSKARIQIWLFEQKDLRIEGRITGFDEYMNLVLDEAEEVSIKKNTRKQLGRILLKGDNITLMMNT

SEQ ID NO: 20613 - protein, 87 aa, Ceratodon purpureus
MATKVQRIMTQPINLIFRFLQSKSRIQIWLFEQKDMRIEGRIIGFDEYMNLVLDEAEEVSLKKNTRKPLGRILLKGDNITLMMNTGK

SEQ ID NO: 20614 - protein, 88 aa, Pinus pinaster
  Sequence also found in Organisms: Pseudotsuga menziesii, Picea glauca
MATTRVQRIMTQPINLIFRFLQSKARIQIWLFEQKDLRIEGRIIGFDEYMNLVLEDAEEISVKRKTHKPLGRILLKGDNITLMMSTGK

SEQ ID NO: 20615 - protein, 88 aa, Pinus pinaster
  Sequence also found in Organisms: Pinus taeda
MATTRVQRIMTQPINLIFRFLQSKARIQIWLFEQKDMRIEGRIIGFDEYMNLVLEDAEEISVKRKTCKPLGRILLKGDNITLMMNTGK

SEQ ID NO: 20616 - protein, 87 aa, Elaeis guineensis
MASTKVQRIMTQPINLIFRFLQSKARIQIWLFEQRDLTIEGRIIGFDEYMNLVLDDADELNIKKKTRKPLGRILLKGDNITLMMNTI

SEQ ID NO: 20617 - protein, 88 aa, Podocarpus macrophillus
MATTRVQRIMTQPINLIFRFLQSKARIQIWLFEQKDMRIEGRIIGFDEYMNLVLEDAEEVSIKRKTRKPLGRILLKGDNITLMMNTGK

SEQ ID NO: 20618 - protein, 88 aa, Sciadopitys verticillata
MATTRVQRIMTQPINLIFRFLQSKARIQIWLFEQKDLRIEGRIIGFDEYMNLVLDEAEEISMKKKTRKQLGRILLKGDNITLMMSTGK

SEQ ID NO: 20619 - protein, 88 aa, Picea glauca
MATTRVQRIMTQPINLIFRFLQGKARIQIWLFEQKDLRIEGRIIGFDEYMNLVLEDAEEISVKRKTHKPLGRILLKGDNITLMMNTGK

SEQ ID NO: 20620 - protein, 89 aa, Conyza canadensis
MAAKVQRIMTQPINLIFRFLQSKARIQIWLFEQKDLRIEGRIIGFDEYMNLVLDEAEEVSIKKKTRKSLGRILLKGDNITLMMNLNAGK

SEQ ID NO: 20621 - protein, 96 aa, Fraxinus spp
MASTKVQRIMTQPINLIFRFLQSKARIQIWLFEQKDTRIEGRIIGFDEYMNLVLDDAEEVNVKKKSRKQLGRILLKGDNITLMMNTGNDAKGSFES

SEQ ID NO: 20622 - protein, 88 aa, Amborella trichopoda
MATTRVQRIMTQPINLIFRFLQSKARIQIWLFEQKDLRIEGRIIGFDEYMNLVLDDADELNIKRNTRKPLGRILLKGDNITLMMSTGK

SEQ ID NO: 20623 - protein, 85 aa, Artemisia annua
MATKVQRIMTQPINLIFRFLQSKARIQIWLFEQKDLRIEGRIIGFDEYMNLVLDEAEEVSIKKKTRKPLGRILLDNITLMMNSGR

SEQ ID NO: 20624 - protein, 86 aa, Phalaenopsis aphrodite
MATTKVQRIMTQPINLIFRFLQSKARIQIWLFEQKDLRIEGRIIGFDEYMNLVLEDADELNIKKNTRKPLGRILLKGDNITLMMNT

SEQ ID NO: 20625 - protein, 87 aa, Physcomitrella patens
MATKVQRIMTQPINLIFRFLQSKSRIQIWLFEQKDMRIEGRIIGFDEYMNLVLEEAEEVSLKKNTRKPLGRILLKGDNITLMMNTGK

SEQ ID NO: 20626 - protein, 88 aa, Papaver somniferum
MATTKVQRIMTQPINLIFRFLQSKAKIQIWLFEQKDIRIEGRIIGFDEYMNLVLDDAEEVNIKKNTRKSLGKILLKGDNITLMQNAGK

SEQ ID NO: 20627 - protein, 88 aa, Papaver somniferum
MATTRVQRIMTQPINLIFRFLQSKARIQIWLFEQKDRRIEGRIIGFDEYMNLVLDEAEEVNIKKNTRKSLGKILLKGDNITLMQNTGK

SEQ ID NO: 20628 - protein, 88 aa, Zamia vazquezii
MATTRVQRIMTHPINLIFRFLQSKARIQIWLFEQKDMRIEGRIIGFDEYMNLVLDDAEEISVKRKTRKSLGRILLKGDNITLMMSTGK

SEQ ID NO: 20629 - protein, 83 aa, Pinus taeda
MATTRVQRIMTQPINLIFRFLQSKARIQIWLFEQKDMRIEGRIIGFDEYMNLVLEDAEEKTHKPLGRILLKGDNITLMMSTGK

SEQ ID NO: 20630 - protein, 79 aa, Oryza sativa
MASTKVQRIMTQPIKARIQIWLFEQKDLRIEGRIIGFDEYMNLVLDDAEEINVKKDTRKSLGRILLKGDNITLMMNTGK

SEQ ID NO: 20631 - protein, 79 aa, Panax ginseng
MASTKVQRIMTQPIKARIQIWLFEQKDLRIEGRIIGFDEYMNLVLEDAEEVSIKKKSRKQLGRILLKGDNITLMMNTGK

SEQ ID NO: 20632 - protein, 87 aa, Mesostigma viride
MATKVQRIMTQPINLIFRFLQSKSRIQIWLYEQTDMRIEGQIIGFDEYMNLVLNDAEEVSMKKKTRKSLGHILLKGDTITLMMNTGK

SEQ ID NO: 20633 - protein, 88 aa, Platanus occidentalis
MATTRVQRIMTQPINLIFRFLQSKARIQIWLFEQKYLRIEGRIIGFDEYMNLVWMMLKKSTSKKNSRKPLGRILLKGDNITLMMNTGK

SEQ ID NO: 20634 - protein, 81 aa, Scabiosa columbaria
MASTKVQRIMTQPINLIFRFLQSKARIQIWLFEQKDLRIEGRIIGFDEYMNLVLDDAEEVSIKKKSRKQLGRILLKGTTSH

SEQ ID NO: 20635 - protein, 76 aa, Utricularia gibba
PINLIFRFLQSKARIQIWLFEQKDLRIEGRIIGFDEYMNLVLDDAEEVSVKKNSRKQLGRILLKGDNITLMMNTGK

SEQ ID NO: 20636 - protein, 80 aa, Brassica juncea
MASTKVQRIMTQPINLIFRFLQSKARIQIWLFEQKDLRIEGRITGFDEYMNLVLDEAEEVSIKKNTRKPLGRILLKGDNI

SEQ ID NO: 20637 - protein, 97 aa, Tragopogon dubius
MATKVQRIMTQPINLIFRFLQSKARIQIWLFEQKDLRIEGRIIGFDEYMNLVLDEAEEVSIKKKTRKPLGRILLKGDNITLMMNSGKYEEHLHQCSC

SEQ ID NO: 20638 - protein, 123 aa, Trigonella foenum-graecum
MARIKVHELRQKAKADLLAQLKDLKAELALLRVAKVTGGAPNKLSKIKVVRLSIAQVLTVISQKQKAALREVYKNKKYLPLDLRPKKTRAIRRRLTKHQSSLKTEREKKKETYFPMRKYAIKA

SEQ ID NO: 20639 - protein, 123 aa, Fagopyrum esculentum
MARIKVHELRQKNKTDLLAQLKDLKAELSLLRVAKVTGGAPNKLSKIKVVRLQIAQVLTVISQKQKAALREVYKNKKYLPLDLRPKKTRAIRRRLTKHQASLKTEREKKKEIYFPMRKYAIKV

SEQ ID NO: 20640 - protein, 119 aa, Pisum sativum
KVHELRQKAKADLLSQLKDLKAELALLRVAKVTGGAPNKLSKIKVVRLSIAQVLTVISQKQKAALREVYKNKKYLPLDLRPKKTRAIRRRLTKHQASLKTEREKKKETYFPLRKYAIKA

SEQ ID NO: 20641 - protein, 123 aa, Cicer arietinum
MARIKVHELRQKTKADLLSQLKDLKAELSLLRVAKVTGGAPNKLSKIKVVRLSIAQVLTVISQKQKAALREVYKNKKYLPLDLRPKKTRAIRRRLTKHQASLKTEREKKKETYFPLRKYAIKA

SEQ ID NO: 20642 - protein, 123 aa, Trifolium pratense
MARIKVHELRQKAKTDLMAQLKDLKAELALLRVAKVTGGAPNKLSKIKVVRLSIAQVLTVISQKQKAALREVYKNKKYLPLDLRPKKTRAIRRRLTKHQASLKTEREKKKETYFPLRKYAIKA

SEQ ID NO: 20643 - protein, 123 aa, Trifolium pratense
MARIKVHELRQKAKADLLAQLKDLKAELALLRVAKVTGGAPNKLSKIKVVRLSIAQVLTVISQKQKAALREVYKNKKYLPLDLRPKKTRAIRRRLTKHQASLKTEREKKKETYFPLRKYAIKA

SEQ ID NO: 20644 - protein, 123 aa, Vaccinium corymbosum
MARIKVHELRQKSKTDLLAQLKDLKAELALLRVAKVTGGAPNKLSKIKVVRLSIAQVLTVISQKQKAALREVYKNKKYLPLDLRPKKTRAIRRRLTKHQASLKTEREKKKEMYYPMRKYAIKV

SEQ ID NO: 20645 - protein, 123 aa, Glycyrrhiza uralensis
MARIKVHELRQKNKAELLNQLKDLKAELALLRVAKVTGGAPNKLSKIKVVRLSIAQVLTVISQKQKAALREAYKNKKYLPLDLRPKKTRAIRRRLTKHQASLKTEREKKKETYFPMRKYAIKA

SEQ ID NO: 20646 - protein, 123 aa, Vicia sativa
MARIKVHELRQKAKADLLSQLKDLKAELALLRVAKVTGGAPNKLSKIKVVRLSIAQVLTVISQKQKAALREVYKNKKYLPLDLRPKKTRAIRRRLTKHQASLKTEREKKKETYFPLRKYAIKA

SEQ ID NO: 20647 - protein, 123 aa, Trifolium pratense
MARIKVHELRQKTKADLLAQLKDLKAELALLRVAKVTGGAPNKLSKIKVVRLSIAQVLTVISQKQKAALREVYKNKKYLPLDLRPKKTRAIRRRLTKHQASLKTQREQKKETYFPLRKYAIKA

SEQ ID NO: 20648 - protein, 123 aa, Cyclamen graecum
MARIKVHELRQKTKADLLAQLKDLKAELSLLRVAKVTGGAPNKLSKIKVVRLSIAQVLTVISQKQKAALREVYKNKKYLPLDLRPKKTRAIRRRLTKHQASLKTEREKKRDMYFPMRKYAIKV

SEQ ID NO: 20649 - protein, 123 aa, Lotus japonicus
MARIKVHELRQKNKADLLSQLKDLKAELALLRVAKVTGGAPNKLSKIKVVRLNIAQVLTVISQKQKAALREVYKNKKYLPLDLRPKKTRAIRRRLTKHQASLKTEREKKKETYFPMRKFAIKV

SEQ ID NO: 20650 - protein, 123 aa, Sesamum indicum
MARIKVHELRQKNKTELLAQLKDLKAELALLRVAKVTGGAPNKLSKIKVVRLSIAQVLTVISQKQKSALREAYKNKKYLPLDLRPKKTRAIRRRLTKHQASLKTEREKKKEMYFPMRKYAIKV

SEQ ID NO: 20651 - protein, 118 aa, Ananas comosus
VHELRQKSKADLLAQLKDLKTELSLLRVAKVTGGAPNKLSKIKVVRLSIAQVLTVISQKQKAALREVYKNKKYLPLDLRPKKTRAIRRRLTKHQASLKTEREKKRDMYFPMRKYAIKV

SEQ ID NO: 20652 - protein, 123 aa, Antirrhinum majus
MARIKVHELRQKNKTDLLAQLKDLKAELALLRVAKVTGGAPNKLSKIKVVRLSIAQVLTVISQKQKSALREVYKNKKYLPLDLRPKKTRAIRRRLTKHQASLKTEKQKKKEMYFPLRKYAIKV

SEQ ID NO: 20653 - protein, 123 aa, Vaccinium corymbosum
MARVKVHELRQKSKAELLSQLKDLKAELALLRVAKVTGGAPNKLSKIKVVRLSIAQVLTVISQKQKAALREVYKNKKYLPLDLRPKKTRAIRRRLTKHQLSLKTEREKKKEMYYPMRKYAIKV

SEQ ID NO: 20654 - protein, 123 aa, Chelidonium majus
MARIKVHELRGKSKTDLLNQLKDLKAELALLRVAKVTGGAPNKLSKIKVVRLSIAQVLTVISQKQKAALREVYKNKKLLPLDLRPKKTRAIRRRLTKHQLSLKTEREKKKEMYFPMRKYAIKV

SEQ ID NO: 20655 - protein, 123 aa, Chelidonium majus
MARIKVHELRGKSKTDLLSQLKDLKAELALLRVAKVTGGAPNKLSKIKVVRLSIAQVLTVISQKQKAALREVYKNKKLLPLDLRPKKTRAIRRRLTKHQLSLKTEREKKKEMYFPMRKYAIKV

SEQ ID NO: 20656 - protein, 123 aa, Coffea canephora
MARIKVHELRQKNKAELLAQLKDLKAELALLRVAKVTGGAANKLSKIKVVRLSIAQVLTVISQKQKAALREVYKNKKYLPLDLRPKKTRAIRRRLTKHQASLKTERQKKKETYFPLRKYAIKV

SEQ ID NO: 20657 - protein, 123 aa, Cyclamen graecum
MARIKVHELRQKSKADLMAQLKDLKAELSLLRVAKVTGGAPNKLSKIKVVRLSIAQVLTVISQKQKSALREVYKNKKYLPLDLRPKKTRAIRRRLTKHQQSLKTEREKKREMYFPMRKYAIKV

SEQ ID NO: 20658 - protein, 123 aa, Cyclamen graecum
MARIKVHELRQKSKADLLAQLKDLKTELSLLRVAKVTGGAPNKLSKIKVVRLSIAQVLTVISQKQKAALREVYKNKKYLPLDLRPKKTRAIRRRLTKHQASLKTEREKKRDMYFPMRKYAIKV

SEQ ID NO: 20659 - protein, 123 aa, Solanum melongena
MARIKVHELRNKSKTDLLAQLKDLKAELALLRVAKVTGGAPNKLSKIKVVRLSIAQVLTVISQKQKAALREVYKNKKYLPLDLRPKKTRAIRKRLTKHQASLKTEREKKKEMYFPLRKYAIKV

SEQ ID NO: 20660 - protein, 123 aa, Fagopyrum esculentum
MARIKVHELRQKNKTDLLAQLKDLKAELSLLRVAKVTGGAPNKLSKIKVVRLQIAQVLTVISQKQKSALREAYKNKKYLPLDLRPKKTRAIRRRLTKHQANLKTEREKKKEIYFPLRKYAIKV

SEQ ID NO: 20661 - protein, 123 aa, Linum usitatissimum
MARIKVHELRQKNKSDLLNQLKDLKAELALLRVAKVTGGAPNKLSKIKVVRLSIAQVLTVISQKQKAALREVYKNKKLLPLDLRPKKTRAIRRRLTKHQQSLKTEREKKREMYFPMRKYAIKV

SEQ ID NO: 20662 - protein, 123 aa, Linum usitatissimum
MARIKVHELRQKNKLDLLNQLKDLKAELSLLRVAKVTGGAPNKLSKIKVVRLSIAQVQTVISQKQKAALREVYKNKKLLPLDLRPKKTRAIRRRLTKHQQSLKTEREKKREMYFPMRKYAIKV

SEQ ID NO: 20663 - protein, 123 aa, Tropaeolum majus
MARIKVHELRQKSKDDLLSQLKDLKAELALLRVAKVTGGAPNKLSKIKVVRLSIAQVLTVISQKQKSALREVYKNKKYLPLDLRPKKTRAIRRRLTKHQVSLKTEREKKKEMYFPMRKYAIKV

SEQ ID NO: 20664 - protein, 123 aa, Petunia hybrida
MARIKVHELRQKSKTELLAQLKDLKAELSLLRVAKVTGGAPNKLSKIKVVRLSIAQVLTVISQKQKTALREVYKNKKYLPLDLRPKKTRAIRKRLTKHQASLKTEREKKKEMYFPIRKYAIKV

SEQ ID NO: 20665 - protein, 123 aa, Primula obconica
MARIKVHELRQKMKADLLAQLKDLKAELSLLRVAKVTGGAANKLSKIKVVRLSIAQVLTVISQKQKAALREVYKNKKYLPLDLRPKKTRAIRKRLTKHQQSLKTEREKKREMYFPMRKYAIKV

SEQ ID NO: 20666 - protein, 123 aa, Sarracenia psittacina
MARVKVHELRQKTKADLLSQLKDLKAELALLRVAKVTGGAPNKLSKIKVVRLSIAQVLTVISQKQKAALREAYKNKKYLPLDLRPKKTRAIRRRLTKHQASLKTEREKKREMYFPMRKYAIKV

SEQ ID NO: 20667 - protein, 123 aa, Sesamum indicum
MARIKVHELRQKNKTELLAQLKDLKAELALLRVAKVTGGAPNKLSKIKVVRLSIAQVLTVISQKQKAALREAYKNKKYLPLDLRPKKTRAIRRRLTKHQASLKTEKQKKKEMYFPMRKYAIKV

SEQ ID NO: 20668 - protein, 123 aa, Solanum lycopersicum
MARIKVHELRNKSKTDLLAQLKDLKAELALLRVAKVTGGAPNKLSKIKVVRLSIAQVLTVISQKQKSALREVYKNKKYLPLDLRPKKTRAIRKRLTKHQSSLKTEREKKKEMYFPIRKYAIKV

SEQ ID NO: 20669 - protein, 121 aa, Pisum sativum
RIKVYELRNKTKPDLLNQLKDLKAELALLRVAKVTGGAPNKLSKIKVVRLSIAQVLTVISQKQKAALREVYKNKKYLPLDLRPKKTRAIRRRLTKNQASLKTEREKKKEIYFPLRKYAIKA

SEQ ID NO: 20670 - protein, 123 aa, Amsonia hubrichtii
MARIKVHELRQKTKQDLLAQLKDLKAELALLRVAKVTGGAPNKLSKIKVVRLSIAQVLTVISQKQKAALREAYKNKKYLPLDLRPKKTRAIRRRLTKHQASLKTEKQKKKEMYFPMRKYAIKV

SEQ ID NO: 20671 - protein, 123 aa, Amsonia hubrichtii
MARIKVHELRNKNKQELLAQLKDLKAELALLRVAKVTGGAPNKLSKIKVVRLSIAQVLTVISQKQKAALREAYKNKKYLPLDLRPKKTRAIRRRLTKHQASLKTERQKKKEMYFPMRKYAIKV

SEQ ID NO: 20672 - protein, 123 aa, Antirrhinum majus
MARIKVHELRQKNKPDLLAQLKDLKAELALLRVAKVTGGAPNKLSKIKVVRLSIAQVLTVISQKQKLALREVYKNKKYLPLDLRPKKTRAIRRRLTKHQASLKTEKQKKKEMYFPLRKYAIKV

SEQ ID NO: 20673 - protein, 123 aa, Theobroma cacao
MARIKVHELRQKSKTELLAQLKDLKAELALLRVAKVTGGAPNKLSKIKVVRLSIAQVLTVISQKQKAALREAYKNKKFLPLDLRPKKTRAIRRRLTKHQASLKTEREKKREMYFPMRKYAIKV

SEQ ID NO: 20674 - protein, 123 aa, Cicer arietinum
MARIKVYELRNKTKADLLNQLKDLKAELALLRVAKVTGGAPNKLSKIKVVRLSIAQVLTVISQKQKAALREVYKNKKYLPLDLRPKKTRAIRRRLTKHQASLKTEREKKKEIYFPLRKYAIKA

SEQ ID NO: 20675 - protein, 123 aa, Cicer arietinum
MARIKVYELRQKTKADLLNQLKDLKAELSLLRVAKVTGGAPNKLSKIKVVRLSIAQVLTVISQKQKSALREAYKNKKYLPLDLRPKKTRAIRRRLTKHQQSLKTEREKKKEIYFPMRKYAIKV

SEQ ID NO: 20676 - protein, 123 aa, Citrus clementina
MARVKVHELRTKSKTDLLSQLKDLKAELALLRVAKVTGGAPNKLSKIKVVRLSIAQVLTVISQKQKAALREAYKNKKFLPLDLRPKKTRAIRRRLTKHQASLKTEREKKREMYFPMRKYAIKV

SEQ ID NO: 20677 - protein, 123 aa, Gossypium hirsutum
  Sequence also found in Organisms: Gossypium raimondii
MARIKVHELRQKSKTDLLAQLKDLKAELALLRVAKVTGGAPNKLSKIKVVRLSIAQVLTVISQKQKSALREAYKKKKFLPLDLRPKKTRAIRRRLTKHQASLKTEREKKKEMYFPMRKYAIKV

SEQ ID NO: 20678 - protein, 123 aa, Gossypium hirsutum
MARIKVHELRQKSKTELLAQLKDLKAELALLRVAKVTGGAPNKLSKIKVVRLSIAQVLTVISQKQKSALREAYKNKKFLPLDLRPKKTRAIRRRLTKHQASLKTEREKKKEMYFPMRKYAIKV

SEQ ID NO: 20679 - protein, 123 aa, Gossypium hirsutum
  Sequence also found in Organisms: Gossypium raimondii
MARIKVHELRQKSKTELLAQLKDLKAELALLRVAKVTGGAPNKLSKIKVVRLSIAQVLTVISQKQKAALREAYKKKKFLPLDLRPKKTRAIRRRLTKHQASLKTEREKKKEMYFPMRKYAIKV

SEQ ID NO: 20680 - protein, 123 aa, Solanum melongena
MARIKVHELRQKSKTELLAQLKDLKAELALLRVAKVTGGAPNKLSKIKVVRLSIAQVLTVISQKQKSALREVYKNKKYLPLDLRPKKTRAIRKRLTKHQASLKTEREKKKEMYFPIRKYAIKV

SEQ ID NO: 20681 - protein, 123 aa, Solanum melongena
MARIKVHELRNKSKTELLAQLKDLKAELALLRVAKVTGGAPNKLSKIKVVRLSIAQVLTVISQKQKAALREVYKNKKYLPLDLRPKKTRAIRKRLTKHQASLKTEREKKKEMYFPPRKYAIKV

SEQ ID NO: 20682 - protein, 123 aa, Solanum melongena
MARIKVHELRNKSKTELLAQLKDLKAELALLRVAKVTGGAPNKLSKIKVVRLSIAQVLTVISQKQKAALREVYKNKKYLPLDLRPKKTRAIRKRLTKHQASLKTEREKKKEMYFPLRKYAIKV

SEQ ID NO: 20683 - protein, 123 aa, Linum usitatissimum
MARIKVHELRQKNKLDLLNQLKDLKAEFSLLRVAKVTGGAPNKLSKIKVVRLSIAQVQTVISQKQKAALREVYKNKKLLPLDLRPKKTRAIRRRLTKHQQSLKTEREKKREMYFPMRKYAIKV

SEQ ID NO: 20684 - protein, 123 aa, Fraxinus spp
MARIKVHELRQKNKAELLAQLKDLKAELALLRVAKATAGAANKLSKIKVVRLSIAQVLTVISQKQKAALREVYKNKKYLPLDLRPKKTRAIRRRLTKHQASLKTEREKKKEMYFPMRKYAIKV

SEQ ID NO: 20685 - protein, 123 aa, Gossypium raimondii
MARIKVHELRNKSKTELLTQLKDLKAELSLLRVAKVTGGAPNKLSKIKVVRLSIAQVLTVISQKQKAALREAYKNKKFLPLDLRPKKTRAIRRRLTKHQQSLKTEREKKKEMYFPMRKYAIKV

SEQ ID NO: 20686 - protein, 123 aa, Humulus lupulus
MARIKVHELRQKNKADLLTQLKDLKAELALLRVAKVTGGAPNKLSKIKVVRLSIAQVLTVISQKQKAALREVYKNKKFLPLDLRTKKTRAIRRRLTKHQLSLKTEREKKREVYFPMRKYAIKV

SEQ ID NO: 20687 - protein, 123 aa, Actinidia deliciosa
MARVKVHELRQKTKVELLSQLKDLKAELALLRVAKVTGGAPNKLSKIKVVRLSIAQVLTVISQKQKAALREAYKNKKYLPLDLRPKKTRAIRRRLTKHQASLKTEREKKREMYFPMRKYAIKV

SEQ ID NO: 20688 - protein, 123 aa, Actinidia deliciosa
MARIKVHELRQKSKADLLSQLKDLKAELALLRVAKVTGGAPNKLSKIKVVRLSIAQVLTVISQKQKAVLREAYKNKKYLPLDLRPKKTRAIRRRLTKHQASLKTEREKKKEMYFPMRKYAIKV

SEQ ID NO: 20689 - protein, 123 aa, Mimulus guttatus
MARIKVHELRQKNKVDLQAQLNDLKAELALLRVAKVTGGAPNKLSKIKVVRLSIAQVLTVISQKQKAALREVYKNKKYLPLDLRPKKTRAIRRRLTKHQSSLKTLKEKKKDMYFPMRKYAIKV

SEQ ID NO: 20690 - protein, 123 aa, Nicotiana benthamiana
MARIKVHELRQKSKTELLAQLKDLKAELALLRVAKVTGGAPNKLSKIKVVRLSIAQVLTVISQKQKTALREAYKNKKYLPLDLRPKKTRAIRRRLTKHQASLKTEREKKKEMYFPLRKYAIKV

SEQ ID NO: 20691 - protein, 123 aa, Citrus sinensis
MARVKVHELRTKSKTDLLNQLKDLKAELALLRVAKVTGGAPNKLSKIKVVRLSIAQVLTVISQKQKAALREAYKNKKFLPLDLRPKKTRAIRRRLTKHQASLKTEREKKREMYFPMRKYAIKV

SEQ ID NO: 20692 - protein, 123 aa, Orobanche aegyptiaca
MARIKVHELRQKTKTELLAQLKDLKGELSLLRVAKVTGGAPNKLSKIKVVRLSIAQVLTVISQKQKAALREAYKNKKYLPLDLRPKKTRAIRRRLTKHQASLKTEKQKKKEMYFPMRKYAIKV

SEQ ID NO: 20693 - protein, 123 aa, Carica papaya
MARIKVHELRQKSKADLLNQLKDLKAELALLRVAKVTGGAPNKLSKIKVVRLSIAQVLTVISQKQKAALREAYKKKKYLPLDLRPKKTRAIRRRLTKHQASLKTEREKKKEMYFPMRKYAIKV

SEQ ID NO: 20694 - protein, 123 aa, Arachis hypogaea
MARIKVYELRQKNKTELLNQLKDLKAELALLRVAKVTGGAPNKLSKIKVVRLSIAQVLTVISQKQKAILREVYKKKKYTPLDLRPKKTRAIRRRLTKHQASLKTEREKKKETYFPMRKYAIKV

SEQ ID NO: 20695 - protein, 123 aa, Petunia hybrida
MARIKVHELRNKSKTELLAQLKDLKAELSLLRVAKVTGGAPNKLSKIKVVRLSIAQVLTVISQKQKTALREVYKNKKYLPLDLRPKKTRAIRKRLTKHQASLKTEREKKKEMYFPIRKYAIKV

SEQ ID NO: 20696 - protein, 123 aa, Plantago ovata
MARIKVHELRQKNKTDLLAQLKDLKAELALLRVAKVTGGAPNKLSKIKVVRLSIAQVLTVISQKQKAALREVYKNKKYLPLDLRPKKTRAIRRRLTKHQASLKTEKQKKKDMYFPLRKYAIAV

SEQ ID NO: 20697 - protein, 123 aa, Populus trichocarpa
MARIKVHELRQKSKTDLLAQLKDLKAELALLRVAKVTGGAPNKLSKIKVVRLSIAQVLTVISQKQKAVLREAYKNKKFLPLDLRPKKTRAIRRRLTKHQQSLKTEREKKREIYFPMRKYAIKV

SEQ ID NO: 20698 - protein, 123 aa, Silene vulgaris
MARIKVHELREKSKPDLLAQLKDLKAELALLRVAKVTGGAPNKLSKIKVVRLGIAQVLTVISQKQKAALREAYKNKKYLPLDLRPKKTRAIRRRLTKHQASLKTEREKKKEMYFPMRKYAIKV

SEQ ID NO: 20699 - protein, 123 aa, Solanum phureja
MARIKVHELRNKSKTELLAQLKDLKAELALLRVAKVTGGAPNKLSKIKVVRLSIAQVLTVISQKQKSALREVYKNKKYLPLDLRPKKTRAIRKRLTKHQSSLKTEREKKKEMYFPIRKYAIKV

SEQ ID NO: 20700 - protein, 123 aa, Tabernaemontana elegans
MARIKVHELRQKTKQELLAQLKDLKAELALLRVAKVTGGAPNKLSKIKVVRLSIAQVLTVISQKQKAALREAYKNKKYLPLDLRPKKTRAIRRRLTKHQASLKTERQKKKEMYFPMRKYAIKV

SEQ ID NO: 20701 - protein, 123 aa, Tabernaemontana elegans
MARIKVHELRNKTKQELLAQLKDLKAELALLRVAKVTGGAPNKLSKIKVVRLSIAQVLTVISQKQKAALREAYKNKKYLPLDLRPKKTRAIRRRLTKHQASLKTEREKKKEMYFPMRKYAIKV

SEQ ID NO: 20702 - protein, 123 aa, Camellia sinensis
MARIKVHELRQKSKAELLAQLKDLKAELSLLRVAKVTGGAPNKLSKIKVVRLSIAQVLTVISQKQKSVLREAYKNKKYLPLDLRPKKTRAIRRRLTKHQASLKTEREKKKEMYFPMRKYAIKV

SEQ ID NO: 20703 - protein, 123 aa, Valeriana officinalis
MARIKVHELRTKNKGDLLSQLKDLKAELALLRVAKVTGGAPNKLSKIKVVRLSIAQVLTVIQQKQKAALREVYKNKKLLPLDLRPKKTRAIRRRLTKHQASLKTEREKKKEMYFPMRKYAIKV

SEQ ID NO: 20704 - protein, 121 aa, Flaveria ramosissima
RIKVHELRNKSKADLFAQLKDLKAELALLRVAKVTGGAPNKLSKIKVVRTSIAQVLTVISQTQKAALREAYKNKKYLPLDLRPKKTRAIRRRLTKHQASLKTEREKKKEKYFPLRKYAIKA

SEQ ID NO: 20705 - protein, 122 aa, Medicago truncatula
MAIKMFELRSKTKADLLSQLKDLKAELALLRVAKVTGGAPNKLSKIKVVRLSIAQVLTVISQKQKAALREVYKNKKYLPLDLRPKKTRAIRRRLTKHQASLKTEREKKKEIYFPLRKYAIKA

SEQ ID NO: 20706 - protein, 122 aa, Lippia dulcis
ARIKVHELRQKSKAELLAQLKDLKAELSLLRVAKVTGGAPNKLSKIKVVRLSIAQVLTVISQKQKAALREAYKNKKYLPLDLRPKKTRSIRRRLTKHQASLKTEKERKKEMYFPMRKYAIKV

SEQ ID NO: 20707 - protein, 123 aa, Rosmarinus officinalis
MARIKVHELRQKAKQELLAQLKDLKAELALLRVAKVTGGAPNKLSKIKVVRLSIAQVLTVVSQKQKAALREAYKNKKYLPLDLRPKKTRAIRRRLTKHQASLKTERQKKKEMYFPMRKYAIKV

SEQ ID NO: 20708 - protein, 123 aa, Rosmarinus officinalis
MARIKVHELRQKNKTELLAQLKDLKAELALLRVAKVTGGAPNKLSKIKVVRLSIAQVLTVISQKQKSALREAYKNKKYLPLDLRPKKTRAIRRRLTKHQASLKTEKQKKKEMYFPLRKYAIKV

SEQ ID NO: 20709 - protein, 123 aa, Rosmarinus officinalis
MARIKVHELRQKNKVDLLAQLKDLKAELALLRVAKVTGGAPNKLSKIKVVRLSIAQVLTVISQKQKTALREAYKNKKYLPLDLRPKKTRAIRRRLTKHQASLKTEKQKKKEMYFPLRKYAIKV

SEQ ID NO: 20710 - protein, 123 aa, Arnica chamissonis
MARIKVHELRNKSKVDLFAQLKDLKAELALLRVAKVTGGAPNKLSKIKVVRTSIAQVLTVISQTQKAALREVYKNKKYLPLDLRPKKTRAIRRRLTKHQVSLKTEREKKKEKYFPLRKYAIKA

SEQ ID NO: 20711 - protein, 123 aa, Persea americana
MARIKVHELRGKSKADLLTQLKDLKAELALLRVAKVTGGASNKLSKIKVVRLSIAQVLTVISQKQKAALREVYKNKKYLPLDLRPKKTRAIRRRLTKHQASLKTEREKKREIYFPMRKYAIKV

SEQ ID NO: 20712 - protein, 123 aa, Ocimum basilicum
MARIKVHEIRQKNKAELLAQLKDLKAELALLRVAKVTGGAPNKLSKIKVVRLSIAQVLTVISQKQKTALREAYKNKKYLPLDLRPKKTRAIRRRLTKHQASLKTEKEKKKEMYFPLRKYAIKA

SEQ ID NO: 20713 - protein, 123 aa, Phaseolus vulgaris
MARIKVYELRQKTKADLLNQLKDLKAELALLRVAKVTGGAPNKLSKIKVVRLSIAQVLTVISQKQKSALRDAYKNKKYLPLDLRPKKTRAIRRRLTKHQASLKTEREKKKETYFPMRKYAIKV

SEQ ID NO: 20714 - protein, 123 aa, Theobroma cacao
MARIKVHELRNKSKTELLSQLKDLKAELSLLRVAKVTGGAPNKLSKIKVVRLSIAQVLTVISQKQKAALREAYKNKKFLPLDLRPKKTRAIRRRLTKHQQSLKTEREKKREMYFPMRKYAIKV

SEQ ID NO: 20715 - protein, 123 aa, Manihot esculenta
MARIKVHELRQKSKTELLDQLKDLKAELALLRVAKVTGGAPNKLSKIKVVRLSIAQVLTVISQKQKAALREAYKNKKFLPLDLRPKKTRAIRRRLTKHQQSLKTEREKKREMYFPMRKYAIKV

SEQ ID NO: 20716 - protein, 123 aa, Catharanthus roseus
MARIKVHELRQKTKQELLAQLKDLKAELALLRVAKVTGGAPNKLSKIKVVRLSIAQVLTVISQKQKSALRDAYKNKKYLPLDLRPKKTRAIRRRLTKHQASLKTEREKKKEMYFPMRKYAIKV

SEQ ID NO: 20717 - protein, 123 aa, Catharanthus roseus
MARIKVHELRNKTKQELLAQLKDLKAELALLRVAKVTGGAPNKLSKIKVVRLSIAQVLTVISQKQKSALREAYKNKKYLPLDLRPKKTRAIRRRLTKHQASLKTEREKKKEMYFPMRKYAIKV

SEQ ID NO: 20718 - protein, 123 aa, Cirsium arvense
MARIKVHELRNKNRGDLLGQLKDLKAELSLLRVAKVTGGAPNKLSKIKVVRTSIAQVLTVMSQKQKAALREVYKNKKYLPLDLRPKKTRAIRRRLTKHQASLKTEREKKKEKYFPLRKYAIKV

SEQ ID NO: 20719 - protein, 123 aa, Cirsium arvense
MARIKVHELRNKNRSDLLGQLKDLKAELALLRVAKVTGGAPNKLSKIKVVRTSIAQVLTVMSQKQKAALREVYKNKKYLPLDLRPKKTRAIRRRLTKHQASLKTEREKKKEKYFPLRKYAIKA

SEQ ID NO: 20720 - protein, 123 aa, Trifolium pratense
MAGIKVYELRQKTKAELLSQLKDLKAELALLRVAKVTGGAPNKLSKIKVVRLSIAQVLTVISQKQKTALREVYKNKKYLPLDLRPKKTRAIRRRLTKHQQSLKTEREKKKEIYFPLRKYAIKA

SEQ ID NO: 20721 - protein, 123 aa, Coffea canephora
MARIKVHELRNKSKTELLAQLKDLKAELALLRVAKVTGGAPNKLSKIKVVRLSIAQVLTVISQKQKAALREAYKNKKYLPLDLRPKKTRAIRRRLTKHQASLKTERQKKKEMYFPVRKYAIKV

SEQ ID NO: 20722 - protein, 123 aa, Gossypium hirsutum
MARIKVHELRNKSKTELLSQLKDLKAELSLLRVAKVTGGAPNKLSKIKVVRLSIAQVLTVISQKQKAALREAYKKKKFLPLDLRPKKTRAIRRRLTKHQQSLKTEREKKKEMYFPMRKYAIKV

SEQ ID NO: 20723 - protein, 123 aa, Vigna unguiculata
MARIKVYELRQKTKAELLNQLKDLKAELALLRVAKVTGGAPNKLSKIKVVRLSIAQVLTVISQKQKAALRDAYKNKKYLPLDLRPKKTRAIRRRLTKHQASLKTEREKKKETYFPMRKYAIKV

SEQ ID NO: 20724 - protein, 123 aa, Cyclamen graecum
MARIKVHELRQKSKADLLGQLKDLKAELALLRVAKVTGGAPNKLSKIKVVRLSIAQVLTVISQKQKSALREVYKNKKYLPLDLRPKKTRAIRRRLTKHQQLLKTEREKKREMYFPMRKYAIKV

SEQ ID NO: 20725 - protein, 122 aa, Cyclamen graecum
MARIKVHELRQKSKADLMAQLKDLKAELSLLRVAKVTGGAPNKLSKIKVVRLSIAQVLTVISQKQKSALREVYKNKKYLPLDLRPKKTRAIRRRLTKHQQLLKTEREKKREMYFPMRKYAIR

SEQ ID NO: 20726 - protein, 123 aa, Eschscholzia californica
MARIKVHELRGKSKTDLLNQLKDLKAELALLRVAKVTGGAPNKLSKIKVVRLSIAQVLTVISQKQKAALREAYKNKKFLPLDLRPKKTRAIRRRLTKHQLSLKTEREKKKELYYPMRKYAIKV

SEQ ID NO: 20727 - protein, 123 aa, Eschscholzia californica
MARIKVHELRGKSKTDLLNQLKDLKAELALLRVAKVTGGAPNKLSKIKIVRLSIAQVLTVISQKQKAALREAYKNKKFLPLDLRPKKTRAIRRRLTKHQLSLKTEREKKKELYFPMRKYAIKV

SEQ ID NO: 20728 - protein, 123 aa, Euphorbia peplus
MARIKVHELRQKTKADLLNQLKDLKAELALLRVAKVTGGAPNKLSKIKVVRLSIAQVLTVISQKQKAALREAYKNKKFLPLDLRPKKTRAIRRRLTKHQQSLKTEREKKREMYFPMRKYAIKV

SEQ ID NO: 20729 - protein, 123 aa, Fagopyrum esculentum
MARIKVHELRQKPKADLLSQLKELKAELSLLRVAKVTGGAPNKLSKIKVVRLSIAQVLTVISQKQKLALREVYKNKKYLPLDLRPKKTRAIRRRLTKHQASLKTERQKKKEVYFPLRKYAIKV

SEQ ID NO: 20730 - protein, 123 aa, Linum usitatissimum
MARIKVHELRQKNKSDLLNQLKDLKAELALLRVAKVTGGAPNKLSKIKVVRLSIAQVLTVISQKQKAALREVYKHKKLLPLDLRPKKTRAIRRRLTKHQQSLKTEREQKREMYFPMRKYAIKV

SEQ ID NO: 20731 - protein, 123 aa, Linum usitatissimum
MARIKVHELRLKNKLELLNQLKDLKAELALLRVAKVTGGAPNKLSKIKVVRLSIAQVLTVISQKQKAALREVYKNKKLLPLDLRPKKTRAIRRRLTKHQQSLKTEREKKREMYFPMRKYAIKV

SEQ ID NO: 20732 - protein, 123 aa, Heritiera littoralis
MARIKVHELRQKSKTELLAQLKDLKAELALLRVAKVTGGAPNKLSKIKVVRLSIAQVLTVISQKQKAALREAYKKKKFLPLDLRPKKTRAIRRRLTKHQGSLKTEREKKREMYFPMRKYAIKV

SEQ ID NO: 20733 - protein, 123 aa, Actinidia deliciosa
MARIKVHELRQKSKAELLAQLKDLKAELALLRVAKVTGGAPNKLSKIKVVRLSIAQVLTVISQKQKAVLREAYKNKKYMPLDLRPKKTRAIRRRLTKHQASLKTEREKKKEMYFPMRKYAIKV

SEQ ID NO: 20734 - protein, 123 aa, Medicago truncatula
MAGVKVYELRQKTKQDLLNQLKDLKAELALLRVAKVTGGAPNKLSKIKVVRLNIAQVLTVISQKQKTALREAYKSKKYLPLDLRPKKTRAIRRRLTKHQSSLKTEREKKKEIYFPVRKYAIKA

SEQ ID NO: 20735 - protein, 123 aa, Mimulus guttatus
MARIKVHELRQKNKADLLAQLNDLKAELALLRVAKVTGGAPNKLSKIKVVRLSIAQVLTVISQKQKAALREVYKNKKYIPLDLRPKKTRAIRRRLTKHQASLKTEKQKKKEMYFPLRKYAIKV

SEQ ID NO: 20736 - protein, 123 aa, Tropaeolum majus
MARIKVHELRQKSKEDLLSQLKDLKAELALLRVAKVTGGAPNKLSKIKVVRLSIAQVLTVISQKQKSALRDAYKNKKYLPLDLRPKKTRAIRRRLTKHQISLKTEREKKKEMYFPMRKYAIKV

SEQ ID NO: 20737 - protein, 123 aa, Nicotiana benthamiana
MARIKVHELRGKSKTDLLAQLKDLKAELALLRVAKVTGGAPNKLSKIKVVRLSIAQVLTVISQKQKSVLREAYKNKKYLPLDLRPKKTRAIRRRLTKHQASLKTEREKKKEMYFPIRKYAIKV

SEQ ID NO: 20738 - protein, 123 aa, Elaeis guineensis
MARIKVHELRGKSKTELLSQLKDLKAELSLLRVAKVTGGAPNKLSKIKVVRLSIARVLTVISQKQKAALREAYKNKKYIPLDLRPKKTRAIRRRLTKHQASLKTERQKKKEMYFPMRKYAIKA

SEQ ID NO: 20739 - protein, 123 aa, Olea europaea
MARIKVHELRQKNKAELLAQLKDLKAELALLRVAKATAGAANKLSKIKVVRLSIAQVLTVISQKQKAALREVYKNKKYLPLDLRPKKTRAIRRRLTKHQASLKSEREKKKEMYFPMRKYAIKV

SEQ ID NO: 20740 - protein, 123 aa, Solanum lycopersicum
  Sequence also found in Organisms: Solanum tuberosum, Solanum phureja
MARIKVHELRNKSKPDLLTQLKDLKAELALLRVAKVTGGAPNKLSKIKVVRLSIAQVLTVISQKQKAALREVYKNKKYLPLDLRPKKTRAIRKRLTKHQASLKTEREKKKEMYFPLRKYAIKV

SEQ ID NO: 20741 - protein, 123 aa, Solanum tuberosum
  Sequence also found in Organisms: Solanum phureja
MARIKVHELRNKSKTELLAQLKDLKAELSLLRVAKVTGGAPNKLSKIKVVRLSIAQVLTVISQKQKLALREAYKNKKYLPLDLRPKKTRAIRKRLTKHQASLKTEREKKKEMYFPLRKYAIKV

SEQ ID NO: 20742 - protein, 123 aa, Rosa hybrid cultivar
  Sequence also found in Organisms: Fragaria vesca
MARIKVHELRNKSKADLLGQLKDLKAELALLRVAKVTGGAPNKLSKIKVVRLSIAQVLTVISQKQKAALREVYKNKKLLPLDLRPKKTRAIRRRLTKHQASLKTEREKKREMYFPLRKYAIKA

SEQ ID NO: 20743 - protein, 123 aa, Salvia sclarea
MARIKVHELRQKNKVDLLAQLKDLKAELALLRVAKVTGGAPNKLSKIKVVRLSIAQVLTVISQKQKSALREAYKNKKYLPLDLRPKKTRAIRRRLTKHQASLKTEKQKKKEMYFPLRKYAIKV

SEQ ID NO: 20744 - protein, 123 aa, Sarracenia psittacina
MARVKVHELRQKSKAELLAQLKDLKAELALLRVAKVTGGAPNKLSKIKVVRLSIAQVLTVISQKQKSALREAYKNKKYLPLDLRPKKTRAIRRRLTKHQASLKTEREKKREMYFPLRKYAIKV

SEQ ID NO: 20745 - protein, 123 aa, Scabiosa columbaria
MARIKVHELRQKSKSDLLAQLKDLKAELALLRVAKVTGGAPNKLSKIKVVRLSIAQVLTVIQQTQKAALREVYKNKKYMPLDLRPKKTRAIRKRLTKHQASLKTEREKKKEMYFPMRKYAIKV

SEQ ID NO: 20746 - protein, 123 aa, Silene vulgaris
MARIKVHELREKSKPDLLDQLKDLKAELALLRVAKVTGGAPNKLSKIKVVRLGIAQVLTVISQKQKAALREAYKNKKYLPLDLRPKKTRAIRRRLTKHQASLKTEREKKKERYFPMRKYAIKV

SEQ ID NO: 20747 - protein, 123 aa, Nicotiana tabacum
MARIKVHELRQKSKTELSAQLKDLKAELALLRVAKVTGGAPNKLSKIKVVRLSIAQVLTVISQKQKTALREAYKNKKYLPLDLRPKKTRAIRRRLTKHQASLKTEREKKKEMYFPLRKYAIKV

SEQ ID NO: 20748 - protein, 123 aa, Trigonella foenum-graecum
MARIKVYELRQKTKADLLNQLKDLKAELALLRVAKVTGGAPNKLSKIKVVRLNIAQVLTVISQKQKTALREAYKNKKYLPLDLRPKKTRAIRRRLTKHQSSLKTEREKKKEIYFPLRKYAIKA

SEQ ID NO: 20749 - protein, 123 aa, Hordeum vulgare
MARIKVHELRGKNKTELQGQLKDLKAELSLLRVAKVTGGAPNKLSKIKVVRTSIARVLTVISQKQKAALREAYKNKKLLPLDLRPKKTRAIRRRLTKHQLSLKTEREKKREKYFPMRKYAIKA

SEQ ID NO: 20750 - protein, 123 aa, Rosmarinus officinalis
MARIKVHELRNKTKQDLLAQLKDLKAELALLRVAKVTGGAPNKLSKIKVVRLSIAQVLTVISQKQKSALREAYKNKKLLPLDLRPKKTRAIRRRLTKHQASLKTERQKKKEMYFPMRKYAIKV

SEQ ID NO: 20751 - protein, 123 aa, Rosmarinus officinalis
  Sequence also found in Organisms: Salvia sclarea
MARIKVHELRQKNKVELLAQLKDLKAELALLRVAKVTGGAPNKLSKIKVVRLSIAQVLTVISQKQKSALREAYKNKKYLPLDLRPKKTRAIRRRLTKHQASLKTEKQKKKEMYFPLRKYAIKV

SEQ ID NO: 20752 - protein, 123 aa, Malus domestica
MARIKVHELRHKTKADLLAQLKDLKAELALLRVAKVTGGAPNKLSKIKVVRLSIAQVLTVMSQKQKAALREVYRNKKLLPLDLRPKKTRAIRRRLTKHQASLKTEREKKKEMYYPSRKYAIKA

SEQ ID NO: 20753 - protein, 123 aa, Malus domestica
MARIKVHELRHKTKADLLAQLKDLKAELALLRVAKVTGGAPNKLSKIKVVRLSIAQVLTVMSQKQKAALREVYRNKKLLPLDLRPKKTRAIRRRLTKHQASLKTEREKKKEIYYPLRKYAIKA

SEQ ID NO: 20754 - protein, 123 aa, Catharanthus roseus
  Sequence also found in Organisms: Panax ginseng
MARIKVHELRGKSKTDLLTQLKELKAELALLRVAKVTGGAPNKLSKIKVVRLSIAQVLTVMQQKQKAALREVYKNKKLLPLDLRPKKTRAIRRRLTKHQASLKTEREKKKEKYFPMRKYAIKV

SEQ ID NO: 20755 - protein, 123 aa, Centaurea maculosa
MARIKVHELRNKNRGDLLGQLKDLKAELALLRVAKVTGGAPNKLSKIKVVRTSIAQVLTVMSQKQKAALREVYKNKKYLPLDLRPKKTRAIRRRLTKHQASLKTEREKKKEKYFPLRKYAIKV

SEQ ID NO: 20756 - protein, 123 aa, Citrus clementina
  Sequence also found in Organisms: Citrus sinensis
MARIKVHELRQKSKVDLLNQLKELKAELALLRVAKVTGGAPNKLSKIKVVRLSIAQVLTVISQKQKAALREAYKNKKFLPLDLRPKKTRAIRRRLTKHQASLKTEREKKREMYFPMRKYAIKV

SEQ ID NO: 20757 - protein, 123 aa, Cucumis sativus
MARIKVHELRQKSKADLLLQLKDLKAELSLLRVAKVTGGAPNKLSKIKVVRLSIAQVLTVISQKQKAALREAYKKKKLLPLDLRPKKTRAIRRRLTKHQASLKTERQKKKEMYFPLRKYAIKV

SEQ ID NO: 20758 - protein, 123 aa, Cucurbita pepo
MARIKVHELRQKSKADLLTQLKDLKAELSLLRVAKVTGGAPNKLSKIKVVRLSIAQVLTVISQKQKAALREAYKKKKLLPLDLRPKKTRAIRRRLTKHQASLKTEREKKKEMYYPLRKYAIKV

SEQ ID NO: 20759 - protein, 123 aa, Eucalyptus grandis
MARIKVHELRQKTKVDLLTQLKELKAELALLRVAKVTGGAPNKLSKIKVVRLSIAQVLTVISQKQKSALREVYKKKKYLPLDLRPKKTRAIRRRLTKYQVSLKTEREKKKEMYFPLRKYAIKA

SEQ ID NO: 20760 - protein, 123 aa, Euphorbia peplus
MARIKVHELRQKTKAELLNQLKDLKAELALLRVAKVTGGAPNKLSKIKVVRLSIAQVLTVISQKQKLALREAYKNKKFLPLDLRPKKTRAIRRRLTKHQQSLKTEREKKKEMYFPMRKYAIKV

SEQ ID NO: 20761 - protein, 123 aa, Flaveria ramosissima
MARIKVHELRNKSKADLFAQLKDLKAELALLRVAKVTGGAPNKLSKIKVVRTSIAQVLTVISQTQKAALREAYKNKKYLPLDLRPKKTRAIRRRLTKHQASLKTEREKKKEKYFPLRKYAIKA

SEQ ID NO: 20762 - protein, 123 aa, Flaveria ramosissima
MARIKVHELRNKSKVDLFAQLKDLKAELALLRVAKVTGGAPNKLSKIKVVRTSIAQVLTVISQTQKAALREAYKNKKYLPLDLRPKKTRAIRRRLTKHQASLKTEREKKKEKYFPLRKYAIKA

SEQ ID NO: 20763 - protein, 123 aa, Fraxinus spp
  Sequence also found in Organisms: Olea europaea
MARIKVHELRQKNKAELLAQLKDLKAELALLRVAKATAGAANKLSKIKVVRLSIAQVLTVISQKQKAALREAYKNKKYLPLDLRPKKTRAIRRRLTKHQASLKTEREKKKEMYFPLRKYAIKV

SEQ ID NO: 20764 - protein, 123 aa, Hevea brasiliensis
MARIKVHELRQKSKTELLNQLKDLKAELALLRVAKVTGGAPNKLSKIKVVRLSIAQVLTVISQNQKAALREAYKNKKFLPLDLRPKKTRAIRRRLTKHQQSLKTEREKKREMYFPMRKYAIKV

SEQ ID NO: 20765 - protein, 123 aa, Ipomoea batatas
MARIKVHELRNKSKTELLAQLKDLKAELALLRVAKVTGGAPNKLSKIKVVRLSIAQVLTVISQKQKAVLREAYKNKKYLPLDLRPKKTRAIRRRLTKHQASLKTERQKKKEMYFPLRKYAIKV

SEQ ID NO: 20766 - protein, 123 aa, Jatropha curcas
MARIKVHELRQKSKTELLNQLKDLKAELALLRVAKVTGGAPNKLSKIKVVRLSIAQVLTVISQKQKAALRDAYKNKKFLPLDLRPKKTRAIRRRLTKHQQSLKTEREKKREMYFPMRKYAIKV

SEQ ID NO: 20767 - protein, 123 aa, Actinidia deliciosa
MARIKVHELRQKSKADLLSQLKDLKAELALLRVAKVTGGAPNKLSKIKVVRLSIAQVLTVISQKQKAFLREAYKNKKYLPLDLRPKKTRAIRRCLTKHQVSLKTEREKKKEMYFPTRKYAIKV

SEQ ID NO: 20768 - protein, 123 aa, Actinidia deliciosa
MARIKVHELRQKSKAELLAQLKDLKAELALLRVAKVTGGAPNKLSKIKVVRLSIAQVLTVISQKQKAVLREAYKNKKYMPLDLRPKKTRAIRRRLTKHQTSLKTEREKKREMYFPMRKYAIKV

SEQ ID NO: 20769 - protein, 123 aa, Liriodendron tulipifera
MARIKVHELRGKSKVDLLNQLKDLKAELSLLRVAKVTGGAPNKLSKIKVVRLSIAQVLTVISQKQKAALREVYKKKKFLPLDLRPKKTRAIRRRLTKHQASLKTEREKKREMYFPLRKYAIKV

SEQ ID NO: 20770 - protein, 123 aa, Nicotiana benthamiana
  Sequence also found in Organisms: Nicotiana tabacum
MARIKVHELRNKTKTELLAQLKDLKAELALLRVAKVTGGAPNKLSKIKVVRLSIAQVLTVISQKQKTALREAYKNKKYLPLDLRPKKTRAIRKRLTKHQVSLKTEREKKKEMYFPIRKYAIKV

SEQ ID NO: 20771 - protein, 123 aa, Nicotiana benthamiana
MSRIKVHELRNKTKTELLAQLKDLKAELALLRVAKVTGGAPNKLSKIKVVRLSIAQVLTVISQKQKSALREAYKNKKYLPLDLRPKKTRAIRKRLTKHQASLKTEREKKKEMYFPIRKYAIKV

SEQ ID NO: 20772 - protein, 123 aa, Avena sativa
MARIKVHELRGKNKADLQGQLKDLKAELSLLRVAKVTGGAPNKLSKIKVVRTSIARVLTVISQKQKSALREAYKNKKLLPLDLRPKKTRAIRRRLTKHQSSLKTEREKKREKYFPMRKYAIKA

SEQ ID NO: 20773 - protein, 123 aa, Olea europaea
MARMKVHELRQKNKAELLAQLKDLKAELALLRVAKATAGAANKLSKIKVVRLSIAQVLTVISQKQKAALREAYKNKKYLPLDLRPKKTRAIRRRLTKHQASLKSEREKKKEMYFPMRKYAIKV

SEQ ID NO: 20774 - protein, 123 aa, Carica papaya
MARIKVHELRQKSKADLLNQLKDLKAELALLRVAKVTGGAPNKLSKIKVVRLSIAQVLTVISQKQKAALREAYKKKKYLPLDLRPKKTRAIRRRLTKHQASLKTVRETKKEIYFPMRKYAIKV

SEQ ID NO: 20775 - protein, 123 aa, Capsicum annuum
MARIKVHELRQKSKTELLAQLKDLKAELALLRVAKVTGGAPNKLSKIKVVRLSIAQVLTVISQKQKSALREAYKNKKYLPLDLRPKKTRAIRKRLTKHQASLRTEREKKKEMYFPLRKYAIKV

SEQ ID NO: 20776 - protein, 123 aa, Papaver somniferum
MARIKVHELRTKNKTELLGQLKDLKAELALLRVAKVTGGAPNKLSKIKVVRLSIAQVLTVISQKQKSALRDAYKNKKFLPLDLRPKKTRAIRRRLTKHQLSLKTEREKKKEMYFPMRKYAIKV

SEQ ID NO: 20777 - protein, 123 aa, Prunus persica
  Sequence also found in Organisms: Prunus mume
MARIKVHELRNKTKAELLGQLKDLKAELALLRVAKVTGGAPNKLSKIKVVRLSIAQVLTVISQKQKAALREVYKNKKFLPLDLRPKKTRAIRRRLTKHQASLKTEREKKKEMYFPLRKFAIKA

SEQ ID NO: 20778 - protein, 123 aa, Prunus persica
  Sequence also found in Organisms: Prunus mume
MARIKVHELRQKTKAELLNQLKDLKAELALLRVAKVTGGAPNKLSKIKVVRLSIAQVLTVISQKQKSALREVYKNKKFLPLDLRPKKTRAIRRRLTKHQASLKTEREKKKEMYYPLRKYAIKA

SEQ ID NO: 20779 - protein, 123 aa, Fragaria vesca
MARIKVHELRQKSKADLLAQLKDLKAELALLRVAKVTGGAPNKLSKIKVVRLGIAQVLTVISQKQKAALREVYKNKKLLPLDLRPKKTRAIRRRLTKHQASLKTEREKKREMYYPLRKFAIKA

SEQ ID NO: 20780 - protein, 123 aa, Helianthus annuus
MARIKVHELRGKSKVDLFAQLKDLKAELALLRVAKVTGGAPNKLSKIKVVRTSIAQVLTVISQTQKAALREAYKNKKYLPLDLRPKKTRAIRRRLTKHQASLKTEREKKKEKYFPLRKYAIKA

SEQ ID NO: 20781 - protein, 123 aa, Camellia sinensis
MARIKVHELRQKSKAELQSQLKDLKAELSLLRVAKVTGGAPNKLSKIKVVRLSIAQVLTVISQKQKSVLREAYKNKKYLPLDLRPKKTRAIRRRLTKHQASLKTEREKKKEMYFPMRKYAIKV

SEQ ID NO: 20782 - protein, 123 aa, Nicotiana tabacum
MARIKVHELRGKSKTELLAQLKDLKAELALLRVAKVTGGAPNKLSKIKVVRLSIAQVLTVISQKQKSVLREAYKNKKYLPLDLRPKKTRAIRRRLTKHQASLKTEREKKKEMYFPIRKYAIKV

SEQ ID NO: 20783 - protein, 123 aa, Nicotiana tabacum
MARIKVHELRGKSKTELLAQLKDLKAELALLRVAKVTGGAPNKLSKIKVVRLSIAQVLTVISQKQKTALREAYKNKKYLPLDLRPKKTRAIRKRLTKHQASLKTEREKKKEMYFPIRKYAIKV

SEQ ID NO: 20784 - protein, 123 aa, Solanum lycopersicum
MARIKVHELRNKSKTELLAQLKDLKAELALLRVAKVTGGAPNKLSKIKVVRLSIAQVLTVISQKQKLALREAYKNKKYLPLDLRPKKTRAIRKRLTKHQASLKTEREKKKELYFPLRKYAIKV

SEQ ID NO: 20785 - protein, 123 aa, Tragopogon dubius
MARVKVHELRNKGRSDLLAQLKDLKAELALLRVAKVTGGAPNKLAKIKVVRTSIAQVLTVMSQKQKSALREVYKNKKYLPLDLRPKKTRAIRRRLTKHQVSLKTEREKKKEKYFPLRKYAIKA

SEQ ID NO: 20786 - protein, 123 aa, Tripterygium wilfordii
MARIKVHELRQKSKADLLNQLKDLKAELALLRVAKVTGGAPNKLSKIKVVRLSIAQVLTVISQTQKAALREAYKNKKFMPLDLRPKKTRAIRRRLTKHQASLKTEREKKKEMYFPMRKYAIKV

SEQ ID NO: 20787 - protein, 123 aa, Citrullus lanatus
MARIKVHELRQKSKADLLLQLKDLKAELALLRVAKVTGGAPNKLSKIKVVRLSIAQVLTVISQKQKAALREAYKKKKLLPLDLRPKKTRAIRRRLTKHQASLKTEREKKKEMYFPLRKYAIKV

SEQ ID NO: 20788 - protein, 119 aa, Flaveria ramosissima
KVHELRNKSKADLFAQLKDLKAELALLRVAKVTGGAPNKLSKIKVVRTSIAQVLTVISQTQKAALRDAYKKKKYLPLDLRPKKTRAIRRRLTKHQASLKTEREKKKEKYFPLRKYAIKA

SEQ ID NO: 20789 - protein, 123 aa, Glycine max
MARIKVYELRQKTKADLLNQLKDLKAELALLRVAKVTGGAPNKLSKIKVVRLNIAQVLTVISQKQKAALRDAYKNKKYLPLDLRPKKTRAIRRRLTKHQASLKTEREKKKELYFPLRKYAIKV

SEQ ID NO: 20790 - protein, 123 aa, Acacia harpophylla
MARIKVHELRNKSKPELLNQLKELKAELALLRVAKVTGGAPNKLSKIKVVRLSIAQVLTVISQKQKAALREVYKNKKYLPLDLRPKKTRAIRRRLTKHQASLKTQREKKKEMYFPLRKYAIKV

SEQ ID NO: 20791 - protein, 123 aa, Arnica chamissonis
MARIKVHELRNKSKGDLFAQLKDLKAELALLRVAKVTGGAPNKLSKIKVVRTSIAQVLTVISQTQKAALRDAYKNKKYLPLDLRPKKTRAIRRRLTKHQVSLKTEREKKKEKYFPLRKYAIKA

SEQ ID NO: 20792 - protein, 123 aa, Artemisia annua
MARIKVHELRSKSKVDLFAQLKDLKAELALLRVAKVTGGAPNKLSKIKVVRTSIAQVLTVISQTQKSALREAYKNKKYLPLDLRPKKTRAIRRRLTKHQASLKTEREKKKEKYFPLRKYAIKA

SEQ ID NO: 20793 - protein, 123 aa, Fagus grandifolia
MARIKVHELRNKSKADLQSQLKDLKAELALLRVAKVTGGAPNKLSKIKVVRLGIAQVLTVISQKQKAALREVYKGKKYLPLDLRPKKTRAIRRRLTKHQASLKTEREKKKELYFPLRKYAIKV

SEQ ID NO: 20794 - protein, 123 aa, Brachypodium distachyon
MARIKVHELRGKNKAELQGQLKDLKAELSLLRVAKVTGGAPNKLSKIKVVRTSIARVLTVISQKQKAALREAYKNKKLLPLDLRPKKTRAIRRRLTKHQLSLKTEREKKREKYFPMRKYAIKA

SEQ ID NO: 20795 - protein, 123 aa, Brachypodium distachyon
MARIKVHELRGKNKTELQGQLKDLKAELSLLRVAKVTGGAPNKLSKIKVVRTSIARVLTVISQKQKAALREAYKNKKLLPLDLRPKKTRAIRRRLTKHQLSLKTEREKKREKYFPTRKYAIKA

SEQ ID NO: 20796 - protein, 123 aa, Bruguiera gymnorhiza
MARIKVHELRQKTKAELLNQLKDLKAELALLRVAKVTGGAPNKLSKIKVVRLSIARVLTVISQKQKAALREAYKNKKFLPLDLRPKKTRAIRRRLTKHQQSLKTEREKKREMYFPMRKYAIKV

SEQ ID NO: 20797 - protein, 123 aa, Daucus carota
MARIKVHELRTKSKADLLAQLQELKAELSLLRVAKVTGGAPNKLSKIKVVRLSIAQVLTVMQQKQKAALREVYKNKKLMPLDLRPKKTRAIRRRLTKHQASLKTEREKKKEKYFPMRKYAIKV

SEQ ID NO: 20798 - protein, 123 aa, Daucus carota
MARIKVHELRTKPKADLLAQLKDLKAELALLRVAKVTGGAPNKLSKIKVVRTSIAQVLTVMQQKQKAALREVYKNKKLMPLDLRPKKTRAIRRRLTKHQASLKTEREKKKEKYFPMRKYAIKV

SEQ ID NO: 20799 - protein, 123 aa, Manihot esculenta
MARIKVHELRQKSKTELLNQLKDLKAELALLRVAKVTGGAPNKLSKIKVVRLSIAQVLTVISQKQKAALREAYKNKKFLPLDLRPKKTRSIRRKLTKHQQSLKTEREKKREMYFPMRKYAIKV

SEQ ID NO: 20800 - protein, 123 aa, Ricinus communis
MARIKVHELRNKSKTELLSQLKDLKAELALLRVAKVTGGAPNKLSKIKVVRLSIAQVLTVISQKQKAALREAYKNKKLLPLDLRPKKTRAIRRRLTKHQASLKTEREKKREMYFPVRKYAIKV

SEQ ID NO: 20801 - protein, 123 aa, Castanea mollissima
  Sequence also found in Organisms: Quercus alba
MARIKVHELRQKTKAELLNQLKDLKAELALLRVAKVTGGAPNKLSKIKVVRLSIAQVLTVISQKQKGALREAYKKKKYLPLDLRPKKTRAIRRRLTKRQASLKTEREKKKEMYFPMRKYAIKV

SEQ ID NO: 20802 - protein, 123 aa, Chrysanthemum coronarium
MARIKVHELRSKSKADLFAQLKDLKAELALLRVAKVTGGAPNKLSKIKVVRTSIAQVLTVISQTQKSALREAYKNKKYLPLDLRPKKTRAIRRRLTKHQASLKTEREKKKEKYFPLRKYAIKA

SEQ ID NO: 20803 - protein, 123 aa, Chrysanthemum coronarium
MARIKVHELRSKTKVDLFAQLKDLKAELALLRVAKVTGGAPNKLSKIKVVRTSIAQVLTVISQTQKSALREAYKNKKYLPLDLRPKKTRAIRRRLTKHQVSLKTEREKKKEKYFPLRKYAIKA

SEQ ID NO: 20804 - protein, 123 aa, Cichorium intybus
MARIKVHELRGKSKADLFAQLKDLKAELALLRVAKVTGGAPNKLSKIKVVRTSIAQVLTVISQTQKAMLREAYKNKKYLPLDLRPKKTRAIRRRLTKHQVSLKTEREKKKEKYFPLRKYAIKA

SEQ ID NO: 20805 - protein, 123 aa, Cirsium arvense
  Sequence also found in Organisms: Helianthus annuus
MARIKVHELRNKSKADLFAQLKDLKAELALLRVAKVTGGAPNKLSKIKVVRTGIAQVLTVISQTQKAALREAYKNKKYLPLDLRPKKTRAIRRRLTKHQASLKTEREKKKEKYFPLRKYAIKA

SEQ ID NO: 20806 - protein, 123 aa, Cleome gynandra
MARIKVHELRDKSKTDLLNQLKDLKAELALLRVAKVTGGAPNKLSKIKVVRKSIAQVLTVISQKQKSALREAYKNKKLLPLDLRPKKTRAIRRRLTKHQASLKTEREKKKDMYFPMRKYAIKV

SEQ ID NO: 20807 - protein, 123 aa, Trifolium pratense
MARIKVYELRQKTKADLLNQLKDLKAELALLRVAKVTGGAPNKLSKIKVVRLSIAQVLTVISQKQKTALREAYKKKKYLPLDLRPKKTRAIRRRLTKHQQSLKTEREKKKEIYFPLRKYAIKV

SEQ ID NO: 20808 - protein, 123 aa, Cucumis sativus
MARIKVHELRQKSKGDLLAQLKDLKAELALLRVAKVTGGAPNKLSKIKVVRLSIAQVLTVISQKQKAALREAYKKKKLLPLDLRPKKTRAIRRRLTKHQASLKTERQKKKEMYYPLRKYAIKV

SEQ ID NO: 20809 - protein, 123 aa, Cucurbita pepo
MARIKVHELRQKSKVDLLTQLKDLKAELSLLRVAKVTGGAPNKLSKIKVVRLSIAQVLTVISQKQKAALREAYKKKKLLPLDLRPKKTRAIRRKLTKHQASLKTEREKKKEMYYPLRKYAIKV

SEQ ID NO: 20810 - protein, 123 aa, Cyamopsis tetragonoloba
MARIKVHELRQKNKAELLNQLKDLKAELALLRVAKVTGGAPNKLSKIKVVRLSIAQVLTVISQKQKSALREAYKKKKYLPLDLRPKKTRAIRRRLTKHQATLKTEREKKKETYFPLRKFAIKV

SEQ ID NO: 20811 - protein, 123 aa, Cyamopsis tetragonoloba
MARIKVHELRNKTKVELLNQLKDLKAELALLRVAKVTGGAPNKLSKIKVVRLSIAQVLTVISQKQKAALREAYKKKKYLPLDLRPKKTRAIRRRLTKHQASLKTEREKKKELYFPLRKYAIKV

SEQ ID NO: 20812 - protein, 123 aa, Cynara scolymus
MARIKVHELRNKNRADLLGQLKDLKAELALLRVAKVTGGAPNKLSKIKVVRTSIAQVLTVMSQKQKAALREVYKNKKYTPLDLRPKKTRAIRRRLTKHQASLKTEREKKKEKYFPLRKYAIKV

SEQ ID NO: 20813 - protein, 123 aa, Echinacea purpurea
MARIKVHELRNKSKADLFAQLKDLKAELALLRVAKVTGGAPNKLSKIKVVRTSIAQVLTVISQTQKAALRDAYKNKKYLPLDLRPKKTRAIRRRLTKHQVSLKTEREKKKEKYFPLRKYAIKA

SEQ ID NO: 20814 - protein, 123 aa, Euonymus alatus
MARIKVHELRNKSKTELLNQLKDLKAELALLRVAKVTGGAPNKLSKIKVVRLSIAQVLTVISQTQKAALREAYKNKKYLPLDLRPKKTRAIRRRLTKHQASLKTERQKKREMYFPMRKYAIKV

SEQ ID NO: 20815 - protein, 123 aa, Euphorbia peplus
  Sequence also found in Organisms: Euphorbia esula
MARIKVHELRQKSKADLLLQLKDLKAELALLRVAIVTGGAPNKLSKIKVVRLSIAQVLTVISQKQKAALREAYKKKKLLPLDLRPKKTRAIRRRLTKHQASLKTEREKKKEMYFPLRKYAIKV

SEQ ID NO: 20816 - protein, 123 aa, Fagopyrum esculentum
MARIKVHELRQKPKADLLSQLKELKAELSLLRVAKVTGGAPNKLSKIKVVRLSIAQVLTVISQKQKLALREAYKNKKYLPLDLRPKKTRAIRRRLTKHQASLKTERQKKKEVYFPLRKFAIKV

SEQ ID NO: 20817 - protein, 123 aa, Panax ginseng
MARIKVHELRGKSKTDLLTQLKELKAELALLRVAKVTGAAPNKLSKIKVVRLSIAQVLTVMQQKQKAALREVYKNKKLLPLDLRPKKTRAIRRRLTKHQASLKTEREKKKEKYFPMRKYAIKV

SEQ ID NO: 20818 - protein, 123 aa, Vitis vinifera
MARIKVHELRGKTKADLLVQLKELKAELALLRVAKVTGGAPNKLSKIKVVRLSIAQVLTVISQKQKAALREAYKNKKYLPLDLRPKKTRAIRKRLTKHQVSLKTEREKKREMYFPMRKYAIKV

SEQ ID NO: 20819 - protein, 123 aa, Guizotia abyssinica
MARIKVHELRNKSKADLFAQLKDLKAELALLRVAKVTGGAPNKLSKIKVVRTSIAQVLTVISQTQKAALRDAYKNKKYLPLDLRPKKTRAIRRRLTKHQASLKTEREKKKEKYFPLRKYAIKA

SEQ ID NO: 20820 - protein, 123 aa, Mesembryanthemum crystallinum
MARIKVHELRQKSKADLLNQLKDLKAELALLRVAKVTGGAPNKLSKIKVVRLGIAQVLTVISQKQKSALREAYKNKKYLPLDLRPKKTRAIRRRLTKHQASLKTEREKKKEMYYPMRKFAIKV

SEQ ID NO: 20821 - protein, 123 aa, Ipomoea batatas
MARIKVHELRNKNKSELLAQLKDLKAELALLRVAKVTGGAPNKLSKIKVVRLSIAQVLTVISQKQKAVLREAYKNKKYLPLGLRPKKTRAIRRRLTKHQASLKTERQKKKEMYFPLRKYAIKV

SEQ ID NO: 20822 - protein, 123 aa, Lactuca sativa
MARIKVHELRGKTKADLFAQLKDLKAELALLRVAKVTGGAPNKLSKIKVVRTSIAQVLTVISQTQKAMLREAYKNKKYLPLDLRPKKTRAIRRRLTKHQVSLKTEREKKKEKYFPLRKYAIKA

SEQ ID NO: 20823 - protein, 123 aa, Cucumis melo
MARIKVHELRQKSKGDLLAQLKDLKAELALLRVAKVTGGAPNKLSKIKVVRLSIAQVLTVISQKQKAALREAYKKKKLLPLDLRPKKTRAIRRRLTKHQESLKTERQKKKEMYYPLRKYAIKV

SEQ ID NO: 20824 - protein, 123 aa, Momordica charantia
MARIKVHELRQKSKADLLTQLKDLKAELALLRVAKVTGGAPNKLSKIKVVRLSIAQVLTVISQKQKAALREAYKKKKLLPLDLRPKKTRAIRRRLTKHQASLKTERQKKKEMYFPLRKYAIKV

SEQ ID NO: 20825 - protein, 123 aa, Mimulus guttatus
MARIKVHELRQKNKAELLAQLNDLKAELSLLRVAKVTGGAPNKLSKIKVVRLSIAQVLTVISQKQKSALREVYKNKKYVPLDLRPKKTRAIRRRLTKHQASLKTEKQKKKDMYFPLRKYAIKV

SEQ ID NO: 20826 - protein, 123 aa, Orobanche aegyptiaca
MARIKVHELRQKSKADLLSQLQELKGELSLLRVAKVTGGAPNKLSKIKVVRLSIAQVLTVISQKQKAALREVYKNKKYLPLDLRPKKTRAIRRRLTKHQASLKTEKQKKKEMYFPLRKYAIKV

SEQ ID NO: 20827 - protein, 123 aa, Petroselinum crispum
MARIKVHELRTKSKPDLLAQLKDLKAELSLLRVAKVTGGAPNKLSKIKVVRTSIAQVLTVMQQKQKAALREVYKNKKLMPLDLRPKKTRAIRRRLTKHQASLTTEREKKKEKYFPMRKYAIKV

SEQ ID NO: 20828 - protein, 123 aa, Lippia dulcis
MARIKVHELRLKNKVELLAQLKDLKAELALLRVAKVTGGAPNKLSKIKVVRLSIAQVLTVISQKQKSALREAYKNKKYLPLDLRPKKTRAIRRRLTKHQASLKTEKQKKKEMYFPLRKYAIKV

SEQ ID NO: 20829 - protein, 123 aa, Cajanus cajan
MARIKVYELRQKTKAELLNQLKDLKAELALLRVAKVTGGAPNKLSKIKVVRLSIAQVLTVISQKQKAALRDAYKNKKYLPLDLRPKKTRAIRRRLTKHQASLKTEKQKKKETYFPMRKYAIKV

SEQ ID NO: 20830 - protein, 123 aa, Cajanus cajan
MARIKVYELRNKTKAELLNQLKDLKAELALLRVAKVTGGAPNKLSKIKVVRLSIAQVLTVISQKQKAALREAYKNKKYLPLDLRPKKTRAIRRRLTKHQASLKTEREKKKELYFPLRKYAIKV

SEQ ID NO: 20831 - protein, 123 aa, Papaver somniferum
MARIKVHELRDKSKTDLLNQLKDLKAELALLRVAKVTGGAPNKLSKIKVVRLSIAQVLTVISQKQKSALRDAYKGKKFLPLDLRPKKTRAIRRRLTKHQLSLKTEREKKKEMYFPMRKYAIKV

SEQ ID NO: 20832 - protein, 123 aa, Papaver somniferum
MARIKVHELRAKSKADLLNQLKDLKAELALLRVAKVTGGAPNKLSKIKVVRLSIAQVLTVISQKQKLALRDAYKNKKFLPLDLRPKKTRAIRRRLTKHQLSLKTEREKKKEMYFPMRKYAIKV

SEQ ID NO: 20833 - protein, 123 aa, Rosa hybrid cultivar
MARIKVHELRQKSKADLLAQLKDLKAELALLRVAKVTGGAPNKLSKIKVVRLGIAQVLTVISQKQKAALREVYKNKKLLPLDLRPKKTRAIRRKLTKHQASLKTEREKKREMYYPLRKFAIKA

SEQ ID NO: 20834 - protein, 123 aa, Secale cereale
MARIKVHELRGKSKTDLQGQLKDLKAELSLLRVAKVTGGAPNKLSKIKVVRTSIARVLTVISQKQKSALREAYKNKKLLPLDLRPKKTRAIRRRLTKHQLSLKTEREKKREKYFPMRKYAIKA

SEQ ID NO: 20835 - protein, 123 aa, Sciadopitys verticillata
MARIKVHELRTKGKSDLLNQLKDLKAELALLRVAKVTGGAPNKLSKIKVVRKSIAQVLTVISQNQKAALREAYKKKKYLPLDLRPKKTRAIRRRLTKHQASLKTEREKKKEMYFPMRKYAIKV

SEQ ID NO: 20836 - protein, 123 aa, Euphorbia esula
MARIKVHELRLKTKAALLNQLKDLKAELALLRVAKVTGGAPNKLSKIKVVRLSIAQVLTVISQKQKLALREAYKNKKFLPLDLRPKKTRAIRRRLTKHQQSLKTEREKKKEMYFPMRKYAIKV

SEQ ID NO: 20837 - protein, 123 aa, Helianthus annuus
MARIKVHELREKSKTDLFAQLKDLKTELALLRVAKVTGGAPNKLSKIKVVRTSIAQVLTVISQTQKAKLREAYKNKKYLPLDLRPKKTRAIRRRLTKHQVSLKTEREKKKEKYFPLRKYAIKA

SEQ ID NO: 20838 - protein, 123 aa, Tamarix hispida
MARIKVHELRQKSKQELLNQLKDLKAELSLLRVAKVTGGAPNKLSKIKVVRLSIAQVLTVISQKQKTALREAYKNKKYLPLDLRPKKTRAIRRRLTKHQASLKTEKQKKKEMYFPMRKFAIKV

SEQ ID NO: 20839 - protein, 123 aa, Triphysaria pusilla
MARIKVHELRQKSKSDLLAQLKDLKTELSLLRVAKVTGGAPNKLSKIKVVRLSIAQVLTVISQTQKSALREAYKNKKYLPLDLRPKKTRAIRRRLTKHQASLKTEKQKKKEMYFPLRKYAIKV

SEQ ID NO: 20840 - protein, 123 aa, Tripterygium wilfordii
MARIKVHELRQKPKAELLNQLKDLKAELALLRVAKVTGGAPNKLSKIKVVRLSIAQVLTVISQTQKAALREVYKNKKFMPLDLRPKKTRAIRRRLTKHQASLKTERQKKKEMYFPMRKYAIKV

SEQ ID NO: 20841 - protein, 123 aa, Valeriana officinalis
MARIKVHELRQKSKADLLAQLKDLKAELALLRVAKVTGGAPNKLSKIKVVRLSIAQVLTVIQQTQKAALRDVYKNKKYMPLDLRPKKTRAIRKRLTKHQASLKTEREKKKEMYFPLRKYAIKV

SEQ ID NO: 20842 - protein, 123 aa, Vinca minor
MARIKVHELRNKTKQELLAQLKDLKAELATLRVAKVTGGAPNKLSKIKVVRLSIAQVLTVISQKQKSALREAYKNKKYLPLDLRPKKTRAIRRRLTKHQASLKTEREKKKEMYYPMRKYAIKV

SEQ ID NO: 20843 - protein, 122 aa, Utricularia gibba
ARIKVHELRQKNKAELLAQLKDLKAELSLLRVAKVTGGAPNKLAKIKVVRLSIAQVLTVISQKQKGALREAYKNKKYLPLDLRPKKTRAIRRRLTKHQASLKTEKQKKKDMYFPLRKYAVKV

SEQ ID NO: 20844 - protein, 120 aa, Thalictrum flavum
IKVHELRDKSKTDLLSQLNELKAELALLRVAKVTGGAPNKLSKIKVVRLSIARVLTVISQTQKAALRNAYKNKKLLPLDLRPKKTRAIRRRLTKHQESLKTEREKKKEMYFPMRKYAIKV

SEQ ID NO: 20845 - protein, 123 aa, Conyza canadensis
MARIKVHELRSKTKADLFAQLKDLKAELALLRVAKVTGGAPNKLSKIKVVRTSIAQVLTVISQTQKSALREAYKNKKYLPLDLRPKKTRAIRRRLTKHQASLKTAREKKKEKYFPLRKYAIKA

SEQ ID NO: 20846 - protein, 123 aa, Glycine max
MARIKVYELRNKTKAELLNQLKDLKAELALLRVAKVTGGAPNKLSKIKVVRLSIAQVLTVISQKQKAALREAYKKKKYLPLDLRPKKTRAIRRRLTKHQASLKTEREKKKELYFPLRKYAIKV

SEQ ID NO: 20847 - protein, 123 aa, Glycine max
MARIKVYELRNKTKAELLNQLKDLKAELALLRVAKVTGGAPNKLSKIKVVRLSIAQVLTVISQKQKAALREAYKKKKYLPLDLRPKKTRAIRRRLTKHQVSLKTEREKKKELYFPLRKYAIKV

SEQ ID NO: 20848 - protein, 123 aa, Amaranthus tuberculatus
MARIKVHELRQKTKAELLNQLKDLKAELALLRVAKVTGGAPNKLSKIKVVRLGIAQVLTVMSQKQKLALREAYKNKKYLPLDLRPKKTRAIRRRLTKHQASLKTEREKKKEMYYPMRKYAIKV

SEQ ID NO: 20849 - protein, 123 aa, Amaranthus tuberculatus
MARIKVHELRQKTKVELLNQLKDLKAELALLRVAKVTGGAPNKLSKIKVVRLGIAQVLTVMSQKQKSALREAYKNKKYLPLDLRPKKTRAIRRRLTKHQASLKTEREKKKEMYYPMRKYAIKV

SEQ ID NO: 20850 - protein, 123 aa, Artemisia annua
MARIKVHELREKTKTDLFSQLKELKAELALLRVAKVTGGAPNKLSKIKVVRTSIAQVLTVISQTQKAKLREAYKNKKYLPLDLRPKKTRAIRRRLTKHQVSLKTEREKKKEKYFPLRKYAIKA

SEQ ID NO: 20851 - protein, 123 aa, Musa acuminata
MARIKVHELRGKPKAELQAQLKDLKNELSLLRVAKVTGGAPNKLSKIKVVRVSIARVLTVISQKQKAALREAYKNKKFIPLDLRPKKTRAIRRRLTKHQDSLKTEREKKKEMYFPMRKYAIKA

SEQ ID NO: 20852 - protein, 123 aa, Musa acuminata
MARIKVHELRGKTKVELQSQLKDLKNELSLLRVAKVTGGAPNKLSKIKVVRLSIARVLTVISQKQKAALREVYKKKKLMPLDLRPKKTRAIRRRLTKHQESLKTEREKKKEMYFPMRKYAIKA

SEQ ID NO: 20853 - protein, 123 aa, Phaseolus vulgaris
MARIKVYELRSKTKAELLSQLKDLKAELALLRVAKVTGGAPNKLSKIKVVRLSIAQVLTVISQKQKSALREAYKNKKYLPLDLRPKKTRAIRRRLTKHQASLKTEREKKNELYFPMRKYAIKV

SEQ ID NO: 20854 - protein, 123 aa, Phaseolus vulgaris
MARIKVYELRNKNKVELLNQLKDLKAELALLRVAKVTGGAPNKLSKIKVVRLSIAQVLTVISQKQKAALREAYKTKKYLPLDLRPKKTRAIRRRLTKNQASLKTEREKKKELYFPLRKYAIKV

SEQ ID NO: 20855 - protein, 123 aa, Bruguiera gymnorhiza
MARIKVHELRQKTKAELLNQLKDLKAELALLRVAKVTGGAPNKLSKIKVVRLSIARVLTVISQKQKAALREAYENKKFLPLDLRPKKTRAIRRRLTKHQQSLKTEREKKREMYFPMRKYAIKV

SEQ ID NO: 20856 - protein, 123 aa, Daucus carota
MARIKVHELRTKPKADLQAQVKELKAELSLLRVAKVTGGAPNKLSKIKVVRLSIAQVLTVMQQKQKAALREVYKNKKLMPLDLRPKKTRAIRRRLTKHQASLKTEREKKKEKYFPMRKYAIKV

SEQ ID NO: 20857 - protein, 123 aa, Centaurea maculosa
  Sequence also found in Organisms: Cichorium intybus, Cirsium arvense, Cynara scolymus
MARIKVHELRDKSKADLFAQLKDLKAELALLRVAKVTGGAPNKLSKIKVVRTSIAQVLTVISQTQKAKLREAYKNKKYLPLDLRPKKTRAIRRRLTKHQVSLKTEREKKKEKYFPLRKYAIKV

SEQ ID NO: 20858 - protein, 121 aa, Chelidonium majus
MARIKVHELRAKSKTDLLNQLKEFKAELALLRVAKVTGGAPNKLSKIKVVRLSIAQVLTVISQKQKAALREAYKNKKLLPLDLRPKKTRAIRRRLTKHQESLKTEREKKKEMYFPMRKYAN

SEQ ID NO: 20859 - protein, 123 aa, Castanea mollissima
MARIKVHELRNKTKAELLAQLKDLKAELALLRVAKVTGGAPNKLSKIKVVRLGIAQVLTVISQKQKSALREVYKNKKYIPLDLRPKKTRAIRRRLTKKQASLKTEREKKKEMYFPLRKYAIKV

SEQ ID NO: 20860 - protein, 123 aa, Chrysanthemum coronarium
MARIKVFELRSKSKVDLFAQLKDLKAELALLRVAKVTGGAPNKLSKIKVVRTSIAQVLTVISQTQKSALREAYKNKKYLPLDLRPKKTRAIRRRLTKHQVSLKTEREKKKEKYFPLRKYAIKA

SEQ ID NO: 20861 - protein, 123 aa, Cirsium arvense
  Sequence also found in Organisms: Carthamus tinctorius
MARIKVHELRTKSKVDLFAQLKDLKAELALLRVAKVTGGAPNKLSKIKVVRTSIAQVLTVISQTQKSALREAYKNKKYLPLDLRPKKTRAIRRRLTKHQASLKTEREKKKEKYFPLRKYAIKV

SEQ ID NO: 20862 - protein, 122 aa, Cirsium arvense
MARIKVHELRDKSKADLFAQLKDLKAELALLRVAKVTGGAPNKLSKIKVVRTSIAQVLTVISQTQKAKLREAYKNKKYLPLDLRPKKTRAIRRRLTKHQVSLKTEREKKKEKYFPLRKYAIK

SEQ ID NO: 20863 - protein, 123 aa, Cirsium arvense
MARIKVHELRGKSKADLFAQLKDLKAELALLRVAKVTGGAPNKLSKIKVVRTSIAQVLTVISQTQKSMLREAYKNKKYLPLDLRPKKTRAIRRRLTKHQVSLKTEREKKKEKYFPLRKYAIKA

SEQ ID NO: 20864 - protein, 123 aa, Cleome spinosa
MARIKVHELRDKSKTDLLNQLKDLKAELALLRVAKVTGGAPNKLSKIKVVRKSIAQVLTVISQKQKSALREAYKNKKYLPLDLRPKKTRAIRRRLTKHQKSLKTEREKKRDMYFPVRKYAIKV

SEQ ID NO: 20865 - protein, 123 aa, Cocos nucifera
MARIKVHELRGKSKTELLTQLKDLKAELALLRVAKVTGGAPNKLSKIKVVRLSIARVLTVISQKQKQVLREAYKNKKYQPLDLRPKKTRAIRRRLTKHQASLKTEREKKKEMYFPLRKYAIKA

SEQ ID NO: 20866 - protein, 123 aa, Vigna unguiculata
MARIKVYELRNKTKAELLNQLKDLKAELALLRVAKVTGGAPNKLSKIKVVRLSIAQVLTVISQKQKAALREAYKTKKYLPLDLRPKKTRAIRRRLTKHQASLKTEREKKKELYFPLRKYAIKV

SEQ ID NO: 20867 - protein, 123 aa, Vigna unguiculata
MARIKVYELRNKTKAELLNQLKDLKAELALLRVAKVTGGAPNKLSKIKVVRLSIAQVLTVISQKQKAALREAYKNKKYIPLDLRPKKTRAIRRRLTKHQASLKTERETKKELYFPMRKYAIKV

SEQ ID NO: 20868 - protein, 123 aa, Cynara scolymus
MARIKVHELRNKSKVDLFAQLKDLKAELALLRVAKVTGGAPNKLSKIKVVRTSIAQVLTVISQTQKSALREAYKNKKYLPLDLRPKKTRAIRRRLTKHQASLKTEREKKKEKYFPLRKYAIKV

SEQ ID NO: 20869 - protein, 123 aa, Taraxacum officinale
MARIKVHELRDKSKVDLFAQLKDLKAELALLRVAKVTGGAPNKLSKIKVVRTSIAQVLTVISQTQKAKLREAYKNKKYLPLDLRPKKTRAIRRRLTKHQVSLKTEREKKKEKYFPLRKYAIKV

SEQ ID NO: 20870 - protein, 123 aa, Echinacea purpurea
MARIKVHELREKSKTDLFAQLKDLKTELALLRVAKVTGGAPNKLSKIKVVRTSIAQVLTVVSQTQKAKLREAYKNKKYLPLDLRPKKTRAIRRRLTKHQVSLKTEREKKKEKYFPLRKYAIKA

SEQ ID NO: 20871 - protein, 123 aa, Euonymus alatus
MARIKVHELRQKSKAELLNQLKDLKAELALLRVAKVTGGAPNKLSKIKVVRLSIAQVLTVISQTQKAALREAYKNKKFMPLDLRPKKTRAIRRRLTKHQASLKTERQKKKEMYFPMRKYAIKV

SEQ ID NO: 20872 - protein, 122 aa, Festuca arundinacea
MARIKVHELRGKNKAELLGQLKDLKAELSLLRVAKVTGGAPNKLSKIKVVRTSIARVLTVISQKQKSALREAYKNKRLPLDLRPKKTRAIRRRLTKHQLSLKTEREKKREKYFPMRKYAIKA

SEQ ID NO: 20873 - protein, 123 aa, Flaveria ramosissima
MARIKVHELRNKSKADLFAQLKDLKAELALLRVAKVTGGAPNKLSKIKVVRTSIAQVLTVISQTQKAALRDAYKKKKYLPLDLRPKKTRAIRRRLTKHQASLKTEREKKKEKYFPLRKYAIKA

SEQ ID NO: 20874 - protein, 123 aa, Flaveria ramosissima
MARIKVHELREKSKADLFTQLKDLKAELALLRVAKVTGGAPNKLSKIKVVRTSIAQVLTVISQTQKAKLREAYKNKKYLPLDLRPKKTRAIRRRLTKHQASLKTEREKKKEKYFPLRKYAIKA

SEQ ID NO: 20875 - protein, 123 aa, Linum usitatissimum
MARIKVHELRQKNKLDLLNQLKDLKAEFSLLRVAKVTGGAPNKLSKIKVVRLSIAQVQTVISQKQKAALCEVYKNKKLLPLDLRPKKTRAIRRRLTKPQQFFKTEREKKREMYFPMRKYAIKG

SEQ ID NO: 20876 - protein, 123 aa, Gossypium raimondii
MARIKVHELRDKSKTELLSQLKELKAELSLLRVAKVTGGAPNKLSKIKVVRLSIAQVLTVISQKQKAALREAYKKKKFLPLDLRPKKTRAIRRRLTKHQQSLKTEREKKREMYFPQRKYAIKV

SEQ ID NO: 20877 - protein, 123 aa, Guizotia abyssinica
MARITVHELRTKSKVDLFAQLKDLKAELSLLRVAKVTGGAQNKLSKIKVVRTQIAQVLTVISQTQKAALREAYKNKKYLPLDLRPKKTRAIRRRLTKHQASLKTEREKKKEKYFPLRKYAIKA

SEQ ID NO: 20878 - protein, 123 aa, Mesembryanthemum crystallinum
MARIKVHELRQQPKAELLNQLKALKDELSLLRVAKVTGGAPNKLSKIKVVRLGIAQVLTVISQKQKAALREVYKNKKYLPLDLRPKKTRAIRRRLTKHQASLKTEREMKKERYYPMRKYAIKV

SEQ ID NO: 20879 - protein, 123 aa, Ipomoea nil
MARIKVHELRNKSKAELLAQLADLKAELALLRVAKVTGGAPNKLSKIKVVRLSIAQVLTVISQTQKAALRNAYKNKKYLPLDLRPKKTRAIRRRLTKHQASLKTEREKKKEMYFPLRKYAIKV

SEQ ID NO: 20880 - protein, 123 aa, Lactuca sativa
MARIKVHELRNKSKADLFAELKDLKAELALLRVAKVTGGAPNKLSKIKVVRTSIAQVLTVISQTQKSALREAYKNKKYLPLDLRPKKTRAIRRRLTKHQVSLKTEREKKKEKYFPLRKYAIKA

SEQ ID NO: 20881 - protein, 123 aa, Lotus japonicus
MARIKVYELRNKTKAELLSQLKDLKAELALLRVAKVTGGAPNKLSKIKVVRLSIAQVLTVISQKQKAALREAYKNKKYLPLDLRPKKTRAIRRRLTKHQASLKTEREKKKELYFPLRKYAVKV

SEQ ID NO: 20882 - protein, 123 aa, Lupinus angustifolius
MARIKVYELRSKTKAELLNQLKDLKAELALLRVAKVTGGAPNKLSKIKVVRLNIAQVLTVISQKQKAALREAYKNKKYLPLDLRPKKTRAIRRRLTKHQASLKTEREKKKELYFPIRKYAIKV

SEQ ID NO: 20883 - protein, 123 aa, Medicago truncatula
MARIKVHELRQKTKADLLAQLKDLKAELALLRVAKATRAAPNNLSKIKEVRLSIAQVLTVISQKRKAALREVYKNKKYLPIDLRPKKTRAVRRRLTKHQSSLKTEMEKKKETYFTMRKYAIKA

SEQ ID NO: 20884 - protein, 123 aa, Momordica charantia
MARIKVHELRQKSKADLLGQLKDLKAELALLRVAKVTGGAPNKLSKIKVVRLSIAQVLTVISQKQKAALREAYKKKKLLPLDLRPKKTRAIRRRLTKHQASLKTERQKKKEMYYPLRKYAIKV

SEQ ID NO: 20885 - protein, 123 aa, Nuphar advena
MARIKVHELRAKTKTELLNQLKDLKAELALLRVAKVTGGAPNKLSKIKVVRLSIAQVLTVISQKQKAALREAYKKKKYLPLDLRPKKTRAIRRSLTKHQASLKTEREKKREKYFPIRKYAIKV

SEQ ID NO: 20886 - protein, 123 aa, Avena sativa
MARIKVHELRGKNKAELQGQLKDLKAELSLLRVAKVTGGAPNKLSKIKVVRTSIARVLTVISQKQKAALRDAYKNKKLLPLDLRPKKTRAIRRRLTKHQLSLKTEREKKREKYFPMRKYAIKA

SEQ ID NO: 20887 - protein, 123 aa, Elaeis guineensis
MARIKVHELRGKSKADLLNQLKDLKAELALLRVAKVTGGAPNKLSKIKVVRLSIARVLTVISQKQKEVLREAYKKKKYQPLDLRPKKTRAIRRRLTKHQASLKTEREKKKEMYFPMRKYAIKA

SEQ ID NO: 20888 - protein, 123 aa, Orobanche aegyptiaca
MARIKVHELRQKSKADLLSQLQELKGELSLLRVAKVTGGAPNKLSKIKVVRLSIAQVLTVISQKQKAALREVYKNKKYLPLDLRPKKTRAIRRRLTKHQASLKTEKQKKREMYFPLRKYAIKV

SEQ ID NO: 20889 - protein, 123 aa, Cajanus cajan
MARMKVYELRNKTKAELLNQLKDLKAELALLRVAKVTGGAPNKLSKIKVVRLSIAQVLTVISQKQKAALREAYKNKKYLPLDLRPKKTRAIRRRLTKHQVSLKTEREKKKELYFPLRKYALKV

SEQ ID NO: 20890 - protein, 123 aa, Cajanus cajan
MARIKVYELRNKTKAELLNQLKDLKAELALLRVAKVTGGAPNKLSKIKVVRLSIAQVLTVISQKQKAALREAYKNKKYLPLDLRPKKTRAIRRRLTKHQESLKTEREKKKEMYFPIRKYALKV

SEQ ID NO: 20891 - protein, 123 aa, Platanus occidentalis
MARIKVHELRGKSKADLLTQLKDLKAELALLRVAKVTGGAPNKLSKIKVVRLSIAQVLTVISQKQKAALREAYKKKKFLPLDLRPKKTRAIRKRLTKHQLSLKTEREKKREMYFPMRKYAIKV

SEQ ID NO: 20892 - protein, 123 aa, Platanus occidentalis
MARIKVHELRGKSKPDLLNQLKDLKAELALLRVAKVTGGAPNKLSKIKVVRLSIAQVLTVISQKQKAALREAYKKKKFLPLDLRPKKTRAIRKRLTKHQESLKTEREKKREMYFPMRKYAIKV

SEQ ID NO: 20893 - protein, 123 aa, Populus trichocarpa
MARIKVHELREKSKTELLAQLKELKAELALLRVAKVTGGAPNKLSKIKVVRLSIAQVLTVISQKQKAALREAYKNKKFLPLDLRPKKTRAIRRRLTKHQASLKTKREEKREMYFPMRKYAIKV

SEQ ID NO: 20894 - protein, 123 aa, Populus trichocarpa
MARIKVHELRNKSKADLLAQLKDLKAELALLRVAKVTGGAPNKLSKIKVVRLSIAQVLTVISQKQKAILRDAYKNKKFLPLDLRPKKTRAIRRRLTKHQLSLKTEREKNREMYFPMRKYAIKV

SEQ ID NO: 20895 - protein, 123 aa, Carthamus tinctorius
MARIKVHEFRNKNRADLLGQLKDLKAELAPLRVAKVTGGAPNKLSKIKVVRTSIAQVLTVMSQKQKAALREVYKNKKYLPLDLRPKKTRAIRRRLTKHQASLKTEREKKKEKYFPLRKYAIKV

SEQ ID NO: 20896 - protein, 123 aa, Senecio madagascariensis
MARIKVHELRGKTKADLFAQLKDLKAELALLRVAKVTGGAPNKLSKIKVVRTSIAQVLTVISQTQKAALRDAYKNKKYLPLDLRPKKTRAIRKRLTKHQASLKTEREKKKEMYFPLRKYAIKA

SEQ ID NO: 20897 - protein, 123 aa, Solanum phureja
MARIKVHELRQKSKADLLGQLKDLKTELALLRVAKVTGGAPNKLSKIKVVRLSVAQVLTVISQRQKSALREAYKNKKYLPLDLRPKKTRAIRRRLTKHQASLKTEREKKKEMYFPLRKYAIKV

SEQ ID NO: 20898 - protein, 123 aa, Helianthus annuus
MARIKVHELRFKTKADLFAQLKDLKAELALLRVAKVTGGAPNKLSKIKVVRTSIAQVLTVISQTQKAALRDAYKKKKYLPLDLRPKKTRAIRRRLTKHQASLKTEREKKKEKYFPLRKYAIKA

SEQ ID NO: 20899 - protein, 123 aa, Eutrema halophilum
MARIKVHELREKSKSDLSAQLKDLKAELAVLRVAKVTGGAPNKLSKIKVVRKSIAQVLTVISQKQKSALREAYKNKKLLPLDLRPKKTRAIRRRLTKHQSSLKTEREKKKEMYFPIRKYAIKV

SEQ ID NO: 20900 - protein, 123 aa, Tragopogon dubius
MARIKVHELRGKSKADLFAQLKDLKTELALLRVAKVTGGAPNKLSKIKVVRTSIAQVLTVISQTQKAMLREAYKNKKYLPLDLRPKKTRAIRRRLTKHQVSLKTEREKKKEKYFPLRKYAIKA

SEQ ID NO: 20901 - protein, 123 aa, Triphysaria pusilla
MARIKVHELRQKSKSDLLAQLKDLKTELSLLRVAKVTGGAPNKLSKIKVVRLSIAQVLTVISQTQKSALREAYKNKKYLPLDLRPKKTRAIRRRLTKHQASLKTEKQKKKAMYFPLRKYAIKV

SEQ ID NO: 20902 - protein, 123 aa, Triphysaria pusilla
MARIKVHELRQKSKTELLSQLKDLKTELSLLRVAKVTGGAPNKLSKIKVVRLSIAQVLTVISQTQKSALREAYKNKKYLPLDLRPKKTRAIRRRLTKHQASLKTEKQKKKEMYFPLRKYAIKV

SEQ ID NO: 20903 - protein, 122 aa, Triticum aestivum
MARIKVHELRGKNKADLQGQLKDLKAELSLLRVAKVTGGAPNKLSKIKVVRTSIARVLTVISQKQKSALREAYKNKRLPLDLRPKKTRAIRRRLTKHQLSLKTEREKKREKYFPMRKYAIKA

SEQ ID NO: 20904 - protein, 121 aa, Avena sativa
ARVKVHELRGKNKAELQGQLKDLKAELSLLRVAKVTGGAPNKLSKIKVVRTSVARVLTVISQKQKAALREVYKNKPLPLDLRTKKTRAIRRRLTKHQLSLKTEREKKREKYFPIRKYAIKA

SEQ ID NO: 20905 - protein, 123 aa, Oryza sativa
MARIKVHELRGKNKAELQAQLKDLKAELSLLRVAKVTGGAPNKLSKIKVVRTSIARVLTVISQKQKAALREAYKKKSLLPLDLRPKKTRAIRRRLTKHQLSLKTEREKKREKYFPMRKYAVKA

SEQ ID NO: 20906 - protein, 123 aa, Glycine max
MARIKVYELRYKTKAELLNQLKDLKAELALLRVAKVTGGAPNKLSKIKVVRLSIARVLTVISQKQKAALREAYKKKKYLPLDLRPKKTRAIRRRLTKHQASLKTQREKKKELYFPMRKYAIKV

SEQ ID NO: 20907 - protein, 123 aa, Abies balsamea
MARIKVHELRNKSKVDLLSQLKDLKAELALLRVAKVTGGAPNKLSKIKVVRLSIAQVLTVISQSQRSALREAYKKKKYLPLDLRPKKTRAIRRRLTKHQASLKTEREKKKEMYFPMRKYAVKV

SEQ ID NO: 20908 - protein, 123 aa, Amaranthus tuberculatus
MARIKVHELRQKTKVELLNQLKDLKAELALLRVAKVTGGAPNKLSKIKVVRLGIAQVLTVMSQKQKSALREAYKNKKYLPLDLRPKKTRAIRRRLTKHQASLKTEREKKREMYYPMRKYAIKV

SEQ ID NO: 20909 - protein, 123 aa, Amorphophallus konjac
MARIKVHELRAKSKVDLLSQLKDLKTELSLLRVAKVTGGAPNKLSKIKVVRLSIARVLTVISQKQKAALREAYSKKKYLPLDLRPKKTRAIRKRLTKHQASLKTEREKKREMYFPKRKYAIKA

SEQ ID NO: 20910 - protein, 123 aa, Aquilegia formosa
MARIKVHELRDKSKTDLLSQLNELKAELALLRVAKVTGGAPNKLSKIKVVRLSIARVLTVISQTQKAALRNAYKNKKLLPLDLRPKKTRAIRRRLTKHQASLKTEREKKKEMYFPMRKYAIKV

SEQ ID NO: 20911 - protein, 123 aa, Arabidopsis lyrata
MARIKVHELRGKSKSDLSTQLKDLKAELALLRVAKVTGGAPNKLSKIKVVRKSIAQVLTVISQKQKSALREAYKNKKLLPLDLRPKKTRAIRRRLTKHQASLKTEREKKKEMYFPIRKYAIKV

SEQ ID NO: 20912 - protein, 123 aa, Aristolochia fimbriata
MARIKVHELRTKSKTDLLNQLKELKAELALLRVAKVTGGAPNKLSKIKVVRLSIAQVLTVISQKQKAALREAYKNNKFLPLDLRPKKTRAIRKRLTKHQASLKTEREKKREMFFPMRKYAIKV

SEQ ID NO: 20913 - protein, 123 aa, Arnica chamissonis
MARIKVHELREKSKADLFTQLKDLKAELALLRVAKVTGGAPNKLSKIKVVRTGIAQVLTVISQTQKAKLREAYKNKKYLPLDLRPKKTRAIRRRLTKHQVSLKTEREKKKEKYFPLRKYAIKA

SEQ ID NO: 20914 - protein, 123 aa, Artemisia annua
MARIKVHELRGKSKADLFSQLKDLKAELALLRVAKVTGGAPNKLSKIKVVRTSIAQVLTVISQTQKATLREAYKNKKYMPLDLRPKKTRAIRRRLTKHQASLKTEREKKKEKYFPLRKYAIKA

SEQ ID NO: 20915 - protein, 123 aa, Brassica oleracea
  Sequence also found in Organisms: Brassica rapa
MARIKVHELREKSKTDLSTQLKDFKAELALLRVAKVTGGAPNKLSKIKVVRKSIAQVLTVISQKQKLALREAYKNKKFLPLDLRPKKTRAIRRRLTKHQASLKTEREKKKEMYFPIRKYAIKV

SEQ ID NO: 20916 - protein, 123 aa, Fagus grandifolia
MARIKVHELRQKTKAELLNQLKDLKAELALLRVAKVTGGAPNKLSKIKVVRLSIAQVLTVMSQKQKSALREAYKKKKYLPLDLRPKKTRAIRRKLTKHQLSLKTEREKKREMYFPMRKYAIKV

SEQ ID NO: 20917 - protein, 123 aa, Centaurea maculosa
  Sequence also found in Organisms: Helianthus annuus
MARIKVHELRGKSKADLFAQLKDLKAELALLRVAKVTGGAPNKLSKIKVVRTSIAQVLTVISQTQKSMLREAYKKKKYLPLDLRPKKTRAIRRRLTKHQASLKTEREKKKEKYFPLRKYAIKA

SEQ ID NO: 20918 - protein, 123 aa, Centaurea maculosa
MARIKVHELRTKSKVDLFAQLKDLKAELALLRVAKVTGGAPNKLSKIKVVRTSIAQVLTVISQTQKSALREAYKNKKYLPLDLRPKKTRAIRKRLTKHQASLKTEREKKKEKYFPLRKYAIKV

SEQ ID NO: 20919 - protein, 123 aa, Chrysanthemum coronarium
MARIKVHELREKSKTDLFSQLKELKAELALLRVAKVTGGAPNKLSKIKVVRTSIAQVLTVISQTQKAKLREAYKNKKYMPLDLRPKKTRAIRRRLTKHQVSLKTEREKKKEKYFPLRKYAIKA

SEQ ID NO: 20920 - protein, 123 aa, Chrysanthemum coronarium
MARIKVHELRVKSKADLFSQLKDLKAELALLRVAKVTGGAPNKLSKIKVVRTSIAQVLTVISQTQKATLREAYKNKKYMPLDLRPKKTRAIRRRLTKHQASLKTEREKKKEKYFPLRKYAIKA

SEQ ID NO: 20921 - protein, 123 aa, Chrysanthemum coronarium
MARIKVHELREKTKTDLFSQLKELKAELALLRVAKVTGGAPNKLSKIKVVRTSIAQVLTVISQTQKATLREAYKNKKYMPLDLRPKKTRAIRRRLTKHQASLKTEREKKKEKYFPLRKYAIKA

SEQ ID NO: 20922 - protein, 123 aa, Cichorium intybus
MARIKVHELRNKSKADLFTELKDLKAELALLRVAKVTGGAPNKLSKIKVVRTSIAQVLTVISQTQKSALREAYKNKKYLPLDLRPKKTRAIRRRLTKHQVSLKTEREKKKEKYFPLRKYAIKA

SEQ ID NO: 20923 - protein, 123 aa, Cirsium arvense
MARIKVHELRGKSKADLFAQLKDLKAELALLRVAKVTGGAPNKLSKIKVVRTSIAQVLTVISQTQKSMLREAYKKKKYLPLDLRPKKTRAIRRRLTKHQVSLKTEREKKKEKYFPLRKYAIKA

SEQ ID NO: 20924 - protein, 123 aa, Cleome gynandra
MARIKVHELRDKSKTDLLNQLKDLKNELALLRVAKVTGGAPNKLSKIKVVRKSIAQVLTVISQKQKSALREAYKNKKFLPLDLRPKKTRAIRRRLTKHQASLKTEREKKRDMYFPMRKYAIKM

SEQ ID NO: 20925 - protein, 123 aa, Cleome gynandra
MARIKVHELREKSKADLSSQLKELKAELALLRVAKVTGGAPNKLSKIKVVRKSIAQVLTVISQKQKSALREAYKNKKYLPLDLRPKKTRAIRRRLTKHQASLKTEREKKKEMYFPLRKYAIKV

SEQ ID NO: 20926 - protein, 123 aa, Gossypium hirsutum
MARIKVHELRNKSKTELLSQLKDLKAELALLRVAKVTGGAPNKLSKIKVVRLSIAQVLTVISQKQKSALREAYKKKKFLPLDLRPKKTRAIRRRLTKHQASLKTQREKKKEMYFPLRKYAIKV

SEQ ID NO: 20927 - protein, 123 aa, Cucurbita pepo
MARIKVHELRQKSKADLLTQLKDLKAELALLRVAKVTGGAPNKLSKIKVVRLSIAQVLTVISQKQKAALREAYKKKKLLPLDLRPKKTRAIRRRLTKHQASLLTERQKKKEMYYPLRKYAIKV

SEQ ID NO: 20928 - protein, 123 aa, Cyamopsis tetragonoloba
MARIKVYELRNKTKAELLNQLKDLKAELALLRVAKVTGGAPNKLSKIKVVRLSIAQVLTVISQKQKAALREAYKKKKYLPLDLRPKKTRAIRRRLTKHQASLKTEREKKKELYFPLRKYAVKV

SEQ ID NO: 20929 - protein, 123 aa, Distylium racemosum
MARIKVHELRAKSKGDLLAQLKELKAELALLRVAKVTGGAPNKLSKIKVVRRSIAQVLTVISQTQKAALREAYKKKKYMPLDLRPKKTRAIRRRLTKHQASLKTERQKKKEMYFPMRKYAIKV

SEQ ID NO: 20930 - protein, 123 aa, Echinochloa colona
MARIKVHELRGKNKADLQAQLKELKSELSLLRVAKVTGGAPNKLSKIKVVRTSIARVLTVISQKQKSALREAYKKKKLLPLDLRPKKTRAIRRRLTKHQLSLKTEREKKHEKYFPMRKYAIKA

SEQ ID NO: 20931 - protein, 123 aa, Echinochloa colona
MARIKVHELRGKNKADLQAQLKELKSELSLLRVAKVTGGAPNKLSKIKVVRTSIARVLTVISQKQKSALREAYKKKKLLPLDLRPKKTRAIRRRLTKHQLSLKTEREKKREKYFPMRKYAIKA

SEQ ID NO: 20932 - protein, 123 aa, Euonymus alatus
MARIKVHELRQKSKAELLNQLKDLKAELALLRVAKVTGGAPNKLSKIKVVRLSIAQVLTVISQTQKAALREAYKNKKFMPLDLRPKKTRAIRRRLTKHQASLKTERQKKKEMYFPVRKYAIKV

SEQ ID NO: 20933 - protein, 123 aa, Euonymus alatus
MARIKVHELRNKSKTELLNQLKDLKAELALLRVAKVTGGAPNKLSKIKVVRLSIAQVLTVISQTQKAALREAYKNKKYMPLDLRPKKTRAIRRRLTKHQASLKTERQKKREMYFPTRKYAIKV

SEQ ID NO: 20934 - protein, 123 aa, Euphorbia peplus
MARIKVHELRNKSKTELLSQLKDLKSELALLRVAKVTGGAPNKLSKIKVVRLSIAQVLTVISQKQKAALREAYKNKKFLPLDLRPKKTRAIRRRLTKHQASLKTEREKKREMYYPLRKYAIKV

SEQ ID NO: 20935 - protein, 122 aa, Festuca arundinacea
MARIKVHELRGKNKADLQGQLKDLKAELSLLRVAKVTGGAPNKLSKIKVVRTSIARVHTVISQKQKSALREAYKNKRLPLDLRPKKTRAIRRRLTKHQVSLKTEREKKREKYFPMRKYAIKA

SEQ ID NO: 20936 - protein, 123 aa, Flaveria ramosissima
MARIKVHELREKSKADLFTQLKDLKAELALLRVAKVTGGAPNKLSKIKVVRTSIAQVLTVISQTQKAKLRDAYKNKKYLPLDLRPKKTRAIRRRLTKHQASLKTEREKKKEKYFPLRKYAIKA

SEQ ID NO: 20937 - protein, 123 aa, Linum usitatissimum
MARIKVHELRNKSKTDLLNQLTELKSELSLLRVAKVTGGAPNKLSKIKVVRLSIAQVLTVISQKQKAALREAYKNKKLLPLDLRPKKTRAIRRRLTKHQASLKTEREKKREMYFPLRKFAIKV

SEQ ID NO: 20938 - protein, 121 aa, Fraxinus spp
MARIKVHELRQKNKAELLAQLKDLKAELALLRVAKATAGAANKLSKIKVVRLSIAQVLTVISQKQKAALREAYKNKKFLPLDLRPKKTRAIRRRLTKHQASLKTEREKKKEMYFPMRKYDN

SEQ ID NO: 20939 - protein, 123 aa, Vitis vinifera
MARIKVHELRGKPKADLLAQLKELKAELALLRVAKVTGGAPNKLSKIKVVRLSIAQVLTVISQKQKAALREAYKKKKFLPLDLRTKKTRAIRKRLTKHQASLKTEREKKKEMYYPMRKYAIKV

SEQ ID NO: 20940 - protein, 123 aa, Humulus lupulus
MARIKVHELRNKNKADLQSQLKDLKAELALLRVAKVTGGAPNKLSKIKVVRLSIAQVLTVISQKQKSALREAYKNKRFLPLDLRTKKTRAIRRRLTKHQVSLKTEREKKREIYFPMRKYAIKV

SEQ ID NO: 20941 - protein, 123 aa, Ipomoea batatas
MARIKVHELRNKSKAELLAQLAELKAELALLRVAKVTGGAPNKLSKIKVVRLSIAQVLTVISQTQKAALRNAYKNKKYLPLDLRPKKTRAIRRRLTKHQASLKTEREKKKEMYFPLRKYAIKV

SEQ ID NO: 20942 - protein, 122 aa, Lolium multiflorum
MARIKVHELRGKNKADLQGQLKDLKAELSLLRVAKVTGGAPNKLSKIKVVRTSIARVLTVISQKQKSALREAYKNKRLPLDLRAKKTRAIRRRLTKHQVSLKTEREKKREKYFPMRKYAIKA

SEQ ID NO: 20943 - protein, 122 aa, Lolium multiflorum
MARIKVHELRGKNKADLQGQLKDLKAELSLLRVAKVTGGAPNKLSKIKVVRTSIARVHTVISQKQKSALREAYKNKRLPLDLRPKKTRAIRRRLTKHQLSLKTEREKKREKYFPMRKYAIKA

SEQ ID NO: 20944 - protein, 123 aa, Nuphar advena
MARIKVHELRTKTKTELLNQLKDLKAELALLRVAKVTGGAPNKLSKIKVVRLSIAQVLTVISQKQKAALREAYKKKKYIPLDLRPKKTRSIRRRLTKHQASLKTEREKKREKYFPLRKYAIKV

SEQ ID NO: 20945 - protein, 123 aa, Quercus alba
MARIKVHELRNKTKAELLAQLKDLKAELALLRVAKVTGGAPNKLSKIKVVRLGIAQVLTVISQKQKSALREVYKNKKYIPLDLRPKKTRAIRRRLTKKQASLKTEREKKREMYFPLRKYAIKV

SEQ ID NO: 20946 - protein, 122 aa, Avena sativa
MARIKVHELRGKNKAELQGQLKDLKAELSLLRVAKVTGGAPNKLSKIKVVRTSIARVLTVISQKQKSALREAYKNKRLPLDLRPKKTRAIRRRLTKHQLSLKTEREKKREKYFPMRKYAIKA

SEQ ID NO: 20947 - protein, 123 aa, Avena sativa
MARIKVHELRGKNKAELQAQLKDLKAELSLLRVAKVTGGAPNKLSKIKVVRTSIARVLTVISQKQKSALREAYKNKNLLPLDLRPKKTRAIRRRLTKHQLSLKTERERKREKYFPMRKYAIKA

SEQ ID NO: 20948 - protein, 123 aa, Elaeis guineensis
MARIKVHELRGKSKADLLNQLKDLKAELALLRVAKVTGGAPNKLSKIKVVRLSIARVLTVISQKQKEVLREAYKKKKYQPLDLRPKKTRAIRRRLTKHQASLKTERQKKKEMYFPMRKYAIKA

SEQ ID NO: 20949 - protein, 123 aa, Olea europaea
MARIKVHELRQKSKAELLAQLKDLKAELALLRVAKATGGAANKLSKIKVVRLSIAQVLTVISQTQKAALRQAYKNKKYLPLDLRPKKTRAIRRRLTKHQASLKTERQKVKEMYFPMRKYAIKV

SEQ ID NO: 20950 - protein, 123 aa, Petroselinum crispum
MARIKVHELRTKSKADLLTQLQELKAELSLLRVAKVTGGAPNKLSKIKVVRLSIAQVLTVMQQKQKAALREVYKNKKLMPLDLRPKKTRAIRKRLTKHQASLKTEREKKKEKYFPMRKYAIKV

SEQ ID NO: 20951 - protein, 123 aa, Phalaenopsis aphrodite
MARIKVHELRQKSKTELLNQLNDLKAELALLRVAKVTGGAPNKLSKIKVVRLSIAQVLTVISQKQKAALREAYKKKKFLPLDLRPKKTRAIRRKLTKRQASLKTERQKKKELYFPLRKYAIKA

SEQ ID NO: 20952 - protein, 123 aa, Ananas comosus
MARIKVHELRGKTKAELLAQLKDLKAELSLLRVAKVTGGAPNKLSKIKVVRVSIARVLTVISQKQKAALREAYKKKKYQPLDLRPKKTHAIRHRLTKHQASLKTEREKKREKYFPMRKYAIKA

SEQ ID NO: 20953 - protein, 123 aa, Platanus occidentalis
MARIKVHELRTKPKTELLNQLKELKAELALLRVAKVTGGAPNKLSKIKVVRLSIARVLTVISQKQKAALREAYKKKKFLPLDLRPKKTRAIRRRLTKHQASLKTEREKKREMYFPMRKYAIKV

SEQ ID NO: 20954 - protein, 123 aa, Populus trichocarpa
MARIRVHELREKSKTELLAQLKELKAELALLRVAKVTGGAPNKLSKIKVVRLSIAQVLTVISQKQKSALREAYKNKKFLPLDLRPKKTRAIRRRLTKHQASLKTEREKKREIYFPIRKYAIKV

SEQ ID NO: 20955 - protein, 123 aa, Solanum tuberosum
MARIKVHELRQKSKADLLGQLKDLKTELALLRVAKVTGGAPNKLSKIKVVRLSVAQVLTVISQRQKSALREAYKNKKYLPLDLRPKKTRAIRRRLTKHQASLKTEREKKKEMYYPLRKYAIKV

SEQ ID NO: 20956 - protein, 123 aa, Sciadopitys verticillata
MARIKVHELRTKGKQDLLNQLKDLKAELALLRVAKVTGGAANKLSKIKVVRKSIAQVLTVISQSQKAALREAYKKKKYLPLDLRPKKTRAIRRRLTKNQVSLKTEREKKKEMYFPMRKYAIKV

SEQ ID NO: 20957 - protein, 123 aa, Sorghum bicolor
  Sequence also found in Organisms: Saccharum officinarum
MARIKVHELRGKSKTDLQAQLKELKSELSLLRVAKVTGGAPNKLSKIKVVRTSIARVLTVISQKQKSALREAYKKKKLLPLDLRPKKTRAIRRRLTKHQLSLKTEREKKREKYFPMRKYAIKA

SEQ ID NO: 20958 - protein, 123 aa, Tragopogon dubius
MARIKVHELRDKSKADLFAQLKDLKAELALLRVAKVTGGAPNKLAKIKVVRTSIAQVLTVISQTQKAKLREAYKNKKYLPLDLRPKKTRAIRRRLTKHQVSLKTEREKKKEKYFPLRKYAIKV

SEQ ID NO: 20959 - protein, 123 aa, Tragopogon dubius
MARIKVHELRNKSKADLFAELKDLKAELALLRVAKVTGGAPNKLAKIKVVRTSIAQVLTVISQTQKSALREAYKNKKYLPLDLRPKKTRAIRRRLTKHQVSLKTEREKKKEKYFPLRKYAIKA

SEQ ID NO: 20960 - protein, 123 aa, Valeriana officinalis
MARIKVHELRTQKKEDLLNQLKDLKTELSLLRVAKVTGGAPNKLSKIKVVRLSIAQVLTVIQQKQKAALREVYKNKKLMPLDLRPKKTRAIRKRLTKHQASLKTEREKKKEMYFPLRKYAIKV

SEQ ID NO: 20961 - protein, 123 aa, Citrullus lanatus
MARIKVHELRQKSKGDLLTQLKDLKAELALLRVAKVTGGAPNKLSKIKVVRLSIAQVLTVISQKQKSALREAYKKKKLLPLDLRPKKTRAIRRRLTKHQASLKTERQKKKEMYYPLRKYAIKV

SEQ ID NO: 20962 - protein, 123 aa, Zostera marina
MARIKVHELRGKTKVDLVNQLNDLKTELSLLRVAKVTGGAPNKLSKIKVVRKSIAQVLTVVSQKQKSALREAYKNKKYLPLDLRPKKTRAIRRRLTKHQLSLKTEREKKRERYFPMRKYAIKA

SEQ ID NO: 20963 - protein, 128 aa, Nicotiana benthamiana
FVLVVLARIKVHELRGKSKTDLLAQLKDLKAELALLRVAKVTGGAPNKLSKIKVVRLSIAQVLTVISQKQKTALREAYKNKKYLPLDLRPKKTRAIRKRLTKHQASLKTEREKKKEMYFPIRKYAIKV

SEQ ID NO: 20964 - protein, 123 aa, Cycas rumphii
MARIKVHELRTKSKSELLNQLKELKAELALLRVAKVTGGAPNKLSKIKVVRLSIAQVLTVISQNQKAALREAYKKKKYLPLDLRPKKTRAIRRRLTKHQASMKTERQKKKEMYFPMRKYAIKV

SEQ ID NO: 20965 - protein, 123 aa, Oryza sativa
MARIKVDELRGKNKAELQAQLKDLKAELSLLRVAKVTGGAPNKLSKIKVVRTSIARVLTVISQKQRAALREAYKKKSLLPLDLRPKKTRAIRRRLTKHQLSLKTEREKKREKYFPMRKYAIKA

SEQ ID NO: 20966 - protein, 123 aa, Amborella trichopoda
MARIKVHELRTKSKTELLNQLKELKAELALLRVAKVTGGAPNKLSKIKVVRLSIAQVLTVISQKQKAALREAYKKKKFLPLDLRPKKTRAIRRRLTKHQASLKTERESKKEKYFPKRKSAIKV

SEQ ID NO: 20967 - protein, 123 aa, Ambrosia trifida
MARIKVHELRNKSKADLFSQLKDLKAELALLRVAKVTGGAPNKLSKIKVVRTGIAQVLTVISQTQKAALRDAYKKKKYLPLDLRPKKTRAIRRRLTKHQASLKTEREKKKEKYFPLRKYAIKA

SEQ ID NO: 20968 - protein, 123 aa, Arabidopsis lyrata
MARIKVHELRDKSKTDLQNQLKEFKAELALLRVAKVTGGAPNKLSKIKVVRKSIAQVLTVISQKQKYALREAYKNKKFLPLDLRPKKTRAIRRRLTKHQASLKTEREKKKEMYFPVRKYAIKV

SEQ ID NO: 20969 - protein, 123 aa, Arabidopsis thaliana
MARIKVHELRDKSKTDLQNQLKEFKAELALLRVAKVTGGAPNKLSKIKVVRKSIAQVLTVISQKQKSALREAYKNKKLLPLDLRPKKTRAIRRRLTKHQASLKTEREKKKEMYFPVRKYAIKV

SEQ ID NO: 20970 - protein, 123 aa, Aristolochia fimbriata
MARIKVHELRTKSKTDLLGQLKELKAELALLRVAKVTGGAPNKLSKIKVVRLSIARVLTVISQKQKAALREAYSKKKFLPLDLRPKKTRAIRRRLTKHQASLKTEREKKREMYFPKRKYAIKV

SEQ ID NO: 20971 - protein, 123 aa, Musa acuminata
MARIKVHELRGKTKGELQNQLKDLKNELSLLRVAKVTGGAPNKLSKIKVVRLSIARVLTVISQTQKAKLREVYKKKKHIPLDLRPKKTRAIRRRLTKHQESLKTEREKKKEMYFPMRKYAIKA

SEQ ID NO: 20972 - protein, 123 aa, Theobroma cacao
MARIKVHELRNKSKTELLSQLTDLKAELALLRVAKVTGGAPNKLSKIKVVRLSIAQVLTVISQKQKSALREAYKKKKFLPLDLRPKKTRAIRRRLTKHQASLKTEREKKREMYFPLRKYAIKV

SEQ ID NO: 20973 - protein, 123 aa, Brassica napus
MARIKVHELREKSKTDLSTQLKDFKAELALLRVAKVTGGAPNKLSKIKVVRKSIAQVLTVISQKQKLALREAYKTKKFLPLDLRPKKTRAIRRRLTKHQASLKTEREKKKEMYFPIRKYAIKV

SEQ ID NO: 20974 - protein, 123 aa, Cedrus atlantica
MARIKVHELRTKSKTELLNQLKELKAELALLRVAKVTGGAPNKLSKIKVVRLSIAQVLTVISQNQRSALREAYKKKKYLPLDLRPKKTRAIRRRLTKHQASLKTEREKKKEMYFPMRKYAVKV

SEQ ID NO: 20975 - protein, 123 aa, Cedrus atlantica
MARFKVHELRVKSKAELLNQLKELKAELALLRVAKVTGGAPNKLSKIKVVRLSIAQVLTVISQNQKTALREAYKKKKYLPLDLRPKKTRAIRRRLTKHQASLKTEREKKKEMYFPMRKYAVKV

SEQ ID NO: 20976 - protein, 123 aa, Cenchrus ciliaris
MARIKVHELRGKNKAELQAQLKELKSELSLLRVAKVTGGAPNKLSKIKVVRTSIARVHTVISQKQKAALREAYKKKKLLPLDLRPKKTRAIRRRLTKHQLSLKTEREKKREKYFPMRKYAIKA

SEQ ID NO: 20977 - protein, 120 aa, Chrysanthemum coronarium
MARIKVHELRSKSKADLFAQLKDLKAELALLRVAGGAPNKLSKIKVVRTSIAQVLTVISQTQKSALREAYKNKKYLPLDLRPKKTRAIRRRLTKHQVSLKTEREKKKEKYFPLRKYAIKA

SEQ ID NO: 20978 - protein, 123 aa, Cleome spinosa
MARIKVHELRDKSKTDLLNQLKELKAELALLRVAKVTGGAPNKLSKIKVVRKSIAQVLTVISQKQKSALREAYKNKKFLPLDLRPKKTRAIRRRLTKHQASLKTEREKKRDMYFPLRKYAIKV

SEQ ID NO: 20979 - protein, 123 aa, Echinochloa colona
MARIKVHELRGKNKAELQAQLKELKSELSLLRVAKVTGGAPNKLSKIKVVRTSIARVLTVISQKQKSALREAYKKKKLLPLDLRPKKTRAIRRRLTKHQLSLKTEREKKREKYFPMRKYAIKA

SEQ ID NO: 20980 - protein, 123 aa, Euonymus alatus
MARIKVHELRNKSKTELLNQLKDLKAELALLRVAKVTGGAPNKLSKIKVVRLSIAQVLTVISQTQKAALREAYKNKKYMPLDLRPKKTRAIRRRLTKHQASLKTERQKKRQMYFPTRKYAIKV

SEQ ID NO: 20981 - protein, 123 aa, Festuca arundinacea
MARIKVYELRGKNKAELQGQLKDLKAELSLLRVAKVTGGAPNKLSKIKVVRTSIARVHTVISQKQKSALREAYKNKKYLPTDLRPKKTRAIRRRLTKHQLSLKTEREKKREKYFPMRKYAIKA

SEQ ID NO: 20982 - protein, 123 aa, Festuca arundinacea
MARVKVHEVREKNKAELQGQLKDLKAELSLLRVAKVTGGAPNKLSKIKVVRTSIARVHTVISQKQKSALREAYKNNKYLPLDLRAKKTRAIRRRLTKHQQSLKTEREKKREKYFPMRKYAIKA

SEQ ID NO: 20983 - protein, 123 aa, Setaria italica
MARIKVHELRGKNKAELQGQLKELKSELSLLRVAKVTGGAPNKLSKIKVVRTSIARVLTVISQKQKAALREAYKKKKLLPLDLRPKKTRAIRRRLTKHQLSLKTEREKKREKYFPMRKYAIKA

SEQ ID NO: 20984 - protein, 123 aa, Gerbera hybrid cultivar
MARIKVHELRSKSKVDLFAQLKDLKAELALLRFFKVTGGAPNKLSKIKVVRTSIAQVLTVISQTQKSALREAYKNKKYLPLDLRPKKTRAIRRRLTKHQASLKTEREKKKEKYFPLRKYAIKV

SEQ ID NO: 20985 - protein, 123 aa, Zingiber officinale
MARIKVHELRGKTKTELQNQLKDLKNELSLLRVAKVTGGAPNKLSKIKVVRLSIARVLTVISQKQKAALREAYKHKKLLPLDLRPKKTRAIRRRLTKHQESLKTEREKKRERYFPQRKYAIMA

SEQ ID NO: 20986 - protein, 123 aa, Panax ginseng
MARIKVHELRQKSKADLLAQLNELKSELSLLRVAKVTGGAANKLSKIKVVRQSIAQVSTVMSQKQKAVLREAYKNKKYLPLDLRPKKTRAIRRRLTKHQASLKTEREKKKEMYFPPRKYAIKV

SEQ ID NO: 20987 - protein, 123 aa, Carpinus betulus
MARIKVHELRNKSKAELLGQLKDLKAELALLRVAKVTGGAPNKLSKIKVVRLGIAQVLTVISQKQKEALREVYKKKKYIPLDLRPKKTRAIRRRLTKHQLSLKTEREKKKEMYYPLRKYAIKV

SEQ ID NO: 20988 - protein, 123 aa, Liriodendron tulipifera
MARIKVHELRTKSKTDLLSQLKELKAELALLRVAKVTGGAPNKLSKIKVVRLSIARVLTVISQKQKAALREAYSKKKFLPLDLRPKKTRAIRRRLTKHQQSLKTEREKKREMYFPKRKYAIKV

SEQ ID NO: 20989 - protein, 123 aa, Lotus japonicus
MARIKVYELRNKSKAELLNQLQELKAELALLRVAKVTGGAPNKLSKIKVVRLSIAQVLTVISQKQKAALREAYKNKKYLPLDLRPKKTRAIRRRLTKHQASLKTEREKKKELYFPLRKYAVKV

SEQ ID NO: 20990 - protein, 123 aa, Lupinus angustifolius
MARIKVYELRQKTKAELLNQLKDLKAELALLRVAKVTGGAPNKLSKIKVVRLNIAQVLTVISQKQKSALREAYKNKKYLPLDLRPKKTRAIRRRLTKHQQSLKTEREKKREIYFPLRKFAIKV

SEQ ID NO: 20991 - protein, 123 aa, Lupinus angustifolius
MARIKVYELRQKTKAELLNQLKDLKTELSLLRVAKVTGGAPNKLSKIKVVRLNIAQVLTVISQKQKSALREAYKNKKYLPLDLRPKKTRAIRRRLTKHQQSLKTEREKKREIYFPLRKFAIKV

SEQ ID NO: 20992 - protein, 123 aa, Zea mays
MARIKVHELRGKSKTDLQAQLKELKSELSLLRVAKVTGGAPNKLSKIKVVRTSIARVLTVISQKQKSALREAYKKKNLLPLDLRPKKTRAIRRRLTKHQLSLKTEREKKREKYFPMRKYAIKA

SEQ ID NO: 20993 - protein, 123 aa, Avena sativa
MARIKVHELRGKNKAELQGQLKDLKAELSLLRVAKVTGGAPNKLSKIKVVRTSIARVLTVISQKQKSALREAYKNKNLLPLDLRPKKTRAIRRRLTKHQLSLKTERERKREKYFPMRKYAIKA

SEQ ID NO: 20994 - protein, 122 aa, Avena sativa
MARIKVHELRGKNKAELQAQLKDLKAELSLLRVAKVTGGAPNKLSKIKVVRTSVARVLTVISQKQKAALREAYKNKRLPLDLRTKKTRAIRRRLTKHQLSLKTEREKKREKYFPIRKYAIKA

SEQ ID NO: 20995 - protein, 123 aa, Ananas comosus
MARIKVHELRGKTKAELLAQLKDLKAELSLLRVAKVTGGAPNKLSKIKVVRVSIARVLTVISQKQKAALREAYKKKKSQPLDLRPKKTHAIRLRLTKHQASLKTEREKKREKYFPMRKYAIKA

SEQ ID NO: 20996 - protein, 123 aa, Carthamus tinctorius
MARIKVHELRGKSKADLFAQLEDLKAELALLRVAKVTGGAPNKLSKIKVVRTSIAQVLTVISQTQKSMLREAYKKKKYLPLDLRPKKTRAIRRRLTKHQASLKTEREKKKEKYFPLRKYAIKA

SEQ ID NO: 20997 - protein, 123 aa, Silene vulgaris
MARIKVHELREKSKVDLQTQLKELKAELALLRVAKVTGGAPNKLSKIKIVRLGIAQVLTVISQKQKAALREAYKNKKYLPLDLRPKKTRAIRRRLTKHQASLKTEREKKKEMYYPLRKYAIKV

SEQ ID NO: 20998 - protein, 123 aa, Panicum virgatum
MARIKVHELRGKNKAELQAQLKEFKSELSLLRVAKVTGGAPNKLSKIKVVRTSIARVLTVISQKQKAALREAYKKKKLLPLDLRPKKTRAIRRRLTKHQLSLKTEREKKREKYFPMRKYAIKA

SEQ ID NO: 20999 - protein, 123 aa, Panicum virgatum
MARIKVHELRVKNKAELQAQLKEFKSELSLLRVAKVTGGAPNKLSKIKVVRTSIARVLTVISQKQKAALREAYKTKKRLPLDLRPKKTRAIRRRLTKHQLSLKTEREKKREKYFPMRKYAIKA

SEQ ID NO: 21000 - protein, 123 aa, Panicum virgatum
MARIKVPELRAKNKAELQAQLKEFKSELSLLRVAKVTGGAPNKLSKIKVVRTSIARVLTVISQKQKAALREAYKNKKLLPLDLRPKKTRAIRRRLTKHQLSLKTEREKKREKYFPMRKYAIKA

SEQ ID NO: 21001 - protein, 123 aa, Taxus baccata
MARIKVHELRTKGKTELLNQLKELKAELALLRVAKVTGGAPNKLSKIKVVRKSIAQVLTVISQTQKAALREAFKKKKYMPLDLRPKKTRAIRRRLTKHQASLKTEREKKKEKYFPMRKYAIKV

SEQ ID NO: 21002 - protein, 123 aa, Eutrema halophilum
  Sequence also found in Organisms: Eutrema parvulum
MARIKVHELREKSKTDLQNQLKDFKNELALLRVAKVTGGAPNKLSKIKVVRKSIAQVLTVISQKQKFALREAYKNKKLLPLDLRPKKTRAIRRRLTKHQASLKTEREKKKEMYFPVRKYAIKV

SEQ ID NO: 21003 - protein, 123 aa, Eutrema halophilum
  Sequence also found in Organisms: Eutrema parvulum
MARIKVHELRDKSKSDLQNQLKDLKAELALLRVAKVTGGAPNKLSKIKVVRKSIAQVLTVTSQKQKSALREAYKNKKFLPLDLRPKKTRAIRRRLTKHQLSLKTEREKKKEMYFPVRKYAIKV

SEQ ID NO: 21004 - protein, 123 aa, Eutrema halophilum
MARIKVHELREKSKADLSAQLKDFKAELALLRVAKVTGGAPNKLSKIKVVRKSIAQVLTVISQKQKSALREAYKTKKFLPLDLRPKKTRAIRRRLTKHQASLKTEREKKKEMYFPIRKYAIKV

SEQ ID NO: 21005 - protein, 123 aa, Triphysaria pusilla
MARIKVHELRQQNKSDLLAQLTDLKTELSSLRVAKVTGGAPNKLSKIKIVRLAIAQVLTVISQKQKSALREVYKNKKYLPLDLRPKKTRAIRRRLTKHQASLKTEKQKKKDMYFPLRKYAIKV

SEQ ID NO: 21006 - protein, 128 aa, Cannabis sativa
FFVFVKARIKVHELRTKNKADLQSQLKDLKAELALLRVAKVTGGAPNKLSKIKVVRLSIAQVLTVISQKQKAALREVYKNKKLLPLDLRTKKTRAIRRRLTKHQLSLKTEREKKREIYFPMRKYAIKV

SEQ ID NO: 21007 - protein, 122 aa, Cocos nucifera
ARIKVHELRGKSKAELLNQLKDLKAELALLRVAKVTGGAPNKLSKIKVVRLSIARVLTVISQKQKEVLREAYKKKKSQPLDLRPKKTRAIRRRLTKHQASLKTEREKKKEMYFPLRKYAIKA

SEQ ID NO: 21008 - protein, 122 aa, Ananas comosus
ARIKVHELRGKTKAELLTQLKDLKAELSLLRVAKVTGGAPNKLSKIKVVRVSIARVLTVISQKQKAALREAYKKKKYQPLDLRPKKTHAIRHKLTKHQESLKTEREKKREKYFPMRKYAIKA

SEQ ID NO: 21009 - protein, 121 aa, Medicago truncatula
MAKTYELRQKTKPDLLNQLKDLKAELALLRVAKVTGGAPNKISKIKVVRLNIAQVLTVISQNQKTALRAAYKHKKYLPLDLRPKKTRAIRRRLTKNQLSLKTDREKKKEIYFPLRKYAIKA

SEQ ID NO: 21010 - protein, 124 aa, Panicum virgatum
MAARIKVPELRAKNKAELQAQLKEFKSELSLLRVAKVTGGAPNKLSKIKVVRTSIARVLTVISQKQKAALREAYKNKKLLPLDLRPKKTRAIRRRLTKHQLSLKTEREKKREKYFPMRKYAIKA

SEQ ID NO: 21011 - protein, 123 aa, Ambrosia trifida
MARIKVHELREKTKADLFAQLTELKTELALLRVAKVTGGAPNKLSKIKVVRTGIAQVLTVISQTQKAKLREAYKNKKYLPLDLRPKKTRAIRRRLTKHQASLKTEREKKKEKYFPLRKYAIKA

SEQ ID NO: 21012 - protein, 123 aa, Arabidopsis lyrata
MARIKVHELREKSKADLSSQLKEFKAELALLRVAKVTGGAPNKLSKIKVVRKSIAQVLTVISQKQKSALREAYKNKKLLPLDLRPKKTRAIRRRLTKHQASLKTEREKKKEMYFPIRKYAIKV

SEQ ID NO: 21013 - protein, 123 aa, Arabidopsis thaliana
MARIKVHELREKSKADLSGQLKEFKAELALLRVAKVTGGAPNKLSKIKVVRKSIAQVLTVISQKQKSALREAYKNKKLLPLDLRPKKTRAIRRRLTKHQASLKTEREKKKEMYFPIRKYAIKV

SEQ ID NO: 21014 - protein, 123 aa, Arabidopsis thaliana
MARIKVHELREKSKSDLQNQLKELKAELALLRVAKVTGGAPNKLSKIKVVRKSIAQVLTVSSQKQKSALREAYKNKKLLPLDLRPKKTRAIRRRLTKHQASLKTEREKKKEMYFPIRKYAIKV

SEQ ID NO: 21015 - protein, 123 aa, Persea americana
MARIKVHELRTKSKTDLLNQLKELKAELALLRVAKVTGGAPNKLSKIKVVRLSIARVLTVISQKQKAALREAYSKKKLLPLDLRPKKTRAIRRRLTKHQASLKTQREKKREMYFPQRKYAIKV

SEQ ID NO: 21016 - protein, 123 aa, Brassica juncea
MARIKVHELREKSKSDLSTQLQDFKAELALLRVAKVTGGAPNKLSKIKVVRKSIAQVLTVISQKQKLALREAYKNKKFLPLDLRPKKTRAIRRRLTKHQASLKTEREKKKEMYFPIRKYAIKV

SEQ ID NO: 21017 - protein, 123 aa, Brassica juncea
  Sequence also found in Organisms: Brassica oleracea, Raphanus sativus
MARIKVHELRERSKTDLQSQLQEFKAELALLRVAKVTGGAPNKLSKIKVVRKSIAQVLTVISQKQKLALREAYKNKKFLPLDLRPKKTRAIRRRLTKHQSSLKTEREKKKEMYFPLRKYAIKV

SEQ ID NO: 21018 - protein, 123 aa, Musa acuminata
MARIKVHELRGKSRTELHNQLKDLKNELSLLRVAKVTGGAPNKLSKIKVVRLSIARVLTVNSQKQKAALREVYKKKKHIPLDLRPKKTRAIRRRLTKHQESLKTERQKKKEMYFPTRKYAIKA

SEQ ID NO: 21019 - protein, 118 aa, Daucus carota
MARIKVHELRTKSKADLLAQLQELKAELSLLRVAKVTGGAPNKLSKIKVVRLSIAQVLTVMQQKQKAALREVYKNKKLMPLDLRPKKTRAIRRRLTKHQASLKTEREKKKEKYFPMRK

SEQ ID NO: 21020 - protein, 123 aa, Cleome spinosa
MARIKVHELREKSKADLSSQLKDLKAELALLRVAKVTGGAPNKLSKIKVVRKSIAQVLTVISQKQKSALREAYQNKKFLPLDLRPKKTRAIRRRLTKHQASLKTEREKKKDMYFPLRKYAIKV

SEQ ID NO: 21021 - protein, 123 aa, Cleome spinosa
MARIKVHELRDKSKTDLLNQLKELKAELALLRVAKVTGGAPNKLSKIKVVRKSIAQVLTVISQKQKSALREAYKNKKFLPLDLRPKKTRAIRRRLTKHQASLRTEREKKRDMYFPLRKYAIKV

SEQ ID NO: 21022 - protein, 123 aa, Cleome spinosa
MARIKVHELREKSKADLSNQLKELKAELALLRVAKVTGGAPNKLSKIKVVRKSIAQVLTVISQKQKSALREAYKTKKLLPLDLRPKKTRAIRRRLTKHQASLKTEREKKKEMYFPLRKYAIKV

SEQ ID NO: 21023 - protein, 123 aa, Gossypium raimondii
MARIKVHELRNMSKTELLSQLKDLKAELALLRVAKVTDGAPNKLSKIKVVRLSIAQVLTVISQKQKSALREAYKKKKFLPLDLRPKKTRAIRRRLTKHQASLKTQREKKKEMYFPLRKYAIKV

SEQ ID NO: 21024 - protein, 123 aa, Zea mays
MARIKVHELRGKSKADLQAQLKEFKSELSLLRVAKVTGGAPNKLSKIKVVRTSIARVLTVISQKQKSALREAYKKKKLLPLDLRPKKTRAIRRRLTKHQLSLKTEREKKREKYFPMRKYAIKA

SEQ ID NO: 21025 - protein, 123 aa, Zea mays
MARIKVHELRGKSKTDLQAQLKELKSELSLLRVAKVTGGAPNKLSKIKIVRTSIARVLTVISQKQKSALREAYKKKKLLPLDLRPKKTRAIRRRLTKYQLSLKTEREKKREKYFPMRKYAIKA

SEQ ID NO: 21026 - protein, 123 aa, Pennisetum glaucum
MARIKVHELRGKNKAELQAQLKELKSELSLLRVAKVTGGAPNKLSKIKVVRTSIARVHTVISQKQKAALREAYKKKKLLPLDLRPKKTRAIRRRLTKHQLSLKTEREKKREKYFPLRKYAIKA

SEQ ID NO: 21027 - protein, 123 aa, Pinus taeda
MARIKVHELRLKSKADLLNQLKELKAELALLRVAKVTGGAPNKLSKIKVVRLSIAQVLTVISQNQKTALREAYKKKKYLPLDLRPKKTRAIRRRLTKHQASMKTERQKKKEMYFPMRKYAVKV

SEQ ID NO: 21028 - protein, 123 aa, Podocarpus macrophillus
MARIKVHELRTKSKADLTNQLKELKAELALLRVAKVTGGAPNKLSKIKVVRRSIAQVLTVISQNQKAALREAYKKKKYMPLDLRPKKTRAIRRRLTKHQTSLKTERQKKKEMYFPMRKYAIKV

SEQ ID NO: 21029 - protein, 123 aa, Podocarpus macrophillus
MARIKVHELRTKSKADLTNQLKELKAELSLLRVAKVTGGAPNKLSKIKVVRRSIAQVLTVISQNQKAALREAYKKKKYMPLDLRPKKTRAIRRRLTKNQASLKTERQKKKEMYFPMRKYAIKV

SEQ ID NO: 21030 - protein, 123 aa, Chenopodium quinoa
MARIKPHELRQKPKADLLNQLKDLKAELALLRVAKVTGGAPNKLSKIKVVRLGIAQVLTVMSQKQKSALREAYKKKKFLPLDLRPKKTRAIRRRLTKHQASLKTEREKKRERYYPMRKYAIKV

SEQ ID NO: 21031 - protein, 123 aa, Picea glauca
MARIKVHELRNKSKAELLNQLKDLKAELALLRVAKVTGGAPNKLSKIKVVRLSIAQVLTVISQNQRSALREAYKKKKYLPLDLRPKKTRAIRRRLTKHQASLKTERQKKKEMYFPMRKYAVKV

SEQ ID NO: 21032 - protein, 123 aa, Eutrema parvulum
MARIKVHELREKSKADLSTQLKDFKAELALLRVAKVTGGAPNKLSKIKVVRKSIAQVLTVISQKQKSALREAYKTKKFLPLDLRPKKTRAIRRRLTKHQASLKTEREKKKEMYFPIRKYAIKV

SEQ ID NO: 21033 - protein, 123 aa, Triphysaria pusilla
MARIKVHELRQQNKSDLMAQLTDLKTELSSLRVAKVTGGAPNKLSKIKIVRLAIAQVLTVISQKQKSALREVYKNKKYLPLDLRPKKTRAIRRRLTKHQASLKTEKQKKKDMYFPLRKYAIKV

SEQ ID NO: 21034 - protein, 123 aa, Zamia vazquezii
MARIKVHELRNKSKSELLNQLKELKAELALLRVAKVTGGAPNKLSKIKVVRLSIAQVLTVISQNQKAALREAYKKKKYMPLDLRPKKTRAIRRRLTKHQASLKTERQKKKEMNFPMRKYAIKI

SEQ ID NO: 21035 - protein, 122 aa, Brassica juncea
ARIKVHELRDKSKSDLQNQLQDLKAELALLRVAKVTGGAPNKLSKIKVVRKSIAQVLTVTSQKQKSALREAYKNKKFIPLDLRPKKTRAIRRRLTKHQLSLKTEREKKKEMYFPIRKYAIKV

SEQ ID NO: 21036 - protein, 128 aa, Jatropha curcas
TDAEPWQESRVHELRNKSKTELLSQLKDLKAELALLRVAKVTGGAPNKLSKIKVVRLSIAQVLTVISQKQKAALREAYKNKKFLPLDLRPKKTRAIRRRLTKHQASLKTEREKKREMYFPMRKYAIKV

SEQ ID NO: 21037 - protein, 126 aa, Cirsium arvense
INQWLEYKVHELRTQSKVDLFAQLKDLKAELALLRVAKVTGGAPNKLSKIKVVRTSIAQVLTVISQTQKSALREAYKNKKYLPLDLRPKKTRAIRRRLTKHQVSLKTEREKKKEKYFPLRKYAIKV

SEQ ID NO: 21038 - protein, 124 aa, Setaria italica
MAARIKVHELRGRNKAELQGQLKELKSELSLLRVAKVTGGAPNKLSKIKVVRTSIARVLTVISQKQKAALREAYKKKKLLPLDLRPKKTRAIRRRLTKHQLSLKTEREKKREKYFPMRKYAIKA

SEQ ID NO: 21039 - protein, 123 aa, Cycas rumphii
MARIKVHELRNKSKAELLNQLKELKSELALLRVAKVTGGAPNKLSKIKVVRLSIAQVLTVISQNQKAALREAYKKKKYIPLDLRPKKTRAIRRRLTKHQASMKTERQKKKEMYFPMRKYAIKV

SEQ ID NO: 21040 - protein, 123 aa, Amborella trichopoda
MARIKVHELRTKTKTELLNQLKELKAELALLRVAKVTGGAPNKLSKIKVVRLSIAQVLTVISQKQKAALRDAYQKKKFLPLDLRPKKTRAIRRRLTKHQASLKTEREIKREKYFPQRKYAIKV

SEQ ID NO: 21041 - protein, 123 aa, Ambrosia trifida
MARIKVHELREKTKADLFAQLTELKTELALLRVAKVTGGAPNKLSKIKVVRTGIAQVLTVISQTQKAKLREAYKNKKYLPLDLRPKKTRAIRKRLTKHQASLKTEREKKKEKYFPLRKYAIKA

SEQ ID NO: 21042 - protein, 123 aa, Amorphophallus konjac
MARIKVHELRAKSKAELLNQLKDLKTELSLLRVAKVTGGAPNKLSKIKVVRLSIARVLTVISQKQKAALREAYSKKKFLPLDLRPKKTRAIRKRLTKHQASLKTERQKKREMYFPKRKYAIKA

SEQ ID NO: 21043 - protein, 123 aa, Brassica napus
  Sequence also found in Organisms: Brassica juncea, Brassica oleracea, Brassica rapa, Raphanus sativus
MARIKVHELRDKSKSDLQNQLQDLKAELALLRVAKVTGGAPNKLSKIKVVRKSIAQVLTVTSQKQKSALREAYKNKKFIPLDLRPKKTRAIRRRLTKHQLSLKTEREKKKEMYFPIRKYAIKV

SEQ ID NO: 21044 - protein, 123 aa, Brassica juncea
MARIKVHELRERSKTDLQSQLQEFKAELALLRVAKVTGGAPNKLSKIKVVRKSIAQVLTVISQKQKLALREAYKNKKFLPLDLRPNKTRAIRRRLTKHQSSLKTEREKKKEMYFPLRKYAIKV

SEQ ID NO: 21045 - protein, 123 aa, Brassica napus
  Sequence also found in Organisms: Brassica rapa
MARIKVHELRERSKTDLQSQLQEFKAELALLRVAKVTGGAPNKLSKIKVVRKSIAQVLTVISQKQKLALREAYKSKKFLPLDLRPKKTRAIRRRLTKHQSSLKTEREKKKEMYFPLRKYAIKV

SEQ ID NO: 21046 - protein, 123 aa, Beta vulgaris
MARIKVHELRDKPRAELLNQLKDLKAELALLRVAKVTGGAPNKLSKIKVVRLGIAQVLTVMSQKQKSALREAYSKKKYLPLDLRPKKTRAIRRRLTKHQASLKTEREKKKERYYPMRKYAIKV

SEQ ID NO: 21047 - protein, 123 aa, Brassica napus
MARIKVHELRDKSKIDLQNQLQDLKAELALLRVAKVTGGAPNKLSKIKVVRKSIAQVLTVTSQKQKSALREAYKNKKFIPLDLRPKKTRAIRRRLTKHQLSLKTEREKKKEMYFPIRKYAIKV

SEQ ID NO: 21048 - protein, 123 aa, Brassica napus
MSRIKVHELRERSKTDLQSQLQEFKAELALLRVAKVTGGAPNKLSKIKVVRKSIAQVLTVISQKQKLALREAYKSKKFLPLDLRPKKTRAIRRRLTKHQSSLKTEREKKKEMYFPLRKYAIKV

SEQ ID NO: 21049 - protein, 123 aa, Brassica napus
MARIKVHELRERSKTDLQNQLQEFKAELALLRVAKVTGGAPNKLSKIKVVRKSIAQVLTVISQKQKLALREAYKSKKFLPLDLRPKKTRAIRRRLTKHQSSLKTEREKKKEMYFPLRKYAIKV

SEQ ID NO: 21050 - protein, 123 aa, Cephalotaxus harringtonia
MARIKVHELRTKGKSELLNQLKELKAELALLRVAKVTGGAPNKLSKIKVVRKSIAQVLTVISQTQKAALREAFKKKKYMPLDLRPKKTRAIRRRLTKHQASLKTEREKKREKYFPMRKYAIKV

SEQ ID NO: 21051 - protein, 123 aa, Gerbera hybrid cultivar
MARIKVHELRGKSKADLFAQLKDLKAELALLRVAQVTGGAPNKLSQIKVVRTSIAQVLTVISQTQKATLREAYQNKKYLPLDLRPKKTRAIRRRLTQHQASLKTEREKKKEKYFPLRKYAIKV

SEQ ID NO: 21052 - protein, 122 aa, Panax ginseng
MARIKVHELRQKSKADLLAQLNELKSELSLLRVAKVTGGAVNKLSKIKVVRQSIAQVSTVMSQKQKAVLREAYKDKKYLPLDLRPKKTRAIRRRLTKHQASLKTEREKKEMYFPPRKYAIKV

SEQ ID NO: 21053 - protein, 123 aa, Ipomoea batatas
MERIKVHELRQKSTAELLAQLKDLKAELALLRVAEVTGGAPNKLSKIKVVRLSIAQVLTVISQTQKAALRKAYEKKKYLPLDLRPKKTTAIRRRLTKHQASLKTERQKKKEMYFPVRKYAIKV

SEQ ID NO: 21054 - protein, 123 aa, Pennisetum glaucum
MARIKVHELRGKNKAELQGQLKELKSELSLLRVAKVTGGAPNKLSKIKVVRTSIARVHTVISQKQKAALREAYKKKKLLPLDLRPKKTRAIRRRLTKHQLSLKTEREKKRDKYFPMRKYAIKA

SEQ ID NO: 21055 - protein, 123 aa, Arachis hypogaea
MARLKVYELRNKTKAELLSQLKDLKAELALLRVAKVTGGAPNKLSKIKLVRLSIAQVLTVISQKQKSVLREAYKKKKYLPLDLRPKKTRAIRRRLTKHQASLKTEREKKKEVYFPLRKYAVKV

SEQ ID NO: 21056 - protein, 123 aa, Phalaenopsis aphrodite
MARIKVHELRQKSKTELLNQLNDLKTELALLRVAKVTGGAPNKLSKIKVVRLSIAQVLTVISQKQKAALREAYRKKKFIPLDLRPKKTRAIRRKLTKRQASLKTERQKKKEMYFPLRKYAIKA

SEQ ID NO: 21057 - protein, 123 aa, Pinus taeda
MARIKVHELRNKSKSELLSQLKELKAELALLRVAKVTGGAPNKLSKIKVVRLSIAQVLTVISQSQRSALREAYKKKKYLPLDLRPKKTRAIRRRLTKHQASLKTERQKKKEMYFPMRKYAVKV

SEQ ID NO: 21058 - protein, 123 aa, Pinus taeda
MARIKVHELRNKSKSELLSQLKELKAELALLRVAKVTGGAPNKLSKIKVVRLSIAQVLTVISQSQRSALREAYKKKKYLPLDLRPKKTRAIRRRLTKHQGSLKTERQKKKEMYFPMRKYAVKV

SEQ ID NO: 21059 - protein, 123 aa, Pseudotsuga menziesii
MARIKVHELRNKSKAELLNQLKELKAELALLRVAKVTGGAANKLSKIKVVRLSIAQVLTVISQNQKTALREAYKKKKYLPLDLRPKKTRAIRRRLTKHQASLKTERQKKKEMYFPMRKYAVKV

SEQ ID NO: 21060 - protein, 123 aa, Pseudotsuga menziesii
MARIKVHELRIKTKAELLNQLKELKAELALLRVAKVTGGAPNKLSKIKVVRLSIAQVLTVISQNQRSALREAYKKKKYLPLDLRPKKTRAIRRRLTKHQASLKTERQKKKEMYFPMRKYAVKV

SEQ ID NO: 21061 - protein, 123 aa, Chenopodium quinoa
MARIKPHELRQKPTADLLNQLKDLKAELALLRVAKVTGGAPNKLSKIKVVRLGIAQVLTVTSQKQKSALREAYKKKKFLPLDLRPKKTRAIRRRLTKHQASLKTEREKKRERYYPMRKYAIKV

SEQ ID NO: 21062 - protein, 123 aa, Raphanus sativus
MARIKVHELREKSKSDLSTQLQDFKAELALLRVAKVTGGAPNKLSKIKVVRKSIAQVLTVISQKQKSALREAYKNKKFLPLDLRPKKTRAIRRRLTKHQASLKTEREKKKEMYFPIRKYAVKV

SEQ ID NO: 21063 - protein, 123 aa, Rhizophora mangle
MARLKVHELRSKSKTELLNQLKELKSELALLRVAKVTGGAPNKLSKIKVVRLSIARVLTVISQKQKAALREAYKKKKFLPLDLRPKKTRAIRRRLTKHQVSLKTQREKKREMYFPIRKYAIKV

SEQ ID NO: 21064 - protein, 123 aa, Sequoia sempervirens
MARIKVHELRTKSKSDLLNQLKELKAELALLRVAKVTGGAPNKLSKIKVVRKSIAQVLTVISQTQKTALREAYKKKKYMPLDLRPKKTRAIRRRLTKRQASLKTEREKKKDMYFPMRKYAIKV

SEQ ID NO: 21065 - protein, 120 aa, Tamarix hispida
MARIKVHELRQNSNADLLTQLKDLKAELALLRVAKVTGGAPNKLSKIKVVRLSIAQVLTVISQKPKAALREAYKNKKYLPLDLRPKKTRAIRRRLTQHQASLKTEKQKKKEMYYPMRKYA

SEQ ID NO: 21066 - protein, 123 aa, Zostera marina
MARIKVHELRGKTKLDLLNQLNELKTELSLLRVAKVTGGAPNKLSKIKIVRKSIAQVLTVVSQKQKAALKEAYKNKKYLPLDLRTKKTRAIRRRLTKHQLSLKTEREKKREKYFPMRKYAIKT

SEQ ID NO: 21067 - protein, 128 aa, Nicotiana benthamiana
FVLVVLARIKVHELKGKSKTDLLAQLNDLKAELALLRVAKVTGGAPNKLSKIKVVRLSIAQVLTVISQKQKTALREAYKNKKYLPLDLRPRKTRAIRKRLTKHQASLKTEREKKKEMYFPIRKYAIKV

SEQ ID NO: 21068 - protein, 121 aa, Papaver somniferum
RIKVHELRAKSKAGYWNQLKDLKAELALLRVAKVTGGAPNKLSKIKVARLSIAQVLTVISQKQKLALRDAYKNKKFLPLDLRPKKTRAIRRRLTKNQVSLKTEREKKKKMYFPVRKYAIKV

SEQ ID NO: 21069 - protein, 124 aa, Beta vulgaris
MASRIKPHELRQKSKAELFNQLKDLKAELALLRVAKVTGGAPNKLSKIKVVRLGIAQVLTVISQTQKEKLREVYKKKKYLPLDLRPKKTRAIRRRLTKHQASLKTLREKKKEMYYPMRKYAIKV

SEQ ID NO: 21070 - protein, 124 aa, Curcuma longa
MASIKVHELRGKSKTELQNQLKDLKNELSLLRVAKVTGGAPNKLSKIKVVRLSIARVLTVISQKQKAALREAYKKKKLLPLDLRPKKTRAIRRRLTKHQESLKTEREKKRAMYFPKRKYALLAN

SEQ ID NO: 21071 - protein, 124 aa, Elaeis guineensis
MARIKVHELRGKSKADLLNQLKDLKAELALLRVAKVTGGAPNKLSKIKVVRLSIARVLTVISQKQKEVLREAYKKKKYQPLDLRPKKTRAIRRRLTKHQASLKTEREKKKGDVTSQMRKYAIKA

SEQ ID NO: 21072 - protein, 123 aa, Spinacia oleracea
MARIKPHELRQKPKADLLTQLKDLKAELALLRVAKVTGGAPNKLSKIKVVRLGIAQVLTVMSQKQKSALREAYSKKKFLPLDLRPKKTRAIRRRLTKHQASLKTEREKKRDMYYPMRKYAIKV

SEQ ID NO: 21073 - protein, 123 aa, Arabidopsis thaliana [sequence omitted]

SEQ ID NO: 21074 - protein, 122 aa, Brassica juncea
MARIKVHELRERSKTDLQSQLQEFKAELALLRVAKVTGGAPNKLSKIKVVRKSIAQVLTVISQKQKLALREAYKSKKFLPLDLRPNKTRAIRRRLTKHQSSLKTEREKKKEMYFPLRKYAIK

SEQ ID NO: 21075 - protein, 123 aa, Brassica oleracea
  Sequence also found in Organisms: Raphanus sativus
MARIKVHELRERSKTDLQNQLQEFKAELALLRVAKVTGGAPNKLSKIKVVRKSIAQVLTVISQKQKLALREAYKSKKFLPLDLRPKKTRAIRRRLTKHQASLKTEREKKKEMYFPLRKYAIKV

SEQ ID NO: 21076 - protein, 123 aa, Brassica napus
MARIKVHELRDKSKIDLQNQLQELKAELALLRVAKVTGGAPNKLSKIKVVRKSIAQVLTVTSQKQKSALREAYKNKKFIPLDLRPKKTRAIRRRLTKHQLSLKTEREKKKEMYFPIRKYAIKV

SEQ ID NO: 21077 - protein, 123 aa, Cryptomeria japonica
MARIKVHELRTKSKVDLQSQLKELKAELALLRVAKVTGGAPNKLSKIKVVRKSIAQVLTVISQTQKSALREAYKKRKYMPLDLRPKKTRAIRRRLTKHQASLKTEREKKKDKYFPMRKYAIKV

SEQ ID NO: 21078 - protein, 123 aa, Cryptomeria japonica
MARIKVHELRTKSKLDLQNQLKELKAELALLRVAKVTGGAPNKLSKIKVVRKSIAQVLTVISQTQKSALREAFKKKKYMPLDLRPKKTRAIRRRLTKHQASLKTEREKKKDKYFPMRKYAIKV

SEQ ID NO: 21079 - protein, 123 aa, Curcuma longa
MARIKVHELRGKTKTELQNQLKELKNELSLLRVAKVTGGAPNKLSKIKVVRLSIARVLTVISQKQKSALREAYKKKKLLPLDLRPKKTRAIRRRLTKHQESLKTEREKKKARYFPLRKYAILT

SEQ ID NO: 21080 - protein, 123 aa, Linum usitatissimum
MARIKVHELRTKSKTDLLNQVTELKSEVSLLRVAKVTGGAPNKLSKIKVVRRSIAQVLTVISQKQKEALREAYKNKKLLPLDLRPKKTRAIRRRLTKHQASLKTEREKKREMYFPLRKFAIKV

SEQ ID NO: 21081 - protein, 122 aa, Panax ginseng
MARIKVPELRAKSKQDIVNQLKDLKAELALLRVAKVTGGAPNKLSKIKVVRLSIAQVLTVMRQKQKAALREAYKNKKHVPLDLRPKKTRAIRRRLTKHQASLKTEREKKEKYFPLRKYAIKV

SEQ ID NO: 21082 - protein, 123 aa, Gnetum gnemon
MARIKVHELRPKSKTDLLNQLKELKAELALLRVAKVTGGAPNKLSKIKVVRKSIAQVLTVISQTQKSALREAYKKKKYLPLDLRPKKTRAIRRRLSKHQLSLKTEKQKKKEMNFPMRKYAVKV

SEQ ID NO: 21083 - protein, 115 aa, Arachis hypogaea
MARIKVYELRQKNKTELLNQLKDLKAELALLRVAKVTGGAPNKLSKIKVVRLSIAQVLTVISQKQKAILREVYKKKKYTPLDLRPKKTRAIRRRLTKHQASLKTEREKKKETYSQ

SEQ ID NO: 21084 - protein, 123 aa, Raphanus sativus
MARIKVHELRDKSKSDLQNQLQDLKAELALLRVAKVTGGAPNKLSKIKVVRKSIAQVLTVTSQKQKSALREAYKNKKFMPLDLRPKKTRAIRRRLTKHQLSLKTERAKKKEMYFPIRKYAIKV

SEQ ID NO: 21085 - protein, 123 aa, Sequoia sempervirens
MARIKVHELRTKSKSDLLSRLKELKAELALLRVAKVTGGAPNKLSKIKVVRKSIAQVLTVISQTQKTALREAFKKKKYMPLDLRPKKTRAIRRRLTKHQASLKTEREKKKDMYFPMRKYAIKV

SEQ ID NO: 21086 - protein, 123 aa, Picea glauca
MARIKVHELRIKSKAELLNQLTELKAELALLRVAKVTGGAPNKLSKIKVVRLSIAQVLTVISQNQKTALREAYKKKKYLPLDLRPKKTRAIRRRLTKHQASMKTERQKKKEMYFPMRKYAVKV

SEQ ID NO: 21087 - protein, 123 aa, Utricularia gibba
RIKVHELRQKNKAELLAQLKDLKAELSLLRVAKVTGGAPNKLAKIKVVRLSIAQVLTVISQKQKGALREAYKNKKYLPLDLRPKKTRAIRRRLTKHQASLKTEENKKKKGNVTFPLKKVCHRG

SEQ ID NO: 21088 - protein, 108 aa, Eschscholzia californica
DLLNQLKELKAELALLRVAKVTGGAPNKLSKIKVVRLSIAQVLTVISQKQKAALREAYKNKKFLPLDLRPKKTRAIRRRLTKHQLSLKTEREKKKELHFPMRKYAIKV

SEQ ID NO: 21089 - protein, 112 aa, Heritiera littoralis
KSKTELLAQLKDLKAELALLRVAKVTGGAPNKLFKIKVVRLSIAQVLTVISQKQKAALRDAYKKKKFLPLDLRPKKTRAIRRRLTKHQASLKTDREKKREMYFPMRKYAIKV

SEQ ID NO: 21090 - protein, 114 aa, Avena sativa
LRGKNKAELQGQLKDLKAELSLLRVAKVTGGAPNKLSKIKVVRTSVARVLTVISQKQKAALREAYKNKRLPLDLRTKKTRAIRRRLTKHQLSLKTEREKKREKYFPIRKYAIKA

SEQ ID NO: 21091 - protein, 117 aa, Selaginella moellendorffii
HELRTKSKQDLLVQLKELKSELALLRVAKVTGGAPNKLSKIKVVRLSIARVLTVISQTQKAKLREAYKNKKYMPLDLRPKKTRAIRRRLTKHQLSLKTEKQKKKEAYFPMRKYAVRA

SEQ ID NO: 21092 - protein, 124 aa, Arachis hypogaea
MARLKVYELRNKTKAELLSQLKDLKAELALLRVAKVTGGAPNKLSKIKLVRLSIAQVLTVISQKQKSVLREAYKKKKKYLPLDLRPKKTRAIRRRLTKHRASLKTEREKKKEVYFPLRKYAVKV

SEQ ID NO: 21093 - protein, 124 aa, Selaginella moellendorffii
MAGKIKVHELRTKSKQDLLVQLKELKSELALLRVAKVTGGAPNKLSKIKVVRLSIARVLTVISQTQKAKLREAYKNKKYMPLDLRPKKTRAIRRRLTKHQLSLKTEKQKKKEAYFPMRKYAVRA

SEQ ID NO: 21094 - protein, 123 aa, Aquilegia formosa
VARIKVHELRDQSKPDLLKQLKELKDELALLRVAKVTGGAPNKLSKIKVVRTGIAQVLTVISQKQKQALRDVYKKKKLLPLDLRPKKTRAIRRRLTNHQLSLKTDREKKKEMYFPMRKYAIKV

SEQ ID NO: 21095 - protein, 123 aa, Brassica rapa
MARIKVHELRERSKTDLQNQLQEFKAELALLRVAKVTGGAPSKLSKIKVVRKSIAQVLTVISQKQKLALREAYKSKKLLPLDLRPKKTRAIRRRLTKHQVSLKTEREKKKEMYFPLRKYAIKV

SEQ ID NO: 21096 - protein, 123 aa, Musa acuminata
MARIKVHELRGKTKAELQNQLKDLKNELSLLRVAKVTGGAPNKLSKIKVVRLSIARVLTVTSQKQKAALRDAYKKKKLIPLDLRPKKTRAIRRRLTKRQGSLKTERQKKKEMYFPTRKYAIKA

SEQ ID NO: 21097 - protein, 123 aa, Brassica napus
MARIKVHELRERSKTDLQNQLQEFKAELALLRVAKVTGGAPNKLSKIKVVRKSIAQVLTVISQKQKLALREAYKSKKFLPLDLRPKKTRAIRRRLTKHQASLKTEREKKKDMYFPLRKYAIKV

SEQ ID NO: 21098 - protein, 123 aa, Marchantia polymorpha
MAKIKVHELRTKSKADLLNQLKELKAELALLRVAKVTGGAPNKLSKIKVVRLSIAQVLTVISQTQKAHLREVYSKKRFLPLDLRPKKTRAIRKRLTKHQMSLKTEKQKKKEAYFPLRKYAVKA

SEQ ID NO: 21099 - protein, 121 aa, Lippia dulcis
MARIKVHELRQKNKAELLAQLKDLKAELALLRVAKVTGGAPNKLSKIKVVRLSIAQVLTVISQKQKAALREVYKNKKYLPLDLRPKKTRAIRRRLTKHQASMKTEKETKERDVLPNEKVCY

SEQ ID NO: 21100 - protein, 123 aa, Pteridium aquilinum
MAKIKVHELRTKSKSDLQAQLKDLKAELALLRVAKVTGGAPNKLSKIKVVRLSIAQVLTVLSQNQKDALRAAYKKSKLLPLDLRPKKTRAIRRRLTKHQASVKTEKQKKKETYFPKRKYALKA

SEQ ID NO: 21101 - protein, 123 aa, Raphanus sativus
MARIKVHELRDKSKSDLQNQLQDLKAELALLRVAKVTGGAPNKLSKIKVVRKSIAQVLTVTSQKQKSALREAYQHKKFIPLDLRPKKTRAIRRRLTKHQLSLKTEREKKKEMYFPIRKYAIKV

SEQ ID NO: 21102 - protein, 123 aa, Picea glauca
MARIKVHELRIKSKAELLNQLTELKAELALLRVAKVTGGAPNKLSKIKVVRLSVAQVLTVISQNQRSALREAYKKKKYLPLDLRPKKTRAIRRRLTKHQASLKTERQKKKEMYFPMRKYAVKV

SEQ ID NO: 21103 - protein, 123 aa, Picea glauca
MARIKVHELRIKSKAELLNQLTELKAELALLRVAKVTGGAPNKLSKIKVVRLSIAQVLTVISQNQKTALREAYKKKKYLPLDLRPKKTRAIRRRLTKHQASMKTERQKKKEMYFPVRKYAVKV

SEQ ID NO: 21104 - protein, 123 aa, Picea glauca
MARIKVHELRIKSKAELLNQLTELKAELALLRVAKVTGGAPNKLSKIKVVRLSVAQVLTVISQNQKTALREAYKKKKYLPLDLRPKKTRAIRRRLTKHQASMKTERQKKKEMYFPMRKYAVKV

SEQ ID NO: 21105 - protein, 128 aa, Zingiber officinale
MARIKVHELRGKTKTELQNQLKDLKNELSLLRVAKVTGGAPNKLSKIKVVRLSIARVLTVISQKQKAALREAYKKKKLLPLDLRPKKTRAIRRRLTKHQESLKTEREKKRERYFPLRKYAIMARDRVL

SEQ ID NO: 21106 - protein, 132 aa, Tropaeolum majus
MARIKVHELRNKSKADLLSQLKDLKAELALLRVAKVTGGAPNKLSKIKVVRLSIAQVLTVISQTEKAALREVYKNKKFLPLDLRPKKTRAIRRRLTKHQASLKTEREKKKEMYFPLRKYAIKRSFMCLETEY

SEQ ID NO: 21107 - protein, 129 aa, Cenchrus ciliaris
FRLCPWSARIKVHELRGKNKAELQGQLKELKSELSLLRVAKVTGGAPNKLSKIKVVRTSIARVLTVISQKQKAALREAYKKKKLLPLDLRPKKTRAIRRRLTKHQLSLKTEREKKREKYFPMRKYAIKA

SEQ ID NO: 21108 - protein, 124 aa, Allium cepa
MARIKVHELRTKSKTDLLTQLNELKSELALLRVAKVTGGAPNKLSKIKVVRKGIAQVLTVISQKQKQALREVYKKKKLLPLDLRPKKTKAIRMKLTKHQESLKTERQKKREMYFPMRKYAIKAQ

SEQ ID NO: 21109 - protein, 134 aa, Vinca minor
MARIKVHELRNKTKQELLAQLKDLKAELALLRVAKVTGGAPNKLSKIKVVRLSIAQVLTVISQKQKSALREAYKNKKYLPLDLRPKKTRAIRRRLTKHQASLKTEREKKKEMYYPMRKYAIKVLGQEICVIRSF

SEQ ID NO: 21110 - protein, 114 aa, Ocimum basilicum
AARIKVHELRQKNRSDLLAQLKELKTELALLRVAKVTGGAPNKLSKIKVVRLSIAQVLTVISQKQKSALREVYKNRKYLPLDLRPKKTRAIRRRLTKHQASLKTEKQKKKEMYF

SEQ ID NO: 21111 - protein, 107 aa, Cyclamen graecum
MARIKVHELRQKSKADLLAQLKDLKAELALLRVAKVTGGAPNKLSKIKVVRLSIAQVLTVISQKQKAALREVYKNKKYLPLDLRPKKTRAIRRRLTKHQASLKTERE

SEQ ID NO: 21112 - protein, 123 aa, Gnetum gnemon
MARIKVHELRPKSKQELLNQLKDLKGELALLRVAKVTGGAQNKLSKIKVVRKSIAQVLTVISQNQKAALRKAYKKKKYLPLDLRPKKTRAIRRRLSKYQLSLKTERQKKKEMNFPMRKYAIKV

SEQ ID NO: 21113 - protein, 123 aa, Mesostigma viride
MAKIKVHELRNKRKEELLAQLKELKTELAALRVAKVTGGAPNKLSKIKVVRLSIAQVLTVISQTQKASLREVYKGKKFVPLDLRPKKTRAIRRRLTKYQANLKTEKEKKKLAYFPMRKYAVKA

SEQ ID NO: 21114 - protein, 123 aa, Physcomitrella patens
MAKIKVHELRAKSKNELLSQLKELKAELAALRVAKVTGGAPNKLSKIKVVRLSIAQVLTVISQTQKASLREAYSKKKYLPIDLRPKKTRAIRRRLTKHQSSMKTEKQKKKEAYFPMRKFAVKA

SEQ ID NO: 21115 - protein, 103 aa, Vinca minor
LKDLKAELALLRVAKVTGGAPNKLSKKKVVRLSIAQVLTVISQKQKSALREVYKNKKYLPLDLRPKKTRAIRRRLTKHQASLKTEREKKKEMYFPMRKYAIKV

SEQ ID NO: 21116 - protein, 298 aa, Trifolium pratense
MALRLIDNALPTITQERPKKQPKIAVSTQKQQQPRTSSNDENQVPLEPTIDYISSDNLKPMSDPEAQIQSLIEDLDSKNWVKVCESLNDVRRFALYNSSLLLPILDKILLVVVKSMKNPRSALCKTSIMAASDIFNAFGDKLFDPSTSEAFGGLLLQLLLKASQDKKFVCEEAEKALGSMVGSMTPLPLLQKLRVSVSHTNLRIRAKAAVSLSKCVSKMGIDEMEEFGMGKLIEVAADLVNDRLPEAREAARSIATSGYEAIIKDVEEVEQKMEVWQSFCHSKLTPINALSILKIVRP

SEQ ID NO: 21117 - protein, 297 aa, Trifolium pratense
MALRPIDNALPTITQERPKKQPKIVVSTQKQQPRTSSNDENQVPSEPTIDYISSDNLKPMSDPEAQIQNLIGDLDSKNWVKVCESLNDVRRFALYDSSLLLPILDKILLVVVKSMKNPRSALCKTSIMAASDIFNAFGDKLFDPSTSEAFGGLLLQLLLKASQDKKFVCEEAEKALGSMVGSMTPLPLLQKLRVSVSHTNLRIRAKAAVSLSKCVSKMGIDEMEEFGMGKLIEVAADLVNDRLPEAREAARSIATSVYEAIIKDVEEMEQKMEVWQSFCHSKLTPINALSILKIVKP

SEQ ID NO: 21118 - protein, 297 aa, Trifolium pratense
MALRPIDNALPTITQERPKKQPKIVVSTQKQQPRTSSNDENQVPSEPTIDYISSDNLKPMSDPEAQIQNLIGDLDSKNWVKVCESLNDVRRFALYDSSLLLPILDKILLVVVKSMKNPRSALCKTSIMAASDIFNAFGDKLFDPSTSEAFDGLLLQLLLKASQDKKFVCEEAEKALGSMVGSMTPLPLLQKLRVSVSHTNLRIRAKAVVSLSKCVSKMGIEEMEEFGMEKLIEVAADLVNDRLPEAREAARSIATSVYEAIIKDAEEVEEKMEVWQSFCHSKLTPNNALSIMKILKP

SEQ ID NO: 21119 - protein, 298 aa, Trifolium pratense
MALRPIDNALPTITQERPKKQPKIVVSTQKQQPRTSSNDENQVPSEPTIDYISSDNLKPMSDPEAQIQNLIGDLDSKNWVKVCESLNDVRRFALYDSSLLLPILDKILLVVVKSMKNPRSALCKTSIMAASDIFNAFGDKLFDPSTFEAFDGLLLQLLLKASQDKKFVCEEAEKALGSMVGSMTPLPLLLKLRVSVSHTNLRIRAKAAVSLSKCVSKMQGIEGMEEFGTEKLIEVAADLVNDRLPEAREAARSIATSVYEAIIKNVEEVEEKMEVWQSFCHSKLTPINALSILKIVKP

SEQ ID NO: 21120 - protein, 289 aa, Trifolium pratense
MALRPIDNALPTITQERPKKQPKIVVSTQKQQPRTSSNDENQVPSEPTIDYISSDNLKPMSDPEAQIQNLIGDLDSKNWVKVCESLNDVRRFALYDSSLLLPILDKILLVVVKSMKNPRSALCKTSIMAASDIFNAFGDKLFDPSTFEAFDGLLLQLLLKASQDKKFVCEEAEKALGSMVGSMTPLPLLLKLRVSVSHTNLRIRAKAAVSLSKCVSKMGIEGMEEFGMEKLIEVAADLVNDRLPEAREAARSIATSVYETIIKNVGEVEEKMEVWQSFCHSKLTPNNAL

SEQ ID NO: 21121 - protein, 300 aa, Cicer arietinum
MALRPIDNALPATTQDRPKKQPKIAVAATVKQQQQKPIASNDENQVPLEPSIDYISSDNLKPMSDPEAQIQSLIEDLDSKNWIKVCESLNDVRRFALYHSSLLLPILDKIVLVVAKTMKNPRSALCKTSIMAASDIFNAFGDKLFDPSISDAFDSLMLQLLLKASQDKRFVCEEAVKALGSMVGTMTPLPLLQKLRVYVSHTNLRVRAKAAVSLSKCVSKMQGIEEMEEFGMEKLIEVAADLLNDRLPEARDAARSIATSVYEALIKDVEVEQKMEVWQSFCHSKLTPIHALSILKIVKP

SEQ ID NO: 21122 - protein, 394 aa, Trigonella foenum-graecum
MSDDEREEKELDLTSPDVVTKYKTAAEIVNKALKLVISECKPKAKIVDICEKGDSFIREQTSNVYKNVKKKIERGVAFPTCISINNTICHFSPLASDETVLEEGDIIKIDLACHIDGFIAAVAHTHVLQEGPVTGRAADVIAAANTAAEVALRLVRPGKKNKDVSDAIQKVAAAYDCKIVEGVLSHQMKQFVIDGNKVVLNISNPDTRVDDAEFEENEVYAIDIVTSTGEGKPKLLDEKQTTIYKRAVDKSYHLKMKASRFIFSEISQKFPIMPFSARALEEKRARLGLVECMNHELLQPYPVLHEKPGDFVAHIKFTVLLMPNGSDRVTSHPLQQLQPSKTVDDPEIKAWLALGTKTKKKGGGKKKKGKKEDKADESAEAEPEDSTNGTTPQQ

SEQ ID NO: 21123 - protein, 390 aa, Trifolium pratense
MSDDEREEKELDLSSSEVVTKYKTAAEIINKALKLVISECKPKAKIVDICEKGDSFIREQTSNVYKNVKKKIERGVAFPTCISVNNTICHFSPLASDETVLEEGDIVKIDLACHIDGFIAAVAHTHVLQEGPVTGRAADVIAAANTAAEVALRLVRPGKKNKDVTDAIQKVAAAYDCKIVEGVLSHQLKQFVIDGNKVVLSITNPDTRVDDAEFEENEVYAIDILTSTGEGKPKLLDEKQTTIYKRAVDKSYHLKMKASRFIFSEISQKFPIMPFSARALEEKRARLGLVECMNHELLQPYPVLHEKPGDFVAHIKFTVLLMPNGSDRVTSHPLQELQPTKTIDDPEIKAWLALGTKTKKKGGGKKKKGKKEDKAEAEPEDSTNGATPQE

SEQ ID NO: 21124 - protein, 394 aa, Cicer arietinum
MSDDEREEKELDLSSSEVVTKYKTAAEIVNKALKLVISECKPKAKIVDICEKGDSFIREQTSNVYKNVKKKIERGVAFPTCISVNNTICHFSPLASDETVLEEGDIVKIDLACHIDGFIAAVAHTHVLQEGPVTGRAADVIAAANTAAEVALRLVRPGKKNKDVTDAIQKVAAAYDCKIVEGVLSHQLKQFVIDGNKVVLSITNPDTRVDDTEFEENEVYAIDIVTSTGDGKPKLLDEKQTTIYKRAVDKSYHLKMKASRFIFSEISQKFPIMPFSARALEEKRARLGLVECMNHELLQPYPVLHEKPGDFVAHIKFTVLLMPNGSDRVTSHPLQELQPTKTIEDPEINAWLALGTKTKKKGGGKKKKGKKEDKADGSAEAVPEDSTNGATPQE

SEQ ID NO: 21125 - protein, 390 aa, Trifolium pratense
MSDDEREEKELDLSSSEVVTKYKTAAEIINKALKLVISECKPKAKIVDICEKGDSFIREQTNNVYKNVKKKIERGVAFPTCISVNNTICHFSPLASDETVLEEGDIVKIDLACHIDGFIAAVAHTHVLQEDPVTGRAADVIAAANTAAEVALRLVRPGKKNKDVTDAIQKVAAAYDCKIVEGVLSHQLKQFVIDGNKVVLSISNPDTRVDDAEFEENEVYAIDIVTSTGEGKPKLLDEKQTTIYKRAVDKSYHLKMKASRFIFSEISQKFPIMPFSARALEEKRARLGLVECMNHELLQPYPVLHEKPGDFVAHIKFTVLLMPNGSDRVTSHPLQELQPTKTIDDAEIKAWLALGTKTKKKGGGKKKKGKKDDKAEAEPEDSTNGATPQE

SEQ ID NO: 21126 - protein, 390 aa, Trifolium pratense
MSDDEREEKELDLSSSEVVTKYKTSAEIINKALKLVVSECKPKAKIVDICEKGDAFIREQTSNVYKNVKKKIERGVAFPTCISVNNTICHFSPLASDETVLEEGDIVKIDLACHIDGFIAAVAHTHVLQEGPVTGRAADVIAAANTAAEVALRLVRPGKKNKDVTDAIQKVAAAYDCKIVEGVLSHQLKQFVIDGNKVVLSISNPDTRVDDAEFEENEVYAIDILTSSGEGKPKLLDEKQTTIYKRAVDKNYHLKMKASRFIFSEISQKFPIMPFSARALEEKRARLGLVECMNHELLQPYPVLHEKPGDFVAHIKFTVLLMPNGSDRVTSHPLQELQPTKTIDDPEIKAWLALGTKTKKKGGGKKKKGKKEDKAEAEPEDSTNGATPQE

SEQ ID NO: 21127 - protein, 394 aa, Glycine max
MSDDEREEKELDLSSAEVVTKYKTAAEIVNKALKLVISECKPKAKIVDICEKGDSYIREQTGNVYKNVKRKIERGVAFPTCLSVNNVVCHFSPLASDEAVLEEGDILKIDMACHIDGFIAAVAHTHVLQEGPVTGRAADVIAAANTAAEVALRLVRPGKKNKDVSDAIQKVAAAYDCKIVEGVLSHQMKQFVIDGNKVVLSLSNPDTRVDEAEFEENEVYAIDIVTSTGDGKPKLLDEKQTTIYKRAVDKSYHLKMKASRFIFSEISQKFPIMPFSARALEEKRARLGLVECVNHELLQPYPVLHEKPGDLVAHIKFTVLLMPNGSDRITTHPLQELQPTKTIDDPDIKAWLALGTKTKKKGGGKKKKGKKGDKADETTEAEAMDSTNGATPQE

SEQ ID NO: 21128 - protein, 394 aa, Glycine max
MSDDEREEKELDLSSAEVVTKYKTAAEIVNKALKLVISECKPKAKIVDICEKGDSYIREQTGNVYKNVKRKIERGVAFPTCLSINNVVCHFSPLASDEAVLEEGDILKIDMACHIDGFIAVVAHTHVLQEGPVTGRAADVIAAANTAAEVALRLVRPGKKNKDVSDAIQKVAAAYDCKIVEGVLSHQMKQFVIDGNKVVLSLSNPDTRVDEAEFEENEVYAIDIVTSTGDGKPKLLDEKQTTIYKRAVDKSYHLKMKASRFIFSEISQKFPIMPFSARALEEKRARLGLVECVNHELLQPYPVLHEKPGDFVAHIKFTVLLMPNGSDRITTHPLQELQPTKTIDDPDIKAWLALGTKTKKKGGGKKKKGKKGEKADESAEAEPMDSTNEATPQE

SEQ ID NO: 21129 - protein, 391 aa, Arachis hypogaea
MSDDEREEKELDLSSPEVVTKYKTAAEIVNKALKLVVSECKPKAKIVDICEKGDSYIREQTGNVYKNVKRKIERGVAFPTCISVNNTVCHFSPLASDEAVLEGGDILKIDMACHIDGFIAAVAHTHVLQDGPVTGRAADVITAANTAAEVALRLVRPGKKNKDVTEAIQKVAAAYDCKIVEGVLSHQMKQFVIDGNKVVLSVTNPDTRVDDAEFEENEVYAIDIVTSTGEGKPKLLDEKQTTIYKRAVDKSYHLKMKASRFIFSEISQKFPIMPFSARALEEKRARLGLVECVNHELLQPYPVLHEKPGDYVAHIKFTVLLMPNGSDRVTSYPLQELQPTKTIEDPDIKAWLALGTKTKKKGGGKKKKGKKGDKADESAEAEPMDSTNGQE

SEQ ID NO: 21130 - protein, 392 aa, Phaseolus vulgaris
MSDEEREEKELDLSSAEVVTKYKTAAEIVNKALKLVISECKPKAKIVDLCEKGDSYIREQTGNVYKNVKRKIERGVAFPTCLSVNNLVCHFSPLASDEAVLEEGDILKIDMACHIDGFIAAVAHTHVLQEGPVSGRAADVIAAANTAAEVALRLVRPGKKNKDVTDAIQKVAAAYDCKIVEGVLSHQMKQFVIDGNKVVLSLSNPDTRVDEAEFEENEVYAIDIVTSTGDGKPKLFDEKQTTIYKRAVDKSYHLKMKASRFIFSEISQKFPIMPFSARALEEKRARLGLVECVNHELLQPYPVLHEKPGDYVAHIKFTVLLMPNGSDRVTSHTLQELQPTKTIDDPDIKAWLALGTKTKKKGGGKKKKGKKGDKVDESAEAEPMDSTNGATS

SEQ ID NO: 21131 - protein, 394 aa, Vigna unguiculata
MSDEEREEKELDLSSAEVVTKYKTAAEIVNKALKLVISECKPKTKIVDICEKGDSYIREQTGNVYKNVKRKIERGVAFPTCLSVNNVVCHFSPLASDEAVLEEGDILKIDMACHIDGFIAAVAHTHVLQDGPVTGRAADVIAAANTAAEVALRLVRPGKKNKDVTEAIQKVAAAYDCKIVEGVLSHQMKQFVIDGNKVVLSLSNPETRVDEAEFEENEVYAIDIVTSTGDGKPKLLDEKQTTIYKRAVDKSYHLKMKASRFIFSEISQKFPIMPFSARALEEKRARLGLVECVNHELLQPYPVLHEKPGDYVAHIKFTVLLMPNGSDRVTSHPLQELQPTKTIDDPDIKAWLALGTKTKKKGGGKKKKGKKGDKVEESAEAEPMDSTNGATSQD

SEQ ID NO: 21132 - protein, 389 aa, Lupinus angustifolius
MSDDERDEKELDLSSHEVVTKYKTAAEIVNKALKLVISECKPKAKIVDICEKGDSFIREQTGNVYKNVKRKIERGVAFPTCLSVNNTVCHFSPLASDEAVLEEGDILKIDLACHIDGFIAAVAHTHVLQNGPVTGRAADVLAAANTAAEVALRLVRPGKKNKDVTEAIQKVAAAYDCKIVEGVLSHQLKQFVIDGNKVVLSVSNPDTRVDEAEFEENEVYAIDIVTSTGDGKPKLLDEKQTTIYKRAVDKSYHLKMKASRFIFSEISQKFPIMPFSARALEEKRARLGLVECVNHELLQPYPVLHEKPGDFVAHIKFTVLLMPNGSDRLSSIPLQELQPTKTVDDPEIKAWLALGTKTKKKGGGKKKKGKKGDKADESVEAAEPVDSTN

SEQ ID NO: 21133 - protein, 394 aa, Phaseolus vulgaris
MSDDEREEKELDLSSAEVVTKYKTAAEIVNKALKLVISECKPKAKVVDICEKGDSYIREQTGNVYKNVKRKIERGIAFPTCLSVNNVICHFSPLASDEAVLEEGDILKIDMACHIDGFIAAVAHTHVLQEGPITGRAADVIAAANTAAEVALRLVRPGKKNKDVSEAIQKVAAAYDCKIVEGVLSHQMKQFVIDGNKVVLSLSNPETRVDEADFEENEVYAIDIVTSTGDGKPKLLDEKQTTIYKRAVDKSYHLKMKASRFIFSDISQKFPIMPFSARALEEKRARLGLVECVNHELLQPYPVLHEKPGDYVAHIKFTVLLMPNGSDRVTSHPLQELQPTKAIDDPDVKAWLALGTKTKKKGGGKKKKGKKGDKVDESVEAEPMDSTNGATPQD

SEQ ID NO: 21134 - protein, 390 aa, Cajanus cajan
MSDDEREEKELDLTSPEVVTKYKSAAEIVNKALQLVISECKPKAKIVDLCEKGDSYIREQTGNMYKNVKRKIERGVAFPTCVSVNNTVCHFSPLASDESVLEEGDIVKIDMACHIDGFIAAVAHTHVLQEGPVTGRAADAIAAANTAAEVALRLVRPGKKNKDVSEAIQKVAAAYDCKIVEGVLSHQMKQFVIDGNKVVLSVSNPDTRVDDAEFEENEVYAIDIVASTGDGKPKLLDEKQTTIYKRAVDKSYHLKMKASRFIFSEISQKFPIMPFSARALEEKRARLGLVECVNHELLQPYPVLHEKPGDYVAHIKFTVLLMPNGSDRVTTHPLQELQPTKTIDDPEIKAWLALGTKTKKKGGGKKKKGKKGAEAEPMEATNGATPQEQD

SEQ ID NO: 21135 - protein, 394 aa, Vigna unguiculata
MSDEEREEKELDLSSAEVVTKYKTAAEIVNKALKLVISECKPKTKIVDICEKGDSYIREQTGNVYKNVKRKIERGVAFPTCISVNNVVCHFSPLASDESVLEEGDILKIDMACHIDGFIAAVAHTHVLQEGPITGRAADVIAAANTAAEVALRLVRPGKKNKDVTEAIQKVAAAYDCKIVEGVLSHQMKQFVIDGNKVVLSLSNPDTRVEEAEFEENEVYAIDIVTSTGDGKPKLLDEKQTTIYKRAVDKSYHLKMKASRFIFSEISQKYPIMPFSARALEEKRARLGLVECVNHELLQPYPVLHEKPGDYVAHIKFTVLLMPNGSDRVTSHPLQELQPTKSIDDPDIKAWLALGTKTKKKGGGKKKKGKKGDKVDESVEAEPMDSTDGATPQG

SEQ ID NO: 21136 - protein, 390 aa, Glycine max
MSDDEREEKELDLTSPEVVTKYKSAAEIVNKALQLVISECKPKTKIVDLCEKGDSYIREQTGNMYKNVKRKIERGVAFPTCVSVNNTVCHFSPLASDETVLEDGDIVKIDMACHIDGFIAAVAHTHVLHEGPVTGRAADAIAAANTAAEVALRLVRPGRKNKDVTEAIQKVAAAYDCKIVEGVLSHQMKQFVIDGNKVVLSVSNPDTRVDDAEFEENEVYAIDIVASTGDGKPKLLDEKQTTIYKRAVDKSYHLKMKASRFIFSEISQKFPIMPFSARALEEKRARLGLVECVNHELLQPYPVLHEKPGDDVAHIKFTVLLMPNGSDRVTSHPLQELQPTKTIDDPEIKAWLALGTKTKKKGGGKKKKGKKGAEAEPMEATNGATPQEQD

SEQ ID NO: 21137 - protein, 395 aa, Euonymus alatus
MSSDDEREEKELDLTSPEVVTKYKSAAEIVNKALQLVISECKPKAKVVDVCEKGDSYIREQSGNMYKNVKKKIERGVAFPTCVSVNNTVCHVSPLASDETVLEEGDLVKIDMGCHIDGFIAVVAHTHVLQEGPVTGKAADVIAASNTAAEVALRLVRPGKKNKDVTDAIQKVAAAYDCKIVEGVLSHQLKQFVIDGNKVVLSVSSPDTRVDDAEFEENEVYAVDIVTSTGEGKPKLLDEKQTTIYKRAVDKNYHLKMKASRFIFSEISQKFPIMPFSARALEEKRARLGLVECVNHDLLQPYPVLHEKPGDLVAHIKFTVLLMPNGSDRITSHSLQELQPTKTIDDPEIKAWLALGTKTKKKGGGKKKKGKKGDKPGESAEAEPMDATTNGASQE

SEQ ID NO: 21138 - protein, 395 aa, Lupinus angustifolius
MSDDERDEKELDLSSHEVVTKYKTAAEIVNKALKLVISECKPKAKIVDICEKGDLFIREQTGNVYKNVKRKIERGVAFPTCLSVNSTVCHFSPLASDETVLEEGDIMKIDMACHIDGFIAAVAHTHVLQEGPVTGRAADVLAAANTAAEVATRLIRPGKKNKDVTDAIQKVAAAYDCKIVEGVLSHQMKQFVIDGNKVVLSVTNPDTRVDEAEFEENEVYAIDIVTSTGDGKPRLLDEKQTTIYKRAVDKSYHLKMKASRFIFSEISQKFPIMPFSARALEEKRARLGLVECVNHELLQPYPVLHEKPGDYVAHIKFTVLLMPNGSDRLSSFPLQELQPTKTVDDPEIKAWLALGTKTKKKGGGKRKKGKKGDKADELPEAAEPTNTTNEATPQD

SEQ ID NO: 21139 - protein, 394 aa, Cicer arietinum
MSDDEREEKELDLTSPDVVTKYKSAAEIVNKALQLIISECKPKVKVVEICEKGDSFIREQTGNMYKNVKKKIERGVAFPTCISINNTVCHFSPLASDETVLEEGDILKIDLACHIDGFIAAVAHTHVLQEGPVTGRAADVIAAANTAAEVALRLVRPGKKNKDVTDAIQKVAAAYDCKIVEGVLSHQMKQFVIDANKVVLSVSNPDTRVDDAEFEENEVYAIDIVASTGEGKPKLLDEKQTTIYKRAVDRSYHLKMKASRFIYSEITQNFPIMPFSARALEEKRARLGLVECMNHELLQPYPVLHEKAGDYVAHIKFTVLLMPNGSDRITTHSLQELQPTKTVDDPEIKAWLALGIKTKKKGGGKKKKGKKGAEGEAQAEPMDATNGASTQEQE

SEQ ID NO: 21140 - protein, 395 aa, Cucumis melo
MSDEEREEKELDLTSPEVVTKYKSAAEIANKALQLVISECKPKTKIVDICEKGDSFIREQTGNMYKNVKKKIERGVAFPTCISVNNTICHFSPLSSDETVLEEGDMVKIDLGCHIDGFIAVVAHTHVLQEGPVTGRAADVIAAANTAAEVALRLVRPGKKNKDVTEAIQKVAASYDCKIVEGVLSHQLKQFVIDGNKVVLSVANPETRVDEAEFEENEVYSIDIVTSTGEGKPKLLDEKQTTIYKRAVDRNYHLKMKASRFIFSEITQKFPIMPFTARALEEKRARLGLVECVNHDLLQPYPVLHEKPGDFVAHIKFTVLLMPNGSDRVTSHPLQDLQPTKTIDDPEIKAWLALGIKTKKKGGGKKKKGKKGDKTEDPADAEPMDTTANGAASQE

SEQ ID NO: 21141 - protein, 390 aa, Glycine max
MSDDEREKKELDLTSPEVVTKYKSAAEIVNKALQLVISECKPKTKIVDLCEKGDSYIREQTGNMYKNVKRKIERGVAFPTCVSVNNTVCHFSPLASDETVLEDGDIVKIDMACHIDGFIAAVAHTHVLHEGPVTGRAADAIAAANTAAEVALRLVRPGRKNKDVTEAIQKVAAAYDCKIVEGVLSHQMKQFVIDGNKVVLSVSNPDTRVDDAEFEENEVYAIDIVASTGDGKPKLLDEKQTTIYKRAVDKSYHLKMKASRFIFSEISQKFPIMPFSARALEEKRARLGLVECVNHELLQPYPVLHEKPGDDVAHIKFTVLLMPNGSDRVTSHPLQELQPTKTIDDPEIKAWLALGTKTKKKGGGKKKKGKKGAEAEPMEATNGATPQEQD

SEQ ID NO: 21142 - protein, 392 aa, Cucumis sativus
MSDEEREEKELDLTSPEVVTKYKSAAEIANKALQLVISECKPKAKIVDICEKGDSFIREQTGNMYKNVKKKIERGVAFPTCISVNNTICHFSPLSSDETVLEEGDMVKIDLGCHIDGFIAVVAHTHVLQEGPVTGRAADVIAAANTAAEVALRLVRPGKKNKDVTEAIQKVAASYDCKIVEGVLSHQLKQFVIDGNKVVLSVANPETRVDEAEFEENEVYSIDIVTSTGEGKPKLLDEKQTTIYKRAVDRNYHLKMKASRFIFSEITQKYPIMPFTARALEEKRARLGLVECVNHDLLQPYPVLHEKPGDFVAHIKFTVLLMPNGSDRVTSHPLQDLQPTKTIDDPEIKAWLSLGIKTKKKGGGKKKKGKKGDKTEDAEPMDTTTNGAASQE

SEQ ID NO: 21143 - protein, 392 aa, Eucalyptus grandis
MSDDEREEKELDLTSPDVVTKYKSAAEIVNKALQLVISECKPKAKVVDVCEKGDSFIREQTGNMYKNVKKKIERGVAFPTCISVNNTVCHFSPLASDETVLEEGDILKIDMGCHIDGFIAVVAHTHVLQEGPVTGRAADVIAAANTAAEVALRLVRPGKNNKDVTEAINKVAAAYDCKIVEGVLSHQLKQFVIDGNKVIISVSNPDTKVDEFEFEENEVYAIDIVTSTGEGKPKLLDEKQTTVYKRAVDKNYHLKMKASRFIFSEINQKFPILPFSARALEEKRARLGLVECVNHELLQPYPVLHEKPGDYAAHIKFTVLLMPNGSDRITSHSLQELQPTKTIDDPEIKAWLALGTKTKKKGGGKKKKGKKGTESAETEPMDATTNGAESQE

SEQ ID NO: 21144 - protein, 395 aa, Citrullus lanatus
MSDEEREEKELDLTSPEVVTKYKSAAEIVNKALQLVISECKPKAKIVDICEKGDSFIREQTGNMYKNVKKKIERGVAFPTCISVNNTVCHFSPLSSDETLLEEGDMVKIDLGCHIDGFIAVVAHTHVLQEGPVTGRAADVIAAANTAAEVALRLVRPGKKNKDVTEAIQKVAASYDCKIVEGVLSHQLKQFVIDGNKVVLSVANPETRVDEAEFEENEVYSIDIVTSTGEGKPKLLDEKQTTIYKRAVDRNYHLKMKASRFIFSEITQKFPIMPFTARALEEKRARLGLVECVNHDLLQPYPVLHEKPGDYVAHIKFTVLLMPNGSDRVTSHPLQDLQPTKTIDDPEIKAWLALGTKTKKKGGGKKKKGKKGDKTEDPTDAEPMDTTANGAASQE

SEQ ID NO: 21145 - protein, 390 aa, Glycine max
MSDDEREEKELDLTSPEVVTKYKSAAEIVNRALQLVISECKPKAKIVDLCEKGDSYIREQTGSMYKNVKRKIERGVAFPTCVSVNNTVCHFSPLASDETVLEDGDIVKIDMACHIDGFIAAVAHTHVLQEGPVTGRAADALAAANTAAEVALRLVRPGRKNKDVTEAIQKIAAAYDCKIVEGVLSHQMKQFVIDGNKVVVSVSNPDTRVDDAEFEENEVYAIDIVASTGDGKPKLLDEKQTTIYKRAVDKSYHLKMKASRFIFSEISQKFPIMPFSARALEEKRARLGLVECVNHELLQPYPVLHEKPGDYVAHIKFTVLLMPNGSDRVTSHSLQELQPTKTIDDPEIKAWLALGTKTKKKGGGKKKKGKKGAEAEPMDATNDATPQEQD

SEQ ID NO: 21146 - protein, 394 aa, Ricinus communis
MSDDEREEKELDLTSPEVVTKYKSAAEIVNKALQLVISECKPKAKIVDLCEKGDAFIREQTGNMYKNVKKKIERGVAFPTCVSVNNTVCHCSPLASDETLLEEGDVVKIDMGCHIDGFIAVVGHTHVLQAGPVTGRAADVIAAANTAAEVALRLVRPGKKNKDVTEAIQKVAAAYDCKIVEGVLSHQLKQFVIDGNKVILSVSNPETRVDDAEFEENEVYAIDIVTTTGEGKPKLLDEKHTTIYKRAVDKNYHLKMKASRFIFSEISQKFPIMPFTARALEEKRARLGLVECVNHDLLQPYPVLHEKPGDIVAHIKFTVLLMPNGSDRITSHSLQELQPTKTIDDPEIKAWLALGTKTKKKGGGKKKKAKKGDKAEESTEAEPMDATNGAETQE

SEQ ID NO: 21147 - protein, 395 aa, Euonymus alatus
MSSDDEREEKELDLTSPEVVTKYKSAAEIVNKALQLVISECKPKAKVVDVCEKGDSYIREQSGNMYKNVKKKIERGVAFPTCVSVNNTVCHVSPLASDETVLEEGDLVKIDMGCHIDGFIAVVAHTHVLREGPVTGKAADVIAASNTAAEVALRLVRPGKKNKDVTDAIQKVAAAYDCKIVEGVLSHQLKQFVIDGNKVVLSVSSPDTRVDEAEFEENEVYAVDIVTSTGEGKPKLLDEKQTTIYKRAVDKNYHLKMKASRFIFSEISQKFPIMPFSARALEEKRARLGLVECVNHDLLQPYPVLHEKPGDLVAHIKFTVLLMPNGSDRITSHSLQELQPTKTIDDPEIKAWLALGTKTKKKGGGKKKKGKKGDKPGESVEAEPMDATTNGASQE

SEQ ID NO: 21148 - protein, 395 aa, Prunus persica
  Sequence also found in Organisms: Prunus mume
MSDDEREEKELDLSSPEVVTKYKSAAEIVNKALQLVISECKPKAKIVDLCEKGDSYIREQTGNMYKNVKKKIERGVAFPTCISVNNTVCHFSPLASDETVLEEGDILKIDLGCHIDGFIAIVAHTHALQAGPVTGKAADVIAAANTAAEVALRLVRPGKKNKDVTEAIQKVAAAYDCKIVEGVLSHQLKQFVIDGNKVILSASNPDTRVDEAEFEENEVYSIDIVTSTGEGKPKLLDEKQTTVYKRAVDKNYHLKMKASRFIFSEIREKFPIMPFTARALEEKRARLGLLECVNHELLQPYPVLHEKPGDLVAHIKFTVLLMPNGSDRITSHPLQELQPTKQIDDPEIKAWLALGTKTKKKGGGKKKKGKKSDKAEESTEAEPMDATTNGAESQA

SEQ ID NO: 21149 - protein, 395 aa, Tripterygium wilfordii
MSSDDEREEKELDLTSPEVVTKYKSAAEIVNKALQLVISECKPKAKVVDVCEKGDSYIREQSGNMYKNVKRKIERGVAFPTCVSVNNTVCHFSPLASDETVFEEGDLVKIDMGCHIDGFIAVVAHTHVLQGGPVTGKAADVIAAANTAAEVALRLVRPGKKNKDVTDAIQKVAAAYDCKIVEGVLSHQLKQFVIDGNKVVLSVSNPDTRVDEAEFEENEVYAVDIVTSTGEGKPKLLDEKQTTIYKRAVDKNYHLKMKASRFIFSEISQKFPIMPFSARALEEKRARLGLVECVNHDLLQPYPVLHEKPGDMVAHIKFTVLLMPNGSDRITSHSLQELQPTKIVDDPEIKAWLALGTKTKKKGGGKKKKGKKGDKPGESAEAEPMDATTISASQE

SEQ ID NO: 21150 - protein, 390 aa, Arachis hypogaea
MSEDEREEKELDLTTPEVVTKYKSAAEIVNKALQLVVSECKPKSKIVDICEKGDSYIREQTGNMYKNVKRKIERGVAFPTCISVNNTVCHFSPLATDETVLEEGDILKIDMACHIDGFIAAVAHTHVLQQGPVTGRVADVIAAANTAAEVALRLVRPGRKNKDVTDAIQKVAAAYDCKIVEGVLSHQMKQFVIDGNKVVLSVSNPDTRVDDAEFEENEVYAIDIVASTGEGKPKLLDEKQTTIYKRAVDKSYHLKMKASRFIFSEISQNFPIMPFSARALEEKRARLGLVECVNHELLQPYPVLHEKPGDYVAHIKFTVLLMPNGSDRITSHALQELQPTKTIDDPEIKAWLALATKTKKKGGGKKKKGKKGAEAEPMEEEATNGATPQE

SEQ ID NO: 21151 - protein, 397 aa, Quercus alba
MSSDEEREEKELDLTSPEVVTKYKSAAEIINKALQLVVSECKPKAKIVDVCEIGDSFIREQTGNMYKNVKKKIERGVAFPTCISVNNTVCHFSPLASDETVMEAGDVLKIDMGCHIDGFIAVVAHTHVLQDGPVTGKAADVIAAANTAAEVALRLVRPGKKNKDVTDAIQKVAAAYDCKIVEGVLSHQLKQFVIDGNKVVLSVSNTDTRVDDAEFEENEVYAIDIVTSSGEGKPKLLDEKQTTIYKRAVDKNYHLKMKASRFIFSEISQKFPIMPFTARALEEKRARLGLVECVNHELLQPYPVLHEKPGDYVAHIKFTVLLMPNGSDRVTSHPLKELQPTKTIDDPEIKAWLALGTKTKKKGGGKKKKGKKGDKTEESTEADPMDETTTNGAASQE

SEQ ID NO: 21152 - protein, 394 aa, Manihot esculenta
MSDDEREEKELDLTSPEVVTKYKSAAEIVNKSLQLVVSECKAKAKVVDVCEKGDAYIREQTGNMYKNVKKKIERGVAFPTCISVNNTVCHFSPLASDETVLEEGDIVKIDMGCHIDGFIAVVAHTHVIQAGPVTGRAADVIAAANTAAEVALRLVRPGKKNKDVTEAIQKVAAAYDCKIVEGVLSHQLKQFVIDGNKVILSVSNSDTRVDDAEFEENEVYAIDIVTSTGEGKPKLLDEKHTTIYKRAVDKNYHLKMKASRFIFSEINQKFPILPFTARALEEKRARLGLVECVNHDLLQPYPVLHEKPGDLVAHIKFTVLLMPNGSDRITSHPLQELQPTKPIDDPEIKAWLALGTKTKKKGGGKKKKAKKGDKAEESTEAEPMDATSGNDGQE

SEQ ID NO: 21153 - protein, 394 aa, Citrus clementina
MSDDEREEKELDLTSPEVVTKYKSAAEIANKALQLVVSECKPGVKIVDLCEKGDSFIREQTGNMYKNVKKKIERGVAFPSCVSVNNTLCHFSPLASDETVLQEGDMIKIDLGCHIDGFIAVVAHTHVLQDEPVTGRAADVIAAANTAAEVALRLVRPGKKNKDVTEAIQKVAAAYDCKIVEGVLSHQLKQFVIDGNKVVLSVSNPDTRVDDAEFEENEVYAVDIVTSTGDGKPKLLDEKQTTIYKRAVDKNYHLKMKASRFIFSEINQKFPIMPFTARALEEKRARLGLVECVNHELLQPYPVLHEKPGDYVAHIKFTVLLMPNGSDRITSHTLQEIQSTKTIDDPEIKAWLALGIKTKKKGGGKKKKGKKGDKAEESTEAEPMDATNGAATQE

SEQ ID NO: 21154 - protein, 396 aa, Cucurbita pepo
MSDEEREEKELDLTSPEVVTKYKSAAEIANKALQLVISECKPKAKIVDVCEKGDSFIREQTGNVYKNAKKKIERGVAFPTCISVNNTVCHFSPLSSDATVLEEGDIVKIDLGCHIDGFIAVVAHTHVLQEGPVTGRAADVIAAANTAAEVALRLVRPGKKNKDVTEAIQKVAASYDCKIVEGVLSHQLKQFVIDGNKVVLSVANPETRVDEAEFEENEVYSIDIVTSTGEGKPKLLDEKQTTIYKRAVDRNYHLKMKASRFIFSEITQKFPIMPFSARALEEKRARLGLVECVNHDLLQPYPVLHEKPGDYVAHIKFTVLLMPNGSDRVTSHPLQDLQPTKTIEDPEIKAWLALGTKTKKKGGGKKKKGKKGDKTEDPKDADEPMDATVNGGASQE

SEQ ID NO: 21155 - protein, 394 aa, Vitis vinifera
MSDDEREEKELDLTSPEVVTKYKSAAEIANKALQLVLSECKPKAKIVDICEKGDSFIREQTGNMYKNVKKKIERGVAFPTCISVNNTVCHFSPLASDETVLEDGDMLKIDLGCHIDGFIAVVAHTHVLQGGPVMGRAADVLAAANTAAEVALRLVRPGRKNKDVTEAIQKVAAAYDCKIVEGVLSHQLKQFVIDGNKVVLSVPSPETRVEDAEFEENEVYAVDIVTSTGDGKPRLLDEKQTTIYKRAVDKSYHLKMKASRFIFSEISQKFPIMPFSARALEEKRARLGLVECVNHDLLQPYPVLHEKPGDYVAHIKFTVLLMPNGSDRITSHSLQELQPTKTTDDPEIKAWLALGTKTKKKGGGKKKKGKKGDKPEESAEAEPMDATTNGASQE

SEQ ID NO: 21156 - protein, 394 aa, Citrus sinensis
MSDDEREEKELDLTSPEVVTKYKSAAEIANKALQLVVSECKPGVKIVDLCEKGDSFIREQTGNMYKNVKKKIERGVAFPSCVSVNNTLCHFSPLASDETVLQEGDMIKIDLGCHIDGFIAVVAHTHVLQDGPVTGRAADVIAAANTAAEVALRLVRPGKKNKDVTEAIQKVAAAHDCKIVEGVLSHQLKQFVIDGNKVVLSVSNPDTRVDDAEFEENEVYAVDIVTSTGDGKPKLLDEKQTTIYKRAVDKNYHLKMKASRFIFSEINQKFPIMPFTARALEEKRARLGLVECVNHELLQPYPVLHEKPGDYVAHIKFTVLLMPNGSDRITSHALQEIQSTKTIDDPEIKAWLALGIKTKKKGGGKKKKGKKGDKAEESTEAEPMDATNGAATQE

SEQ ID NO: 21157 - protein, 396 aa, Trigonella foenum-graecum
MSDDERDEKELDLTSPDVVTKYKSAAEIVNKALQLVVSECKPKAKVVDICEKGDSFIREQTGKLYKNVKKKIERGLAFPTCISVNNTVCHFSPLASDETLLEEGDIVKIDLACHIDGFIAAVAHTHVLQEGPVTGRAADVIAAANTAAEVALRLVKPGKKNQDVTDAIQKVAAAYDCRIVEGVLSHQMKQFVIDANKVVLSVSNPETRVDDAEFEENEVYAIDIVASTGEGKPKLLDEKQTTIYKRAVDRSYNLKMKASRFIYSEISQNFPIMPFSARALEEKRARLGLVECMNHELLQPYPVLHEKPGDYVAHIKFTVLLMPNGSDRITSHPLQEIQPTKTVDDPEIKAWLALGVKTKKKGGGKKKKGKKGAEGEAEAEADPMDATDGAATQEQN

SEQ ID NO: 21158 - protein, 398 aa, Ananas comosus
MSDDELKEEKELDLTSPDVVTKYKTAAEIVNKALQLVVSECKPKAKIVDICEKGDAFIREQTGNVYKNVKKKIERGVAFPTCISVNNTVCHFSPLATDETVLEENDIVKIDMGCHIDGFIAVVAHTHVIQEGPVTGRAADVIAAANTAAEVALRLVRPGKKNKDVTEAIQKVAAAYDCKIVEGVLSHQLKQFVIDGNKVILSVSNPETRVDDAEFEENEVYAIDIVTSTGEGKPKLLDEKQTTIYKRAVDKNYHLKMKASRFIFSEINQKFPIMPFSARALEEKRARLGLVECVNHDLLQPYPVLHERPGDLVAHIKFTVLLMPNGSDRITSHPLQQLQPTKSIEDNAEIKAWLALGTKTKKKGGGKKKKGKKGDAKDDSAEAEPMDEEASNGAATQG

SEQ ID NO: 21159 - protein, 394 aa, Amsonia hubrichtii
MSDDEREERELDLTSPEVVTKYKSAAEIVNKALQLVVSECKPKAKIVDICEKGDAFIREQTGNMYKNVKKKIERGVAFPTCISVNNTVCHFSPLASDEALLEEGDVVKIDMGCHIDGFIAVVAHTHVLQEGPVTGRAADVIAAANTAADVALRLVRPGKKNKDVTEAVQKVAAAYDCKIVEGVLSHQMKQFVIDGNKVILSVSNPETRVDDAEFEENEIYSIDIVTSTGEGKPKLLDEKQTTIYKRAVDKNYHLKMKASRFIFSEISQKFPIMPFTARALEEKRARLGLVECVNHELLQPYPVLHEKPGDLVAHIKFTVLLMPNGSDRITSHSLQELQPTKAVDDPEIKAWLALGTKTKKKGGGKKKKGKKGDKAEPAADAEPMDAANGSASQE

SEQ ID NO: 21160 - protein, 378 aa, Fagus grandifolia
MSDDERDEREEKELDLTSPEVVTKYKSAAEIVNKALQLVISECKPKAKIVDICEKSDSYLREQTGNMYKNVKKKIERGVAFPTCISVNNTMCHFSPLASDESVMEEGDILKIDLGCHIDGFIAVVAHTHVLQEGPVTGRAADVIAAANTAAEVALRLVRPGKKNKDVTDAIQKVAAAYDCKIVEGVLSHQLKQFVIDGNKVVLSVSNPDTRVDDAEFEENEVYAIDIVTSTGEGKPKLLDEKQTTIYKRAVDKSYHLKMKASRFIFSEISQKFPIMPFTARALEEKRARLGLVECVNHELLQPYPVLHEKPGDFVAHIKFTVLLMPNGSDRVTSHTLQELQPTKSIDDPEIKAWLALGTKTKKKGGGKKKKGKKGRKN

SEQ ID NO: 21161 - protein, 395 aa, Malus domestica
MSDDEREEKELDLTSPEVVTKYKSAAEIVNKALQLVISECKPKAKIVDLCEKGDSYIREQTGNMYKNAKKKIERGVAFPTCISVNNTVCHFSPLGSDESVLEEGDILKIDLGCHIDGFIAIVAHTHVLQAGPVTGRAADVIAAANTAAEVALRLVRPGRKNKDVTEAIQKVAAAYDCKIVEGVLSHQLKQFVIDGNKVILSVSNPETRVDDAEFEENEVYAVDIVASTGEGKPKLLDEKQTTIYKRAVDKSYHLKMKASRFIFSEISQKFPIMPFTARALEEKRARLGLLECVNHELLQPYPVLHEKPGDFVARIKFTVLLMPNGSDRITSHPVQELQPTKQVDDPEIKAWLSLATKKKKGGGKKKKGKKSDKPEEESAEAEPMDATTNGAESQA

SEQ ID NO: 21162 - protein, 393 aa, Theobroma cacao
MSDDEREEKELDLTSPEVVTKYKSAAEIVNKALQLVVKDCKPKAKIVDICEKGDVFIREQTGNMYKNVKRKIERGVAFPTCISVNNTVCHFSPLASDTSELEEGDMVKIDLGCHIDGFIAIVAHTHVVQDGPITGRQADVVAAVNTAAEVALRLVRPGKKNKDVTDAIQKVAAAYDCKIVEGVLSHQLKQFVIDGNKVILSVSNPDTRVDDAEFEENEVYAVDIVASTGEGKPKLLDEKQTTIYKRAVDKNYHLKMKTSRFIFSEINQKFPILPFTARALEEKRARLGLVECVNHDLLQPYPVLHEKPGDYVAHIKFTVLLMPNGSDRVTSHPLQELQPTKTIDDPEIKAWLALGTKTKKKGGGKKKKGKKGDKAEESAEAEPMDEATNGATS

SEQ ID NO: 21163 - protein, 395 aa, Momordica charantia
MSDEEREEKELDLTSPEVVTKYKSAAEIANKALQLVISECKPKAKIVDVCEKGDSFIREQTGNMYKNVKKKIERGVAFPTCISVNNTVCHFSPLSSDETLFEEGDILKIDLGCHIDGFIAVVAHTHVLQEGPVTGRAADVIAAANTAAEVALRLVRPGKKNKDVTDAIQKVAASYDCKIVEGVLSHQMKQFVIDGNKVVLSVANPETRVDEAEFEENEVYSIDIVTSTGEGKPRLLDEKQTTIYKRAVDRNYHLKMKSSRFIFSEITQKFPIMPFTARALEEKRARLGLVECVNHDLLQPYPVLHEKPGDYVAHIKFTVLLMPNGSDRVTSHPLQELQPTKTLDDPEIKAWLALGTKTKKKGGGKKKKGKKSDKIEEPTDGEPMDATANGAASQE

SEQ ID NO: 21164 - protein, 391 aa, Medicago truncatula
MSDDERDEKELDLTSPDVVTKYKSAAEIVNKALQLVISECKPDVKIVDICEKGDSFIREQTGKLYKNVKKKIERGVAFPTCISVNNTVCHFSPLASDETVLEVGDILKIDMACHIDGFIAAVAHTHVLREGPVTGRAADVIAAANTAAEVALRLVKPGKKNQDVTDAIQKVAAAYDCRIVEGVLSHQMKQFVIDANKVVLSVSNPDTRVDDAEFEENEVYAIDIVASTGEGKPKLLDEKQTTIYKRAVDRSYNLKMKASRFIYSEISQNFPIMPFSARALEEKRARLGLVECMNHELLQPYPVLHEKPGDYVAHIKFTVLLMPNGSDRITSHPLQEIQPTKTVDDPEIKAWLALGVKTKKKGGGKKKKGKKGAEGEGEADATNDASTQEQN

SEQ ID NO: 21165 - protein, 394 aa, Malus domestica
MSDDEREEKELDLTSPEVVTKYKSAAEIVNKALQLVISECKPKAKIVELCEKGDSYIREQTGNMYKNAKKKIERGVAFPTCISVNNTVCHFSPLASDESVLEEGDILKIDLGCHIDGFIAIVAHTHVLQAGPVTGRAADVIAAANTAAEVALRLVRPGRKNKDVTEAIQKVAAAYDCKIVEGVLSHQLKQFVIDGNKVILSASNPETRVDEAEFEENEVYAVDIVASTGEGKPKLLDEKQTTIYKRAVDKSYHLKMKASRFIFSEISQKFPIMPFTARALEEKRARLGLLECVNHELLQPYPVLHEKPGDFVAHIKFTILLMPNGSDRITSHPVQELQPTKQVDDPEIKAWLSLATKKKKGGGKKKKGKKSDKPEESTEAEPMDATANGAESQA

SEQ ID NO: 21166 - protein, 396 aa, Populus trichocarpa
MSSDDEREERELDLTSPEVITKYKSAAEIVNKALQLVISECKPKAKIVDICEKGDSFIREQTGNMYKNVKKKIERGVAFPTCVSVNNTICHFSPLASDESVLEEGDIVKIDLGCHIDGFIAVVGHTHALQSGPVTGRAADVIAAANTAAEVALRLVRPGKKNKDVTEAIQKVAAAYDCKIVEGVLSHQLKQFVIDGNKVILSVSNPDTRVDDAEFEENEVYAVDIVTSTGEGKPKLLDEKSTTIYKRAVDKNYHLKMKSSRFIFSEINQKFPIMPFTARALEEKRARLGLLECVNHDLLQPYPVLHEKPGDYVAHIKFTVLLMPNGSDRITSHSLQELQPSKTIDDPEIKAWLALGTKTKKKGGGKKKKAKKSGEKAESTEAEPMDATTNGAAAQE

SEQ ID NO: 21167 - protein, 392 aa, Trifolium pratense
MSDDERDEKELDLTSPDVVTKYKSAAEIVNKALQLVISDLKPKVKVVDICEKGDSFIREQTAKLYKNVKKKIERGVAFPTCVCVNNTVCHFSPLAGDETVFEEGDVVKIDLACHIDGFIAAVAHTHVLQEGPVTGRAADVIAAANTAAEVALRLVKPGKKNQDVTDAIQKVAAAYDCRIVEGVLSHQMKQFVIDANKVVLSVSNTDTRVDDAEFEENEVYAIDIVASTGEGKPKLLDEKQTTIYKRAVDKSYNLKMKASRFIYSEISQKFPIMPFSARALEEKRARLGLVECMNHELLQPYPVLHEKPGDYVAQIKFTVLLMPNGSDRITSHPLQEVQPTKTVDDPEIKAWLALGVKTKKKGGGKKKKGKKGAEGEAEVSEATNGASTQDQE

SEQ ID NO: 21168 - protein, 393 aa, Rosmarinus officinalis
MSDEEREEKELDLTSPEVVTKYKSAAEIVNKALQLVLSECKPKAKIADLCEKGDTFIREQTANMYKNVKKKVEKGIGFPTCISVNNTVCHFSPLSSDEAVLEEGDILKIDMGCHIDGFIAVVAHTHVLQEGPVTGRVADVIAAANTAAEVALRLVRPGKKNKDVSEAIQKVAAAYGCKIVEGVLSHQMKQYVIDGNKVVLNISGPDTRVDDAEFEENEVYAIDIVTSTGEGKPRLLDERKTTIYKRAVDKNYHLKMKASRFIFSEISQKFPIMPFSARALEEKRARLGLVECVNHELLQPYPVLHEKPGDLVAHIKFTVLLMPNGSDRVTSHPLQELQPTKTLDDPEIKSWLALGTKTKKKGGGKKKKGKKGDKPEEAADAEPMDEATNGAAS

SEQ ID NO: 21169 - protein, 395 aa, Cucurbita pepo
MSDEEREEKELDLTSPEVVTKYKSAADIANKALQLVISECKPKAKIVDVCEKGDSFIREQTGNVYKNAKKKIERGVAFPTCISVNNTVCHFSPLSSDATVLEEGDIVKIDLGCHIDGFIAVVAHTHVLQEGPVTGRAADVIAAANTAAEVALRLVRPGKKNKDVTEAIQKVAASYDCRIVEGVLSHQMKQFVIDGNKVVLSVANPETRVDEAEFEENEVYSIDIVTSTGEGKPKLLDEKQTTIYKRAVDRNYHLKMKASRFIFSEITQKFPIMPFTARALEEKRARLGLVECVNHDLLQPYPVLQEKPGDYIAHIKFTVLLMPNGSDRVTSHPLQDLQPTITTDDPEIKAWLALGTKTKKKGGGKKKKGKKGDKTEDPTNAEPMDTTANGAASQE

SEQ ID NO: 21170 - protein, 392 aa, Mimulus guttatus
MSDEDMEEKELDLTSPEVVTKYKSAAEIVNKALQLVLSECKPKAKIVDLCEKGDVYIREHSGNMYKNVKKKIERGVAFPTCISVNNTVCHFSPLASDETVLEDGDILKIDMGCHIDGFIAVVAHTHVLQQGPVTGRAADVIAAANTAAEVALRLVRPGKKNKDVTEAIQKVAAAYDCKIVEGVLSHQMKQFVIDGNKVVLSVSGTDTRVDESEFEENEVYSIDIVTSTGEGKPKLLDEKQTTIYKRAVDKNYHLKMKASRFIFSEISQKFPIMPFSARALEEKRARLGLVECVNHDLLQPYPVLHEKPGDLVAHIKFTVLLMPNGSDRVTTHPLQELQPTKTVDDPEIKAWLALGTKTKKKGGGKKKKGKKVEKSEEAADAEPMDTGAASQE

SEQ ID NO: 21171 - protein, 384 aa, Valeriana officinalis
MSDDEREEKELDLSSPEVVTKYKSAAEIVNKALQLVLSQCKPKAKVVDICEQGDSFIREQTGNMYKNVKKKIERGVAFPTCISVNNTICHFSPLASDDTVLEEGDILKIDMGCHIDGFIAVVAHTHVLQEGPVTGRAADVIAAANTAAEVALRLVRPGKKNKDVTEAIQKVAAAYDCKIVEGVLSHQLKQFVIDGNKVVLSVSNPDTRVDDAEFEENEVYAIDIVTSTGDGKPKLLDEKQTTIYKRAVDKNYHLKMKASRFIFSEINQKFPIMPFTARALEEKRARLGLVECVNHELLQPYPVLHEKSGDHVAHIKFTVLLMPNGSDRITTHALQELQPTKTIEDPEIKAWLALATKTKKKGGGKKKKGKKGEKGEEGMDEAAS

SEQ ID NO: 21172 - protein, 387 aa, Valeriana officinalis
MSDDEREEKELDLSSPEVVTKYKSAAEIVNKALQLVLSQCKPKAKVVDICEQGDSYIREQTGNMYKNVKKKIERGVAFPTCISVNNTICHFSPLASDDTVLEEGDILKIDMGCHIDGFIAVVAHTHVLQEGPVTGRAADVIAAANTAAEVALRLVRPGKKNKDVTEAIQKVAAAYDCKIVEGVLSHQLKQFVIDGNKVVLSVSNPDTRVDDAEFEENEVYAIDIVTSTGDGKPKLLDEKQTTIYKRAVDKNYHLKMKASRFIFSEINQKFPIMPFTARALEEKRARLGLVECVNHELLQPYPVLHEKSGDHVAHIKFTVLLMPNGSDRITTHALQELQPTKTIEDPEIKAWLALATKTKKKGGGKKKKGKKGEKGEEAMDEATDGAS

SEQ ID NO: 21173 - protein, 394 aa, Cocos nucifera
MSDDEAKEEELDLTSPDVVTKYKSAAEIVNKALQLVVSECKPKAKIVDICEKGDAFIREQAGNIYKNVKKKIERGLAFPTCISVNNIVCHFSPLAGDETVLEENDIVKIDMGCHIDGFIAVVAHTHVLREGPVTGRAADVIAAANTAAEVALRLVRPGKKNKDVTEAIQKVAAAYDCKIVEGVLSHQLKQFVIDGNKVVLSVSNPEARVDEAEFEENEVYAVDIVTSTGEGKPKLLDEKQTTIYKRAVDKNYHLKMKSSRFIFSEINQKFPIMPFTARALEEKRARLGLVECVNHELLQPYPVLHEKPGDLVAHIKCTVLLMPNGSDRITSHPLEQLQPTKAIDNDPEIKAWLALGTKTKKKGGGKKKKGKKGGADTAETEPMDATSNGAPAQE

SEQ ID NO: 21174 - protein, 398 aa, Amorphophallus konjac
MSDDEAKEEKELDLSSPDVVTKYKTAAEIVNKALQLVISECKPKAKIVDLCEKGDAFIREQTGNVYKNVKKKIERGVAFPTCISVNNTVCHFSPLGSDESVLEENDIVKIDMGCHIDGFIAVVAHTHMLQEGAVTGRAADVIAAANTAGEVALRLVRPGKKNKDVTEAIQKVAAAYDCRIVEGVLSHQLKQFVIDGNKVILSVGNPETRVDDAEFEENEVYAIDIVTSTGEGKPRLLDEKQTTIYKRAVDKNYHLKMKSSRFIFSEINQKFPIMPFTARALEEKRARLGLVECVNHDLLQPYPVLHEKPGDLVAHIKFTVLLMPNGSDRMTSHPLQELKPDKTVDNDPEIKAWLALGTKTKKKGGGKKKKGKKGDDAKDDLAEAQPMDTSSNGAQRTE

SEQ ID NO: 21175 - protein, 393 aa, Cyclamen graecum
MSSDDERGEEKELDLSSPEVVTKFKSASDIINKALQLVLSECKPKAKIVNLCEKGDSFITEQTGNMYKNVKKKIERGVAFPTCISVNNTICHFSPLASDETVLEEGDMVKIDMGCHIDGFIAVVAHTHILQDGPITGRKADVVAAANTAAEVALRLVRPGKKNKDVTEAIQKVAAAYDCKIVEGVLSHQLKQFVIDGNKVVLSVSNPDTRVDDAEFEENEVYSIDIVTSTGDGKPKLLDEKQTTIYKRAVDKSYHLKMKASRFIFSEISQKFPIMPFTARALEEKRARLGLVECVNHELLQPYPVLHEKPGDYVAHIKFTVLLMPNGSDRITSHPLQELQPTKTIDDPEIKAWLAMGTKTKKKGGGKKKKGKKGDKVEEPAGAEPMDAEPNEG

SEQ ID NO: 21176 - protein, 396 aa, Platanus occidentalis
MSDDETKEEKELDLTSPEVVTKYKSAAEIANKALQLVLSECKPKAKIVDVCEKGDAFIREQTGNMYKNVKKKIERGVAFPTCISVNNTVCHFSPLASDEAVMEEGDILKIDMGCHIDGFIAVVAHTHLLQEGPVTGRAADVIAAANTAAEVALRLVRPGRKNKEVTDAIQKVAAAYDCKIVEGVLSHQLKQFVIDGNKVILSVSSPETRVDDAEFEDNEVYAIDIVTSTGDGKPRLLDERQTTIYKRAVDKNYHLKMKSSRFIFSEINQKFPIMPFSARALEEKRARLGLVECVNHDLLQPYPVLHEKPGDFVAHIKFTVLLMPNGSDRITSHALQELRPTKTIDDPEIKAWLSLGTKTKKKGGGKKKKGKKGDKADESAEPELMEATSNDAPSQD

SEQ ID NO: 21177 - protein, 393 aa, Panax ginseng
MSDDEREEKELDLSSPEVVTKYKLAAETVNKALQLVLLECKPKAKIVDICEKGDSFIREQTGNMYKNVKKKIEKGIAFPTCLSVNNTVCHFSPLASDESVLEEGDVLKIDIGCHIDGFIAVVAHTHVLHEGKVTGKAADVIAAANTAAEVALRLVRPGKKNKDVTEAIQKVAAAYDCKIVEGVLGHQLKQFVIDGNKVVLSVSNPDTRVDDAEFEENEVYAIDIVTSTGDGKPKLLDERQTTVYKRAVDKNYHLKMKASRFIFSEISQKFPIMPFTARALEEKRARLGLVECVNHDLLQPYPVLHEKPGDYVAHIKFTVLLMPNGSDRITSHPLQELEPTKTIDDPEIKAWLALGTKTKKKGGGKKKKAKKGDKVEDTAEPMDDATNGGAPQE

SEQ ID NO: 21178 - protein, 394 aa, Lippia dulcis
MSDDEREERELDLTSPEVVTKYKSAAEIVNKALQLVLSECKPKAKIVDICEKGDTFIREQTANMYKNVKKKIERGVAFPTCISVNNVVCHFSPLASDESVLEDGDLLKIDMGCHIDGFIAVVGHTHVLQQGPVTGRAADVIAAANTAAEVALRLVRPGKKNKDVTEAIQKVAAAYDCKIVEGVLSHQMKQFVIDGNKVVLSVSGPDTRVDDAEFEENEVYSIDIVTSTGEGKPKLLDEKQTTIYKRAVDKNYHLKMKASRFIFSEISQKFPIMPFSARALEEKRARLGLVECVNHELLQPYPVLHEKPGDLVAHIKFTVLLMPNGSDRITSLSLQELQPTKTVDDPEIKAWLSLGTKTKKKGGGKKKKGKKGEKSEDAAKPTNEAGENVAAPQE

SEQ ID NO: 21179 - protein, 395 aa, Musa acuminata
MSDDEAREEKELDLTSPDVVTKYKSAAEIVNKALQLVVSECKPKAKIVDLCEKGDAFIREQTGNMYKNVKRKIERGVGFPTCVSVNNTVCHFSPLGSDEAVLEANDIVKIDMGCHIDGFIAVVAHTHVIQEGPVTGRAADVIAAANTAAEVALRLVRPGKKNKDVTEAIQKVAAAYDCKIVEGVLSHQLKQFVIDGNKVIISVTNPETRVDEVEFEENEVYAIDIVTSTGEGKPKLLDEKQTTIYKRAVDKSYHLKMKSSRFIFSEISQKFPIMPFSARALEEKRARLGLVECVNHDLLQPYPVLHEKPGDLVAHIKFTLLLMPNGSDRVTSHPLQQLQPTKTIDDNPEIKAWLALGTKTKKKGGGKKKKGKKGDGRDDSADAEPMDTASNTAVA

SEQ ID NO: 21180 - protein, 391 aa, Cichorium intybus
MSDDERGEEKELDLSSPEVVTKYKSAAEIVNKALQLVLSECKPNAKIVDICEKGDSYIREQTGNMYKNVKKKIERGVAFPTCLSVNNTVCHYSPLASDETVLKEGDILKIDMGCHIDGFIAVVGHTHALQEGPVTGRAADVIAAANTAAEVALRLVRPGKKNQDVTEAIQKVAAAYDCKIVEGVLSHQMKQFVIDGNKVVLSVSNPDTRVDDAEFEENEVYSIDIVTSTGDGKPKLLDEKQTTIYKRAVDKNYHLKMKASRFIFSEISQKFPIMPFSARSLEEKRARLGLVECVNHELLQPYPVLHEKPGDFVAHIKFTVLLMPNGSDRITSHSLQELKPTKTVDDPEIKAWLALAVKTKKKGGGKKKKGKKGEKGEGDEAVAMDETNGES

SEQ ID NO: 21181 - protein, 396 aa, Rosmarinus officinalis
MSDEEREEQELDLSNSEVVTKYKAAAEIVNKALQLVLPECRPKAKIVDLCEKADSFIREQTGNMYKKVKKKIERGVAFPTCISVNNTVCYFSPLNGDETALEDGDIVKIDMGCHIDGFIAVVAHTHVLQQVPVTGRAADVIAAANTAAEVALRLVRPGKKNKDVSEAIQKVAAAYDCKIVEGVLSHQMKQFVIDGNKVVLSATGPDTRVDDAEFEENEVYAIDIVTSTGEGKPKLLDEKQTTIYKRAVDKNYLLKMKASRFIFSEISQKFPIMPFSARALEEKRVRLGLVECVYHDLLQPYPVLHEKPGDLVAHIKFTVLLLPNGSDRVTSHPLQELQPTKTIDDPEIKAWLALGTKSRKKGGGKKKKGKKGDKAENTAEAEPMEEEAPNGATSQE

SEQ ID NO: 21182 - protein, 394 aa, Elaeis guineensis
MSDDEAKEEELDLTSPDVVTKYKSAADIVSKALQLAVSECKPKAKIVDICEKGDAFIREQAGNIYKNVKKKIERGLAFPTCISVNNIVCHFSPLAGDETVLEENDIVKIDMGCHIDGFIAVVAHTHVLQEGPVTGRAADVIAAANTAAEVALRLVRPGKKNKDVTEAIQKVAAAYDCKIVEGVLSHQLKQFVIDGNKVVLSVSNPEARVDEAEFEENEVYAVDIVTSTGEGKPKLLDEKQTTIYKRAVDKNYHLKMKSSRFIFSEINQKFPIMPFTARALEEKRARLGLVECVNHELLQPYPVLHEKLGDLVAHIKFTVLLMPNGSDRITSHPLQQSQPTKTIDNDPEIKAWLALGTKTKKKGGGKKKRGKKGGADAAETEPMDATSNGAPAQE

SEQ ID NO: 21183 - protein, 396 aa, Vinca minor
MSDDEREEERELDLTSSEVVTKYKSAAEIVNRALQLVVSQCKPKVKIVDVCEKGDAFIREQTGNMYKNAKKKIERGVAFPTCVSVNNTVCHFSPLASDETVFQEGDIVKIDMGCHIDGFIAVVAHTHVLQEGPVTGRAADVIAAANTAAEVALRLVRPGKKNKDVTEAVQKVAAAYDCKIVDGVLSHQMKQFVIDGNKVILSVTNPDTRVDDAEFEENEVYSVDIVTSTGEGKPKLLDEKQTTIYKRAVDKSYHLKMKASRFIFSEISQKFPIMPFTARALEEKRARLGLVECVNHELLQPYPVLHEKPGDLVAHIKFTVLLMPNGSDRITSHSLQEIQPTKTVDDPEIKGWLSLGTKTKKKGGGKKKQGKKGDKTEASADAEPMDVATNDAESQE

SEQ ID NO: 21184 - protein, 388 aa, Arnica chamissonis
MSDDERGEEKELDLSSPEVVTKYKSAAEIVNKALQLVLSECKPKAKIVDICEKGDSYIREQTGSMYKNVKKKIERGVAFPTCLSVNNTVCHFSPLASDETVLEEGDILKIDMGCHIDGFIAVVGHTHVLQQGPVTGRAADAIAAANTAAEVALRLVKPGKKNQDVTKAIQEVAAAYDCKIVEGVLSHQLKQFVIDGNKVVLSVSNPDTRVDDAEFEENEVYAIDIVTSTGDGKPKLLDEKQTTIYKRAVDKSYHLKMKASRFIFSEISQNFPIMPFSARALEEKRARLGLVECVNHELLQPYPVLHEKPGDFVAHIKFTVLLMPNGPDRITSHGLQELQPTKTVDDPEIKAWLSLPVKTKKKGGGKKKKGKRAEKGDGEAEAEAMEET

SEQ ID NO: 21185 - protein, 372 aa, Vaccinium corymbosum
MSDEEREEKELDLSSPEVVTKYKSAAEIVNKALQLVLSECKPKAKIVDICEKGDSFIREQSGNMYKNVKKKIERGVAFPTCMSVNNTVCHFSPLASDETVLEEGDILKIDMGCHIDGFIAVVAHTHVLQEGPVTGRQADVIAAANTAAEVALRLVRPGRKNKDVTEAIQKVAAAYDCKIVEGVLSHQLKQFVIDGNKVVLSISNPETRVDDAEFEENEVYAIDIVTSTGEGKPKLLDEKQTTIYKRAVDKNYHLKMKASRFIFSEISQKFPIMPFTARALEEKRARLGLLECVNHDLLQPYPVLHEKPGDYVAHIKFTVLLMPNGSDRITSHPLQDLQPSKTIDDPEIKAWLALGTKTKKKGGGKKKKGKKR

SEQ ID NO: 21186 - protein, 395 aa, Panax ginseng
MSDDEREEKELDLSSPEVVTKYKLAAKTVNKALQLVLSECKPKAKIVEICEKGDSFIREQTENMYKNVKKKIEKGIAFPTCLSVNNTVCHFSPLASNKAVLEEGDILKIDMGCHIDGFIAVVAHTHVLQEGKVTGKAADVIAAANTAAEVALRLVRPGKKNKDVTEAIQKVAAAYDCKIVEGVLSHQLKQFVIDGNKVVLSVSNPDTRVDDAEFEENEVYAVDIVTSTGDGKPKLLDEKLTTVYKRAVDKNYHLKMKASRFIFREISHKFPIMPFTARVLEEKRARLGLVECVNHDLLQPYPVLHEKPGDSVAHIKFTVLLMPNGSDRITSHPLQELEPTKIIDDPEIKAWLALGTKTKKKGDGKKKKGKKGDKGVDSAEAEPMDASTNGSASQE

SEQ ID NO: 21187 - protein, 394 aa, Rhizophora mangle
MSDDEREEKELDLTSHEVVTKYKTAAEIVNRALQLVISECKSKAKIVDVCEKGDTFIKEQTSNVYKNVKRKIERGIAFPTCISVNNTVCHFSPLASDEMVLEEGDIVKIDMGCHIDGFIAVVGHTHVLQEGPVTGRAADIIAATNTAAEVALRLVRPGRKNKDVTEAIQKVATAYDCKIVEGVLSHQMKQFVIDGNKVILSVSNPETRVDDAEFEENEVYAIDIVTSTGDGKPKMLDEKNTTIYKRAVDKNYHLKMKASRFIFSEINQKFPIMPFTARALEEKRARLGLIECVNHDLLQPYPVLHEKPGDLVAHIKFTVLLMPNGSDRITSHPLQELQATKTLDDPEIKAWLALGTKKKKGGGKKKKGKKGDKGEESTDAEPMAATPNGAASQE

SEQ ID NO: 21188 - protein, 394 aa, Centaurea maculosa
  Sequence also found in Organisms: Cirsium arvense
MSDDERGEEKELDLSSSEVVTKYKSAAEIVNKALQLVLSECKPNTKIVDICEKGDSYIREQTASMYKNVKKKIERGVAFPTCLSVNNTVCHFSPLASDETVLKEGDILKIDMGCHIDGFIAVVGHTHVLQQGPVTGRAADVIAAANTAAEVALRLVRPGKKNQDVTEAIQKVAAAYDCKIVEGVLSHQLKQFVIDGNKVVLSVANPDTRVDDAEFEENEVYAIDIVASTGDGKPKLLDEKQTTIYKRAVDKNYHLKMKASRFIFSEINQKFPIMPFSARALEEKRARLGLVECVNHELLQPYPVLHEKPGDFVAHIKFTVLLMPNGSDRITSHTLQELQPTKTVDDPEIKAWLALAVKSKKKGGGKKKKGKKGEKGEGDEAVAMDETTNGGNQG

SEQ ID NO: 21189 - protein, 391 aa, Cichorium intybus
MSDDERGEEKELDLSSPEVVTKYKSAAEIVNKALQLVLSECKPNAKIVDICEKGDSYIREQTGNMYKNVKKKIERGVAFPTCLSVNNTVCHYSPLASDETVLKEGDMLKIDMGCHIDGFIAVVGHTHALQEGPVTGRAADVIAAANTAAEVALRLVRPGKKNQDVTEAIQKVAAAYDCKIVEGVLSHQMKQFVIDGNKVVLSVANPDTRVDDAEFEENEVYSIDIVTSTGDGKPKLLDEKQTTIYKRAVDKNYHLKMKASRFIFSEISQKFPIMPFSARSLEEKRARLGLVECVNHELLQPYPVLHEKPGDFVAHIKFTVLLMPNGSDRITSHSLQELKPTKTVDDPEIKAWLALAVKTKKKGGGKKKKGKKGEKGEGDEAVAMDETNGES

SEQ ID NO: 21190 - protein, 389 aa, Flaveria ramosissima
MSDDERVEEKELDLSSPEVVTKYKSAAEIVNKALQLVLSECKPKAKIVDICEKGDSYIREQTGSMYKNVKKKIERGVAFPTCLSVNNTVCHFSPLASDETVLEEGDILKIDMGCHIDGFIAVVAHTHVLQQGPVTGRAADVIAAANTAAEVALRLVKPGKKNQDVTKAIQEVAAAYDCKIVEGVLSHQLKQFVIDGNKVVLSVSNPETRVDDAEFEENEVYAIDIVTSTGEGKPKLLDEKQTTIYKRAVDKSYHLKMKASRFIFSEISQNFPIMPFSARALEEKRARLGLVECVNHELLQPYPVLHEKPGDFVAHIKFTVLLMPNGSDRITSHGLQELQPTKTVDDHPEIKGWLSLPVKIKKKGGGKKKKGKRVEKGEGEAEVEPMEET

SEQ ID NO: 21191 - protein, 393 aa, Gossypium raimondii
MSDDEREEKELDLSSSEVVTKYKGAAEIVNKALQLVVKECKPKAKIVDICEKGDAFIREQTGNMYKNSKKKIERGVAFPTCLSVNNTVCHFSPLASDTSELEEGDMVKIDMGCHIDGFIAVVAHTHVVQSGPITGKQADVVAAANTAAEVALRLVRPGKKNKDVSDAIQKVAAAYDCKIVEGVLSHQLKQFVIDGNKVILSVSNPDTRVDDAEFEENEVYAVDIVASTGEGKPKLLDEKQTTIYKRAVDKNYHLKMKASRFIFSEINQRFPILPFTARALEEKRARLGLVECVNHDLLQPYPVLYEKPGDYVAHIKFTVLLMPNGSDRITSHPLQELQPTKTIDDPEIKAWLALGTKTKKKGGGKKKKGKKGDKAEGGAEGEAMDASTNGGAS

SEQ ID NO: 21192 - protein, 391 aa, Vitis vinifera
MSDDEREERELDLTSPEVVTKYKTAAEIVNKALQVVLSECKPKAKIVDVCEKGDAFIREQTGNVYKNVKKKIERGVAFPTCISVNNTVCHFSPLSSDETLLEAGDILKIDMGCHIDGFIAVVAHTHVLQDGPVTGRAADVIAAANTAAEVALRLLRPGRKNKEVTDAIQKVAAAYDCKIVEGVLSHQLKQFVIDGNKVVLSVPSGETRVDDAEFEENEVYAVDIVISSGDGKPRLLDERQTTIYKRAVDKNYHLKMKSSRFIFSEINQKFPIMPFTARALEEKRARLGLVECVNHDLLQPYPVLHEKPGDFVAHIKFTVLLMPNGSDRITSHPLQELRPTKTIDNDPEIKAWLALGTKTKKKGGGKKKKGKKGDKTENSGEAEPMDAASQE

SEQ ID NO: 21193 - protein, 395 aa, Allium cepa
MSDDEVIEEKELDLSSSDVVTKYKTAAEIVNKALKLVVSECKPKAKIVDICEKGDSFIREQAGNMYKNAKKKIERGVAFPTCISVNNTVCHFSPVAGDETVLEENDIVKIDMGCHIDGFIAVVAHTHVLQEGPITGRAADVIAAANTAAEVALRLVRPGKKNTDVTEAIQKVAAAYDCKIAEGVLSHQLKQFVIDGNKVVLSVSNPDTKVDVVEFEENEVYAIDIVTSTGEGKPKLLDEKQTTIYKRAVDKNYNLKMKASRFIFSEISQKFPIMPFTARALEEKRARLGLLECMNHDLLQPYPVLHEKPGDLVAHIKFTVLLMPNGSDRITSLPLQQLQPTKTIDDPEIKAWLALSTKTKKKGGGKKKKGKKSETAEAGEAVPMEEEASDAVAAK

SEQ ID NO: 21194 - protein, 394 aa, Platanus occidentalis
MSDDEAKEEKELDLSSPEVVTKYKSAAEIINKALQLVLSECKPKAKIVDICEKSDAFIREQTGNMYKNVKKKIERGVAFPTCISVNNIVGHFSPLASDETVLEEGDLLKIDMGCHIDGFIAVVGHTHVLHEGPVTGRAADVIAAGNTAAEVALRLVRPGKKNKDVTEAIQKVAAAYDCKVVEGVLSHQLKQFVIDGNKVILSVSSPDTRVDDAEFEENEVYAIDIVTSTGDGKPKLLDERQTTIYKRAVDKNYHLKMKSSRFIFSEISQKFPIMPFTARALEEKRARLGLVECVNHDLLQPYPVLHEKPGDFVAHIKFTVLLMPNGSDRITSHTLQELQPTKTIDDDPEIKAWLALGTKTKKKGGGKKKKGKKGDKVDESADTEPVDAASNGAA

SEQ ID NO: 21195 - protein, 387 aa, Solanum tuberosum
MSDDEREEKELDLTSPEVVTKYKSAAEIVNKALQLVLSECKPKAKIVDLCEKGDAFIKEQTGNMYKNVKKKIERGVAFPTCISVNNTVCHFSPLASDETVVEEGDILKIDMGCHIDGFIAVVGHTHVLHEGPVTGRAADVIAAANTAAEVALRLVRPGKKNSDVTEAIQKVAAAYDCKIVEGVLSHQMKQFVIDGNKVVLSVSNPDTRVDEAEFEENEVYSIDIVTSTGDGKPKLLDEKQTTIYKRAVDKSYNLKMKASRFIFSEISQKFPIMPFTARDLEEKRARLGLVECVNHELLQPYPVLHEKPGDLVAHIKFTVLLMPNGSDRVTSHALQELQPTKTTENEPEIKAWLALPTKTKKKGGGKKKKGKKGDKVEEASQAEPMEG

SEQ ID NO: 21196 - protein, 387 aa, Solanum lycopersicum
MSDDEREEKELDLTSPEVVTKYKSAAEIVNKALQLVLSECKPKAKIVDLCEKGDAFIKEQTGNMYKNVKKKIERGVAFPTCISVNNTVCHFSPLASDETVVEEGDILKIDMGCHIDGFIAVVGHTHVLQNGPVTGRAADVIAAANTAAEVALRLVRPGKKNSDVTEAIQKVAAAYDCKIVEGVLSHQMKQFVIDGNKVVLSVSNPDTRVDEAEFEENEVYSIDIVTSTGDGKPKLLDEKQTTIYKRAVDKSYNLKMKASRFIFSEISQKFPIMPFTARDLEEKRARLGLVECVNHELLQPYPVLHEKPGDLVAHIKFTVLLMPNGSDRVTSHALQELQPTKSTENEPEIKAWLALPTKTKKKGGGKKKKGKKGDKVEEASQAEPMEG

SEQ ID NO: 21197 - protein, 396 aa, Aquilegia formosa
MSDDEIKEEKELDLSSPEVVNKYKSAAEIINKALQLVISECKPKVKIVDVCEKGDSFIREQTGNMYKNVKKKIERGVAFPTCISVNNTICHFSPLASDESVLEAGDIVKIDMGCHIDGFIAVVAHTHVLQEGPVTGRVADVIAAANTAAEVALRLVRPGKKNKDVTEAIQKVAAAYDCKIVEGVLTHQLKQFVIDGNKVVLSVSSPETKVDDAEFEENEVYAVDIVTSTGEGKPKLLDEKQTTIYKRAVDKNYHLKMKASRFIFSEINQNFPIMPFTARALEEKRARLGLVECVNHELLQPYPVLHEKPGDFVAHIKFTVLLMPNGSDRITSHPLQEVQSTKSVTEDPEIKAWLSLGTKSKKKGGGKKKKAKQGDKGDDTAEAEPSEAVATNGATA

SEQ ID NO: 21198 - protein, 394 aa, Lactuca sativa
MSDDERGEEKELDLSSPEAVTKYKSAAEIVNKALQLVLSECKPKAKIVDICEKGDSYIREQTGNMYKNVKKKIERGVAFPTCLSVNNTVCHYSPLASDETVLEEGDILKIDMGCHIDGFIAVVGHTHVLQQGPVTGRAADAIAAANTAAEVALRLVKPGKKNQDVTEAIQKVAAAYDCKIVEGVLSHQLKQFVIDGNKVVLSVSNPETRVDDAEFEENEVYAIDIVTSTGEGKPRLLDEKQTTIYKRAVDKSYHLKMKASRFIFSEINQKFPIMPFSARALEEKRARLGLVECVNHELLQPYPVLHEKPGDFVAHIKFTVLLMPNGSDRITSHTLQELQTTTNKTVDDPEIKAWLALPVKTKKKGGGKKKKGKRAEKGEGEAMDVEATNGGGQD

SEQ ID NO: 21199 - protein, 390 aa, Mimulus guttatus
MADEIREENEELDLSSPEVVTKYKSAAEIVNKALQLVLSQCKPKVKIVDLCEAGDAFIREQTGNMYKNVKKKIEKGVAFPTCVSVNNTVCHFSPLASDESVLEDGDIVKIDMGCHIDGFIAVVAHTHVLQEGPVTGRAADVIAAANTAAEVALRLVRPGKKNKDVTEAIQKVAAAYDCKIVEGVLSHQMKQFVIDGNKVVLSVSAPDTKVDEAEFEENEVYSIDIVTSTGEGKPKLLDEKQTTIYKRAVDKSYHLKMKASRFIFSEISQKFPIMPFSARALEEKRARLGLVECVNHDLLQPYSVLHEKPGDLVAHIKFTVLLMPNGSDRVTSHALQELQPTKTVDDDEIKAWLALGTKTKKKGGGKKKKAKKEDKADAAVPVDDASTNGV

SEQ ID NO: 21200 - protein, 387 aa, Solanum phureja
MSDDEREEKELDLTSPEVVTKYKSAAEIVNKALQLVLSECKPKAKIVDLCEKGDAFIKEQTGNMYKNVKKKIERGVAFPTCISVNNTVCHFSPLASDETVVEEGDILKIDMGCHIDGFIAVVGHTHVLHEGPVTGRAADVIAATNTAAEVALRLVRPGKKNSDVTEAIQKVAAAYDCKIVEGVLSHQMKQFVIDGNKVVLSVSNPDTRVDEAEFEENEVYSIDIVTSTGDGKPKLLDEKQTTIYKRAVDKSYNLKMKASRFIFSEISQKFPIMPFTARDLEEKRARLGLVECVNHELLQPYPVLHEKPGDLVAHIKFTVLLMPNGSDRVTSHALQELQPTKTTENEPEIKAWLALPTKTKKKGGGKKKKGKKGDKVEEASQAEPMEG

SEQ ID NO: 21201 - protein, 396 aa, Papaver somniferum
MSDDENKEEKELDLTSPEVVTKYKTAAEIVNKALQLVLSECKPGAKIVDLCEKGDSYIREQSGSVYKNVKKKIERGVAFPTCISVNNIVCHFSPLASDETVLVQGDMMKIDMGCHIDGFIAVVGHTHVLQDGPVTGRAADVVAAANTAAEVALRLVKPGNKNKDVTKAIQKVAAAYDCKIVEAVLSHQLKQFVIDGNKVILSVSNPETRVDDAEFEENEVYAIDIVVSTGEGKPKLVDEKQTTIYKRAVDKSYSLKMKASRFIFSEISQKFPIMPFSARALEEKRARLGLVECMSHELLQPYPVLHEKPGDFVAQIKFTVLLMPNGSDRITSHALQELQSTKTIDDDAEIKGWLALGTKKKKGGGKKKKAKKGGDSKADETVEAEPMDETSKATTS

SEQ ID NO: 21202 - protein, 391 aa, Rosmarinus officinalis
VREEKELDLSSPEVVTKYKLAAEIVNKALQLVVSECKPKAKIVDICERGDAFIREQAGNMYKNVKKKIERGTAFPTCISVNNTVCHFSPLASDETLLEQGDMVKIDMGCHIDGFIAVVAHTHVLQEGPVTGRAADVIAAANTAAEVALRLVRPGKKNKDVTEAVQKVAAAYDCKIVEGVLSHQMKQFVIDGNKVILSVSSPETRVDDAEFEENEVYSIDLATSTGEGKPKLLDEKQTTIYKRAVDRTYHLKMKASRFIFSEISQKFPIMPFTARALEEKRARLGLVECVNHELLQPYPVLHEKPGDLVAHIKFTVLLMPNGSDRITSHSLQELQPTKTVDDPEIKAWLALGIKTKKKGGGKKKKGKKGDKTELSADAEPMDVATNGTASQE

SEQ ID NO: 21203 - protein, 394 aa, Amorphophallus konjac
MSDDEAREEKELDLSSPDVVTKYKSAAEIVNKALQLVISECKPKAKIVDLCEKGDAFIREQTGNVYKNVKKKIERGVAFPTCISVNNTVCHFSPLASDESVLEENDMIKIDMGCHIDGFIAVVAHTHVVHQGPVTGRAADVIAAANTAAEVALRLVRPGKKNKDVTEAIQKVAAAYDCKIVEGVLSHQLKQFVIDGNKVVLSVANPETRVDDAEFEENEVYAVDIVTSTGDGKPKMLDERATTIYKRAVDKSYHLKMKSSRFIFSEINQKHQIMPFTARALEEKRARLGLVECVNHDLLQPYPVLHEKPGDLIAHIKFTVLLMPNGSDRITSHPLQDLQPHKTVDDDPEIKAWLALGTKTKKKGGGKKKKGKKSDNKDDSEPVDASSNGAPLQE

SEQ ID NO: 21204 - protein, 395 aa, Centaurea maculosa
MSDDERAEEKELDLTSPEVVTKYKSAAEIVNKALQLVLSECKPKAKIVDICEKGDSYIREQTGSMYKNVKKKIERGVAFPTCLSVNNTVCHYSPLASDETVLEEGDILKIDMGCHIDGFIAVVGHTHVLQQGPVTGRAADAIAAANTAAEVALRLVKPGKKNQDVTEAIQKVAAAYDCKIVEGVLSHQLKQFVIDGNKVVLSVSNPETRVDDAEFEENEVYAIDIVTSTGDGKPKLLDEKQTTIYKRAVDKNYHLKMKASRFIFSEINQKYPIMPFSARALEEKRARLGLVECVNHELLQPYPVLHEKPGDFVAHIKFTVLLMPNGSDRITSHTLQELQPTKTVDDPEIKAWLSLPVKSKKKGGGKKKKGKKAEKGEGEVEPMEESSNDQGQGQE

SEQ ID NO: 21205 - protein, 393 aa, Gossypium hirsutum
MSDDEREEKELDLSSSEVVTKYKGAAEIVNKALQLVVKECKPKAKIVDICEKGDAFIREQTGNMYKNSKKKIERGVAFPTCLSVNNTVCHFSPLASDTSELEEGDMVKIDMGCHIDGFIAVVAHTHVVQSGPITGKQADVVAAANTAAEVALRLVRPGKKNKDVSDAIQKVAAAYDCKIVEGVLSHQLKQFVIDGNKVILSVSNPDTRVDDAEFEENEVYAVDIVASTGEGKPKLLDEKQTTIYKRAVDKNYHLKMKASRFIFSEINQRFPILPFTTRALEEKRARLGLVECVNHDLLQPYPVLYEKPGDYVAHIKFTVLLMPNGSDRITSHPLQELQSTKTIDDPEIKAWLALGTKTKKKGGGKKKKGKKGDKAEGGAEGEAMDASTNGGAS

SEQ ID NO: 21206 - protein, 395 aa, Allium cepa
MSDDEVIEEKELDLSSSDVVTKYKSAAEIVNKALKLVVSECKPKAKIVDICEKGDSFIREQAGNMYKNAKKKIERGVAFPTCISVNNTVCHFSPVAGDETVLEENDIVKIDMGCHIDGFIAVVAHTHILQEGPITGRAADVIAAANTAAEVALRLVRPGKKNTDVTEAIQKVAAAYDCKIAEGVLSHQLKQFVIDGNKVVLSVSNPDTKVDVVEFEENEVYAIDIVTSTGEGKPKLLDEKQTTIYKRAVDKNYNLKMKASRFIFSEISQKFPIMPFTARALEEKRARLGLLECMNHDLLQPYPVLHEKPGDLVAHIKFTVLLMPNGSDRITSLPLQQLQPTKTIDDPEIKAWLALSTKTKKKGGGKKKKGKKSETAEAGEAVPMEEEASDAVAAK

SEQ ID NO: 21207 - protein, 397 aa, Triphysaria pusilla
MSDEEREEKELDLTSPEVVTKYKSAAEIVNKALQLVLSECKPNVKIVDICEKGDAFIREQSGNTYKNVKKKIERGIAFPTCISVNNTVCHYSPLASDECVLESGDIVKVDMGCHIDGFIAVVAHTHVIQQGPVTGRGADVIAAANTAAEVALRLVRPGKKNKDVAEAIQKVAAAYDCKIVEGVLSHQMKQFVIDGNKVVLSVSAPDTRVEEAEFEENEVYSIDIVTSTGEGKPKLLDEKQTTIYKRAVDRNYNLKMKASRFIFSEISQKFPIMPFSARALEEKRARLGLVECVNHDLLQPYPVLYEKPGDFVAHIKFTVLLMPNGSDRVTSHPLQELQPTKTIDDPEIKAWLALATKTKKKGGGKKKKGKKGDKAEDAAVVEVEPMDTTAADGGADS

SEQ ID NO: 21208 - protein, 406 aa, Rosmarinus officinalis
MSSLKRKCETMSDEEREEQELDLTNSEVVTKYKAAAEIVNKALQLVLSECRPKAKIVDLCEKADSFIREQTGNMYKKVKKKIERGVAFPTCISVNNTVCHFSPLNGDESVLEAGDIVKIDMGCHIDGFIAVVAHTHVLQQVPVTGRAADVIAAANTAAEVALRLVRPGKKNKDVSDAIQKVAAAYDCKIVEGVLSHQMKQFVIDGNKVVLSATGPDTRVDDAEFEENEVYAIDIVTSTGEGKPKLLDEKQTTIYKRAVDKNYLLKMKASRFIFSEISQKFPIMPFSARALEEKRVRLGLVECVNHDLLQPYPVLHEKPGDLVAHIKFTVLLLPNGSDRVTSHPLQELQPTKTIDDPEIKAWLALGTKSRKKGGGKKKKGKKGDKAENTAEAEPMEEEAPNGATSQE

SEQ ID NO: 21209 - protein, 387 aa, Olea europaea
MSDEEREERELDLTSPEVVTKYKSAAEIVNKALQLVLSECKPKAKIIDICEKGDSFIGEQTGNMYKNVKKKIERGVAFPTCISVNNTVCHFSPLASDDTVLEEGDLLKIDMGCHIDGFIAVVAHTHVLQQGPVTGRAADVIAAANTAAEVALRLVRPGKNNKDVTEAIQKVAAAYDCKIVEGVLSHQMKQFVIDGNKVVLSVSAPETRVDDAEFEENEVYAIDIVTSTGEGKPKLLDEKQTTIYKRAVDKSYHLKMKASRFIYSEINQKFPIMPFTARALEEKRSRLGLVECLNHDLLEPYPVLHEKPGDLVAHIKFTVLLMPNGSDRITSHSLQELQPTKTVDDPEIKAWLSLGTKAKKKGGGKKKKGKKADEAANEEAKDENSQG

SEQ ID NO: 21210 - protein, 396 aa, Triphysaria pusilla
MSDEEREEKELDLTSPEVVTKYKSAAEIVNKALQLVLSECKPNVKIVDICEKGDAFIREQSGNTYKNVKKKIERGIAFPTCISVNNTVCHYSPLASDECVLESGDIVKVDMGCHIDGFIAVVAHTHVIQQGPVTGRGADVIAAANTAAEVALRLVRPGKKNKDVAEAIQKVAAAYDCKIVEGVLSHQMKQFVIDGNKVVLSVSAPDTRVEEAEFEENEVYSIDIVTSTGEGKPKLLDEKQTTIYKRAVDKNYHLKMKASRFIFSEISQKFPIMPFSARALEEKRARLGLVECVNHELLQPYPALYEKPGDFVAHIKFTVLLMPNGSDRVTSHPLQELQPTKTIDDPEIKAWLALATKTKKKGGGKKKKGKKGDKAEDAAAATAADAEPMDTAADNS

SEQ ID NO: 21211 - protein, 389 aa, Chrysanthemum coronarium
MSSDDERGEEKELDLSSPEVVTKYKSAAEIVNKALQLVLSECKPNVKIVDLCEKGDSYIREQTGSMYKNVKKKIERGVAFPTCLSVNNTVGHFSPLASDESVLKEGDILKIDMGCHIDGFIAVVAHTHVLQEGPVTGRAADVIAAANTAAEVALRLVRPGKKNQDVTEAIQKVAAAYDCKIVEGVLSHQLKQFVIDGNKVVLSVANPDTRVDDAEFEENEVYGIDIVTSTGDGKPKLLDEKQTTIYKRAVDKNYHLKMKASRFIFSEISQKFPIMPFSARALEEKRARLGLVECVNHELLQPYPVLHEKPGDFVAHIKFTVLLMPNGSDRITSHPLQELQTTKNVDDPEVKAWLALPVKSKKKGGGKKKKAKKGDEAEPMDETNDGAQA

SEQ ID NO: 21212 - protein, 392 aa, Setaria italica
MSSDDEVREEKELDLSSNDVVTKYKAAAEILNNALKLVVSECKPKAKIVDLCEKGDSFIREQTGNVYKNAKRKIERGIAFPTCVSVNNTVCHFSPLATDEAVLEENDMVKIDMGCHIDGFIAVVAHTHVITNGPVTGRAADVLAAANTAAEVAMRLVRPGKKNKDVTEAIQKVAAAYDCKIVEGVLSHQLKQFVIDGNKVVLSVSNADTKVDDAEFEENEVYAIDIVTSTGEGKPKLLDEKQTTIYKRAVDKNYHLKMKASRFIFSEISQKFPIMPFTARALEEKRARLGLVECMNHELLQPYPVLHEKPGDLVAHIKFTVLLMPNGSDKVTSHQLQELQPTKSIEDNAEIKAWLALGTKSKKKGGGKKKKGKKGDAAEPMEEATNGAPSQE

SEQ ID NO: 21213 - protein, 394 aa, Conyza canadensis
MSDDERGEEKELDLSSPEVVTKYKSAAEIVNKAMQLVLSECKPHAKIVDICEKGDSYMREQTGSMYKNVKKKIERGVAFPTCLSVNNTVSHFSPLASDETILKEGDILKIDMGCHIDGFIALLAHTHVLQEGPVTGKAADVIAAANTAAEVALRLVRPGKKNQDVTEAIQKVAAAYDCNIVEGVLSHQLKQFVIDGNKVVLSVSNPDTRVDDAEFEENEVYAIDIVTSTGDGKPKLLDEKQTTVYKRAVDKSYYLKMKASRFIFSEISQNFPIMPFSARALEEKRARLGLVECVNHELLQPYPVLHEKPGDFVAHIKFTVLLMPNGSDRITSHSLQELQTTKTVDDPEIKAWLALPVKSKKKGGGKKKKGKKGEKAEGDEAVVMDESTNGGAQG

SEQ ID NO: 21214 - protein, 389 aa, Euphorbia peplus
MSDEEREEELDLSSPEVVTKYKSAAEIVNKALQIVIAECKPKAKIVDLCEKGDAYIREQTGNMYKNVKKKIERGVAFPTCISVNSTVCHFSPLASDESVLEDGDMIKIDMGCHIDGFIAVVAHTHVLQAGPVTGRAADVIAAANTAAEVALRLVKPGKKNKDVTEAIQKVASAYDCKIVEGVLSHQLKQFVIDGNKVILSSSNPETRVDEAEFEENEVYSIDIVTSTGEGKPKLLDEKHTTIYKRAVDKNYHLKMKASRFIFSEISQKFPIMPFSARALEEKRARLGLVECVNHDLLQPYPVLYEKPGDLVAHIKFTVLLMPNGSDRITSHSLQELQPTKTIEDPDIKAWLALAIKKKKGGGKKKKAKKGEKAEEAEPMDATNEAETQE

SEQ ID NO: 21215 - protein, 394 aa, Allium cepa
MSDDEVIEEKELDLSSSDVVTKYKSAAEIVNKALKLVVSECKPKAKIVDICEKGDSFIREQAGNMYKNAKKKIERGVAFPTCISVNNTVCHFSPVAGDETVLEENDIVKIDMGCHIDGFIAVVAHTHILQKEPITGRAADVIAAANTAAEVALRLVRPGKKNTDVTEAIQKVAAAYDCKIAEGVLSHQLKQFVIDGNKVVLSVSNPDTKVDVVEFEENEVYAIDIVTSTGEGKPKLLDEKQTTIYKRAVDKNYNLKMKASRFIFSEISQKFPIMPFTARALEEKRARLGLLECMNHDLLQPYPVLHEKAGDLVAHIKFTVLLMPNGSDRITSHPLQQLQPTKTIDDPEIKAWLALSTKTKKKGGGKKKKGKKSEATEGSEAVPMEEASDAAAAK

SEQ ID NO: 21216 - protein, 387 aa, Petunia hybrida
MSDDEREERELDLTSPEVVTKYKSAAEIVNKALQLVLSECKPKAKIVDLCEKGDAYIKEQTGNMYKNVKKKIERGVAFPTCISVNNTVCHFSPLSSDETVLEEGDILKIDLGCHIDGFIAVVGHTHVLQEGPVTGRAADVIAAANTAAEVALRLVRPGKKNSDVTEAIQKVAAAYDCKIVEGVLSHQMKQFVIDGNKVVLSVSNPETRVDEAEFEENEVYSIDIVTSTGEGKPKLLDEKQTTIYKRAVDKSYNLKMKASRFIFSEISQKFPIMPFTARDLEEKRARLGLVECVNHELLQPYPVLHEKPGDLVAHIKFTVLLMPNGSDRVTSHALQELNPTKTVENEPEIKAWLALPVKTKKKGGGKKKKGKKGEKTEESSQAEPMEG

SEQ ID NO: 21217 - protein, 386 aa, Lippia dulcis
MSDEEREEKELDLTSPEVVTKYKSAAEIVNKALQLVLSECKPKTKIVDLCEKGDAFIREQTGNMYKNVKKKIERGVAFPTCISVNNTVCHFSPLASDETVLEEGDILKIDLGCHIDGFIAVVGHTHILQQGPVTGRAADVIAAANTAAEVALRLVRPGKKNKDVTEAIQKVAAAYDCKIVEGVLSHQMKQFVIDGNKVVLSVSSPDTRVDEAEFEENEIYAIDIVTSTGEGKPKLLGEKQTTIYKRAVDKNYHLKMKASRFIFSEISQKFPIMPFSARALEEKRARLGLVECVNHELLQPYPVLHEKPGDLVAHIKFTVLLMPNGSDRITTHPLQELQPTKTIDDPEIKAWLALPTKTKKKGGGKKKKARKVTRLKIIQLMLSLWT

SEQ ID NO: 21218 - protein, 395 aa, Fragaria vesca
MSSDDEREEKELDLTSPEVVTKYKSAAEIVNKALQRVIAECKPKAKIVDVCEIGDSFIREQTGNMYKSAKKKIERGVAFPTSISVNNTVCHFSPLATDETVFEEGDIVKIDMGCHIDGFIAIVAHTHALQTGPITGRAADVIAAANTAAEVALRLVKPGKKNKDVTEAIQKVAAAYDCKIVEGVLSHQMKQFVIDANKVILSISNPETRVEEAEFEENEVYAIDIVASTGEGKPKLLDEKQTTIYKRAVDKNYHLKMKASRFIFSEITQKFPLMPFTARALEEKRARLGLFECVNHDLLQPYPVLHEKPGDIVAHIKFTVLLMPNGSDRITSHPLQELQPTKQVDDPEIKAWLALGTKTKKKGGGKKKKGKKGDKVEGSTEAEPMDATNDAETQG

SEQ ID NO: 21219 - protein, 404 aa, Populus trichocarpa
MSSDDEREERELDLTSPEVVTKYKSAAEIVNKALQLAISECKPKAKIVDICEKGDSYIREQSGNMYKNVKKKIERGVAFPTCVSVNNTVCHFSPLASDESVLEEGDVVKIDMGCHIDGFIAVVGHTHVLQSGPVTGRAADVIAAANTAAEVALRLVRPGKKNKDVTEAIQKVAAAYDCKIVEGVLSHQLKQFVIDGNKVILSVSNPDTRVDDAEFEENEVYAVDIFTSTGEGKPKLLDEKTTTIYKRAVDKNYHLKMKSSRFIFSEINQKFPIMPFSARALEEKRARLGLVECVNHDLLQPYPVLHEKPGDCVAHIKFTVLLMPNGSDRITSHALQELQPTKTIDDPEIKAWLALGTKTKKKGGGKKKKAKKAGEKAEEATEAEPMDATEAEPMDATTNGATAV

SEQ ID NO: 21220 - protein, 392 aa, Aristolochia fimbriata
MSDDEAKEEKELDLSSTDVVNKYKSAAEIVNKALQLVLSECKPKAKVVDVCEKGDAFIREQTGNMYKNTKKKIERGVAFPTCISINNTVCHFSPLASDEAVMEENDIVKIDMGCHIDGFIAVVAHTHVLQEGPVTGRAADVIAAANTAAEVALRLVRPGRKNKDVTEAIQKVAAAYDCKIVEGVLSHQLKQFVIDGNKVILSVSNPDTRVDDAEFEENEVYAVDIVTSTGDGKPRLLDEKQTTIYKRAVDKNYHLKMKSSRFIFSEISQKFPIMPFTARALEEKRARLGLVECVNHDLLQPYPVLHEKPGDLVAHIKFTVLLMPNGSDRITSHPLQDLQSTKSVQDDPEIKAWLALGTRTKKKGGGKKKKGKKGEASEAEPMETTEPANAAS

SEQ ID NO: 21221 - protein, 395 aa, Musa acuminata
MSDDEAREEKELDLTSPDVVTKYKSAAEIVNKALQLVISKCKPKAKIVDLCEQGDAFIREQAGNIYKNVKRKIERGVAFPTCISVNNTVCHFSPLASDDAVLEENDIVKIDMGCHIDGFIAVVGHTHVIQEGPVTGRAADVIAAANTAAEVALRLVRPGKKNKDVTEAIQKVAAAYDCKIVEGVLSHQLKQFVIDGNKVIISVTNPETRVDEFEFEENEVYAIDVVTSTGEGKPKLLDEKQTTIYKRAVDKNYHLKMKSSRFIFSEISQKFPIMPFSARALEEKRARLGLVECVNHDLLQPYPVLHEKPGDLVAHIKFTVLLMPNGSDRITSHPLQQLLPSKMIDDNAEIKAWMALGTKTKKKGGGKKKKGKKGDAQDDAAESEPKDSASNSTAA

SEQ ID NO: 21222 - protein, 394 aa, Centaurea maculosa
SDDERAEEKELDLTSPEVVTKYKSAAEIVNKALQLVLSECKPKAKIVDICEKGDTYIREQTGSMYKNVKKKIERGVAFPTCLSVNNTVCHYSPLASDETVLEEGDILKIDMGCHIDGFIAVVGHTHVLQQGPVTGRAADAIAAANTAAEVALRLVKPGKKNQDVTEAIQKVAAAYDCKIVEGVLSHQLKQFVIDGNKVVLSVSNPETRVDDAEFEENEVYAIDIVTSTGDGKPKLLDEKQTTIYKRAVDKNYHLKMKASRFIFSEINQKYPIMPFSARALEEKRARLGLVECVNHELLQPYPVLHEKPGDFVAHIKFTVLLMPNGSDRITSHTLQELQPTKTVDDPEIKAWLSLPVKSKKKGGGKKKKGKKAEKGEGEVEPMEESSNDQGQGQE

SEQ ID NO: 21223 - protein, 393 aa, Cichorium intybus
MSDDERGEEKELDLSSPEVVTKYKSAAEIVNKALQLVLSECKPKAKIVDICEKGDSYVREQTGNMYKNVKKKIERGVAFPTCLSVNNTVCHYSPLASDETVLEEGDILKIDMGCHIDGFIAVVAHTHVLQQGPVTGRVADAIAAANTAAEVALRLVKPGKKNQDVTEAIQKVAAAYDCKIVEGVLSHQLKQFVIDGNKVVLSVSNPETRVDEAEFEENEVYAIDIVTSTGDGKPKLLDEKQTTIYKRAVDRSYHLKMKASRFIFSEINQKFPIMPFSARALEEKRARLGLVECVNHELLQPYPVLHEKPGDFVAHIKFTVLLMPNGSDRITSHNLQELQPTKTVDDPEIKSWLALPVKSKKKGGGKKKKGKRAEKGEGDVEVMEVDASNGGGQ

SEQ ID NO: 21224 - protein, 392 aa, Gossypium hirsutum
MSDDEREEKELDLTSPEVVTKYKSAAEIVNKALQLVVKECKPKTKIVDICEKGDAFIREQTGNMYKNAKRKIERGVAFPTCLSVNNIVCHFSPLASDTSELQEGDMVKIDMGCHIDGFIAVVAHTHVVQEGPVNDRKADVIAAANTAAEVALRLVRPGKKNKDVTDAIQKVAAAYDCKIVEGVLSHQLKQFVIDGNKVILSVSNPDTRVDDAEFEENEVYAVDIVASTGEGKPKLLDEKQTTIYKRAVDKNYHLKMKTSRFIFSEINQKFPILPFTARALEEKRARLGLVECVNHDLLQPYPVLHEKPGDYVAHIKFTVLLMPNGSDRITLHPLQELQPTKTIDDPEIKGWLALGTKTKKKGGGKKKKGKKNEGDKADAEPMDASKTDAAAS

SEQ ID NO: 21225 - protein, 393 aa, Gossypium hirsutum
MSDDEREEKELDLTSSEVVTKYKSAAAIVSKALQLVVKECKPKAKIVDICEKGDAFIREQTGNMYKNSKKKIERGVAFPTCLSVNNTVCHFSPLASDTSELEEGDMVKIDMGCHIDGFIAVVAHTHVVQSGPITGKQADVVAAANTAAEVALRLVRPGKKNKDVSDAIQKVAAAYDCKIVEGVLSHQLKQFVIDGNKVILSVSNPDTRVDDAEFEENEAYAVDIVASTGEGKPKLLDEKQTTIFKRAVDKNYHLKMKASRFIFSEINQRFPILPFTARALEEKRARLGLVECVNHDLLQPYPVLYEKPGDYVAHIKFTVLLMPNGSDRITSHPLQELQPTKMIDDPEIKAWLALGTKTKKKGGGKKKKGKKGDKAEGGAEGEAMDASTNGGAS

SEQ ID NO: 21226 - protein, 392 aa, Echinochloa colona
MSSDDEVREEKELDLSSNDVVTKYKAAAEILNNALKLVVSECKPKAKIVDLCEKGDAFIREQTGNVYKNAKRKIERGIAFPTCVSVNNTVCHFSPLATDEAVLEENDMVKIDMGCHIDGFIAVVAHTHVITNGPVTGRAADVLAAANTAAEVAMRLVRPGKKNKDVTEAIQKVAAAYDCKIVEGVLSHQLKQFVIDGNKVVLSVSNADTKVDDAEFEENEVYAIDIVTSTGEGKPKLLDEKQTTIYKRAVDKNYHLKMKASRFIFSEISQKFPIMPFTARALEEKRARLGLVECMNHELLQPYPVLHEKPGDLVAHIKFTVLLMPNGSDKVTSHPLQELQATKSIEDNAEIKAWLALGTKSKKKGGGKKKKGKKGDAAEPMEEATNGAPSQE

SEQ ID NO: 21227 - protein, 392 aa, Linum usitatissimum
MSDEEREEKELDLTSPEVVTKYKGAAEIVNKALQLVVKECKPKAKIVDLCEKGDSYIIGQTGNMYKNAKKKIEKGVAFPTCVSVNNTVGHFSPLASDERVLEEGDIVKIDMGCHIDGFIAVVAHTHVVHDGAVTGRAADVIAAANTAAEVALRLVRPGKKNQDVTDAIQKVAAAYDCKIVEGVLSHQLKQFVIDGNKVILSVANPDTRVDDIEFEENEVYAVDIVTSTGEGKPKLLDEKETTIYKRAVDKNYHLKLKASRFIFSEISQKFPIMPFTARALEEKRARLGLVECVNHELLQPYPVLHEKPGDYVAHIKFTVLLMPNGSDRITSHPLQELQSSKTIEDPEIKAWLALGTKTKKKGGGKKKKGKKGEKAEDAAEAEAEPMDETSKA

SEQ ID NO: 21228 - protein, 392 aa, Pennisetum glaucum
MSSDDEVREEKELDLSSNDVVTKYKAAAEILNNALKLVVSECKPKAKIVDLCEKGDTFIREQTGNVYKNAKRKIERGIAFPTCVSVNNTVCHFSPLATDEAVLEENDMVKIDMGCHIDGFIAVVAHTHVITNGPVTGRAADVLAAANTAAEVAMRLVRPGKKNKDVTEAIQKVAAAYDCKIVEGVLSHQLKQFVIDGNKVVLSVSNADTKVDDAEFEENEVYAIDIVTSTGEGKPKLLDEKQTTIYKRAVDKNYHLKMKASRFIFSEISQKFPIMPFTARALEEKRARLGLVECMNHELLQPYPVLHEKPGDLVAHIKFTVLLMPNGSDKVTSHQLQELQPTKSIEDNAEIKAWLALGTKSKKKGGGKKKKGKKGDAAEPMEEATNGAPSQE

SEQ ID NO: 21229 - protein, 392 aa, Sorghum bicolor
MSSDDEVREEKELDLSSNDVVTKYKAAAEILNNALKLVVSECKPKAKIVDLCEKGDSFIREQTGNVYKNAKRKIERGIAFPTCVSVNNTVCHFSPLATDDAVLEENDMVKIDMGCHIDGFIAVVAHTHVITSGPVTGRAADVLAAANTAAEVAVRLVRPGKKNKDVTEAIQKVAAAYDCKIVEGVLSHQLKQFVIDGNKVVLSVSNADTKVDDAEFEENEVYAIDIVTSTGEGKPKLLDEKQTTIYKRAVDKNYHLKMKASRFIFSEISQKFPIMPFTARALEEKRARLGLVECMNHELLQPYPVLHEKPGDLVAHIKFTVLLMPNGSDKITSHPLQELKPTKSIEDNAEIKAWLALGTKSKKKGGGKKKKGKKGDAAEADPMEATNGASQE

SEQ ID NO: 21230 - protein, 390 aa, Solanum lycopersicum
MSDDEREEKELDLTSPEVVTKYKGAAEIVNKALQLVVSECKAKAKIVDLCEKGDAFIKEQTGNMYKNVKKKIERGVAFPTCISVNNTVCHFSPLSSDETVLEEGDIVKIDMGCHIDGFIAVVAHTHVVQGGPVTGRAADVLAAANTAAEVALRLVRPGRKNSDVTEAIQKVAAAYDCKIVEGVLSHQMKQFVIDGNKVVLSVSNPDTRVDDAEFEENEVYSVDIVTSTGEGKPKLLDEKQTTIYKRAVDKSYNLKMKASRFIFSEISQKFPIMPFTARDLEEKRARLGLVECVNHDLLQPYPVLHEKPGDLVAHIKFTVLLMPNGSDRITSHALQELSPAKTIDDEPEIKTWLALPVKTKKKGGGKKKKGKKGESCQAEPMEGEPNVAES

SEQ ID NO: 21231 - protein, 390 aa, Ambrosia trifida
MSDDERVEEKELDLSSPEVVTKYKSAAEIVNKALQLVLAECKPKAKIVDICEKGDSYIREQTGNMYKNVKKKIERGVAFPTCLSVNNTVCHFSPLASDETVLEEGDILKIDMGCHIDGFIAVVAHTHVLQQGPVTGRAADVIAAANTAAEVALRLVKPGKKNQDVTKAIQEVAAAYDCKIVEGVLSHQLKQFVIDGNKVVLSVSNPETRVDDAEFEENEVYAIDIVTSTGDGKPKLLDEKQTTIYKRAVDKSYHLKMKASRFIYSDICQNFPIMPFSARALEEKRARLGLVECVNHELLQPYPVLHEKPGDFVAHIKFTVLLMPNGSDRITSHALQELQPTKTVDDHPEIKAWLSLPVKSKKKGGGKKKKGKQAEKAAEGEEAKPEAMET

SEQ ID NO: 21232 - protein, 392 aa, Echinochloa colona
MSSDDEVREEKELDLSSNDVVTKYKAAAEILNNALKLVVSECKPKTKIVDLCEKGDAFIREQTGNVYKNAKRKIERGIAFPTCVSVNNTVCHFSPLATDEAVLEENDMVKIDMGCHIDGFIAVVAHTHVITNGPVTGRAADVLAAANTAAEVAMRLVRPGKKNKDVTEAIQKVAAAYDCKIVEGVLSHQLKQFVIDGNKVVLSVSNADTKVDDAEFEENEVYAIDIVTSTGEGKPKLLDEKQTTIYKRAVDKNYHLKMKASRFIFSEISQKFPIMPFTARALEEKRARLGLVECMNHELLQPYPVLHEKPGDLVAHIKFTVLLMPNGSDKVTSHPLQELQATKSIEDNAEIKAWLALGTKSKKKGGGKKKKGKKGDAAEPMEEATNGAPSQE

SEQ ID NO: 21233 - protein, 395 aa, Secale cereale
MSSDEEVREEKELDLSSNEVVTKYKTAAEIINKALKLVLAECKPKAKIVDICEKGDNFITEQTGNVYKNVKRKIERGIAFPTCVSVNNTVCHFSPLATDDSVLQENDMVKIDMACHIDGFIAVVAHTHVIKAGPVTGRAADVLAAANTAAEVAMRLVRPGKKNKDVTEAIQKVAAAYDCKIVEGVLSHQLKQFVIDGNKVVLSVANADTKVDDAEFEENEVYAIDIVTSTGEGKPKLLDEKQTTIYKRAVDKNYHLKMKASRFIFSEISQKFPIMPFTARALEEKRARLGLVECMNHELLQPYPVLHEKPGDLVAHIKFTVLLMPNGSDKITSHPLQQLEPSKSIEDDVEIKAWLALGTKSKKKGGGKKKKGKKGDAAEAAAEPMEVSKEAPSQE

SEQ ID NO: 21234 - protein, 375 aa, Cannabis sativa
MSDDEREEKELDLSSPEVVTKYKGAAEIVNKALQLVLSECKPKAKIVDLCEKGDSYIREQTGNMYKNAKKKIEKGVAFPTCISVNNTVCHFSPLASDESVLEDGDILKIDMGCHIDGFIAVVAHTHVLHEGPVTGRAADVIAAANTAAEVALRLVRPGKNNKDVTEAIQKVAAAYDCKIVEGVLSHQLKQFVIDGNKVVLSVSSPDTRVDDAEFEENEVYAIDIVTSTGDGKPKLLDEKQTTIYKRAVDKSYHLKMKASRFIFSEINQKFPIMPFTARALEEKRARLGLVECVNHDLLQPYPVLHEKPGDFVAHIKFTVLLMPNGSDRITSHSLQELQPTKTVEDPEIKAWLALATKSKKKGGGKKKKGKLFECA

SEQ ID NO: 21235 - protein, 396 aa, Daucus carota
MSDEEREEVELDLSSPEVVTKYKLAAETVNKALQLVLSECRPNAKIVDICEKGDSYIRTQTSNMYKNVKKKVEKGIAFPTCLSVNNTVCHFSPLASDETVLEEGDVLKIDMGCHVDGFIAVVAHTHVLQDGKVTGKAANVIAAANTAAEVALRLVRPGKKNKDVSEAVQKVAAAYDCKIVEGVLSHQLKQFVIDGNKVVLSVSNPDTRVDDAEFEENEVYAIDIVTSTGEGKPKLVDEKQTTVYKRAVDKNYHLKMKASRFIFSEISQNFPIMPFTARALEEKRARLGLVECVNHDLLQPYPVLHEKPGDYVAHIKFTVLLMPNGSDRITSHPLQELEPTKAIEDPEIKAWLALGIKTKKKGGGKKKKGKKSEKCDDSAEPGPVDAPPTNGSAPQE

SEQ ID NO: 21236 - protein, 393 aa, Cichorium intybus
MSDDERGEEKELDLSSPEVVTKYKSAAEIVNKALQLVLSECKPKVKIVDICEKGDSYIREQTGNMYKNVKKKIERGVAFPTCLSVNNTVCHYSPLASDETVLEEGDILKIDMGCHIDGFIAVVAHTHVLQQGPVTGRVADAIAAANTAAEVALRLVKPGKKNQDVTEAIQKVAAAYDCKIVEGVLSHQLKQFVIDGNKVVLSVSNPETRVDEAEFEENEVYAIDIVTSTGDGKPKLLDEKQTTIYKRAVDRSYHLKMKASRFIFSEINQKFPIMPFSARALEEKRARLGLVECVNHELLQPYPVLHEKPGDFVAHIKFTVLLMPNGSDRITSHNLQELQPTKTVDDPEIKSWLSLPVKSKKKGGGKKKKGKRAEKGEGDVEVMEVDASNGGGQ

SEQ ID NO: 21237 - protein, 393 aa, Cichorium intybus
MSDDERGEEKELDLSSPEVVTKYKSAAEIVNKALQLVLSECKPKVKIVDICEKGDSYIREQTGNMYKNVKKKIERGVAFPTCLSVNNTVCHYSPLASDETVLEELDILKIDMGCHIDGFIAVVAHTHVLQQGPVTGRVADAIAAANTAAEVALRLVKPGKKNQDVTEAIQKVAAAYDCKIVEGVLSHQLKQFVIDGNKVVLSVSNPETRVDEAEFEENEVYAIDIVTSTGDGKPKLLDEKQTTIYKRAVDRSYHLKMKASRFIFSEINQKFPIMPFSARALEEKRARLGLVECVNHELLQPYPVLHEKPGDFVAHIKFTVLLMPNGSDRITSHNLQELQPTKTVDDPEIKSWLALPVKSKKKGGGKKKKGKRAEKGEGDVEVMEVDASNGGGQ

SEQ ID NO: 21238 - protein, 382 aa, Flaveria ramosissima
MSDDERGEEKELDLSSPEVVTKYKLAAEIVNKALQLVLSECKPKAKIVDICEKGDSYIREQTGSMYKNVKKKIERGVAFPTCLSVNNTVCHFSPLASDETVLEEGDILKIDMGCHIDGFIAVVAHTHVLQQGPVTGRAADVIAAANTAAEVALRLVKPGKKNQDVTKAIQEVAAAYDCKIVEGVLSHQLKQFVIDGNKVVLSVSNPETRVDDAEFEENEVYAIDIVTSTGEGKPKLLDEKQTTIYKRAVDKSYHLKMKASRFIFSEISQNFPIMPFSARALEEKRARLGLVECVNHELLQPYPVLHEKPGDFVAHIKFTVLLMPNGSDRITSHGLQELQPTKTVDDHPEIKGWLSLPVKTKKKGGGKKKKGKRVERVKARLR

SEQ ID NO: 21239 - protein, 392 aa, Gossypium raimondii
MSDDEREEKELDLTSPEVVTKYKSAAEIVNKALQLVVKECKPKTKIVDICEKGDAFIREQTGNMYKNAKRKIERGVAFPTCLSVNNTVCHFSPLASDTSELQEGDMVKIDMGCHIDGFIAVVAHTHVVQEGLVNDRKADVIAAANTAAEVALRLVRPGKKNKDVTDAIQKVAAAYDCKIVEGVLSHQLKQFVIDGNKVILSVSNPDTRVDDAEFEENEVYAVDIVASTGEGKPKLLDEKQTTIYKRAVDKNYHLKMKTSRFIFSEINQKFPILPFTARALEEKRARLGLVECVNHDLLQPYPVLHEKPGDYVAHIKFTVLLMPNGSDRITLHPLQKLQPTKTIDDPEIKGWLALGTKTKKKGGGKKKKGKKNEGDKADAEPMDASKTDAAAS

SEQ ID NO: 21240 - protein, 387 aa, Tropaeolum majus
MSDDEREEKELDLSSPEVVTKYKSAAEIVNKALQHVLLECKPKAKIVDICEKGDAFIIEQTGNMYKNAKKKIERGVAFPTCISVNNTVCHFSPLASDESVLEEGDLVKIDMGCHIDGFIAVVGHTHVLSEGPITGRKADVIAAANTAAEVALRLVRPGKKNKDVTEAIQKVAAAYDCKIVEGVLSHQLKQFVIDGNKVILSVSNPETRVDDAEFEENEVYSIDIVTSTGDGKPKLLDEKQTTIYKRAVDKSYHLKMKASRFIFSEISQKFPIMPFTARALEEKRARLGLLECVNHDLLQPYPVLHEKPGDIVAHVKFTVLLMPNGSDRVTSHALQELQPTKTIDDPEIKAWLALGTKTKKKGGGKKKKAAKKGETQEEASTEAVPME

SEQ ID NO: 21241 - protein, 393 aa, Capsicum annuum
MSDDEREEKELDLTSPEVVTKYKGAAEIVNKALQLVVSECKPKAKIVDLCEKGDAFIKEQTGNMYKNVKKKIERGVAFPTCISVNNTVCHFSPLSSDETVLEEGDMVKFDMGCHIDGFIAVVAHTHVLQGGPITGRAAHVLAAANTAAEVALRLVRPGKKNSDVTEAIQKVAAAYDCKIVEGVLSHQMKQFVIDGNKVVLSVSNPDTRVDDAEFEENEVYSIDIVTSTGEGKPKLLDEKQTTIYKRAVDKSYNLKMKASRFIFSEISQKFPIMPFTARDLEEKRARLGLVECVNHDLLQPYPVLHEKPGDLVAHIKFTVLLMPNGSDRITSHALQEVTPAKSIDDEPEIKTWLALPVKTKKKGGGKKKKGKKSEKEESSQAEPREGESNVAES

SEQ ID NO: 21242 - protein, 388 aa, Helianthus annuus
MSDDERVEEKELDLSSPEVVTKYKSAAEIVNKALQLVLSECKPKAKIVDICEKGDSYIREQTGNMYKNVKKKIERGVAFPTCLSVNNTVCHFSPLASDETVLEEGDILKIDMGCHIDGFIAVVAHTHMLQQGPVTGRAADVIAAANTAAEVALRLVKPGKKNQDVTKAIQEVAAAYDCKIVEGVLSHQLKQFVIDGNKVVLSVSNPETRVDDAEFEENEVYAIDIVTSTGDGKPKLLDEKQTTIYKRAVDKSYHLKMKASRFIYSDICQNFPIMPFSARALEEKRARLGLVECVNHELLQPYPVLHEKPGDFVAHIKFTVLLMPNGSDRITSHGLQELQPTKTVDDHPEIKAWLSLPVKSKKKGGGKKKKGKQVEKVEGEAKPEPMET

SEQ ID NO: 21243 - protein, 394 aa, Hordeum vulgare
  Sequence also found in Organisms: Leymus cinereus x Leymus triticoides
MSSDEEVREEKELDLSSNEVVTKYKTAAEIINKALKLVLSECKPKAKIVDICEKGDNFITEQTGNVYKNVKRKIERGIAFPTCVSVNNTVCHFSPLATDDSVLEENDMVKIDMACHIDGFIAVVAHTHVIKAGPVTGRAADVLAAANTAAEVAMRLVRPGKKNKDVTEAIQKVAAAYDCKIVEGVLSHQLKQFVIDGNKVVLSVSNADTKVDDAEFEENEVYAIDIVTSTGEGKPKLLDEKQTTIYKRAVDKNYHLKMKASRFIFSEISQKFPIMPFTARALEEKRARLGLVECMNHELLQPYPVLHEKQGDLVAHIKFTVLLMPNGSDKITSHPLQQLEPSKSIEDDAEIKAWLALGTKSKKKGGGKKKKGKKGDAAEAAEPMEVSKDAPSQE

SEQ ID NO: 21244 - protein, 390 aa, Chrysanthemum coronarium
MSSDDERGEEKELDLSSPEVVTKYKSAAEIVNKALQLVLSQCKPDMKIVDLCEIGDSYIREQTGSMYKNVKKKIERGVAFPTCLSVNNTIGHFSPLASDETVLKEGDILKIDMGCHIDGFIAVVAHTHVLQEGPVTGRAADVIAAANTAAEVALRLVRPGKKNQDVTEAIQKVAAAYDCKIVEGVLSHQLKQFVIDGNKVVLSVANPENRVDDAEFEENEVYAIDIVTSTGDGKPKLLDEKQTTIYKRAVDKNYHLKMKASRFIFSEISQKFPIMPFSARALEEKRARLGLVECVNHELLQPYPVLHEKPGDFVAHIKFTVLLMPNGSDRITSHSLQELQPTKNVDDPEVKAWLALPVKSKKKGGGKKKKAAKKGEEAEPMDETNDGAQA

SEQ ID NO: 21245 - protein, 392 aa, Gossypium hirsutum
MSDDEREEKELDLTSPEVVTKYKSAAEIVNKALQLVVKECKPKTKIVDICEKGDAFIREQTGNMYKNAKRKIERGVAFPTCLSVNNTVCHFSPLASDTSELQEGDMVKIDMGCHIDGFIAVVAHTHVVQEGLVNDRKADVIAAANTAAEVALRLVRPGKKNKDVTDAIQKVAAAYDCKIVEGVLSHQLKQFVIDGNKVILSVSNPDTRVDDAEFEENEVYAVDIVASTGEGKPKLLDEKQTTIYKRAVDKNYHLKMKTSRFIFSEINQKFPILPFTARALEEKRARLGLVECVNHDLLQPYPVLHEKPGDYVAHIKFTVLLMPNGSDRITLHPMQKLQPTKTIDDPEIKGWLALGTKTKKKGGGKKKKGKKNEGDKADAEPMDASKTDAAAS

SEQ ID NO: 21246 - protein, 383 aa, Eschscholzia californica
EEKELDLTSPEVVTKYKSAAEIVNKALQLIISECKPKAKIVDLCEKGDAFIREQTGNMYKNMKKKIERGIAFPTCISVNNTVCHFSPLASDETVVEEGDLLKIDLGCHIDGFIVVVGHTHVIHDGPITGRQADVIAAANTAAEVALRLVRPGKKNKDVTEAIQKVAAAYDCKIVEGVLSHQLKQFVIDGNKVILSVSNPETKVDDVEFEENEVYAVDIVTSTGDGKPKLLDEKQTTIYKRAVDKNYHLKMKASRFIFSEISQKFPIMPFSARALEEKRARLGLVECVNHDLLQPYPVLHEKPGDFVAQIKFTVLLMPNGSDRVTSHAVQELQPTKTIEDDAEIKAWLSLGTKKKKGGGKKKKGKKEDTKIDESAEAEPMDSTS

SEQ ID NO: 21247 - protein, 372 aa, Carpinus betulus
MSDDEREEKELDLTSPEVVTKYKSAAEIVNKALQLVLSECKPKAKIVDLCEKGDSYIREQTGNMYKNVKKKIERGVAFPTCISVNNTVCHFSPLASDEAVFEEGDMLKIDMGCHIDGFIAVVAHTHVLQDGPVTGRAADVIAAANTAAEVALRLVRPGKKNKDVTDAIQKVAAAYDCKIVEGVLSHQLKQFVIDGNKVVLSVAGPETRVDDAEFEENEVYAVDIVTSTGEGKPKLLDEKQTTIYKRAVDRNYHLKMKASRFIFSEINQKFPIMPFTARALEEKRARLGLVECVNHELLQPYPVLHEKPGDYVAHIKFTVLLMPNGSDRVTSHPLQELQPTKTIDDPEIKTWLALGTKTKKKGGRKEEERVKG

SEQ ID NO: 21248 - protein, 394 aa, Brachypodium distachyon
MSSDDEVREEKELDLSSNEVVTKYKTAAEIINKALKLVLSECKPKAKIVDICEKGDNFITEQTGNVYKNVKKKIERGIAFPTCLSVNNTVCHFSPLATDDAILEENDMVKIDMGCHIDGFIAVVAHTHVIKDGPVTGRAADVLAAANTAAEVAMRLVRPGKNNKDVTEAIQKVATAYDCKIVEGVLSHQLKQFVIDGNKVVLSVSNADTKVDDAEFEENEVYAIDIVTSTGEGKPKLLDEKQTTIYKRAVDKNYHLKMKASRFIFSEISQKFPIMPFTARVLEEKRARLGLVECMNHELLQPYPVLHEKPGDLVAHIKFTVLLMPNGSDRVTSHSLQELQPSKSIEDNAEIKGWLALGTKTKKKGGGKKKKGKKGDAAEAEPMEEGSKDAPSQE

SEQ ID NO: 21249 - protein, 391 aa, Festuca arundinacea
MSSDEEVREEKELDLSSNEVVTKYKTAAEIINKALKLVLAECKPKAKIVDICEKGDNFITEQTGNVYKNVKRKIERGIAFPTCLSVNNTVCHFSPLATDDTVLQENDMVKIDMGCHIDGFIAVVAHTHVIKDGPVAGRAADVLAAANTAAEVAMRLVRPGKKNKDVTEAIQKVAAAYDCKIVEGVLSHQLKQFVIDGNKVVLSVSNADTKVDDAEFEENEVYAIDIVTSTGEGKPKLLDEKQTTIYKRAVDKNYHLKMKASRFIFSEISQKFPIMPFTARALEEKRARLGLVECMNHELLQPYPVLHEKQGDLVAHIKFTVLLMPNGSDKVTSHSLQELQPTISIEDNAEIKGWLALGTKSKKKGGGKKKKGKKGDSAEAEPMDVSEQSQE

SEQ ID NO: 21250 - protein, 392 aa, Panicum virgatum
MSSDDEVREEKELDLSSNDVVTKYKAAAEILNNALKLVVSECKPKAKIVDLCEKGDAFIREQTGNVYKNAKRKIERGIAFPTCVSVNNTVCHFSPLATDEAVLEENDMVKIDMGCHIDGFIAVVAHTHVITNGPVTGRAADVLAAANTAAEVAMRLVRPGKKNKDVTEAIQKVAAAYDCKIVEGVLSHQLKQFVIDGNKVVLSVSNADTKVDDAEFEENEVYAIDIVTSTGEGKPKLLDEKQTTIYKRAVDKNYHLKMKASRFIFSEISQKFPIMPFTARALEEKRARLGLVECMNHGLLQPYPVLHEKPGDLVAHIKFTVLLMPNGSNKITSHPLQELKPTKSIEDNAEIKAWLALGTKSKKKGGGKKKKGKKGDAAEPMEEATNGAPSQE

SEQ ID NO: 21251 - protein, 387 aa, Flaveria ramosissima
MSDDEAREEKELDLSSPEVVTKYKLAAEIVNKALQLVLSECKPKAKIVDICEKGDSYIREQTGSMYKNVKKKIERGVAFPACLSVNNTVCHYSPLASDETVLEEGDIVKIDMGCHIDGFIAVVAHTHVLQQGPVTGRAADAIAAANTAAEVALRLVKPGKKNQDVTEAIQKVAAAYDCKIVEGVLSHQLKQFVIDGNKVVLSVSNPETRVDDAEFEENEVYAIDIVTSTGEGKPKLLDEKQTTIYKRAVDKSYHLKLKASRFIFSEISQNFPIMPFSSRALEEKRARLGLVECVNHELLQPYPVLHEKQGDFVAHIKFTVLLMPNGSDRITSHALQELQPTKTVDDPEIKGWLSLPVKSKKKGGGKKKKGKGVEKSEGMEESANGGA

SEQ ID NO: 21252 - protein, 394 aa, Tragopogon dubius
MSDDERGEEKELDLSSPEVVTKYKSAAEIVNKALQLVLSECKPKAKIVDICEKGDSYIREQTGNMYKNVKKKIERGVAFPTCLSVNNTVCHYSPLASDETVLEEGDILKIDMGCHIDGFIAVVGHTHVLQQGPVTGRAADAIAAANTAAEVALRLVKPGKKNQDVTDAIQKVAAAYDCKIVEGVLSHQLKQFVIDGNKVVLSVSNPETRVDDAEFEENEVYAIDIFTSTGDGKPRLLDERETTIYKRAVDRNYHLKMKASRFIFSEINQKFPIMPFSARALEEKRARLGLVECVNHELLQPYPVLHEKNGDFVAHIKFTVLLMPNGSDRITSHTLQELQPTKTVDDPEIKSWLSLPVKSKKKGGGKKKKGKRAEKGEGEGEAMEEDTTNGGGAE

SEQ ID NO: 21253 - protein, 393 aa, Daucus carota
MSDDEKELDLTSPEVVTKYKLAAETVNKAMQLVLAACKPKAKIVDICEKGDAFIKEHTGNMYKNVKKKIEKGIAFPTCLSVNNTVCHFSPLASDEAVLEEGDVLKIDMGCHVDGFIAVVAHTHVLQDGKVTGKAANVIAAANTAAEVALRLVRPGKKNKDVSEAVQKVAAAYDCKIVEGVLSHQLKQFVIDGNKVVLSVSNPDTRVDDAEFEENEVYAIDIVTSTGEGKPKLVDEKQTTVYKRAVDKNYHLKMKASRFIFSEISQNFPIMPFTARALEEKRARLGLVECVNHDLLQPYPVLHEKPGDYVAHIKFTVLLMPNGSDRITSHPLQELEPTKAIEDPEIKAWLALGIKTKKKGGGKKKKGKKSEKCDDSAEPGPVDAPPTNGSAPQE

SEQ ID NO: 21254 - protein, 394 aa, Coffea canephora
MSDDEREERELDLTSPEVVTKYKSAAEIVNKALQLVLSECKPATKIVDLCEKGDAFIKEQTGNMYKNVKKKIERGVAFPTCISVNNTVCHVSPLASDEAVLQQGDIVKIDMGCHIDGFIAVVAHTHVLQDGPVTGRAADVIAAANTAAEVALRLVRPGKKNQEVAEAIQKVAAAYDCRIVEGVLSHQMKQFVIDGNKVVLNVSSPEMRVDDAEFEENEVYAIDIVTSTGDGKPKLLDEKQTTIYKRAVDKNYNLKMKASRFIFSEISQKFPIMPFTARDLEEKRARLGLVECVNHDLLQPYPVLHEKPGDLVAHIKFTVLLMPNGSDRITSHSLQELNPTKTADSDPEIKAWLSLPIKTKKKGGGKKKKGKKGDKAEDSMQTEPVDEAANGASQ

SEQ ID NO: 21255 - protein, 389 aa, Echinacea purpurea
MSDDEVREEKELDLSSPEVVTKYKLAAEIVNKALQLVLSECKPKAKIVDICEKGDSYIRDQTGSMYKNVKKKIERGVAFPTCLSVNNCVCHYSPLASDETLLEEGDILKIDMGCHIDGFIAVVAHTHALQEGPVTGRAADVLAAANTAAEVALRLVKPGKKNQDVTKAIQEVAAAYDCKIVEGVLSHQLKQFVIDGNKVVLSVSNPETRVDDAEFEENEVYAIDIVTSAGDGKPKLLDEKQTTIYKRAVDKSYHLKMKASRFIYSDICQNFPIMPFSARALEEKRARLGLVECVNHELLQPYPVLHEKPGDFVAHIKFTVLLMPNGSDRITSHGLQELQPTKTIDDHPEIKDWLSLPVKTKKKGGGKKKKGKQAEKGEGEAKAEPMEET

SEQ ID NO: 21256 - protein, 387 aa, Nicotiana benthamiana
MSDDEREERELDLTSPEVVTKYKSAAEIVNKALQLVLSECKPKAKIVDLCEKGDAFIKEQSGNMYKNVKKKIERGVAFPTCISVNNTVCHFSPLSSDETVLEEGDILKIDMGCQIDGFIAVVGHTHVLHEGPVTGRAADVIAAANTAAEVALRLVRPGKKNSDVTEAIQKVAAAYDCKIVEGVLSHQMKQFVIDGNKVVLSVTNPETRVDEAEFEENEVYSIDIVTSTGEGKPKLLDEKQTTIYKRAVDKSYNLKMKASRFIFSEISQKFPIMPFTARDLEEKRARLGLVECVNHELLQPYPVLHEKPGDLVAHIKFTVLLMPNGSDRVTSHALQELKTAKTIENEPEIKAWLALPVKTKKKGGGKKKKGKKGDKTEDSSQAEPTEG

SEQ ID NO: 21257 - protein, 390 aa, Solanum phureja
MSDDEREEKELDLTSSEVVTKYKGAAEIVNKALQLVVSECKPKAKIVDLCEKGDAFIKEQTGNMYKNVKKKIERGVAFPTCISVNNTVCHFSPLSSDETILEEGDMVKIDMGCHIDGFIAVVAHTHVVQGGPVTGRAADVLAAANTAAEVALRLVRPGRKNSDVTEAIQKVAAAYDCKIVEGVLSHQMKQFVIDGNKVVLSVSNPDTRVDDAEFEENEVYSIDIVTSTGDGKPKLLDEKQTTIYKRAVDKSYNLKMKASRFIFSEISQKFPIMPFTARDLEEKRARLGLVECVNHDLLQPYPVLHEKPGDLVAHIKFTVLLMPNGSDRITSHALQELTLAKTIEDEPEIKTWLALPVKTKKKGGGKKKKGKKGESSQAEPMEGEPNVAES

SEQ ID NO: 21258 - protein, 394 aa, Triticum aestivum
MSSDEEVREEKELDLSSNEVVTKYKTAAEIINKALKLVLSECKPKAKIVDICEKGDNFITEQTGNVYKNVKRKIERGIAFPTCVSVNNTVCHFSPLATDDSVLEENDMVKIDMACHIDGFIAVVAHTHVIKAGPVTGRAANVLAAANTAAEVAMRLVRPGKKNKDVTEAIQKVAAAYDCKIVEGVLSHQLKQFVIDGNKVVLSVSNADTKVDDAEFEENEVYAIDIVTSTGEGKPKLLDEKQTTIYKRAVDKNYHLKMKASRFIFSEISQKFPIMPFTARALEEKRARLGLVECMNHELLQPYPVLHEKQGDLVAHIKFTVLLMPNGSDKITSHPLQQLEPSKSIEGDAEIKAWLALGTKSKKKGGGKKKKGKKGDAAEVAEPMEVSKDAPSQE

SEQ ID NO: 21259 - protein, 394 aa, Triticum aestivum
MSSDEEVREEKELDLSSNEVVTKYKTAAEIINKALKLVLSECKPKAKIVDICEKGDNFITEQTGNVYKNVKRKIERGIAFPTCVSVNNTVCHFSPLATDDSVLEENDMVKIDMACHIDGFIAVVAHTHVIKGGPVTGRAANVLAAANTAAEVAMRLVRPGKKNKDVTEAIQKVAAAYDCKIVEGVLSHQLKQFVIDGNKVVLSVSNADTKVDDAEFEENEVYAIDIVTSTGEGKPKLLDEKQTTIYKRAVDKNYHLKMKASRFIFSEISQKFPIMPFTARALEEKRARLGLVECMNHELLQPYPVLHEKQGDLVAHIKFTVLLMPNGSDKITSHPLQQLEPSKSIEGDAEIKAWLALGTKSKKKGGGKKKKGKKGDAAEVAEPMEVSKDAPSQE

SEQ ID NO: 21260 - protein, 390 aa, Festuca arundinacea
MSSDEEVREEKELDLSSNEVVTKYKTAAEIINKALKLVLSECKTKAKIVDICEKGDNFITEQTGNVYKNVKRKIERGIAFPTCLSVNNTVCHFSPLGTDDTVLQENDMVKIDMGCHIDGFIAVVAHTHVIKDGPVAGRAADVLAAANTAAEVAMRLVRPGKKNKDVTEAIQKVAAAYDCKIVEGVLSHQLKQFVIDGNKVVLSVSNADTKVDDAEFEENEVYAIDIVTSTGEGKPKLLDEKQTTIYKRAVDKNYHLKMKASRFIFSEISQKFPIMPFTARALEEKRARLGLVECMNHELLQPYPVLHEKQGDLVAHIKFTVLLMPNGSDKVTSHSVQELQPITSIEDNAEIKGWLALGTKSKKKGGGKKKKGKKGDAAEAEPMDVSTSQE

SEQ ID NO: 21261 - protein, 391 aa, Lolium multiflorum
MSSDEEVREEKELDLSSNEVVTKYKTAAEIINKALKLVLAECKPKAKIVDICEKGDNFITEQTGNVYKNVKRKIERGIAFPTCLSVNNTVCHFSPLATDDTVLQENDMVKIDMGCHIDGFIAVVAHTHVIKDGPVAGRAADVLAAASTAAEVAMRLVRPGKKNKDVTEAIQKVAAAYDCKIVEGVLSHQLKQFVIDGNKVVLSVSNADTKVDDAEFEENEVYAIDIVTSTGEGKPKLLDEKQTTIYKRAVDKNYHLKMKASRFIFSEISQKFPIMPFTARALEEKRARLGLVECMNHELLQPYPVLHEKQGDLVAHIKFTVLLMPNGSDKVTSHSLQELKPTISIEDNAEIKGWLALGTKSKKKGGGKKKKGKKGDAAEAEPMDVSEQSQE

SEQ ID NO: 21262 - protein, 394 aa, Zea mays
MSSDDEVREEKELDLSSNDVVTKYKAAAEILNNALKIVVSQCKPKVKIVDLCEKGDSFIREQTGNVYKNAKRKIERGIAFPTCVSVNDTVCHFSPLATDDAVLEENDMVKIDMGCHIDGFIAVVAHTHVITNGPVTGRAGDVLAAANTAAEVAMRLVRPGKKNKDVTEAIQKVAAAYDCKIVEGVLSHQLKQFVIDGNKVVLSVSNADTKVDDAEFEENEVYAIDIVTSTGEGKPKLLDEKQTTIYKRAVDKNYHLKMKASRFIFSEISQKFPIMPFTARALEEKRARLGLVECMNHELLQPYPVLHEKPGDLVAHIKFTVLLMPNGSDKITSHPLQELKPTKSIEDNAEIKAWLALGTKSKKKGGGKKKKGKKGDAAEADPMEEATNGATSQE

SEQ ID NO: 21263 - protein, 391 aa, Daucus carota
MSDEEREEVELDLSSPEVVTKYKLAAETVNKALQLVLSECRPNAKIVDICEKGDSYIRTQTSNMYKNVKKKVEKGIAFPTCLSVNNTVCHFSPLASDETVLEEGDVLKIDMGCHIDGFIAVVAHTHVLQQGKVTGRVADVLAAANTAAEVALRLVRPGKKNKDVTEAIQKVAAAYDCKVVEGVLSHQLKQFVIDGNKVVLSVPNADTRVDEAEFEENEVYAVDIVASSGDGKPKMLDEKQTTVYKRAVDQNYHLKMKASRFIFSEISQKFPIMPFTARALEEKRARFGLVECVNHDLLQPYPVLHEKPGTIVAHIKFTVLLMPNGSDRVTSHPVQELEPTKTIDDPEIKAWLALGTKTKKKGGGKKKKGKKDKVEGAAEEPMDVTNGGAQE

SEQ ID NO: 21264 - protein, 387 aa, Flaveria ramosissima
MSDDEAREEKELDLSSPEVVTKYKLAAEIVNKAMQLVLSECKPKAKIVDICEKGDSYIREQTGSMYKNVKKKIERGVAFPTCLSVNNTVCHYSPLASDEAVLEEGDIVKIDMGCHIDGFIAVVAHTHVLQQGPVTGRAADAIAAANTAAEVALRLVKPGKKNQDVTEAIQKVAAAYDCKIVEGVLSHQLKQFVIDGNKVVLSVSNPETRVDDAEFEENEVYAIDIVTSTGDGKPKLLDEKQTTIYKRAVDKSYHLKLKASRFIFSEISQNFPIMPFSSRALEEKRARLGLVECVNHELLQPYPVLHEKQGDFVAHIKFTVLLMPNGSDRITSHTLQELQPTKTVDDPEIKGWLSLPVKSKKKGGGKKKKGKGVEKSEGMEESSNGGA

SEQ ID NO: 21265 - protein, 374 aa, Elaeis guineensis
MSDDEAREEKELDLTSPDVVTKYKCAAEILNKALQLVVSECKPKANIVDICEKGDAFIKEQTGNVYKNVKKKIEKGIAFPTCISVNNTVCHFSPLGGDETVLEENDVVKIDMGCHIDGFIAIAAHTHVLRDGPITGRAADVIAAANTAAEVALRLVRPGKKNKDVAEAIQKVASAYDCKVVEGVLSHQLKQFVIDGNKVILSISNPETRVDDAEFEENEVYAIDIVTSTGEGKPKLLDEKQTTIYKRAVDKSYHLKMKASRFIFSEINQKFPILPFTARALDEKRARLGLVECVNHDLLQPYPVLHEKPGDLVAHIKFTVLLMPNGSDRITSHPLQELKPTKSIDDNPEIKAWLALGTKTKKKGGGKKKKGKKD

SEQ ID NO: 21266 - protein, 395 aa, Papaver somniferum
MSDDEVGKDEKELDLSSPEVVTKYKSAAEIINKALQLVLTECKPKVKIVDLCEKGDAFIKEQTGKLYKNTKKKIERGVAFPTCISVNNTVCHFSPLASDGTLLEEGDILKIDMGCHIDGFIAVVAHTHVLQEGPVTGRAADVIAAANTAAEVALRLVRPGKKNKEVTEAIQKVAAAYDCKIVEGVLSHQLKQFVIDGNKVVLSVPGPETRVDDAEFQENEVYAIDIVASTGEGKPRLLDERQTTVYKRAVGESYQLKMKASRFIFSEINQNFPIMPFSARALEEKRARLGLVECVNHELLQPYPVLHEKPGDLVAHIKFTVLLMPNGSDRITSHALQEVQPTKTLDEEPEIKAWLALATKSKKKGGGKKKKGKKGDKAEESTEAEPMDATTASQE

SEQ ID NO: 21267 - protein, 395 aa, Chenopodium quinoa
MSDDEREEKELDLSYPEVVTKYKSAADIVNRALQLVVAECKPKAKIVDLCEKGDNFIREQTANMYKNVKKKIERGVAFPTCLSVNNVVCHFSPLASDDSVLEEGDLVKIDMGCHIDGFIAVVAHTHVIQEGPVTGRQADVLAATNTAAEVALRLVRPGKKNKDVTEAIQKVAAAYDCKIVEGVLSHQMKQFVIDGNKVVLSVSNPDMRVDDAEFEENEVYSVDIAASTGEGKPRMLDEKQTTIYKRAVDKNYHLKMKASRFILSEINQKFPIMPFTARALEEKRARLGLVECVNHDLLQPYPVLYEKPGDYVAHIKFTVLLMPNGSDRVTSYPLQELQPTKSTDDPEIKAWLALGTKTKKKGGGKKKKAKKGEKSGAEESADAEPMDANGATAEN

SEQ ID NO: 21268 - protein, 401 aa, Triphysaria pusilla
MSDEEREEKELDLTSPEVVTKYKSAAEIVNKALQLVLSECKPNVKIVDICEKGDAFIREQSGNTYKNVKKKIERGIAFPTCISVNNTVCHYSPLASDECVLESGDIVKVDMGCHIDGFIAVVAHTHVIQQGPVTGRGADVIAAANTAAEVALRLVRPGKKNKDVAEALQKVAAAYDCKIVEGVLSHQMKQFVIDGNKVALSVSAPDTRVEEAEFEENEVYSIDIVTSTGEGKPKLLDEKQTTIYKRAVDRNYNLKMKASRFIFSEISQKFPIMPFSARALEEKRARLGLVECVNHDLLQPYPVLYEKPGDFVAHIKFTVLLMPNGSDRVTSHPLQELQPTKTIDDPEIKAWLALATKTKKKGGGKKKKGKKGDKAEDAAAAAAAAATAADAEPMDTAADNS

SEQ ID NO: 21269 - protein, 368 aa, Tabernaemontana elegans
MSDDEREERELDLTSPEVVTKYKSAAEIVNKALQLVVSECKPKAKIVDICEKGDAFIREQTGNMYKNVKKKIERGVAFPTCISVNNTVCHVSPLASDEAILEEGDVVKIDMGCHIDGFIAVVAHTHVLQEGPVTGRAADVIAAANTAAEVALRLVRPGKKNKDVTEAVQKVAAAYDCKIVEGVLSHQMKQFVIDGNKVILSVSNPETRVDDAEFEENEVYSIDIVTSTGEGKPKLLDEKQTTIYKRAVDKNYHLKMKASRFIFSEISQKFPIMPFTARALEEKRARLGLVECVNHDLLQPYPVLHEKPGDIVAHIKYTVLLMPNGSDRITSHSLQELQPTKAVDDPEIKAWLALGTKTKKKGGGRKER

SEQ ID NO: 21270 - protein, 391 aa, Triphysaria pusilla
MLDEDREEKELDLTSPEVVTKYKSAAEIVNKALQLVLSECNPGAVIVDLCEKGDAFIREQTGNVYKNVKKKIERGVAFPTCISVNNTVCHYSPLASDDTRLMGGDILKIDMGCHIDGFIAVVAHTHVLQQGPITGRAADVIAAANTAAEVALRLVRPGKKNKDVTEAIQKVAAAYECKIVEGVLSHQMKQFVIDGNKVVLSASGPETKVDEAEFEENEVYSIDIVTSTGEGKPKLLDEKQTTVYKRAVDRNYHLKMKASRFIFSEISQNFPIMPFSARALEEKRARLGLVECVNHELLQPYPVLHEKPGDLVAHIKFTVLLMPNGSDRITSHPLQELQSTKMVDDPDIKAWLALGTKTKKKGGGKKKKAKKTDKPEDAAAVSEPMDIASQE

SEQ ID NO: 21271 - protein, 392 aa, Amborella trichopoda
MSDDEAKEERELDLTSPDVVTKYKTAAEILNKALQLVVSECKPKAKVVDICEKGDAFIREQTGSVYKNAKKKIERGVAFPTCISVNNTVCHFSPLASDETTLVENDMVKIDMGCHIDGFIAVVAHTHVLQEGPVTGRAADVIAAANTAAEVALRLVRPGRKNKDVTEAIQKVAAAYDCKIVEGVLSHQLKQFVIDGNKVILNVSNPETRVDDAEFEENEVYAIDIVTSTGDGKPKLLDEKQTTIYKRAVDKNYHLKMKSSRFIFSEINQRFPIMPFTARVLEEKRARLGLVECVNHELLQPYPVLHEKPGDLVAHIKFTVLLLPSGSDRITSHPLQDLQPSKQIEDPEIKAWLALGTKTKKKPKKKKAGKKGEVDTEMGDTSVNGGGSNDPE

SEQ ID NO: 21272 - protein, 395 aa, Papaver somniferum
MSDDEVGKDEKELDLSSPEVVTKYKSAAEIINKALQLVLTECKPKVKIVDLCEKGDAFIKEQTGKLYKNTKKKIERGVAFPTCISVNNTVCHFSPLASDGTLLEEGDILKIDMGCHIDGFIAVVAHTHVLQEGPVTGRAADVIAAANTAAEVALRLVRPGKKNKEVTEAIQKVAAAYDCKIVEGVLSHQLKQFVIDGSKVVLSVPGPETRVDDAEFQENEVYAIDIVASTGEGKPRLLDERQTTVYKRAVGESYQLKMKASRFIFSEINQNFPIMPFSARALEEKRARLGLVECVNHELLQPYPVLHEKPGDLVAHIKFTVLLMPNGSDRITSHALQEVQPTKTLDEEPEIKAWLALATKSKKKGGGKKKKGKKGDKAEESTEAEPMDATTASQE

SEQ ID NO: 21273 - protein, 362 aa, Castanea mollissima
MSSDEEREEKELDLTSPEVVTKYKSAAEIINKALQLVVSECKPKAKIVDVCEIGDSYIREQTGNMYKNVKKKIERGVAFPTCISVNNTVCHFSPLASDETVMEAGDVLKIDLGCHIDGFIAVVAHTHVLQDGPVTGKAADVIAAANTAAEVALRLVRPGKKNKDVTDAIQKVAAAYDCKIVEGVLSHQLKQFVIDGNKVVLSVSNTDTRVDDAEFEENEVYAIDIVTSSGEGKPKLLDEKQTTIYKRAVDKNYHLKMKASRFIFSEISQKFPIMPFTARALEEKRARLGLVECVNHELLQPYPVLHEKPGDYVAHIKFTVLLMPNGSDRVTSHPLQELQPTKTIDDPEIKAWLALATKTKKK

SEQ ID NO: 21274 - protein, 370 aa, Flaveria ramosissima
MSDDEAREEKELDLSSPEVVTKYKLAAEIVNKALQLVLSECKPKAKIVDICEKGDSYIREQTGSMYKNVKKKIERGVAFPTCLSVNNTVCHYSPLASDEAVLEEGDIVKIDMGCHIDGFIAVVAHTHVLQKGPVTGRAADAIAAANTAAEVALRLVKPGKKNQDVTEAIQKVAAAYDCKIVEGVLSHQLKQFVIDGNKVVLSVSNPETRVDDAEFEENEVYAIDIVTSTGDGKPKLLDEKQTTIYKRAVDKSYHLKLKASRFIFSEISQNFPIMPFSSRALEEKRARLGLVECVNHELLQPYPVLHEKQGDFVAHIKFTVLLMPNGSDRITSHTLQELQPTKTVDDPEIKGWLSLPVKSKKKGGGKKKKG

SEQ ID NO: 21275 - protein, 393 aa, Oryza sativa
MSSDDEVREEKELDLSSSDVVTKYKDAADIINNALKLVVSLCKPKAKIVDICEKGDSYIREQTGNIYKNVKRKIERGVAFPTCVSVNNTVCHFSPLATDEAVLEENDMVKIDMGCHIDGFIAVVAHTHVIHDGAVTGKAADVLAAANTAAEVALRLVRPGKKNKDVTEAIQKVAAAYDCKIVEGVLSHQLKQFVIDGNKVVLSVSNADTKVDDAEFEENEVYAIDIVTSTGEGKPKLLDEKQTTIYKRAVDKNYHLKMKASRFIFSEISQKFPIMPFTARALEEKRARLGLVECMNHELLQPYPVLHEKPGDLVAHIKFTVLLLPSGSQRVTSHSLQELQPTKSIEDNAEIKAWLALGTKTKKKSGAKKKKGKKGDAAEAVPMEEGSNDANKE

SEQ ID NO: 21276 - protein, 391 aa, Avena sativa
MSSDEEVREEKELDLSSNEVVTKYKTAAEIINKALKLVLSECKPKAKIVDICEKGDNYITEQTGNVYKNVKRKIERGIAFPTCLSVNNTVCHFSPLATDDTVLEANDMVKIDMGCHIDGFIAVVAHTHVIRDGQVTGRAADVLAAANTAAEVAMRLVRPGKKNKDVTEAIQKVAAAYDCKIVEGVLSHQLKQFVIDGNKVVLSVSNADTKVDDAEFEENEVYAIDIVTSTGEGKPKLLDEKQTTIYKRAVDKNYHLKMKASRFIFSEISQKFPIMPFTARALEEKRARLGLVECMNHELLQPYPVLHEKQGDLVAHIKFTVLLMPNGSDKVTSHPLQDLLPTISIEDNAEIKGWLALGTKSKKKGGGKKKKGKKGDAAEPMEVSKDAPGQE

SEQ ID NO: 21277 - protein, 392 aa, Petroselinum crispum
MADDEKELDLTSPEVVNKYKLAAETVNKALQLVLAACKPKAKIVDICEKGDAFIKEHTGNMYKNVKKKIEKGIAFPTCLSVNNTVCHFSPLASDETVLEEGDVLKIDMGCHVDGFIAVVAHTHVLQDGKVTGKAADVIAAANTAAEVALRLVRPGKKNKDVSEAVQKVAAAYDCKIVEGVLSHQLKQFVIDGNKVVLSVPNPDTRVDDAEFEENEVYAIDIVTSTGEGKPKLLDEKQTTVYKRAVDKNYHLKMKASRFIFSEISQNFPIMPFTARALEEKRARLGLVECVNHDLLQPYPVLHEKPGDYVAHIKFTVLLMSNGSDRITSHPLQELKPTKAIDDPEIKAWLALGIKTKKKGGGRKKKAKKSEKGEDSAEPGPADAPADGSAPQE

SEQ ID NO: 21278 - protein, 391 aa, Avena sativa
MSSDEEVREEKELDLSSNEVVTKYKTAAEIINKALKLVLSECKPKAKIVDICEKGDNYITEQTGNVYKNVKRKIERGIAFPTCLSVNNTVCHFSPLATDDTVLEANDMVKIDMGCHIDGFIAVVAHTHVIRDGQVTGRAADVLAAANTAAEVAMRLVRPGKKNKDVTEAIQKVAAAYDCKIVEGVLSHQLKQFVIDGNKVVLSVSNADTKVDDAEFEENEVYAIDIVTSTGEGKPKLLDEKQTTIYKRAVDKNYHLKMKASRFIFSEISQKFPIMPFTARALEEKRARLGLVECMNHELLQPYPVLHEKQGDLVAHIKFTVLLMPNGSDKVTSHALQDLLPTISIEDNAEIKGWLALGTKSKKKGGGKKKKGKKGDAAEPMEVSKDAPGQE

SEQ ID NO: 21279 - protein, 392 aa, Silene vulgaris
MSDDEREEKELDLSSSEVVTKYKSAAEILNKALQIVVSECKPKAKIVDLCEKGDAYIIEQTGKMYKNVKKKIERGIAFPTCISVNNVVCHYSPLATDESVLVEGDVVKVDMGCHIDGFIATVAHTHVIQEGPITGRKADVIAATNTAAEVALRLVRPGKKNKDVTDAIQKVAAAYDCKIVEGVLSHQLKQFVIDGNKVVLSVSSPEMRVDDAEFEENEVYAIDIFASTGEGKPRMLDEKQTTVYKRAVDRNYHLKMKASRFIFSEISQKFPIMPFTARALEEKRARLGLLECVNHDLLQPYPVLHEKSGDFVAHIKFTVLLMPNGSDRITSHSLQELQPTKTIDDPEIKAWLAMGTKTKKKGGGKKKKGKKGDKPEGEESTSAEPMDASNES

SEQ ID NO: 21280 - protein, 404 aa, Flaveria ramosissima
MSDDEAREEKELDLSSPEVVTKYKLAAEIVNKALQLVLSECKPKAKIVDICEKGDSYIREQTGSMYKNVKKKIERGVAFPTCLSVNNTVCHYSPLASDETVLEEGDIVKIDMGCHIDGFIAVVAHTHVLQQGPVTGRAADAIAAANTAAEVALRLVKPGKKNQDVTEAIQKVAAAYDCKIVEGVLSHQLKQFVIDGNKVVLSVSNPETRVDDAEFEENEVYAIDIVTSTGDGKPKLLDEKQTTIYKRAVDKSYHLKLKASRFIFSEISQNFPIMPFSSRALEEKRARLGLVECVNHELLQPYPVLHEKQGDFVAHIKFTVLLMPNGSDRITSHTLQELQPTKTVDDPEIKGWLSLPVKSKKKGGGKKKKGKGVEKVKEWKNHQMVVLKDLVEWEILKLNFVLFV

SEQ ID NO: 21281 - protein, 395 aa, Tabernaemontana elegans
MSDEEREERELDLTSHEVVTKYKSAAEIVNKAFQLVLSECKPKVKIVDLCEKGDAFIKEQAGNMYKNVKKKIERGVAFPTCISVNNTVCHFSPLASDETILEEGDLVKIDMGCHIDGFIAVVAHTHVLQEGPVTGRAADVIAAANTAAEVALRLVRPGRKNQDVTEAIQKVAAAYDCRIVEGVLSHQMKQFVIDGNKVVLNVSSPEMRVDDAEFEENEVYSIDIVTSTGEGKPKLLDEKQTTIYKRAVEKTYNLKMKASRYIFSEISQKFPIMPFTARDLEEKRARFGLVECVNHDLLQPYPVLHEKPGDLVAHIKFTVLLMPNGSDRITSHPLQELKPTKSIENDPEIKAWLSLPVKTKKKGGGKKKKGKKVEKAEDSSQTEAMDEETNGAATQ

SEQ ID NO: 21282 - protein, 367 aa, Cirsium arvense
MSDDERGEEKELDLTSSEVVTKYKSAAEIVNKALQLVLSECKPKAKIVDICEKGDSYIREQTGNMYKNVKKKIERGIAFPTCLSVNNTVCHYSPLASDETVLEEGDILKIDMGCHIDGFIAVVGHTHVLQQGPVTGRAADAIAAANTAAEVALRLVKPGKKNQDVTEAIQKVAAAYDCKIVEGVLSHQLKQFVIDGNKVVLSVSNPETRVDDAEFEENEVYAIDIVTSTGDGKPKLLDEKQTTIYKRAVDKNYHLKMKASRFIFSEINQNYPIMPFSARALEEKRARLGLVECVNHELLQPYPVLHEKPGDFVAHIKFTVLLMPNGSDRITSHTLQEFQPTKTVDDPEIKAWLSLPVKTKKKGGGKK

SEQ ID NO: 21283 - protein, 365 aa, Olea europaea
MSDEEREERELDLTSPEVVTKYKSAAEIVNKALQLVLSECKPKAKIVDICEKGDSFIREQAGNMYKNVKKKIERGVAFPTCISVNNTVCHFSPLASDETVLEEGDVLKIDMGCHIDGFIAVVAHTHVLQQGLVTGRAADVIAAANTAAEVALRLVRPGKNNKDVTEAIQKVAAAYDCKIVEGVLSHQMKQFVIDGNKVVLSVSAPETRVDDAEFEENEVYAIDIVTSTGEGKPKLLDEKQTTIYKRAVDKNYHLKMKASRFIYSEINQKFPIMPFTARALEEKRTRLGLVECLNHDLLEPYPVLHEKPGDLVAHIKFTVLLMPNGSDRITSHYLQELQPAKTVDDPEIKAWLSLGTKTKKKGGGK

SEQ ID NO: 21284 - protein, 382 aa, Helianthus annuus
MSDDETREEKELDLSSPEVVTKYKLAAEVVNKALQLVLSECKPKAKIVDICDKGDSYIKEQTGSMYKNVKKKIERGVAFPTCLSVNNTVCHFSPLASDETVLEEGDIVKIDMGCHIDGFIAVVGHTHVLQQGPVTGRAADAIAAANTAAEVALRLVKPGKKNQDVTEAIQKVAAAYDCKIVEGVLSHQLKQFVIDGNKVVLSVSNPETRVDDAEFEENEVYSIDIVTSTGDGKPKLFDEKQTTIYKRAVDKSYHLKMKASRFVFSEISQNFPIMPFSARVLEEKRARFGLLECVNHELLQPYPVLHEKPGDFVAQIKFTVLLMPNGSDRITSHTLQELQPTKTVDDPEIKGWLSLPVKSKKKGGGKKKKGKGVEKSEAMEET

SEQ ID NO: 21285 - protein, 402 aa, Nicotiana benthamiana
MSDDEREEKELDLTSPEVVTKYKSAAEIVNKALQLVVSECKPKAKIVDLCEKGDAFIKEQTGNMYKNVKKKIERGVAFPTCISVNNTVCHFSPLSSDETVLEEGDMVKIDMGCHLDGFIAVVGHTHVLQEGPVTGRAADVVAAANTAAEVALRLVRPGRKNSDVTEAIQIVAAAYDCKIVEGVLSHQMKQFVIDGNKVVLSVSNPETRVEDAEFEENEVYSIDIVTSTGEGKPKLLDEKQTTIYKRAVDKSYNLKMKASRFIFSEISQKFPVMPFTARDLEEKRARLGLVECVNHELLQPYPVLHEKPGDLVAHIKFTVLLMPNGSDRITTHTLQELKPAKTIDDEPESLTDDEPEIKTWLALPVKSKKKGGGKKKKAKKSEKTEELSQAEPMEGESNGAES

SEQ ID NO: 21286 - protein, 372 aa, Nicotiana benthamiana
MSDDEREERELDLTSPEVVTKYKSAAEIVNKALQLVLSECKPKATIVDLCEKGDAFIKEQTGNMYKNVKKKIERGVAFPTCISVNSTVCHFSPLSSDETVLEEGDILKIDMGCHIDGFIAVVGHTHVLHEGPVTGRAADVIAAANTAAEVALRLVRPGKKNSDVTEAIQKVAAAYDCKIVEGVLSHQMKQFVIDGNKVVLSVTNPETRVDEAEFEENEVYSIDIVTSTGEGKPKLLNEKQTTIYKRAVDKSYNLKMKASRFIFSEISQKFPIMPFTARDLEEKRARLGLVECVNHELLQPYPVLHEKPGDLVAHIKFTVLLMPNGSDRVTSHALQELKPAKTIENEPEIKAWLALPVKTKKKGGGKKKKGNS

SEQ ID NO: 21287 - protein, 382 aa, Helianthus annuus
MSDDETREEKELDLSSPEVVTKYKLAAEVVNKALQLVLSECKPKAKIVDICDKGDSYIKEQAGSMYKNVKKKTERGVAFPTCLSVNNTVCHFSPLASDETVLEEGDIVKIDMGCHIDGFIAVVGHTHVLQQGPVTGRAADAIAAANTAAEVALRLVKPGKKNQDVTEAIQKVAAAYDCKIVEGVLSHQLKQFVIDGNKVVLSVSNPETRVDDAEFEENEVYSIDIVTSTGDGKPKLLDEKQTTIYKRAVDKSYHLKMKASRFVFSEISQNFPIMPFSARVLEEKRARFGLLECVNHELLQPYPVLHEKPGDFVAQIKFTVLLMPNGSDRITSHTLQELQPTKTVDDPEIKGWLSLAVKSKKKGGGKKKKGKGVEKSEAMEET

SEQ ID NO: 21288 - protein, 398 aa, Ambrosia trifida
MSDDEVREEKELDLSSPEVVTKYKLAAEILNKALQLVVSECKPKAKIVDICDKGDSYIKEQTGNTYKNVKKKIEKGVAFPTCLSVNNTVCHYSPLASDETVLEEGDFVKIDMGCHIDGFIAVVGHTHVLQQGPVTGRAADAIAAANTAAEVALRLVKPGKKNQDVTEAIQKVAAAYDCKIVEGVLSHQMKQFVIDGNKVVLSVSNPDTRVDDAEFEENEVYSIDIVTSTGDGKPKLLDEKQTTIYKRAVDKSYHLKMKASRFIFSEISQNFPIMPFTARALEEKRARFGLVECVNHELLQPYPVLHEKPGDFVAHIKFTVLLMPNGSDRITSHTLQELQPTKTVDDPEIKGWLSLPVKSKKKGGGKKKKGKGVERVKQWKKHEMMVAKEDFEVKFWLN

SEQ ID NO: 21289 - protein, 362 aa, Cocos nucifera
MSDDEAREEKELDLTSPDVVTKYKCAAEILNKALQLVISECKPKAKIVDICEKGDTFIKEQTGNVYKNVKKKIEKGIAFPTCISVNNTVCHFSPLGSDETVLEENDVVKIDMGCHVDGFIAIVAHTHVLQDGPITGRAADVIAAANTAAEVALRLVRPGKKNKDVAEAIQKVAAAYDCKVVEGVLSHQLKQFVIDGNKVILSLSNPETRVDDAEFEENEVYAIDIVTSTGEGKPKLLDEKQTTIYKRAVDKSYHLKMKASRFIFSEINQKFPILPFTARALEEKRARLGLVECVNHDLLQPYPVLHEKPGDLVAHIKFTVLLMPNGSDRITSHPLQELKPTKSIDDNPEIKAWLALGTKTKK

SEQ ID NO: 21290 - protein, 394 aa, Cycas rumphii
MSDDEAKEEKELDLTSPEVVTKYKVAAEIVNKALQVVLADCKPKAKVVDLCEKGDAYIKEQTGNVYKNAKKKIEKGIAFPTCVSVNSTVCHFSPLASDETVLEENDIVKIDLGCHIDGFIAVVAHTHVLQEGPITGRVADVIAAANTAAEVALRLVKPGKKNKDVTEAIQKVATAYDCKIAEGVLSHQMKQFVIDGNKVILSVSNPEMRVDDAEFEENEVYSIDIVTSTGEGKPKLLDEKQTTIYKRAVDKNYHLKMRASRFIFSEINQKFPIMPFTARALEEKRSRLGLVECVNHDLLQPYPVLHEKPGDLVAHIKFTVLLMPNGSDKITGHPLQELKPTKAIEDPDIKAWLALGTKSKKKGGGKKKKAKKGDTQEEADAPVDGADGIDPLQG

SEQ ID NO: 21291 - protein, 395 aa, Vinca minor
MSDEERDEGELDLTSPEVVTKYKSAAEIVNKALQLVLSECKPKVKIVDLCEKGDSFIKEQSGSMYKNVKKKIERGVAFPTCISVNNTVCHFSPLASDETLLEEGDMVKIDIGCHIDGFIAVVAHTHVIQEGLVTGRAADVLAAANTAAEVALRLVRPGKNNQDVTEAIQKVAAAYDCRIVEGVLSHQMKQFVIDGNKVVLNVSSPEMKVDDAEFEENEVYAIDIVTSTGDGKPKLLDEKQTTIYKRAVDKSYNLKMKASRFIFSEISQKFPIMPFTARDLEEKRARFGLVECVNHDLLQPYPVLHEKPGDLVAHIKFTVLLMPNGSDRVTSHPLQELKPEKTVDNYAEIKAWLSLPVKTKKKGGGKKKKGKKGDKAEDLSQTVAMDEEPNGAATQ

SEQ ID NO: 21292 - protein, 397 aa, Spinacia oleracea
MSDDEREEKELDLSYPEVVTKYKSAADIVNRALQLVVAECKPKAKIVDLCELSDNFIREQSGNMYKNVKKKIERGVAFPTCLSVNNVVCHFSPLASDESVLEEGDMVKIDLGCHIDGFIAVVAHTLVIQEGPITGRKADVLAAVNTAAEVALRLVRPGKKNKDVTEAIQKVASAYDCKIVEGVLSHQMKQFVIDGNKVVLSVTSPDMRVDDAEFEENEVYSVDIAASTGEGKPRMLDEKQTTIYKRAVDKNYHLKMKASRFIFSEINQKFPIMPFTARALEEKRARLGLVECVNHDLLQPYPVLYEKPGDFVAHIKFTVLLMPNGSDRVTSHSLQEMQPTNSVDDPEIKAWLALGTKTKKKGGGKKKKGKKGDKAEAEESADAAPMDADASGTTAEN

SEQ ID NO: 21293 - protein, 403 aa, Silene vulgaris
MSDDERDEKELDLTSSEVVTKYKCAAEILNKALHLVVSECKPKAKIVDLCEKGDAYIREQTGTMYKNAKKKIERGVAFPTCISVNSVVCHYSPLPNDESVLEEGDVVKVDMGCHIDGFIATVAHTHVIQEGPVTGRKADVIAATNTAAEVALRLVRPGKKNKDVTDAIQKVAAAYDCKIVEGVLSHQLKQFVIDGNKVVLSVASPEMRVDEAEFEENEVYGIDILATTGEGKPRMLDEKQTTIYKRAVDKNYHLKMKASRFIFSEINQKFPIMPFTARALEEKRARLGLVECVMHDLLQPYPVLHEKNGEFVAHIKFTVLLMPNGSDRITSHPLQELQPTKTIEDPEIKAWLALATKTKKKGGGKKKKGKKGDKPEDESAAAEPMDASTNGATAEARELENVS

SEQ ID NO: 21294 - protein, 368 aa, Amaranthus tuberculatus
MSDEEREERELDLTYPEVVTKYKSAADIVNRALQLVLSECKPKAKIVDVCEKGDSFIQEQTGNMYKNVKKKIERGVAFPTCISVNNVVCHYSPLASDETVLEEGDLVKIDMGCHIDGFIAVVAHTHVVQDGPVTGRKADVIAAANTAAEVAMRLIRPGKKNKDVTEAIQKVAAAYDCKIVEGVLSHQMKQFVIDGNKVVLSVTNPEVRVDDAEFEENEVYAVDIVASTGEGKPKMLDEKQTTIYKRAVDRNYHLKMKTSRFIFSEINQKFPIMPFTARALEEKKARLGLVECVNHDLLQPYPVLHEKPGDLVAHIKFTVLLMPNGSDRVTSHPLQELQPTKTIDDPEIKAWLALGTKTKKKGGGKKKK

SEQ ID NO: 21295 - protein, 372 aa, Centaurea maculosa
NKSAAEIVNKALQLVLSECKPNTKIVDICEKGDSYIREQTASMYKNVKKKIERGVAFPTCLSVNNTVCHFSPLASDETVLKEGDILKIDMGCHIDGFIAVVGHTHVLQQGPVTGRAADVIAAANTAAEVALRLVRPGKKNQDVTEAIQKVAAAYDCKIVEGVLSHQLKQFVIDGNKVVLSVANPDTRVDDAEFEENEVYAIDIVASTGDGKPKLLDEKQTTIYKRAVDKNYHLKMKASRFIFSEINQKFPIMPFSARALEEKRARLGLVECVNHELLQPYPVLHEKPGDFVAHIKFTVLLMPNGSDRITSHTLQELQPTKTVDDPEIKAWLALAVKSKKKGGGKKKKGKKGEKGEGDEAVAMDETTNGGNQG

SEQ ID NO: 21296 - protein, 395 aa, Vinca minor
MSDEEGEERELDLTSPEVVTKYKSAAEIVNKALQLVLSECKPKVKIVELCDKGDSFIKEQSGSMYKNVKKKIERGVAFPTCISVNSTVCHFSPLASDETVLEEGDMVKIDMGCHIDGFIAVVAHTHVIQEGPVTGRAADVLAAANAAAEVALRLVRPGKNNQDVTEAIQKVASAYDCRIVEGVLSHQMKQFVIDGNKVVLNVTSPEMKVDDAEFEENEVYAIDIVTSTGEGKPKLLDEKQTTVYKRAVDKNYNLKMKASRFIFSEISQNFPIMPFTARDLEEKRARFGLVECVNHDLLQPYPVLHEKPGDLVAHIKFTVLLMPNGSDRVTSHPLQELKPEKTIDNDPEIKAWLSLPVKTKKKGGGKKKKGKKGEKAEVSSQTEAMDEEPNGAATQ

SEQ ID NO: 21297 - protein, 394 aa, Cycas rumphii
MSDDEAKEEKELDLTSPEVVTKYKVAAEIVNKALQVVLADCKPKAKVVDLCEKGDAYIKEQTGNVYKNAKKKIEKGIAFPTCVSVNSTVCHFSPLASDETVLEENDIVKIDLGCHIDGFIAVVAHTHVLQEGPITGRVADVIAAANTAAEVALRLVKPGKKNKDVTEAIQKVATAYDCKIAEGVLSHQMKQFVIDGNKVILSVSNPEMRVDDAEFEENEVYSIDIVTSTGEGKPKLLDEKQTTIYKRAVDKNYHLKMRASRFIFSEINQKFPIMPFTARALEEKRSRLGLVECVNHDLLQPYPVLHEKPGDLVAHIKFTVLLMPNGSDKITGHPLQELKPTKAIEDPDIKAWLALGTKSKKKGGGKKKKGKKGDTQEEADATVDGADGIDTLQG

SEQ ID NO: 21298 - protein, 394 aa, Pinus taeda
MSDDEAKEEKELDLTSHDVVTKYKLSAEIANKALQIVLSECKPKAKVVDLCEKGDSYIREQTGNVYKNAKKKIEKGVAFPTCISINSTVCHFSPLTGDETVLEENDIVKIDLGCHIDGFISVVAHTHVVQEGPVTGRAADVIAAANTAAEVALRLVKPGKKNKDVTEAIQKVAAVYDCKIAEGVLSHQMKQFVIDGNKVILGASNPETRVDDAEFEENEVYAIDIVTTTGEGKLKLLDEKETNIYKRAVDKNYQLKMKASRLIFTEINQKFPIMPFTARALEDKRARLGLVECVNHELLQPYPVLHEKPGELVAHIKFTVLLMPNGSDKITGHPLQELNPTKTIDDPEIKAWLALGTKSKKKGGGKKKKGKKDALENSADDTGNGAVSMDTSQG

SEQ ID NO: 21299 - protein, 359 aa, Cirsium arvense
MSDDERAEEKELDLTSPEVVTKYKSAAEIVNKALQLVLSECKPKAKIVDICEKGDSYIREQTGSMYKNVKKKIERGVAFPTCLSVNNTVCHYSPLASDETVLEEGDILKIDMGCHIDGFIAVVGHTHVLQQGPVTGRAADAIAAANTAAEVALRLVKPGKKNQDVTEAIQKVAAAYDCKIVEGVLSHQLKQFVIDGNKVVLSVSNPETRVDDAEFEENEVYAIDIVTSTGDGKPKLLDEKQTTIYKRAVDKNYHLKMKASRFIFSEINQKYPIMPFSARALEEKRARLGLVECVNHELLQPYPVLHEKPGDFVAHIKFTVLLMPNGSDRITSHTLQELQPTKTVDDPEIKAWLSLPVKS

SEQ ID NO: 21300 - protein, 385 aa, Nuphar advena
DLTSPEVVTKYKSAAEIVNKALHLVLSECKPKAKIVDLCEKGDTFIREQTGNMYKSVKKKIERGVAFPTCISVNNTVCHLSPLASDESTLEENDIVKIDMGCHIDGFIAVVAHTHVIIEGPVKGRAADVIAAANTASEVALRLVRPGRKNKDVTEAIQKVAAAYDCKIVEGVLSHQLKQFVIDGNKVILSVSNPETRVDDAEFEENEVYAVDIVASTGDGKPKLLDERQTTIYKRAVDKNYHLKMKSSRFIFSEISQRFPIMPFTARAFEEKRARLGLVECVNHELLQPYPVLHEKPGDLVAHIKFTVLLMPNGSDRITSHPLQELQPTKSIDDYQEIKAWLSLGTKTKKKGGKKKKASKKGDASEPELVDGTSNVATGQEASQE

SEQ ID NO: 21301 - protein, 416 aa, Euonymus alatus
DDEREEKELDLTSPEVVTKYKSAAEIVNKALQLVISECKPKAKVVDVCEKGDSYIREQSGNMYKNVKKKIERGVAFPTCVSVNNTVCHVSPLASDETVLEEGDLVKIDMGCHIDGFIAVVAHTHVLQQGPVTGKAADVIAASNTAAEVALRLVRPGKKNKDVTDAIQKVAAAYDCKIVEGVLSHQLKQFVIDGNKVVLSVSSPDTRVDDAEFEENEVYAIDIVTSTGEGKPKLLDEKQTTIYKRAVDKNYHLKMKASRFIFSEISQKFPIMPFSARALEEKRARLGLVECVNHELLQPYPVLHEKPVDLVAHIKFTVLLMPNGSDRITSHSLQEVQPTKTIDDPEIKAWLALGTKTKKKGGGKRREVRRATSSGSRRKLSLWMQQQMVHHKNEPVLNLSLSFIQFCYFVLLLVTHY

SEQ ID NO: 21302 - protein, 373 aa, Elaeis guineensis
MSDDEAKEEKELDLSFPDVVTKYKCAAEIVNKALQLVVSECKPKAKIVDICEKGDTFIKEQSGNVYKNVKKKIERGVAFPTCISVNNTVCHFSPLSGDEAVLEENDVVKIDMGCHIDGFIAVVAHTHVLQEGPITGRAADVIAAANTAADVALRLVRPGRKNKDVTEAIQKVAGAYDCKIVEGVLSHQLKQFVIDGNKIIISVSNPETRVDDAEFEENEVYAIDIVTSTGEGKPKLLDEKHTTIYKRAVDKNYHLKMKASRFIFSEINQKFPIMPFTARALEEKRARLGLVECVNHELLQPYPVLHEKPGDLVAHIKFTVLLMPNGSDRITSHPLQELKPTKSIDNNPEIKAWLSLGTKTKKKVEERRRKVKR

SEQ ID NO: 21303 - protein, 369 aa, Amaranthus tuberculatus
MSDDERDEKELDLSYPDVVTKYKSAADIVNRALLLVISECKPKAKIVDVCEKGDSFINEQTANMYKNVKKKIERGVAFPTCISVNSVVCHYSPLASDESVLEEGDMVKIDMGCHIDGFIAAVAHTYVIQEGPVTGRKADVMAAANTAAEVALRLIRPGKKNKDVTEAIQKVAAAYDCKIVEGVLTHQMKQFVIDGNKVVLSVTNPETRVDDAEFEENEVYAVDIVASTGEGKPRMLDEKQTTIYKRAVERAYHLKMKASRFIFSEINQKFPIMPFTARALEEKRARLGLLECVNHDLLQPYPVLHEKPGDLVAHIKFTVLLMPNGSDRVTSQSLQELQPTKTVDDPEIKAWLALGIKTKKKGGGKKKKV

SEQ ID NO: 21304 - protein, 380 aa, Panicum virgatum
MVVHTSIGKVTLKFFDPFGTDALKLVVSECKPKAKIVDLCEKGDAFIREQTGNVYKNAKRKIERGIAFPTCVSVNNTVCHFSPLATDEAVLEENDMVKIDMGCHIDGFIAVVAHTHVITNGPVTGRAADVLAAANTAAEVAMRLVRPGKKNKDVTEAIQKVAAAYDCKIVEGVLSHQLKQFVIDGNKVVLSVSNADTKVDDAEFEENEVYAIDIVTSTGEGKPKLLDEKQTTIYKRAVDKNYHLKMKASRFIFSEISQKFPIMPFTARALEEKRARLGLVECMNHELLQPYPVLHEKPGDLVAHIKFTVLLMPNGSDKITSHPLQELQPTKSIEDNAEIKAWLALGTKSKKKGGGKKKKGKKGDAAEPMEDATNGAPSQE

SEQ ID NO: 21305 - protein, 221 aa, Medicago truncatula
MKILYFLVSILALASSLAFAYDPSPLQDFCVAIKDPKDGVFVNGKFCKDPALVKAEDFFKHVEAGNASNALGSQVTPVTVDQLFGLNTLGISLARIDFVPRGLNPPHIHPRGTEILIVLEGTLYVGFVTSNQDNNRLFTKVLNKGDVFVFPIGLIHFQLNVGYGNAVAIAGLSSQNPGVITVANALFKSNPLISDEVLTKAFQVDKSIIDYLQKQSWYDNN

SEQ ID NO: 21306 - protein, 221 aa, Cicer arietinum
MKTLHFLVSILALASCVAFAYDPSPLQDFCVAIKDPKDGVFVNGKFCKDPILVNAEDFFKHVEPGNASNPLGSQVTPVTVDQLFGLNTLGISLARIDFAPKGLNPPHIHPRGTEFLIVVEGTLYVGFVTSNQDNNRLFSKVLNKGDVFVFPIGLIHFQLNVGYGNAVAIAGLSSQNPGVITIANALFKSNPPISDEVLTKAFQVDKSIIDYLQKQSWYDNN

SEQ ID NO: 21307 - protein, 221 aa, Cicer arietinum
MKTLHFLESILALASSVAFASDPSPLQDFCVAIKDPKDGVFVNGKFCKDPILVNAEDFFKHVEPGNASNPLGSQVTPVTVDQLFGLNTLGISLARIDFAPNGLNPPHIHPRGTEFLIVVEGTLYVGFVTSNQDNNRLFTKVLNKGDVFVFPIGLIHFQLNVGYGNAVAIAGLSSQNPGVITIANALFKSNPPISDEVLTKALQVDKSIVDYLQKQSWYDNN

SEQ ID NO: 21308 - protein, 220 aa, Vicia sativa
MKVLYFLVSILALASVSFAYDPSPLQDFCVAIKDPKDGVFVNGKFCKDPALVKAEDFFKHIDPANTANALGSQVTAVTVDQLFGLNTLGISLARIDFAPKGLNPPHTHPRGTEILIVLEGTLYVGFVTSNQDNNRLFTKVLNKGDVFVFPIGLIHFQLNVGYGNAVAIAGLSSQNPGVITIAKALFKSDPLISDEVLTKAFQVDKSIVDYLQGQTWYDNN

SEQ ID NO: 21309 - protein, 210 aa, Trifolium pratense
ALASSVAFAYDPSPLQDFCVAINDPKDGVFVNGKFCKDPALVKAEDFFKHIEQGNTSNALGSEVTPVAVDQLFGLNTLGISLARVDFAPKGLNPPHIHPRGTEILIVVEGTLYVGFVTSNQDKNRLFTKVLNKGDVFVFPIGLIHFQLNVGYGNAVAIAGLSSQNPGVITIANALFKSNPSISDEVLTKAFQVDKSIIDYLQKQSWYDNN

SEQ ID NO: 21310 - protein, 223 aa, Lotus japonicus
MEVVYFLVTILALASSFASAYDPSPLQDFCVGINDPKYGVFVNGKFCKDPALVKAEDFFKHVEPGNTSNPLGSKVTPVTVEQLFGLNTLGISLARIDFAPKGLNPPHTHPRATEILIVLEGTLYVGFVTSNNANGGNRLFTKVLNKGDVFVFPIGLIHFQLNVGNGNAVAIAGLSSQNPGVITIANALFKADPPISKEVLTKAFQVDKSIIDYLQKQSWYDNN

SEQ ID NO: 21311 - protein, 222 aa, Lotus japonicus
MEVVYFLVTMALASSFASAYDPSPLQDFCVGINDPKNGVFVNGKFCKDPALVKAEDFFKHVEPGNTSNPLGSKVTPVTVEQLFGLNTLGISLARIDFAPKGLNPPHTHPRATEILIVLEGTLYVGFVTSNNANGGNRLFTKVLNKGDVFVFPIGLIHFQLNVGNGNAVAIAGLSSQNPGVITIANALFKADPPISKEVLTKAFQVDKSIIDYLQKQSWYDNN

SEQ ID NO: 21312 - protein, 223 aa, Lotus japonicus
MKVVYFLVTILALASSFASAYDPSPLQDFCVGINDPKDGVFVNGKFCKDPALVKAEDFFKHVEPGSTSNPLGSKVTPVTVEQLFGLNTLGISLARIDFAPKGLNPPHTHPRATEILIVLEGTLYVGFVTSNNANGGNRLFTKVLNKGDVFVFPIGLIHFQLNVGSGNAVAIAGLSSQNPGVITIANALFKASPPISQEVLTKALQVDKSIIDNLLKKSWYDNN

SEQ ID NO: 21313 - protein, 221 aa, Glycine max
MKVVYFLVAILALTSTVVSAYDPSPLQDFCVAAKEKDGVFVNGKFCKDPKLVKAEDFFKHVEPANTANPLGSQVTPVFVDQLPGLNTLGISLARIDYAPKGLNPPHTHPRGTEILIVLEGTLYVGFVTSNQDGNRLFTKVLNKGDVFVFPIGLIHFQLNVGYGNAVAIAGLSSQNPGTITIANALFKANPPISPEVLTKAFQVDKSTIDYLQKQSWYDNNN

SEQ ID NO: 21314 - protein, 220 aa, Cajanus cajan
MKVAYFVVAILALTFSVVSAYDPSPLQDFCVAVKETDGVFVNGKFCKDPKLVKAEDFFKHVEPGKTDNPLGSQVTPVFVDQLPGLNTLGISLARIDFAPKGLNPPHTHPRGTEILIVLEGTLYVGFVSSNQDGNRLFTKVLNKGDVFVFPIGLIHFQLNVGYGNAVAIAGLSSQNPGTITIANALFKATPPISVEVLTKAFQVDKSTIDYLQKQSWYDNN

SEQ ID NO: 21315 - protein, 221 aa, Glycine max
MKVVYLLVALLALTSTVVSAYDPSPLQDFCVAAKEKDGVFVNGKFCKDPKLVKAEDFFRHVEPGKTDNPLGSNVTQVFVDQLPGLNTLGIGLARIDFAPKGLNAPHTHPRGTEILIVLEGTLYVGFVTSNQDGNRLFTKVLNKGDVFVFPIGLIHFQLNVGYGNAVAIAGLSSQNPGAITIANALFKANPPISSEVLTKAFQVDKSIIDYLQKQSWYDNNN

SEQ ID NO: 21316 - protein, 221 aa, Glycine max
MKVVYFLVAILALTSSLVSAYDPSPLQDFCVAAKEKDGVFVNGKFCKDPKLVKAEDFFRHVEPGKTDNPVGSNVTQVFVDQLPGLNTLGIALARIDFAPKGLNAPHTHPRGTEILIVLEGTLYVGFVTSNQDGNRLFTKVLNKGDVFVFPIGLIHFQLNVGYGNAVAIAGLSSQNPGAITIANALFKANPPISSEVLTKAFQVDKTIIDYLQKQSWYDNNN

SEQ ID NO: 21317 - protein, 221 aa, Glycine max
MKVVYFLVVILALTSSVVSAYDPSPLQDFCVAAKEKDGVFVNGKFCKDPKLVKAEDFFRHVEPGKTDNPVGSNVTQVFVDQLPGLNTLGIALARIDFAPKGLNAPHTHPRGTEILIVLEGTLYVGFVTSNQDGNRLFTKVLNKGDVFVFPIGLIHFQLNVGYGNAAAIAALSSQNPGAITIANALFKANPPISSEVLTKAFQVDKSIIDYLQKQSWYDNNN

SEQ ID NO: 21318 - protein, 221 aa, Glycine max
MKVVYFLVAILALTSSVVSAYDPSPLQDFCVAAKEKDGVFVNGKFCKDPKLVKAEDFFRHVEPGKTDNPVGSNVTQVFVDQLPGLNTLGIALARIDFAPKGLNAPHTHPRGTEILIVLEGTLYVGFVTSNQDGNRLFTKVLNKGDVFVFPIGLIHFQLNVGYGNAAAIAALSSQNPGAITIANALFKANPPISSEVLTKAFQVDKSIIDYLQKQSWYDNNN

SEQ ID NO: 21319 - protein, 219 aa, Cajanus cajan
MKVTYLIVAILALTSVVSAYDPSPLQDFCVAVKETDGVFVNGKFCKDPKLVKAEDFFKHVEPGKTDNPLGSQVTPVFVDQLPGLNTLGISLARIDFAPKGLNPPHTHPRGTEILIVLEGTLYVGFVSSNQDGNRLFTKVLNKGDVFVFPIGLIHFQLNVGYGNAVAIAALSSQNPGTITIANALFKATPPISTEVLTKAFQVDQKTIDYLLKQSWYDNN

SEQ ID NO: 21320 - protein, 220 aa, Cajanus cajan
MKVAYLIVAILALTSVVSAYDPSPLQDFCVAVKETDGVFVNGKFCKDPKFVKAEDFFKHVEPGKTDNPLGSQVTPVFVDQLPGLNTLGISLARIDFAPKGLNPPHTHPRGTEILIVLEGTLYVGFVSSNQDGNRLFTKVLNKGDVFVFPIGLIHFQLNVGYGNAVAIVGLSSQNPGTITIANALFKANPPISTEVLTKAFQVDKNTIDYLLKQSWYDNNN

SEQ ID NO: 21321 - protein, 221 aa, Glycine max
MKVMYFLVAVLALAFSVASAYDPSPLQDFCVTVNGTKDGVFVNGKFCKDPKLVKAEDFFRHVEPGNTSNPNGAQVTQVFVDQLPALNTLGISLARVDFAPKGLNPPHTHPRGTEILIVTEGTLYVGFVTSNQDGNRLFTKVLNKGDVFVFPIGLIHFQRNVGYGNAVAIAALSSQNPGTITIANVLFKANPPISSEVLTKAFQVDKKVIDYLQKQSWYGNN

SEQ ID NO: 21322 - protein, 220 aa, Phaseolus vulgaris
MKAVYLVVAILGLTCLVVSAYDPSPLQDFCVGAKESDGVFVNGKFCKDTKVVKAEDFFKHVEPAKTENPLGSQVTQVFVDQLPGLNTLGISLARIDFAPKGLNPPHTHPRGTEILIVVEGTLYVGFVTSNQDGNRLFTKVLNKGDVFVFPIGLIHFQLNVGYGNAVAIAGLSSQNPGTITIANALFKSDPPISPEVLTKAFQVDKSTIDYLQKQSWYDNN

SEQ ID NO: 21323 - protein, 197 aa, Trifolium pratense
PLQDFCVAIQDPKDGVFVNGKFCKDPALVKAEDFFKHIEPGNTSNPLGSQVTPVTVDQLFGLNTLGISLARIDFAPKGLNPPHTHPRGSEILIVLEGTLYVGFVTSNQDKNRLFTKVLNKGDVFVFPIGLIHFQLNVGYGNAVAIAGLSSQNAGVITIANALFKSNPAISDEVLTQAFQVDKSIIDYLQQQSWYDNN

SEQ ID NO: 21324 - protein, 221 aa, Cajanus cajan
MKVVYFLVAILALTSSVAFAYDPSPLQDFCVALNDTKNAVFVNGKFCKDPKLVKAEDFFTHVEAGNTSNPLGAQVTPVFVDQLPGLNTLGISLARIDFAPKGLNAPHTHPRGTEILIVIEGTLYVGFVSSNQDGNRLFTKVLNKGDVFVFPIGLIHFQLNVGYGNALAIAGLSSQSPGTITIGSALFNSTPPISTEVLTKAFQVDKSTINYLQKQFWYNNN

SEQ ID NO: 21325 - protein, 195 aa, Pisum sativum
QDFCVAIKDPKDGVFVNGKFCKDPALVKAEDFFKHIDPGNPVNALGSQVTPVFVDQLFGLNTLGISLARIDFAPKGLNPPHIHPRGTEILTVLEGTLYVGFVTSNQDKNRLFTKVLNKGDVFVFPIGLIHFQLNVGYGNAVAIAGLSSQNPGVITIANALFKSNPPISDEVLTKAFQVDKSIIDYLQGQTWYDNN

SEQ ID NO: 21326 - protein, 221 aa, Cajanus cajan
MKVVYFLVAILALTSSVAFAYDPSPLQDFCVALNDTKNAVFVNGKFCKDPKLVKAEDFFTHVEAGNTSNPLGAQVTPVFVDQLPGLNTLGISLARIDFAPKGLNAPHTHPRGTEILIVIEGTLYVGFVSSNQDGNRLFTKVLNKGDVFVFPIGLIHFQLNVGYGNALAIADLSSQSPGTITIGSALFNSTPPISTEVLTKAFQVDKSTINYLQKQFWYNNN

SEQ ID NO: 21327 - protein, 221 aa, Cajanus cajan
MKVAYFIVAILALTSSVVSAYDPSPLQDFCVAVKETDGVFVNGKFCKDPKLVKAEDFFQHVEPGKTDNPLGSHVTPVFVDQLPGLNTLGISLARIDFAPKGLNPPHTHPRGTEILIVLEGTLYVGFVSSNQDGNRLFTKVLNKGDVFVFPIGLVHFQLNVGYGNAVAIAALSSQNPGTITIANALFKATPPISTEVLTKAFQVDKKTIEYLLKQSWYDNNN

SEQ ID NO: 21328 - protein, 222 aa, Vigna unguiculata
MKGVYFLVAILAFTSSIASAYDPSPLQDFCVALNDTKNAVFVNGKLCKDPKVVKAQDFFRHVEAGNTSNPLGAQVSQVFVDQLPGLNTLGISMARIDFAPKGLNAPHNHPRGTEILIVVEGSLYVGFVSSNQDGNRLFTKVLNKGDVFVFPIGLTHFQLNVGYGNAVAIAALNSQNPGTITIANALFKSTPSISSQVLTKAFQVDKSIIDYLQKQFWTDNNH

SEQ ID NO: 21329 - protein, 671 aa, Brachypodium distachyon
MASSFLRASPLSLLSRLKPVNRRPPASHLRRLLLLSGSTSVPSCSPPTLRTLATDAATAPEEAALPAAEAKLERMQPLQWPRRDALCGDLGAGDAGRRVRLCGWVALRRTHAGLTFLTLRDSSGMVQVATLPEYPEVYAVVNKLRVESVVSVEGVVRPRPTEAINTEMKTGAIEVVADHILVLNSVTRSLPFPVTTADTVKEKFPEEVRLRFRVLDLRRPQMQSNLRLRHKVIKHVRRYLEDRHDFVEIETPILSKSTPEGARDYLVPSRVQPGTCFALPQSPQLFKQMLMASGFEKYFQIARCFRDEDLRADRQPEFTQLDMEIAFTSMEDMLKLNEELMIHIFQEVGDIKLPKCFPRLTYAEAMNCYGTDRPDLRFDWELKDASDVFLGSSFKVFADTLENGGVIKALSVPGGAKVFSNTDLKKGTVYAEASKAGAKGLPFLKVMDNGELEGIGPLVSTLKPEKKEQLLELLDAKAGDLILFALGEQSTANQILGRLRLFIAHKLEVIDTSAHSILWVTDFPMFEWNSDEQRYEALHHPFTAPNPEDMNDLPSARALAYDMIYNGVEIGGGSLRIYKSDVQQRIFEIIGISPEQAEEKFGYLLECFDMGAPPHGGIAYGLDRLVMLLACESSIRDVIAFPKTTTAQCSLTKAPSPVDPQQLKDLGLHAP

SEQ ID NO: 21330 - protein, 676 aa, Sorghum bicolor
MASSLLRASPFSLLSRLKPRSSALHLRRLLPLSTTSTSASVPAPQLRTLASAAATDAAATPPEEAAVPAAAGAKVERLQPLQWPPRDALCGELGAGDAGRRVRLCGWVALRRAHAGLTFLTLRDRSGMVQVTTLPEYPEVYNIVNKLRVESVVAVEGVIQPRPVDAINADMKTGAIEVVADHVLVLNSVTRSLPFPVTIADTVKEKFPEEIRLRFRVLDLRRPQMQSNLRLRHNVVKLIRRYLEDEHEFVEIETPVLSKSTPEGARDYLVPSRVQPGTFYALPQSPQLFKQMLMVSGFEKYYQIARCFRDEDLRADRQPEFTQLDMEIAFTSMEDMLKLNEDLMRHVFQVVGDIKLPNPFPRLTYAEAMDRYGTDRPDLRFDWELKDVSDVFLGSNFKVFADTLENGGVIKALCVPGGAAVFSNTDLKKGTVYTEASKAGAKGLPFLKVMDTGELEGIGPLVSSLKPEKKEQLVELLDAKAGDLILFALGEQSSANRILGRLRLFIAHKLEVIDTSAHSVLWVTDFPMFEWNSDEQRYEALHHPFTAPNPEDMNDLPSARALAYDMIYNGVEIGGGSLRIYKSDVQQRIFEIIGISPEQAEEKFGYLLECFDMGAPPHGGIAYGLDRLVMLLAGESSIRDVIAFPKTTTAQCALTKAPSAVDPQQLKDLAFPNSTS

SEQ ID NO: 21331 - protein, 681 aa, Panicum virgatum
MASSLLRASPLALLSRLKPRPSALHLRRLLPLSTTSASAAPAPSGPAPQLRTLAAAAATDAAATPAEEAAAAPAATGEKVERLQPLQWPPRDALCGELGAGDAGRRVRLCGWVALRRAHAGLTFLTLRDRSGMVQVTTLPEYPEVYNIVNKLRVESVVAVEGVVRPRPADAINADMKTGAIEVAADRVLVLNSVTRSLPFPVTTADSVKEKFPEEIRLRFRVLDLRRPQMQSNLRLRHYVVKLIRRYLEDEHEFVEIETPVLSKSTPEGARDYLVPSRVQPGTFYALPQSPQLFKQMLMVSGFEKYYQIARCFRDEDLRADRQPEFTQLDMEIAFTSMEDMLKLNEDLMRHVFQAVGGIKLPNPFPRLTYTDAMNRYGTDRPDLRFDWELKDVSHVFLGSGFKVFADTLENGGVIKALCVPGGATVFSNTDLKKGTVYTEASKAGAKGLPFLKVMENGDLEGIGPLVSSLKPEKKEQLVKLLDAKAGDLILFALGEQSSANRVLGRLRLFIAHKLEVIDTSAHSVLWVTDFPMFEWNSDEQRYEALHHPFTAPNPEDMNDLPSARALAYDMIYNGVEIGGGSLRIYKSDVQQRIFEIIGISPEQGEEKFGYLLESFDMGAPPHGGIAYGLDRLVMLLAGESSIRDVIAFPKTTTAQCALTKAPSAVDPQQLKDLAFPKSTL

SEQ ID NO: 21332 - protein, 677 aa, Setaria italica
MASSLLRASPLSLLSRLKPRPSALHLRRLIPLSTTSASPSPAGPSPQLRTLAAAAATDAAASPPEEAAAPAEAGAKVERLQPLQWPPRDALCGELGAGDAGRRVRLCGWVALRRVHAGLTFLTLRDRSGMVQVTTLPEYPEVYNIVNKLRVESVVAVEGVVRPRPADAINADMKTGAIEVAADRVLVLNSVTRSLPFPVTTAETVKEKFPEEIRLRFRVLDLRRPQMQSNLRLRHNVVKLIRRYLEDEHEFVEIETPVLSKSTPEGARDYLVPSRVQPGTFYALPQSPQLFKQMLMVSGFEKYYQIARCFRDEDLRADRQPEFTQLDMEIAFTSMEDMLKLNEDLMRHVFLAAGGIKLPNPFPRLTYAEAMDRYGTDRPDLRFDWELKDVSGAFLGSSFKVFADTLENGGIIKALCVPGGATVFSNTDLKKGTVYTEASKAGAKGLPFLKVMENGDLEGIGPLVSSMKPEKKEQLVELLDAKAGDLILFALGEQSSANRILGWLRLFIAHKLEVIDTSTNSVLWVTDFPMFEWNSDEQRYEALHHPFTAPNPKDMNDLPSARALAYDMIYNGVEIGGGSLRIYKSDVQQRIFEIIGISPEQAEEKFGYLLESLDMGAPPHGGIAYGLDRLVMLLAGESSIRDVIAFPKTTTAQCALTKAPSAVDPQQLKDLAFPKST

SEQ ID NO: 21333 - protein, 684 aa, Panicum virgatum
MAASLLRASPLSLLSRLKPRPSALHLRRILPLSTTSASASPAPSSSGPAPQLRTLAAAAATDAAANPAEEAAAAAPAAAGEKVERLQPLQWPPRDALCGELGAGDAGRRVRLCGWVALRRAHAGLTFLTLRDRSGMVQVTTLPEYPEVYNIVNKLRVESVVAVEGVVRPRPADAINADMKTGAIEVAADRVLVLNSVTRSLPFPVTTADSVKEKFPEEIRLRFRVLDLRRPQMQSNLRLRHNVVKSVRRYLEDEHEFVEIETPVLSKSTPEGARDYLVPSRVQPGTFYALPQSPQLFKQMLMVSGFEKYYQIARCFRDEDLRADRQPEFTQLDMEIAFISMEDMLKLNEDLMRHVFQAVGGIKLPNPFPRLTYAEAMSRYGTDRPDLRFDWELKDVSDVFLGSGFKVFADTMENGGVIKALCVPGGATVFSNTDLKKGTVYTEASKAGAKGLPFLKVMENGDLEGIGPLVSSLKPEKKEQLVKLLDAKAGDLILFALGEQSSANRVLGRLRLFIAHKLEVIDTSAHSVLWVTDFPMFEWNSDEQRYEALHHPFTAPNPEDMNDLPSARALAYDMIYNGVEIGGGSLRIYKSDVQQRIFEIIGISPEQAEEKFGYLLESFDMGAPPHGGIAYGLDRLVMLLAGESSIRDVIAFPKTTTAQCALTKAPSAVDPQQLKDLAFPKSTL

SEQ ID NO: 21334 - protein, 677 aa, Avena sativa
SHASNGVLPPTRLAALPPLPSEASQPQASRYFEPPPSPPALGPRPGHLLPLPAHAPNPSHRRGDHGRGGGAPRCGGEAGEDAAPQWPQRDALCGELGAGDAGRRVRLCGWVALRRNHAGLTFLILRDSSGMVQVTTLPEYPEVYAVVNKLRVESVVAVEGVVRPRPTDAINADMRTGAIEVAADSILVLNSVTRSLPFPITTADTVKDKFPEEVRLRFRVLDLRRPQMQSNLRLRHKVIKNVRRYLEDKHDFVEIETPILSKSTPEGARDYLVPSRVQPGTCFALPQSPQLFKQMLMASGFEKYFQIARCFRDEDLRADRQPEFTQLDMEIAFTSMEDMLKLNEELMIHIFQEVGDIKLPKCFPRLSYTEAMNRYGTDRPDLRFDWELKDAGDVFLGSSFKVFADILENGGVVKALCVPGGAKVFSNTDLKKGTVYTEASKAGAKGLPFLKVMDNGELEGVGPLVSSLKPEKKEQLLELLDAKAGDLILFALGEQSIANQILGRLRLFIAQKLEVIDTSAHSILWVTDFPMFEWNSDEQRYEALHHPFTAPNPEDMNDLPSARALAYDMIYNGVEIGGGSLRIYKSDVQQRIFEIIGISPEQAEEKFGYLLECFDMGAPPHGGIAYGLDRLVMLLARESSIRDVIAFPKTTTAQCSLTKAPSPVDPQQLKDLGLRSS

SEQ ID NO: 21335 - protein, 368 aa, Setaria italica
MATVMQKIKDIEDEMARTQKNKATAHHLGLLKAKLAKLRRELLTPTSKGGGGAGEGFDVTKSGDARVGLVGFPSVGKSTLLNKLTGTFSEVAAYEFTTLTCIPGVIMYKGAKIQLLDLPGIIEGAKDGKGRGRQVISTARTCNVILIVLDAIKPITHKRLIEKELEGFGIRLNKTPPNLTFRKKDKGGINFTSTVTNTHLDLETVKAICSEYRIHNADVSLRYDATADDLIDVIEGSRIYTPCIYVVNKIDQITLEELEILDKLPHYCPISAHLEWNLDGLLEKVWEYLDLVRIYTKPKGLNPDYEDPVIVSSKKKTVEDFCNRIHKDMVKQFKYALVWGSSVKHKPQRVGKEHELEDEDVVQIIKKI

SEQ ID NO: 21336 - protein, 369 aa, Sorghum bicolor
MATVMQKIKDIEDEMARTQKNKATAHHLGLLKAKLAKLRRELLTPTSKGGGGGAGEGFDVTKSGDARVGLVGFPSVGKSTLLNKLTGTFSEVAAYEFTTLTCIPGVIMYKGAKIQLLDLPGIIEGAKDGKGRGRQVISTARTCNVILIVLDAIKPITHKRLIEKELEGFGIRLNKTPPNLTFRRKDKGGINFTSTVTNTHLDLDTVKAICSEYRIHNADVSLRYDATADDLIDVIEGSRIYTPCIYVVNKIDQITLEELEILDKLPHYCPVSAHLEWNLDGLLEKVWEYLDLVRIYTKPKGLNPDYEDPVIVSSKKKTVEDFCNRIHKDMVKQFKYALVWGSSVKHKPQRVGKEHELEDEDVVQIIKKI

SEQ ID NO: 21337 - protein, 368 aa, Saccharum officinarum
MATVMQKIKDIEDEMARTQKNKATAHHLGLLKAKLAKLRRELLTPTSKGGGGAGEGFDVTKSGDARVGLVGFPSVGKSTLLNKLTGTFSEVAAYEFTTLTCIPGVIMYKGAKIQLLDLPGIIEGAKDGKGRGRQVISTARTCNVILIVLDAIKPITHKRLIEKELEGFGIRLNKTPPNLTFRRKDKGGINFTSTVTNTHLDLDTVKAICSEYRIHNADVSLRYDATADDLIDVIEGSRIYTPCIYVVNKIDQITLEELEILDKLPHYCPVSAHLEWNLDGLLEKVWEYLDLVRIYTKPKGLNPDYEDPVIVSSKKKTVEDFCNRIHKDMVKQFKYALVWGSSVKHKPQRVGKEHELEDEDVVQIIKKI

SEQ ID NO: 21338 - protein, 368 aa, Pennisetum glaucum
MATVMQKIKDIEDEMARTQKNKATAHHLGLLKAKLAKLRRELLTPTSKGGGGAGEGFDVTKSGDARVGLVGFPSVGKSTLLNKLTGTFSEVAAYEFTTLTCIPGVIMYKGAKIQLLDLPGIIEGAKDGKGRGRQVISTARTCNVILIVLDAIKPITHKRLIEKELEGFGIRLNKTPPNLTFRKKEKGGINFTSTVTNTHLDLETVKAICSEYRIHNADISLRYDATADDLIDVIEGSRIYTPCIYVVNKIDSITLEELEILDKLPHYCPISAHLEWNLDGLLEKVWEYLDLVRIYTKPKGLNPDYEDPVIVSSKKKTVEDFCNRIHKDMVKQFKYALVWGSSVKHKPQRVGKEHELEDEDVVQIIKKI

SEQ ID NO: 21339 - protein, 368 aa, Zea mays
MATVMQKIKDIEDEMARTQKNKATAHHLGLLKAKLAKLRRELLTPTSKGGGGAGEGFDVTKSGDARVGLVGFPSVGKSTLLNKLTGTFSEVASYEFTTLTCIPGVIMYKGAKIQLLDLPGIIEGAKDGKGRGRQVISTARTCNVILIVLDAIKPITHKRLIEKELEGFGIRLNKTPPNLTFRRKDKGGINFTSTVTNTHLDLDTVKAICSEYRIHNADVSLRYDATADDLIDVIEGSRIYTPCVYVVNKIDQITLEELEILDKLPHYCPVSAHLEWNLDGLLEKVWEYLDLVRIYTKPKGLNPDYEDPVIVSSKKKTVEDFCDRIHKDMVKQFKYALVWGSSVKHKPQRVGKEHELDDEDVVQIIKKI

SEQ ID NO: 21340 - protein, 368 aa, Musa acuminata
MATVMQKIKDIEDEMARTQKNKATAHHLGLLKAKLAKLRRELLAPTSKGGGGAGEGFDVTKSGDARVGLVGFPSVGKSTLLNKLTGTFSEVASYEFTTLTCIPGVIVYRGAKIQLLDLPGIIEGAKDGKGRGRQVISTARTCNCILIVLDAIKPITHKRLIEKELEGFGIRLNKEPPNLTFRKKDKGGINFTSTVTNTQLDLETVKAICSEYRIHNADISLRYDATADDLIDVIEGSRVYMPCIYAVNKIDQITLEELEILDKLPHYCPVSAHLEWNLDGLLEKIWEYLDLVRIYTKPKGLNPDYEDPVILSSKRTTVEDFCNRIHKDMVKQFKYALVWGSSAKHKPQRVGKEHELEDEDVVQIIKKV

SEQ ID NO: 21341 - protein, 369 aa, Citrus clementina
MATVMQKIKDIEDEMARTQKNKATAHHLGLLKAKLAKLRRELLTPTSKGGGGGGGEGFDVTKSGDSRVGLVGFPSVGKSTLLNKLTGTFSEVASYEFTTLTCIPGVITYRGAKIQLLDLPGIIEGAKDGKGRGRQVISTARTCNCILIVLDAIKPITHKRLIEKELEGFGIRLNKQPPNLTFRKKDKGGINFTSTVTNTNLDLETVKAICSEYRIHNADITLRYDATADDLIDVIEGSRIYMPCIYVINKIDQITLEELEILDKLPHYCPVSAHLEWNLDGLLEKIWEYLNLTRIYTKPKGMNPDYEDPVILSSKKRTVEDFCERIHKDMVKQFKYALVWGSSAKHKPQRVGKEHELEDEDVVQIIKKV

SEQ ID NO: 21342 - protein, 368 aa, Gossypium raimondii
MATVMQKIKDIEDEMARTQKNKATAHHLGLLKAKLAKLRRELLTPSSKGGGGAGEGFDVTKSGDARVGLVGFPSVGKSTLLNKLTGTFSEVASYEFTTLTCIPGVIMYRGAKIQLLDLPGIIEGAKDGKGRGRQVISTARTCNCILIVLDAIKPITHKRLIEKELEGFGIRLNKEPPNLTFRKKDKGGINFTSTVTNTHLDLDTVKAICSEYRIHNADITLRYDATADDLIDVIEGSRIYMPCIYVVNKIDQITLEELEILDKLPHYCPISAHLEWNLDGLLDKIWEYLDLTRIYTKPKGMNPDYEDPVILSSKRRTVEDFCTRIHKDMLKQFKYALVWGSSVKHKPQRVGKDHELEDEDVVQIIKKV

SEQ ID NO: 21343 - protein, 368 aa, Theobroma cacao
MATVMQKIKDIEDEMARTQKNKATAHHLGLLKAKLAKLRRELLTPSSKGGGAAGEGFDVTKSGDARVGLVGFPSVGKSTLLNKLTGTFSEVASYEFTTLTCIPGVIVYRGAKIQLLDLPGIIEGAKDGKGRGRQVISTARTCNCILIVLDAIKPITHKRLIEKELEGFGIRLNKEPPNLTFRKKDKGGINFTSTVANTLLDLETVKAICSEYRIHNADITLRYDATADDLIDVIEGSRIYMPCIYVVNKIDQITLEELEILDKLPHYCPVSAHLEWNLDGLLDKIWEYLDLTRIYTKPKGMNPDYEDPVILSSKKRTVEDFCNRIHKDMLKQFKYALVWGSSVKHKPQRVGKDHELEDEDVVQIIKKV

SEQ ID NO: 21344 - protein, 368 aa, Cichorium intybus
MATVMQKIKDIEDEMAKTQKNKATAHHLGLLKAKLAKLRRELLTPTSKGGGGAGEGFDVTKSGDARVGLVGFPSVGKSTLLNKLTGTFSEVASYEFTTLTCIPGVITYRGAKIQLLDLPGIIEGAKDGKGRGRQVISTARTCNCILIVLDAIKPITHKRLIEKELEGFGIRLNKEPPNLTFRKKDKGGINFTSTVANTHLDLETVKAICSEYRIHNADVTLRFDATADDLIDVIEGSRIYTPCIYVVNKIDQITLEELEILDKLPHYCPVSAHLEWNLDGLLEKIWEYLSLTRIYTKPKGMNPDYEDPVILSSKRKTVEDFCNRIHKDMLKQFKYALVWGSSAKHKPQRVGKEHELEDEDVVQIIKKV

SEQ ID NO: 21345 - protein, 368 aa, Gossypium hirsutum
MATVMQKIKDIEDEMARTQKNKATAHHLGLLKAKLAKLRRELLTPSSKGGGGAGEGFDVTKSGDARVGLVGFPSVGKSTLLNKLTGTFSEVASYEFTTLTCIPGVIMYRGAKIQLLDLPGIIEGAKDGKGRGRQVISTARTCNCILIVLDAIKPITHKRLIEKELEGFGIRLNKEPPNLTFRKKDKGGINFTSTVTNTHLDLDTVKAICSEYRIHNADITLRYDATADDLIDVIEGSRIYMPCIYVVNKIDQITLEELEILDKLPHYCPISAHLEWNLDGLLDKIWEYLNLTRIYTKPKGMNPDYEDPVILSSKRRTVEDFCTRIHKDMLKQFKYALVWGSSVKHKPQRVGKDHELEDEDVVQIIKKV

SEQ ID NO: 21346 - protein, 368 aa, Secale cereale
  Sequence also found in Organisms: Triticum aestivum
MATVMQKIKDIEDEMSKTQKNKATAHHLGLLKAKLAKLRRELLTPTTKGGGGAGEGFDVTKSGDARVGLVGFPSVGKSTLLNKLTGTFSEVASYEFTTLTCIPGVIMYKGAKVQLLDLPGIIEGAKDGKGRGRQVISTARTCNVILIVLDAIKPITHKRLIEKELEGFGIRLNKTPPNMTFRRKEKGGINFTSTVANTHLDLDTVKAICSEYRIHNADVSLRFDATADDLIDVIEGSRIYMPCIYVVNKIDQITVEELDILDKLPHYCPISAHLEWNLDGLLEMVWEYLDLCRLYTKPKGLNPDYEDPVILSSKRKTVEDFCNQIHKDMAKQFKYALVWGSSVKHKPQRVGKEHELEDEDVVQIIKKI

SEQ ID NO: 21347 - protein, 368 aa, Amorphophallus konjac
MATVMQKIKDIEDEMARTQKNKATAHHLGLLKAKLAKLRRELLEPSTKGGGGAGEGFDVTKSGDARVGLVGFPSVGKSTLLNKLTGTFSEVASYEFTTLTCIPGVIVYKGAKIQLLDLPGIIEGAKDGKGRGRQVISTARTCNIILIVLDAIKPITHKRLIEKELEGFGIRLNKEPPNLSFRKKDKGGINFTSTVANTHLDLETVKAICGEYRIHNADISLRYDATADDLIDVIEGSRKYMPCIYAVNKIDQITLEELEILDKLPHYCPISAHLEWNLDGLLEKIWDYLDLVRIYTKPKGMNPDYEDPVILSSKQRTVEDFCNRIHKDMMKQFKYALVWGSSVKHKPQRVGKEHELEDEDVVQIIKKV

SEQ ID NO: 21348 - protein, 369 aa, Aristolochia fimbriata
MATIMQKIKDIEDEMARTQKNKATAHHLGLLKAKLAKLRRELLDPPSKGGGGGAGQGFDVTKSGDSRVGLVGFPSVGKSTLLNKLTGTFSEVASYEFTTLTCIPGVIVYRGAKIQLLDLPGIIEGAKDGKGRGRQVISTARTCNCILIVLDALKPITHKRLIEKELEGFGIRLNKEPPNLTFRKKDKGGINFTSTVTNNHLDLETVKAICSEYRIHNADISLRYDATADDLIDVIEGSRIYMPCIYVVNKIDQITLEELEILDKLPHYSPVSAHLEWNLDGLLEKIWEYLDLTRIYTKPKGMNPDYEDPVILSSKKRTVEDFCNRIHKDMLKQFKYALVWGSSVKHKPQRVGKEHELEDEDVVQIIKKV

SEQ ID NO: 21349 - protein, 368 aa, Centaurea maculosa
MATVMQKIKDIEDEMAKTQKNKATAHHLGLLKAKLAKLRRELLTPTTKGGGGAGEGFDVTKSGDARVGLVGFPSVGKSTLLNKLTGTFSEVASYEFTTLTCIPGVITYRGAKIQLLDLPGIIEGAKDGKGRGRQVISTARTCNCILIVLDAIKPITHKRLIEKELEGFGIRLNKEPPNLTFRKKEKGGINFTSTVANTHLDLETVKAICSEYRIHNADVTLRFDATADDLIDVIEGSRIYTPCIYVVNKIDQITLEELEILDKLPHYCPVSAHLEWNLDGLLEMIWEYLSLTRIYTKPKGMNPDYEDPVILSSKRKTVEDFCNRIHKDMLKQFKYALVWGSSAKHKPQRVGKEHELEDEDVVQIIKKV

SEQ ID NO: 21350 - protein, 368 aa, Centaurea maculosa
  Sequence also found in Organisms: Cirsium arvense
MATVMQKIKDIEDEMAKTQKNKATAHHLGLLKAKLAKLRRELLTPTTKGGGGAGEGFDVTKSGDARVGLVGFPSVGKSTLLNKLTGTFSEVASYEFTTLTCIPGVITYRGAKIQLLDLPGIIEGAKDGKGRGRQVISTARTCNCILIVLDAIKPITHKRLIEKELEGFGIRLNKEPPNLTFRKKEKGGINFTSTVANTHLDLETVKAICSEYRIHNADVTLRFDATADDLIDVIEGSRIYTPCIYVVNKIDQITLEELEILDKLPHYCPVSAHLEWNLDGLLEMIWEYLSLTRIYTKPKGMNPDYEDPVILSSKHKTVEDFCNRIHKDMLKQFKYALVWGSSAKHKPQRVGKEHELEDEDVVQIIKKV

SEQ ID NO: 21351 - protein, 368 aa, Echinacea purpurea
  Sequence also found in Organisms: Helianthus annuus
MATVMQKIKDIEDEMAKTQKNKATAHHLGLLKAKLAKLRRELLTPTSKGGGGAGEGFDVTKSGDARVGLVGFPSVGKSTLLNKLTGTFSEVASYEFTTLTCIPGVITYRGAKIQLLDLPGIIEGAKDGKGRGRQVISTARTCNCILIVLDAIKPITHKRLIEKELEGFGIRLNKEPPNLTFRKKEKGGINFTSTVANTHLDLETVKAICSEYKIHNADVTLRFDATADDLIDVIEGSRIYTPCIYVVNKIDQITLEELEILDKLPHYCPVSAHLEWNLDGLLEMIWEYLNLTRIYTKPKGMNPDYEDPVILSSKKKTVEDFCFRIHKDMLKQFKYALVWGSSAKHKPQRVGKEHELEDEDVVQIIKKV

SEQ ID NO: 21352 - protein, 369 aa, Euonymus alatus
MATVMQKIKDIEDEMARTQKNKATAHHLGLLKAKLAKLRRELLTPSSKGGGGGAGEGFDVTKSGDARVGLVGFPSVGKSTLLNKLTGTFSEVASYEFTTLTCIPGVIMYRGAKLQLLDLPGIIEGAKDGKGRGRQVISTARTCNCILIVLDAIKPITHKRLIEKELEGFGIRLNKEPPNLTFRKKDKGGINLTSTVTNTNLDLETVKAICSEYRIHNADITLRCDATADDLIDVIEGSRIYMPCIYVVNKIDQITLEELEILDKLPHYCPVSAHLEWNLDGLLEKIWEYLNLTRIYTKPKGMNPDYEDPVILSSKKRTVEDFCVRIHKDMLKQFKFALVWGSSAKHKPQRVGREHELEDEDVVQIIKKV

SEQ ID NO: 21353 - protein, 368 aa, Flaveria ramosissima
MATVMQKIKDIEDEMAKTQKNKATAHHLGLLKAKLAKLRRELLTPTSKGGGGAGEGFDVTKSGDARVGLVGFPSVGKSTLLNKLTGTFSEVASYEFTTLTCIPGVITYRGAKIQLLDLPGIIEGAKDGKGRGRQVISTARTCNCILIVLDAIKPITHKRLIEKELEGFGIRLNKEPPNLTFRKKEKGGINFTSTVANTHLDLETVKAICSEYKIHNADVTLRFDATADDLIDVIEGSRIYTPCIYVVNKIDQITLEELEILDKLPHYCPVSAHLEWNLDGLLEMIWEYLNLTRIYTKPKGMNPDYEDPVILSSKKKTVEDFCIRIHKDMLKQFKYALVWGSSAKHKPQRVGKEHELEDEDVVQIIKKV

SEQ ID NO: 21354 - protein, 369 aa, Quercus alba
MSTVMQKIKDIEDEMAKTQKNKATAHHLGLLKAKLAKLRRELLAPPSKGGGGGAGEGFDVTKSGDARVGLVGFPSVGKSTLLNKLTGTFSEVASYEFTTLTCIPGVIVYRGAKIQLLDLPGIIEGAKDGKGRGRQVISTARTCNCILIVLDAIKPITHKRLIEKELEGFGIRLNKEPPNLTFRKKDKGGINFTSTVANTHLDLETVKAICSEYRIHNADITLRFDATADDLIDVIEGSRIYMPCIYVVNKIDQITLEELEILDKLPHYCPISAHLEWNLDGLLEKIWEYLNLTRIYTKPKGMNPDYEDPVILSSKHKTVEDFCERIHKDMVKQFKYALVWGSSAKHKPQRVGKEHELEDEDVVQIIKKV

SEQ ID NO: 21355 - protein, 368 aa, Avena sativa
MATVMQKIKDIEDEMSKTQKNKATAHHLGLLKAKLAKLRRELLTPTTKGGGGAGEGFDVTKSGDARVGLVGFPSVGKSTLLNKLTGTFSEVASYEFTTLTCIPGVIMYKGAKVQLLDLPGIIEGAKDGKGRGRQVISTARTCNVILIVLDAIKPITHKRLIEKELEGFGIRLNKTPPNMTFRRKEKGGINFTSTVANTHLDLDTVKAICSEYRIHNADVSLRFDATADDLIDVIEGSRIYMPCIYVVNKIDQITVEELNILDKLPHYCPISAHLEWNLDGLLEMVWEYLDLVRLYTKPKGLNPDYEDPVILSKKRKTVEDFCNQIHKDMAKQFKYALVWGSSVKHKPQRVGKEHELEDEDVIQIIKKI

SEQ ID NO: 21356 - protein, 368 aa, Brachypodium distachyon
MATVMQKIKDIEDEMSKTQKNKATAHHLGLLKAKLAKLRRELLTPTTKGGGGAGEGFDVTKSGDARVGLVGFPSVGKSTLLNKLTGTFSEVASYEFTTLTCIPGVIGYKGAKVQLLDLPGIIEGAKDGKGRGRQVISTARTCNVILIVLDAIKPITHKRLIEKELEGFGIRLNKTPPNMTFRKKEKGGINFTSTVANTHLDLDTVKAICSEYRIHNADISLRFDATADDLIDVIEGSRIYMPCIYVVNKIDQITVEELDILDKLPHYCPISAHLEWNLDGLLEMVWEYLDLVRIYTKPKGLNPDYEDPVILSTKRKTVEDFCNQIHKDMAKQFKYALVWGSSVKHKPQRVGKEHELEDEDVVQIIKKI

SEQ ID NO: 21357 - protein, 368 aa, Ricinus communis
MATVMQKIKDIEDEMARTQKNKATAHHLGLLKAKLAKLRRELLEPSSKGGGGAGQGFDVTKSGDARVGLVGFPSVGKSTLLNKLTGTFSEVASYEFTTLTCIPGVIVYRGAKIQLLDLPGIIEGAKDGKGRGRQVISTARTCNCILIVLDAIKPITHKRLIEKELEGFGIRLNKEPPNLTFRKKDKGGINFTTTVANTHLDLETVKAICSEYRIHNADITLRYDATADDLIDVIEGSRIYMPCIYVVNKIDQITLEELEILDKLPHYCPISAHLEWNLDGLLDKIWEYLDLTRIYTKPKGMNPDYEDPVILSSKKRTVEDFCIRIHKDMLKQFKYALVWGSSAKHKPQRVGKEHELEDEDVVQIIKKV

SEQ ID NO: 21358 - protein, 368 aa, Centaurea maculosa
MATVMQKIKDIEDEMAKTQKNKATAHHLGLLKAKLAKLRRELLTPTTKGGGGAGEGFDVTKSGDARVGLVGFPSVGKSTLLNKLTGTFSEVASYEFTTLTCIPGVITYRGAKIQLLDLPGIIEGAKDGKGRGRQVISTARTCNCILIVLDAIKPITHKRLIEKELEGFGIRLNKEPPNLTFRKKEKGGINFTSTVANTHLDLETVKAICSEYRIHNADVTLRFDATADDLIDVIEGSRIYTPCIYVVNKIDQITLEELEILDKLPHYCPVSAHLEWNLDGLLEMIWEYLSLTRIYTKPKGMNPDYEDPVILSSKRKTVEDFCNRIHKDILKQFKYALVWGSSAKHKPQRVGKEHELEDEDVVQIIKKV

SEQ ID NO: 21359 - protein, 368 aa, Festuca arundinacea
MATVMQKIKDIEDEMAKTQKNKATAHHLGGLKAKLAKLRRELLTPTTKGGGGAGERFDVTKSGDARVGLVGFPSVGKSTLLNKLTGTFSEVASYEFTTLTCIPGVIMYKGAKVQLLDLPGIIEGAKDGKGRGRQVISTARTCNVILIVLDAIKPITHKRLIEKELEGFGIRLNKTPPNMTFRRKEKGGINFTSTVANTHLDLDTVKAICSEYRIHNADVSLRFDATADDLIDVIEGSRIYMPCIYVVNKIDQITVEELDILDKLPHYCPISAHLEWNLDGLLEMVWEYLDLVRLYTKPKGLNPDYEDPVILSTKRKTVEDFCNQIHKDMAKQFKYALVWGSSVKHKPQRVGKEHELEDEDVIQIIKKI

SEQ ID NO: 21360 - protein, 368 aa, Leymus cinereus x Leymus triticoides
MATVMQKIKDIEDEMSKTQKNKATAHHLGLLKAKLAKLRRELLTPTTKGGGGAGEGFDVTKSGDARVGLVGFPSVGKSTLLNKLTGTFSEVASYEFTTLTCIPGVIMYKGAKVQLLDLPGIIEGAKDGKGRGRQVISTARTCNVILIVLDAIKPITHKRLIEKELEGFGIRLNKTPPNMTFRSKEKGGIHFTSTLANTHLDLDTVKAICSEYRIHNADVSLRFDATADDLIDVIEGSRIYMPCIYVVNKIDQITVEELDILDKLPHYCPISAHLEWNLDGLLEMVWEYLDLVRLYTKPKGLNPDYEDPVILSSKRKTVEDFCNQIHKDMAKQFKYALVWGSSVKHKPQRVGKEHELEDEDVVQIIKKI

SEQ ID NO: 21361 - protein, 368 aa, Avena sativa
MATVMQKIKDIEDEMSKTQKNKATAHHLGLLKAKLAKLRRELLTPTTKGGGGAGEGFDVTKSGDARVGLVGFPSVGKSTLLNKLTGTFSEVASYEFTTLTCIPGVIMYKGAKVQLLDLPGIIEGAKDGKGRGRQVISTARTCNVILIVLDAIKPITHKRLIEKELEGFGIRLNKTPPNMTFRRKEKGGINFTSTVANTHLDLDTVKAICSEYRIHNADVSLRFDATADDLIDVIEGSRIYMPCIYVVNKIDQITVEELNILDKLPHYCPISAHLEWNLDGLLEMVWEYLDLVRLYTKPKGLNPDYEDPVILSKRRKTVEDFCNQIHKDMAKQFKYALVWGSSVKHKPQRVGKEHELEDEDVIQIIKKI

SEQ ID NO: 21362 - protein, 368 aa, Helianthus annuus
MATVMQKIKDIEDEMAKTQKNKATAHHLGLLKAKLAKLRRELLTPTTKGGGGAGEGFDVTKSGDARVGLVGFPSVGKSTLLNKLTGTFSEVASYEFTTLTCIPGVITYRGAKIQLLDLPGIIEGAKDGKGRGRQVISTARTCNCILIVLDAIKPITHKRLIEKELEGFGIRLNKEPPNLTFRKKEKGGINFTSTVANTHLDLETVKAICSEYKIHNADVTLRFDATADDLIDVIEGSRIYTPCIYVVNKIDQITLEELEILDKLPHYCPVSAHLEWNLDGLLEMIWEYLNLTRIYTKPKGMNPDYEDPVILSSKKKTVEDFCFRIHKDMLKQFKYALVWGSSAKHKPQRVGKEHELEDEDVVQIIKKV

SEQ ID NO: 21363 - protein, 368 aa, Ambrosia trifida
MATVMQKIKDIEDEMAKTQKNKATAHHLGLLKAKLAKLRRELLTPTTKGGGGAGEGFDVTKSGDARVGLVGFPSVGKSTLLNKLTGTFSEVASYEFTTLTCIPGVITYRGAKIQLLDLPGIIEGAKDGKGRGRQVISTARTCNCILIVLDAIKPITHKRLIEKELEGFGIRLNKEPPNLTFRKKEKGGINFTSTVANTHLDVETVKAICSEYKIHNADVTLRFDATADDLIDVIEGSRIYTPCIYVVNKIDQITLEELEILDKLPHYCPVSAHLEWNLDGLLEMIWEYLNLTRIYTKPKGMNPDYEDPVILSSKKKTVEDFCFRIHKDMLKQFKYALVWGSSAKHKPQRVGKEHELEDEDVVQIIKKV

SEQ ID NO: 21364 - protein, 368 aa, Nicotiana benthamiana
MATVMQKIKDIEDEMAKTQKNKATAHHLGLLKAKLAKLRRELLTPTSKGGGGAGEGFDVTKSGDARVGLVGFPSVGKSTLLNKLTGTFSEVASYEFTTLTCIPGVIMYRGAKIQLLDLPGIIEGAKDGKGRGRQVISTARTCNCILIVLDAIKPITHKRLIEKELEGFGIRLNKEPPNLTFRKKEKGGINLTSTVTNTHLDLDTVKAICSEYRIHNADVHLRYDATADDLIDVIEGSRVYTPCIYVVNKIDQITVEELEILDKLPHYCPISAHLEWNLDGLLEKIWEYLSLTRIYTKPKGMNPDYEDPVILSSKRRTVEDFCDRIHKDMVKQFKYALVWGSSAKHKPQRVGREHELEDEDVVQIIKKV

SEQ ID NO: 21365 - protein, 368 aa, Phalaenopsis aphrodite
MATVMQKIKDIEDEMARTQKNKATAHHLGLLKAKLAKLRRELLVPSSKGGGGAGEGFDVTKSGDARVGLVGFPSVGKSTLLNKLTGTFSEVASYEFTTLTCIPGVIMYRGAKIQLLDLPGIIEGAKDGKGRGRQVISTARTCNCILIVLDAIKPITHKRIIEKELEGFGIRLNKEPPNLTFRKKDKGGINLTSTVTNTHLDLETVKAICGEYRIHNADITLRYDATADDLIDVIEGSRIYTPCIYVVNKIDQITLEELEILDKLPHYCPISAHLEWNLDGLLEKIWEYLNLTRIYTKPKGMNPDYEDPVILSSKKRTVEDFCNKIHKDMLKQFKYALVWGSSAKHKPQRVGREHELEDEDVVQIIKKV

SEQ ID NO: 21366 - protein, 368 aa, Solanum lycopersicum
MATVMQKIKDIEDEMAKTQKNKATAHHLGLLKAKLAKLRRELLTPTSKGGGGAGEGFDVTKSGDARVGLVGFPSVGKSTLLNKLTGTFSEVASYEFTTLTCIPGVIMYRGAKIQLLDLPGIIEGAKDGKGRGRQVISTARTCNCILIVLDAIKPITHKRLIEKELEGFGIRLNKEPPNMTFRKKEKGGINLTSTVTNTHLDLDTVKAICSEYRIHNADVHLRYDATADDLIDVIEGSRVYTPCIYVVNKIDQITMEELEILDKLPHYCPISAHLEWNLDGLLEKIWEYLSLTRIYTKPKGMNPDYEDPVILSSKRRTVEDFCDRIHKDMVKQFKYALVWGSSAKHKPQRVGKEHELEDEDVVQIIKKV

SEQ ID NO: 21367 - protein, 368 aa, Tragopogon dubius
MATVMQKIKDIEDEMAKTQKNKATAHHLGLLKAKLAKLRRELLTPTTKGGGGAGEGFDVTKSGDARVGLVGFPSVGKSTLLNKLTGTFSEVASYEFTTLTCIPGVITYRGAKIQLLDLPGIIEGAKDGKGRGRQVISTARTCNCILIVLDAIKPITHKRLIEKELEGFGIRLNKEPPNLTFRKKDKGGINFTSTVANTHLDLETVKAICSEYRIHNADVTLRFDATADDLIDVIEGSRIYTPCIYVVNKIDQITIEELEILDKLPHYCPVSAHLEWNLDGLLEKIWEYLSLTRIYTKPKGMNPDYEDPVILSSKRTTVEDFCNRIHKDMLKQFKYALVWGSSAKHKPQRVGKEHELEDEDVVQIIKKV

SEQ ID NO: 21368 - protein, 368 aa, Glycine max
MATVMQKIKDIEDEMARTQKNKATAHHLGLLKAKLAKLRRELLTPSSKGAGGAGEGFDVTKSGDSRVGLVGFPSVGKSTLLNKLTGTFSEVASYEFTTLTCIPGVITYRGAKIQLLDLPGIIEGAKDGKGRGRQVISTARTCNCILIVLDAIKPITHKRLIEKELEGFGIRLNKEPPNLTFRKKDKGGLNLTSTVTTTHLDLETVKAICSEYRIHNADITLRYDATADDLIDVIEGSRVYIPCIYVVNKIDQITLEELEILDKLPHYCPISAHLEWNLDGLLEKIWEYLDLTRIYTKPKGMNPDYEDPVILSSKKRTVEDFCDRIHKDMLKQFKYALVWGSSAKHKPQRVGKEHELEDEDVVQIIKKV

SEQ ID NO: 21369 - protein, 368 aa, Ambrosia trifida
MATVMQKIKDIEDEMAKTQKNKATAHHLGLLKAKLAKLRRELLTPTTKGGGGAGEGFDVTKSGDARVGLVGFPSVGKSTLLNKLTGTFSEVASYEFTTLTCIPGVITYRGAKIQLLDLPGIIEGAKDGKGRGRQVISTARTCNCILIVLDAIKPITHKRLIEKELEGFGIRLNKEPPNLTFRKKEKGGINFTSTVANTHLDVETVKAICSEYKIHNADVTLRFDATADDLIDVIEGSRIYTPCIYVVNKIDQITLEELEILDKLPHYCPVSAHLEWNLDGLLEMIWEYLNLTRIYTKPKGMNPDYEDPVILSSKKKTVEDFCFRIHKDMLKRFKYALVWGSSAKHKPQRVGKEHELEDEDVVQIIKKV

SEQ ID NO: 21370 - protein, 368 aa, Cicer arietinum
MATVMQKIKDIEDEMARTQKNKATAHHLGLLKAKLAKLRRELLTPTSKGGGGAGEGFDVTKSGDARVGLVGFPSVGKSTLLNKLTGTFSEVASYEFTTLTCIPGVITYRGAKIQLLDLPGIIEGAKDGKGRGRQVISTARTCNCILIVLDAIKPITHKRLIEKELEGFGIRLNKEPPNLTFRRKEKGGINFTSTATNTHLDLDTVKAICSEYRIHNADITLRYDATADDLIDVIEGSRVYTPCIYVVNKIDQITLEELEILDKLPHYCPVSAHLEWNLDGLLDKVWEYLNLTRIYTKPKGMNPDYEDPVILSSKKKTIEDFCERIHKDMLKQFKYALVWGSSAKHKPQRVGKEHELEDEDVVQIIKKV

SEQ ID NO: 21371 - protein, 368 aa, Vitis vinifera
MATVMQKIKDIEDEMARTQKNKATAHHLGLLKAKLAKLRRELLAPSSKGAGGPGEGFDVTKSGDSRVGLVGFPSVGKSTLLNKLTGTFSEVASYEFTTLTCIPGVITYRGAKIQLLDLPGIIEGAKDGKGRGRQVISTARTCNCILIVLDAIKPITHKRLIEKELEGFGIRLNKEPPNLTFRKKDKGGINFTSTVTNTNLDLETVKAICSEYRIHNADVSLRYDATADDLIDVIEGSRVYIPCIYAVNKIDQITLEELEVLDKLPHYCPVSAHLEWNLDGLLEKIWEYLDLTRIYTKPKGMNPDYEDPVILSSKRRTVEDFCSRIHKDMLKQFKYALVWGSSVKHKPQRVGREHELEDEDVVQIIKKV

SEQ ID NO: 21372 - protein, 368 aa, Lactuca sativa
MATVMQKIKDIEDEMAKTQKNKATAHHLGLLKAKLAKLRRELLTPTTKGGGGAGEGFDVTKSGDARVGLVGFPSVGKSTLLNKLTGTFSEVASYEFTTLTCIPGVITYRGAKIQLLDLPGIIEGAKDGKGRGRQVISTARTCNCILIVLDAIKPITHKRLIEKELEGFGIRLNKEPPNLTFRKKEKGGINFTSTVANTHLDLETVKAICSEYKIHNADVTLRFDATADDLIDVIEGSRIYTPCIYVVNKIDQITLEELQILDKLPHYCPVSAHLEWNLDGLLEMIWEYLSLTRIYTKPKGMNPDYEDPVILSSKRKTVEDFCFRIHKDMLKQFKYALVWGSSAKHKPQRVGKEHELEDEDVVQIIKKV

SEQ ID NO: 21373 - protein, 368 aa, Arachis hypogaea
MATVMQKIKDIEDEMARTQKNKATAHHLGLLKAKLAKLRRELLTPSSKGAGGAGEGFDVTKSGDSRVGLVGFPSVGKSTLLNKLTGTFSEVASYEFTTLTCIPGVITYRGAKIQLLDLPGIIEGAKDGKGRGRQVISTARTCNCILIVLDAIKPITHKRLIEKELEGFGIRLNKEPPNLTFRKKDKGGINLTSTVTNTHLDLDTVKAICSEYKIHNADITLRYDATADDLIDVIEGSRVYMPCIYVVNKIDQITLEELEILDKLPHYCPISAHLEWNLDGLLEKIWEYLNLTRIYTKPKGMNPDYEDPVILSSKRRTVEDFCNRIHKDMLKQFKYALVWGSSAKHKPQRVGKEHELEDEDVVQIIKKV

SEQ ID NO: 21374 - protein, 368 aa, Cajanus cajan
MATVMQKIKDIEDEMARTQKNKATAHHLGLLKAKLAKLRRELLTPTSKGGGGAGEGFDVTKSGDSRVGLVGFPSVGKSTLLNKLTGTFSEVASYEFTTLTCIPGVITYRGAKIQLLDLPGIIEGAKDGKGRGRQVISTARTCNCILIVLDAIKPITHKRLIEKELEGFGIRLNKEPPNLTFRKKDKGGINLTSTATTTHLDLDTVKAICSEYRIHNADITLRYDATADDLIDVIEGSRVYMPCIYVVNKIDQITLEELEILDKLPHYCPISAHLEWNLDGLLDKIWEYLSLTRIYTKPKGMNPDYEDPVILSSKRRTVEDFCNRIHKDMLKQFKYALVWGSSAKHKPQRVGKEHELEDEDVVQIIKKV

SEQ ID NO: 21375 - protein, 368 aa, Solanum tuberosum
  Sequence also found in Organisms: Solanum phureja
MATVMQKIKDIEDEMAKTQKNKATAHHLGLLKAKLAKLRRELLTPTSKGGGGAGEGFDVTKSGDARVGLVGFPSVGKSTLLNKLTGTFSEVASYEFTTLTCIPGVIMYRGAKIQLLDLPGIIEGAKDGKGRGRQVISTARTCNCILIVLDAIKPITHKRLIEKELEGFGIRLNKEPPNMTFRKKEKGGINLTSTVTNTHLDLDTVKAICSEYRIHNADVHLRYDATADDLIDVIEGSRVYTPCIYVVNKIDQITMEELEILDKLPHYCPISAHLEWNLDGLLEKIWEYLSLTRIYTKPKGMNPDYEDPVILSSRRRTVEDFCERIHKDMVKQFKYALVWGSSAKHKPQRVGKEHELEDEDVVQIIKKV

SEQ ID NO: 21376 - protein, 368 aa, Nicotiana tabacum
MATVMQKIKDIEDEMAKTQKNKATAHHLGLLKAKLAKLRRELLTPTSKGGGGAGEGFDVTKSGDARVGLVGFPSVGKSTLLNKLTGTFSEVASYEFTTLTCIPGVIMYRGAKIQLLDLPGIIEGAKDGKGRGRQVISTARTCNCILIVLDAIKPITHKRLIEKELEGFGIRLNKEPPNLTFRTKEKGGINLTSTVTNTHFDLDTVKAICSEYRIHNADVHLRYDATADDLIDVIEGSRVYTPCIYVVNKIDQITMEELEILDKLPHYCPISAHLEWNLDGLLEKIWEYLSLTRIYTKPKGMNPDYEDPVILSSKRRTVEDFCDRIHKDMVKQFKYALVWGSSAKHKPQRVGREHELEDEDVVQIIKKV

SEQ ID NO: 21377 - protein, 368 aa, Cycas rumphii
MATVMQKIKDIEDEMAKTQKNKATAHHLGLLKAKLAKLRREILAPPTKGGGGAGEGFDVTKSGDSRVGLVGFPSVGKSTLLNKLTGTFSEVASYEFTTLTCIPGVIRYRGAKIQLLDLPGIIEGAKDGKGRGRQVISTARTCNCILIVLDAIKPITHKRLIEKELEGFGIRLNKEPPNLTFRKKDKGGINFTSTVTNTHLDLETVKAICGEYRIHNADISLRYDATADDLIDVIEGSRVYMPCIYVINKIDQITLEELEILDKLPHYCPVSAHLEWNLDGLLEKIWEYLDLTRIYTKPKGLNPDYEDPVILSSKKRTVEDFCLRIHKDMLKQFKYALVWGSSVKHKPQRVGRDHELEDEDVVQIIKKV

SEQ ID NO: 21378 - protein, 368 aa, Rosmarinus officinalis
MATVMQKIKDIEDEMARTQKNKATAHHLGLLKAKLAKLRREILTPASKGGGGAGEGFDVTKSGDSRVGLVGFPSVGKSTLLNKLTGTFSEVASYEFTTLTCIPGVITYRGAKIQLLDLPGIIEGAKDGKGRGRQVISTARTCNCILIVLDAIKPITHKRLIEKELEGFGIRLNKEPPNLSFRRKDKGGINLTSTVTNTNLDLDTVKAICGEYRIHNADINLRYDATADDLIDVIEGSRVYMPCIYVVNKIDQITLEELEILDKLPHYCPISAHLEWNLDGLLEKIWEYLNLTRIYTKPKGMNPDYDDPVILSSKKRTVEDFCIRIHKDMLKQYKYALVWGSSAKHKPQRVGKEHELEDEDVVQIIKKV

SEQ ID NO: 21379 - protein, 368 aa, Arnica chamissonis
MATVMQKIKDIEDEMAKTQKNKATAHHLGLLKAKLAKLRRELLTPTTKGGGGAGEGFDVTKSGDARVGLVGFPSVGKSTLLNKLTGTFSEVASYEFTTLTCIPGVITYRGAKIQLLDLPGIIEGAKDGKGRGRQVISTARTCNCILIVLDAIKPITHKRLIEKELEGFGIRLNKEPPNLTFRKKEKGGINFTSTVANTHLDLETVKAICSEYKIHNADVTLRFDATADDLIDVIEGSRIYTPCIYVVNKIDQITFEELEILDKLPHYCPVSAHLEWNLDGLLEMIWEYLNLTRIYTKPKGMNPDYEDPVILSSKRKTVEDFCFRIHKDMLKQFKYALVWGSSAKHKPQRVGKEHELEDEDVVQIIKKI

SEQ ID NO: 21380 - protein, 368 aa, Beta vulgaris
MATVMQKIKDIEDEMARTQKNKATAHHLGLLKAKLAKLRRDLLTPSAKGGGGAGEGFDVTKSGDARVGLVGFPSVGKSTLLNKLTGTFSEVASYEFTTLTCIPGVIMYRGAKIQLLDLPGIIEGAKDGKGRGRQVISTARTCNCILIVLDAIKPITHKRLIEKELEGFGIRLNKEPPNLTFRRKEKGGINLTSTATNTHLDLETVKAICSEYRIHNADISLRYDATADDLIDVIEGSRVYMPCIYVINKIDQITLEELEILDKLPHYCPISAHLEWNLDGLLEKIWEYLNLTRIYTKPKGMNPDYNDPVILSSRKRTVEDFCERIHKDMVKQFKSALVWGSSAKHKPQRVGKEHELEDEDVVQIIKKI

SEQ ID NO: 21381 - protein, 368 aa, Trifolium pratense
MATVMQKIKDIEDEMAKTQKNKATAHHLGLLKAKLAKLRRELLTPTTKGGGGAGEGFDVTKSGDARVGLVGFPSVGKSTLLNKLTGTFSEVASYEFTTLTCIPGVITYRGAKIQLLDLPGIIEGAKDGKGRGRQVISTARTCNCILIVLDAIKPITHKRLIEKELEGFGIRLNKEPPNLTFRRKEKGGINFTSTATNTHLDLDTVKAICSEYRIHNADITLRYDATADDLIDVIEGSRIYTPCIYVVNKIDQITLEELEILDKLPHYCPVSAHLEWNLDGLLDKVWEYLSLTRIYTKPKGMNPDYEDPVILSSKKKTVEDFCDRIHKDMLKQFKYALVWGSSAKHKPQRVGKEHELEDEDVVQIIKKI

SEQ ID NO: 21382 - protein, 368 aa, Trifolium pratense
MSTVMQKIKDIEDEMAKTQKNKATAHHLGLLKAKLAKLRRELLTPTTKGGGGAGEGFDVTKSGDARVGLVGFPSVGKSTLLNKLTGTFSEVASYEFTTLTCIPGVITYRGAKIQLLDLPGIIEGAKDGKGRGRQVISTARTCNCILIVLDAIKPITHKRLIEKELEGFGIRLNKEPPNLTFRRKEKGGINFTSTATNTHLDLDTVKAICSEYRIHNADITLRYDATADDLIDVIEGSRIYTPCIYVVNKIDQITLEELEILDKLPHYCPVSAHLEWNLDGLLDMVWEYLSLTRIYTKPKGMNPDYEDPVILSSKKKTVEDFCDRIHKDMLKQFKYALVWGSSAKHKPQRVGKEHELEDEDVVQIIKKI

SEQ ID NO: 21383 - protein, 368 aa, Pisum sativum
MATVMQKIKDIEDEMAKTQKNKATAHHLGLLKAKLAKLRRELLTPTTKGGGGAGEGFDVTKSGDARVGLVGFPSVGKSTLLNKLTGTFSEVASYEFTTLTCIPGVITYRGAKIQLLDLPGIIEGAKDGKGRGRQVISTARTCNCILIVLDAIKPITHKRLIEKELEGFGIRLNKEPPNLTFRRKEKGGINFTSTATNTHLDLDTVKAICSEYRIHNADITLRYDATADDLIDVIEGSRIYTPCIYVVNKIDQITLEELEILDKLPHYCPVSAHLEWNLDGLLDKVWEYLCLTRIYTKPKGMNPDYEDPVILSSKKKTVEDFCDRIHQDMLKQFKYALVWGSSAKHKPQRVGKEHELEDEDVVQIIKKV

SEQ ID NO: 21384 - protein, 368 aa, Sesamum indicum
MATVMQKIKDIEDEMARTQKNKATAHHLGLLKAKLAKLRREILTPASKGGGGAGEGFDVTKSGDARVGLVGFPSVGKSTLLNKLTGTFSEVASYEFTTLTCIPGVITYRGAKIQLLDLPGIIEGAKDGKGRGRQVISTARTCNCILIVLDAIKPITHKRLIEKELEGFGIRLNKEPPNLTFRRKDKGGINLTSTVTNTHLDLETVKAICGEYRIHNADINLRYDATADDLIDVIEGSRVYMPCIYAINKIDQITLEELEILDKLPHYCPVSAHLEWNLDGLLEKVWEYLNLTRIYTKPKGMNPDYEDPVILSSKRRTVEDFCNRIHKDMLKQFKYALVWGSSAKHKPQRVGKEHELEDEDVVQIIKKV

SEQ ID NO: 21385 - protein, 368 aa, Trigonella foenum-graecum
MATVMQKIKDIEDEMAKTQKNKATAHHLGLLKAKLAKLRRELLTPTTKGGGGAGEGFDVTKSGDARVGLVGFPSVGKSTLLNKLTGTFSEVASYEFTTLTCIPGVITYRGAKIQLLDLPGIIEGAKDGKGRGRQVISTARTCNCILIVLDAIKPITHKRLIEKELEGFGIRLNKEPPNLTFRRKEKGGINFTSTATNTHLDLDTVKAICSEYRIHNADITLRYDATADDLIDVIEGSRVYTPCIYVVNKIDQITLEELEILDKLPHYCPVSAHLEWNLDGLLDKVWEYLNLTRIYTKPKGMNPDYEDPVILSSKKKTVEDFCDRIHKDMLKQFKYALVWGSSAKHKPQRVGKEHELEDEDVVQIIKKV

SEQ ID NO: 21386 - protein, 368 aa, Glycine max
MATVMQKIKDIEDEMAKTQKNKATAHHLGLLKAKLAKLRRELLTPSSKGAGGAGEGFDVTKSGDSRVGLVGFPSVGKSTLLNKLTGTFSEVASYEFTTLTCIPGVITYRGAKIQLLDLPGIIEGAKDGKGRGRQVISTARTCNCILIVLDAIKPITHKRLIEKELEGFGIRLNKEPPNLTFRKKDKGGLNLTSTVTTTHLDLETVKAICSEYRIHNADITLRYDATADDLIDVIEGSRVYIPCIYVVNKIDQITLEELEILDKLPHYCPISAHLEWNLDGLLEKIWEYLNLTRIYTKPKGMNPDYEDPVILSSKKRTVEDFCDRIHKDMLKQFKYALVWGSSAKHKPQRVGKEHELEDEDVVQIIKKV

SEQ ID NO: 21387 - protein, 368 aa, Phaseolus vulgaris
MATVMQKIKDIEDEMARTQKNKATAHHLGLLKAKLAKLRRDLLTPSSKGGGGAGEGFDVTKSGDSRVGLVGFPSVGKSTLLNKLTGTFSEVASYEFTTLTCIPGVITYRGAKLQLLDLPGIIEGAKDGKGRGRQVISTARTCNCILIVLDAIKPITHKRLIEKELEGFGIRLNKEPPNLTFRKKDKGGINLTSTVTTTLLDLETVKAICSEYRIHNADITLRYDATADDLIDVIEGSRVYMPCIYAVNKIDQITLEELEILDKLPHYCPVSAHLEWNLDGLLDKIWEYLSLTRIYTKPKGMNPDYEDPVILSSKKRTVEDFCNRIHKDMLKQFKYALVWGSSAKHKPQRVGKEHELEDEDVVQIIKKV

SEQ ID NO: 21388 - protein, 368 aa, Humulus lupulus
MATVMQKIKDIEDEMARTQKNKATAHHLGLLKAKLAKLRRDLLTPSTKGAGGAGEGFDVTKSGDARVGLVGFPSVGKSTLLNKLTGTFSEVASYEFTTLTCIPGVIGYRGAKIQLLDLPGIIEGAKDGKGRGRQVISTARTCNCILIVLDAIKPITHKRLIEKELEGFGIRLNKEPPNLTFRKKDKGGINFTSTVTNTHLDLDTVKAICSEYRIHNADITLRFDATADDLIDVIEGSRIYMPCIYVVNKIDQITLEELEILDKLPHYCPISAHLEWNLDGLLDKVWEYLNLTRIYTKPKGMNPDYEDPVILSSKRRTVEDFCERIHKDMLKQFKYALVWGSSAKHKPQRVGKEHELEDEDVVQIIKKV

SEQ ID NO: 21389 - protein, 368 aa, Lotus japonicus
MATVMQKIKDIEDEMAKTQKNKATAHHLGLLKAKLAKLRRELLTPTTKGGGGAGEGFDVTKSGDSRVGLVGFPSVGKSTLLNKLTGTFSEVASYEFTTLTCIPGVITYRGAKIQLLDLPGIIEGAKDGKGRGRQVISTARTCNCILIVLDAIKPITHKRLIEKELEGFGIRLNKEPPNLTFRKKEKGGINFTSTAANTNLDLDTVKAICSEYKIHNADITLRYDATADDLIDVIEGSRVYIPCIYVVNKIDQITLEELEILDKLPHYCPISAHLEWNLDGLLEKIWEYLSLTRIYTKPKGMNPDYEDPVILSSKKRTVEDFCTRIHKDMLKQFKYALVWGSSAKHKPQRVGKEHELEDEDVVQIIKKV

SEQ ID NO: 21390 - protein, 368 aa, Medicago truncatula
MSTVMQKIKDIEDEMAKTQKNKATAHHLGLLKAKLAKLRRELLTPTTKGGGGAGEGFDVTKSGDARVGLVGFPSVGKSTLLNKLTGTFSEVASYEFTTLTCIPGVITYRGAKIQLLDLPGIIEGAKDGKGRGRQVISTARTCNCILIVLDAIKPITHKRLIEKELEGFGIRLNKEPPNLTFRRKEKGGINFTSTATNTHLDLDTVKAICSEYRIHNADITLRYDATADDLIDVIEGSRVYTPCIYVVNKIDQITLEELEILDKLPHYCPVSAHLEWNLDGLLDKVWEYLNLTRIYTKPKGMNPDYEDPVILSSKKKTVEDFCDRIHKDMLKQFKYALVWGSSAKHKPQRVGKEHELEDEDVVQIIKKV

SEQ ID NO: 21391 - protein, 368 aa, Malus domestica
MATLMQKIKDIEDEMARTQKNKATAHHLGLLKAKLAKLRRDLLEPPSKGGGGAGEGFDVTKSGDARVGLVGFPSVGKSTLLNKLTGTFSEVASYEFTTLTCIPGVIVYRGAKIQLLDLPGIIEGAKDGKGRGRQVISTARTCNCILIVLDAIKPITHKRLIEKELEGFGIRLNKEPPNLTFRKKDKGGINFTSTVTNTHLDLETVKAICSEYRIHNADITLRFDATADDLIDVIEGSRIYMPCIYVVNKIDQITLEELEILDKLPHYCPVSAHLEWNLDGLLEKIWEYLNLTRIYTKPKGMNPDYEDPVILSSKTRTVEDFCERIHKDFIKQFKFALVWGSSAKHKPQRVGKEHLLEDEDVVQIIKKV

SEQ ID NO: 21392 - protein, 368 aa, Chrysanthemum coronarium
MATVMQKIKDIEDEMAKTQKNKATAHHLGLLKAKLAKLRRELLTPTTKGGGGAGEGFDVTKSGDARVGLVGFPSVGKSTLLNKLTGTFSEVASYEFTTLTCIPGVITYRGAKIQLLDLPGIIEGAKDGKGRGRQVISTARTCNCIIIVLDAIKPITHKRLIEKELEGFGIRLNKEPPNLTFRKKEKGGINFTSTVANTHLDLDTVKAICSEYKIHNADVTLRFDATADDLIDVIEGSRIYTPCIYAVNKIDQITLEELEILDRLPHYCPVSAHLEWNLDGLLEMIWEYLNLTRIYTKPKGMNPDYEDPVILSSKRKTVEDFCFRIHKDMLKQFKYALVWGSSAKHKPQRVGKEHELEDEDVVQIIKKV

SEQ ID NO: 21393 - protein, 368 aa, Chrysanthemum coronarium
MATVMQKIKDIEDEMAKTQKNKATAHHLGLLKAKLAKLRRELLTPTTKGGGGAGEGFDVTKSGDARVGLVGFPSVGKSTLLNKLTGTFSEVASYEFTTLTCIPGVITYRGAKIQLLDLPGIIEGAKDGKGRGRQVISTARTCNCIIIVLDAIKPITHKRLIEKELEGFGIRLNKEPPNLTFRKKEKGGINFTSTVANTHLDLDTVKAICSEYKIHNADVTLRFDATADDLIDVIEGSRIYTPCIYAVNKIDQITLEELEILDRLPHYCPVSAHLEWNLDGLLEMIWEYLSLTRIYTKPKGMNPDYEDPVILSSKRKTVEDFCFRIHKDMLKQFKYALVWGSSAKHKPQRVGKEHELEDEDVVQIIKKV

SEQ ID NO: 21394 - protein, 365 aa, Euonymus alatus
MQKIKDIEDEMARTQKNKATAHHLGLLKAKLAKLRRELLTPSSKGGGGGAGEGFDVTKSGDARVGLVGFPSVGKSTLLNKLTGTFSEVASYEFTTLTCIPGVIMYRGAKLQLLDLPGIIEGAKDGKGRGRQVISTARTCNCILIVLDAIKPITHKRLIEKELEGFGIRLNKEPPNLTFRKKDKGGINLTSTVTNTNLDLETVKAICSEYGIHNADITLRCDATADDLIDVIEGSRIYMRCIYVVNKIDQITLEELEILDKLPHYCPVSAHLEWNLDGLLEKIWEYLNLTRIYTKPKGMNPDYEDPVILSSKKRTVEDFCIRIHKDMLKQFKFALVWGSSAKHKPQRVGREHELEDEDVVQIIKKV

SEQ ID NO: 21395 - protein, 368 aa, Lupinus angustifolius
MATVMQKIKDIEDEMAKTQKNKATAHHLGLLKAKLAKLRRELLTPSTKGGGGAGEGFDVTKSGDSRVGLVGFPSVGKSTLLNKLTGTFSEVASYEFTTLTCIPGVITYRGAKIQLLDLPGIIEGAKDGKGRGRQVISTARTCNCILIVLDAIKPITHKRLIEKELEGFGIRLNKEPPNLTFRRKEKGGINFTSTAANTNLDLDTVKAICSEYRIHNADITLRYDATADDLIDVIEGSRVYIPCIYVVNKIDQITLEELEILDKLPHYCPISAHLEWNLDGLLEKIWEYLDLTRVYTKPKGMNPDYEDPVILSSKKRTVDDFCTRIHKDMLKQFKYALVWGSSAKHKPQRVGKEHELEDEDVVQIIKKI

SEQ ID NO: 21396 - protein, 368 aa, Lippia dulcis
MATVMQKIKDIEDEMARTQKNKATAHHLGLLKAKLAKLRREILAPATKGGGGAGEGFDVTKSGDARVGLVGFPSVGKSTLLNKLTGTFSEVASYEFTTLTCIPGVITYRGAKIQLLDLPGIIEGAKDGKGRGRQVISTARTCNCILIVLDAIKPITHKRLIEKELEGFGIRLNKEPPNLTFRRKEKGGINLTSTVTNTHLDLETVKAICGEYRIHNADINLRYDATADDLIDVIEGSRVYMPCIYVVNKIDQITLEELEILDKLPHYCPVSAHLEWNLDGLLDKVWEYLNLTRIYTKPKGMNPDYEDPVILSSKRRTVEDFCNRIHKDMLKQFKYALVWGSSVKHKPQRVGREHELEDEDVVQIIKKV

SEQ ID NO: 21397 - protein, 368 aa, Populus trichocarpa
MSTVMQKIKDIEDEMARTQKNKATAHHLGLLKAKLAKLRRELLEPSAKGGGGAGQGFDVTKSGDARVGLVGFPSVGKSTLLNKLTGTFSEVASYEFTTLTCIPGVIVYKGAKIQLLDLPGIIEGAKDGKGRGRQVISTARTCNCILIVLDAIKPITHKRLIEKELEGFGIRLNKEPPNLTFRKKDKGGINFTSTVANTHLDLDTVKAICSEYRMHNADITLRYDATADDLIDVIEGSRIYMPCIYVVNKIDQITLEELEILDKLPHYCPVSAHLEWNLDGLLDKVWEYLNLTRIYTKPKGMNPDYEDPVILSSKKRTVEDFCERIHKDMLKQFKYALVWGSSAKHKPQRVGKEHELEDEDVVQIIKKV

SEQ ID NO: 21398 - protein, 368 aa, Prunus persica
  Sequence also found in Organisms: Prunus mume
MATLMQKIKDIEDEMARTQKNKATAHHLGLLKAKLAKLRRDLLEPPSKGGGGAGEGFDVTKSGDARVGLVGFPSVGKSTLLNKLTGTFSEVASYEFTTLTCIPGVIVYRGAKIQLLDLPGIIEGAKDGKGRGRQVISTARTCNCILIVLDAIKPITHKRLIEKELEGFGIRLNKEPPNLTFRKKDKGGINFTSTVTNTHLDLDTVKAICSEYRIHNADITLRFDATADDLIDVIEGSRIYMPCIYVVNKIDQITLEELEILDKLPHYCPVSAHLEWNLDGLLEKIWEYLNLTRIYTKPKGMNPDYEDPVILSSKTRTVEDFCERIHKDFIKQFKYALVWGSSAKHKPQRVGKEHLLEDEDVVQIIKKV

SEQ ID NO: 21399 - protein, 369 aa, Aquilegia formosa
MATVMQKIKDIEDEMARTQKNKATAHHLGLLKAKLAKLRRDLLAPPTKGGGGGAGEGFDVTKSGDSRVGLVGFPSVGKSTLLNKLTGTFSEVASYEFTTLTCIPGVIMYRGAKLQLLDLPGIIEGAKDGKGRGRQVISTARTCNCILIVLDAIKPITHKRLIEKELEGFGIRLNKEPPNLTFRKKDKGGINFTSTVANTHLDVETVKAICGEYRIHNADVTLRFDATADDLIDVIEGSRVYIPCIYVVNKIDQITIEELEILDKLPHYCPVSAHLEWNLDGLLEKIWEYLNLTRIYTKPKGMNPDYEDPVILSSKTRTVEDFCNRIHKDMLKQFKYALVWGSSAKHKPQRVGKEHELEDEDVVQIIKKV

SEQ ID NO: 21400 - protein, 368 aa, Eucalyptus grandis
MATVMQKIKDIEDEMARTQKNKATAHHLGLLKAKLAKLRRELLEPSSKGGGGAGEGFDVTKSGDARVGLVGFPSVGKSTLLNKLTGTFSEVASYEFTTLTCIPGVITYRGAKIQLLDLPGIIEGAKDGKGRGRQVISTARTCNCILIVLDAIKPITHKRLIEKELEGFGIRLNKEPPNLTFRKKDKGGINFTSTVANTHLDLDTVKAICSEYRIHNADITLRCDATADDLIDVIEGSRKYIPCIYAINKIDQITLEELEILDKLPHYCPVSAHLEWNLDGLLEKIWEYLNLTRIYTKPKGMNPDYEDPVILSSRKRTVEDFCTRIHKDMLKQFKYALVWGSSAKHKPQRVGKEHELEDEDVVQIIKKV

SEQ ID NO: 21401 - protein, 368 aa, Panax ginseng
MSTVMQKIKDIEDEMARTQKNKATAHHLGLLKAKLAKLRRELLEPSSKGGGGAGDGFDVTKSGDARVGLVGFPSVGKSTLLNKLTGTFSEVASYEFTTLTCIPGVITYRGAKIQLLDLPGIIEGAKDGKGRGRQVISTARTCNCILIVLDAIKPITHKRLIEKELEGFGIRLNKEPPNLTFRKKEKGGINFTSTVANTHLDLETVKAICSEYRIHNADVTLRFDATADDLIDVIEGSRVYMPCIYAVNKIDQITLEELEILDKLPHYCPVSAHLEWNLDGLLEKIWEYLSLTRIYTKPKGMNPDYEDPVILSSKRRTVGDFCTRIHKDMLKQFKYALVWGSSAKHKPQRVGKEHELEDEDVVQIIKKV

SEQ ID NO: 21402 - protein, 368 aa, Mimulus guttatus
MATVMQKIKDIEDEMARTQKNKATAHHLGLLKAKLAKLRREILTPASKGGGGAGEGFDVTKSGDARVGLVGFPSVGKSTLLNKLTGTFSEVASYEFTTLTCIPGVITYRGAKIQLLDLPGIIEGAKDGKGRGRQVISTARTCNCILIVLDAIKPITHKRLIEKELEGFGIRLNKEPPNLSFRRKDKGGINLTSTVTNTNLDLETVKAICGEYRIHNADINLRYDATADDLIDVIEGSRVYMPCIYAVNKIDQITFEELEILDKLPHYSPVSAHLEWNLDGLLEKVWEYLSLTRIYTKPKGMNPDYDDPVILSSKRRTVEDFCNRIHKDMLKQYKYALVWGSSAKHKPQRVGKEHELEDEDVVQIIKKV

SEQ ID NO: 21403 - protein, 368 aa, Chenopodium quinoa
MATVMQKIKDIEDEMARTQKNKATANHLGLLKAKLAKLRRDLLTPTSKGGGGAGEGFDVTKSGDARVGLVGFPSVGKSTLLNKLTGTFSEVASYEFTTLTCIPGVIMYRGAKIQLLDLPGIIEGAKDGKGRGRQVISTARTCNCILIVLDAIKPITHKRLIEKELEGFGIRLNKEPPNLSFRKKEKGGINLTSTVANTHLDLDTVKAICSEYRIHNADITLRFDATADDLIDVIEGSRVYMPCIYVINKIDQITLEELEILDKLPHYCPISAHLEWNLDGLLEKVWEYLNLTRIYTKPKGLNPDYNDPVILSSRKRTVEDFCERIHKDMVKQFKNALVWGSSVKHKPQRVGKEHELEDEDVVQIIKKI

SEQ ID NO: 21404 - protein, 368 aa, Cleome spinosa
MATVMQKIKEIEDEMARTQKNKATAHHLGLLKAKLAKLRRELLTPTSKGGAAAGEGFDVTKSGDARVGLVGFPSVGKSTLLNKLTGTFSEVASYEFTTLTCIPGVIMYRGAKIQLLDLPGIIEGAKDGKGRGRQVISTARTCNCILIVLDAIKPITHKRLIEKELEGFGIRLNKEPPNLTFRKKDKGGINLTSTVTTTHLDLDTVKAICSEYRMHNADITLRYDATADDLIDVIEGSRIYMPCIYVINKIDQITVEELEILDKLPHYCPISAHLEWNLDGLLDKIWEYLNLTRIYTKPKGMNPDYDDPVILSSKRRTVEDFCTRIHKDMLKQFKYALVWGSSAKHKPQRVGKEHELEDEDVVQIVKKV

SEQ ID NO: 21405 - protein, 368 aa, Allium cepa
MATVMQKIKDIEDEMAKTQKNKATAHHLGLLKAKLAKLRRELLEPPTKGGGGAGEGFDVTKSGDSRIGLVGFPSVGKSTLLNKLTGTFSEVASYEFTTLTCIPGVIMYRGAKLQLLDLPGIIEGAKDGKGRGRQVISTARTCNCILIVLDAIKPITHKRLIEKELEGFGIRLNKEPPNLTFRKKEKGGINFTSTVTNTNLDLDTVKAICGEYKIHNADVSLRYDATADDLIDVIEGSRVYIPCIYVVNKIDQITLEELEILDKLPHYCPISAHLEWNLDGLLEKIWEYLNLTRIYTKPKGLNPDYDDPVILSSKRRTVEDFCLRIHKDMLKQFKYALVWGSSAKHRPQRVGKEHELEDEDVVQIVKKV

SEQ ID NO: 21406 - protein, 369 aa, Papaver somniferum
MATVMQKIKDIEDEMAKTQKNKATSHHLGTLKAKLAKLRRDLLAPPSKGGGGGAGEGFDVTKSGDSRVGLVGFPSVGKSTLLNKLTGTFSEVASYEFTTLTCIPGVITYRGAKIQLLDLPGIIEGAKDGKGRGRQVISTARTCNCILIVLDAIKPITHKRLIEKELEGFGIRLNKEPPNMAFRRKEKGGINFTSTVANTHLDLETVKAICGEYRIHNADVSLRFDATADDLIDVIEGSRVYIPCIYVVNKIDQITLEELEILDKLPHYCPVSAHLEWNLDGLLDKIWEYLDLTRIYTKPKGMNPDYEDPVILSSKKRTVEDFCIRIHKDMLKQFKYALVWGSSVKHKPQRVGREHELEDEDVVQIIKKV

SEQ ID NO: 21407 - protein, 368 aa, Chenopodium quinoa
MATVMQKIKDIEDEMARTQKNKATANHLGLLKAKLAKLRRDLLTPTSKGGGGAGEGFDVTKSGDARVGLVGFPSVGKSTLLNKLTGTFSEVASYEFTTLTCIPGVIMYRGAKIQLLDLPGIIEGAKDGKGRGRQVISTARTCNCILIVLDAIKPITHKRLIEKELEGFGIRLNKEPPNLSFRKKEKGGINLTSTVANTHLDLDTVKAICSEYRIHNADITLRFDATADDLIDVIEGSRVYMPCIYVINKIDQITLEELEILDKLPHYCPISAHLEWNLDGLLEKVWEYLNLTRIYTKPKGLNPDYNDPVILSSRRRTVEDFCERIHKDMVKQFKNALVWGSSVKHKPQRVGKEHELEDEDVVQIIKKI

SEQ ID NO: 21408 - protein, 368 aa, Spinacia oleracea
MATVMQKIKDIEDEMAKTQKNKATSQHLGLLKAKLAKLRRDLLTPTTKGGGGAGEGFDVTKSGDARVGLVGFPSVGKSTLLNKLTGTFSEVASYEFTTLTCIPGVIMYRGAKIQLLDLPGIIEGAKDGKGRGRQVISTARTCNCILIVLDAIKPITHKRLIEKELEGFGIRLNKEPPNLSFRKKEKGGINLTSTVTNTHLDLDTVKAVCSEYRIHNADITLRFDATADDLIDVIEGSRVYMPCIYVINKIDQITLEELEILDKLPHYCPISAHLEWNLDGLLEKIWEYLNLTRIYTKPKGLNPDYNDPVILSSRKRTVEDFCERIHKDMVKQFKNALVWGSSVKHKPQRVGKEHELEDEDVVQIIKKI

SEQ ID NO: 21409 - protein, 365 aa, Chrysanthemum coronarium
VMQKIKDIEDEMAKTQKNKATAHHLGLLKAKLAKLRRELLTPTTKGGGGAGEGFDVTKSGDARVGLVGFPSVGKSTLLNKLTGTFSEVASYEFTTLTCIPGVITYRGAKIQLLDLPGIIEGAKDGKGRGRQVISTARTCNCIIIVLDAIKPITHKRLIEKELEGFGIRLNKEPPNLTFRKKEKGGINFTSTVANTHLDLDTVKAICSEYKIHNADVTLRFDATADDLIDVIEGSRIYTPCIYAVNKIDQITLEELEILDRLPHYCPVSAHLEWNLDGLLEMIWEYLSLTRIYTKPKGMNPDYEDPVILSSKRKTVEDFCFRIHKDMLKQFKYALVWGSSAKHKPQRVGKEHELEDEDVVQIIKKV

SEQ ID NO: 21410 - protein, 369 aa, Picea glauca
MATTMQKIKDIEDEMAKTQKNKATAHHLGLLKAKLAKLRREILAPPTKGGGGGAGEGFDVTKSGDSRVGLVGFPSVGKSTLLNKLTGTFSEVASYEFTTLTCIPGVIRYRGAKLQLLDLPGIIEGAKDGKGRGRQVISTARTCNCILIVLDAIKPITHKRIIEKELEGFGIRLNKEPPNLSFRRKDKGGINFTSTVANTLLDLETVKAICGEYRIHNADISLRYDASADDLIDVIEGSRIYMPCIYVVNKIDQITLEELEILDKLPHYCPISAHLEWNMDGLLEKIWEYLNLTRIYTKPKGLNPDYEDPVILSSKSRTVEDFCTRIHKDMLKQFKYALVWGSSAKHKPQRVGKDHELEDEDVVQIIKKI

SEQ ID NO: 21411 - protein, 368 aa, Triphysaria pusilla
MATVMQKIKDIEDEMARTQKNKATAHHLGLLKAKLAKLRREILTPASKGGGGAGEGFDVTKSGDSRVGLVGFPSVGKSTLLNKLTGTFSEVASYEFTTLTCIPGVITYRGAKIQLLDLPGIIEGAKDGKGRGRQVISTARTCNCILIVLDAIKPITHKRLIEKELEGFGIRLNKEPPNLTFRRKEKGGLNLTSTVANTHLDLDTVKAICGEYRIHNADISLRYDATADDLIDVIEGSRVYIPCIYVVNKVDQITLEELEILDKLPHYCPISAHLEWNLDGLLEKVWEYLDLTRIYTKPKGMNPDYDDPVILSSKTRSVEDFCTRIHKDMLKQFKYALVWGSSVKHKPQRVGREHELEDEDVVQIIKKV

SEQ ID NO: 21412 - protein, 368 aa, Citrullus lanatus
MATVMQKIKDIEDEMARTQKNKATAHHLGLLKAKLAKLRRELISPASKGGGGAGEGFDVTKSGDARVGLVGFPSVGKSTLLNKLTGTFSEVASYEFTTLTCIPGVIGYRGAKIQLLDLPGIIEGAKDGKGRGRQVISTARTCNCIIIVLDAIKPITHKRLIEKELEGFGIRLNKEPPNLSFRKKDKGGINLTSTVTTTHLDLDTVKAICSEYRIHNADITLKYDATADDLIDVIEGSRIYMPCIYAVNKIDQITLEELEILDRLPHYCPVSAHLEWNLDGLLDKVWEYLDLTRIYTKPKGMNPDYEDPVILSSKRRTVEDFCSRIHKDMLKQFKYALVWGSSVKHKPQRVGKEHELEDEDVVQIIKKV

SEQ ID NO: 21413 - protein, 364 aa, Amaranthus tuberculatus
MQKIKDIEDEMARTQKNKATAHHLGLLKAKLAKLRRELLTPTSKGGGPVGEGFDVTKSGDARVGLVGFPSVGKSTLLNKLTGTFSEVASYEFTTLTCIPGVIMYRGAKIQLLDLPGIIEGAKDGKGRGRQVISTARTCNCILIVLDAIKPITHKRLIEKELEGFGIRLNKEPPNLTFRKKEKGGINLTSTVTNTHLDLETVKAICSEYRIHNADITLRYDATADDLIDVIEGSRVYMPCLYVINKIDQITLEELEILDRLPHYCPISAHLEWNLDGLLEKIWEYLNLTRIYTKPKGMNPDYNDPVILSSRKRTVEDFCDRIHKDMVKQFKNALVWGSSVKHKPQKVGKEHELEDEDVVQIIKKI

SEQ ID NO: 21414 - protein, 368 aa, Taxus baccata
MATVMMKIKDIEDEMARTQKNKATAHHLGLLKAKLAKLRREILAPPTKGGGGAGEGFDVTKSGDARVGLVGFPSVGKSTLLNKLTGTFSEVASYEFTTLTCIPGVIRYRGARIQLLDLPGIIEGAKDGKGRGRQVISTARTCNCILIVLDAIKPITHKRLIEKELEGFGIRLNKEPPNLTFRKKDKGGINFTSTAANTNLDLETVKAICGEYRIHNADISLRYDATADDLIDVIEGSRIYMPCIYVINKVDQISLEELEILDRLPHYCPVSAHLEWNLDGLLEKVWEYLDLTRIYTKPKGLNPDYEDPVILSSKRRTVEDFCTRIHKDMLKQFKYALVWGSSAKHKPQRVGKDHELEDEDVVQIIKKI

SEQ ID NO: 21415 - protein, 368 aa, Pinus pinaster
MATTLQKIKDIEDEMAKTQKNKATAHHLGLLKAKLAKLRREILAPPTKGGGGAGEGFDVTKSGDSRVGLVGFPSVGKSTLLNKLTGTFSEVASYEFTTLTCIPGVIRYRGAKLQLLDLPGIIEGAKDGKGRGRQVISTARTCNCILIVLDAIKPITHKRIIEKELEGFGIRLNKEPPNLTFRKKDKGGINFTSTVSNTLLDLETVKAICGEYKIHNADISLRYDATADDLIDVIEGSRIYMPCIYVVNKIDQITLEELEILDKLPHYCPVSAHLEWNLDGLLEKIWEYLNLTRIYTKPKGLNPDYEDPVILSSKSRTVEDFCTRIHKDMLKQFKYALVWGSSAKHKPQRVGKDHELEDEDVVQIIKKI

SEQ ID NO: 21416 - protein, 368 aa, Pinus taeda
MATTLQKIKDIEDEMAKTQKNKATAHHLGLLKAKLAKLRREILAPPTKGGGGAGEGFDVTKSGDSRVGLVGFPSVGKSTLLNKLTGTFSEVASYEFTTLTCIPGVIRYRGAKLQLLDLPGIIEGAKDGKGRGRQVISTARTCNCILIVLDAIKPITHKRIIEKELEGFGIRLNKEPPNLTFRKKDKGGINFTSTVANTLLDLETVKAICGEYKIHNADISLRYDATADDLIDVIEGSRIYMPCIYVVNKIDQITLEELEILDKLPHYCPVSAHLEWNLDGLLEKIWEYLNLTRIYTKPKGLNPDYEDPVILSSKSRTVEDFCTRIHKDMLKQFKYALVWGSSAKHKPQRVGKDHELEDEDVVQIIKKI

SEQ ID NO: 21417 - protein, 355 aa, Castanea mollissima
MAKTQKNKATAHHLGLLKAKLAKLRRELLAPPSKGGGGGAGEGFDVTKSGDARVGLVGFPSVGKSTLLNKLTGTFSEVASYEFTTLTCIPGVIVYRGAKIQLLDLPGIIEGAKDGKGRGRQVISTARTCNCILIVLDAIKPITHKRLIEKELEGFGIRLNKEPPNLTFRKKDKGGINFTSTVANTHLDLETVKAICSEYRIHNADITLRYDATADDLIDVIEGSRIYMPCIYVVNKIDQITLEELEILDKLPHYCPISAHLEWNLDGLLEKIWEYLNLTRIYTKPKGMNPDYEDPVILSSKHTTVEDFCERIHKDMVKQFKYALVWGSSAKHKPQRVGKEHELEDEDVVQIIKKV

SEQ ID NO: 21418 - protein, 368 aa, Euphorbia peplus
MSTVMQKIKDIEDEMAKTQKNKATAHHLGLLKAKLAKLRRELLEPSTKGGAATGQGFDVTKSGDARVGLVGFPSVGKSTLLNKLTGTFSEVASYEFTTLTCIPGVIIYRGAKIQLLDLPGIIEGAKDGKGRGRQVISTARTCNCILIVLDAIKPITHKRLIEKELEGFGIRLNKEPPNLTFRKKDKGGINFTSTVANTHLDLDTVKAICSEYRIHNADITLRFDATADDLIDVIEGSRVYMPCIYVVNKIDQITIEELEVLDNLPHYCPVSAHLEWNLDGLLDMVWEYLDLTRIYTKPKGMNPDYEDPVILSSKKRTVEDFCDRIHKDMLKQFKYALVWGSSAKHKPQRVGKEHELEDEDVVQIIKKV

SEQ ID NO: 21419 - protein, 368 aa, Eutrema halophilum
MSTIMQKIKEIEDEMARTQKNKATAHHLGLLKAKLAKLRRDLLAPPTKGGGGAGEGFDVTKSGDSRVGLVGFPSVGKSTLLNKLTGTFSEVASYEFTTLTCIPGVITYRGAKIQLLDLPGIIEGAKDGKGRGRQVISTARTCNCILIVLDAIKPITHKRLIEKELEGFGIRLNKEPPNLTFRKKDKGGINLTSTVTSTHLDLDTVKAICSEYRIHNADITLRYDATADDLIDVIEGSRIYMPCIYAVNKIDQITLEELEILDKLPHYCPISAHLEWNLDGLLDKIWEYLDLTRIYTKPKAMNPDYDDPVILSSKKRTVEDFCIRIHKDMLKQFKYALVWGSSAKHKPQRVGREHELEDEDVVQIVKKI

SEQ ID NO: 21420 - protein, 337 aa, Echinochloa colona
MATVMQKIKDIEDEMARTQKNKATAHHLGLLKAKLAKLRRELLTPASKGGGGAGEGFDVTKSGDARVGLVGFPSVGKSTLLNKLTGTFSEVAAYEFTTLTCIPGVIMYKGAKIQLLDLPGIIEGAKDGKGRGRQVISTARTCNVILIVLDAIKPITHKRLIEKELEGFGIRLNKTPPNLTFRRKDKGGINFTSTVTNTHLDLETVKAICSEYRIHNADVSLRYDATADDLIDVIEGSRIYTPCIYVVNKIDQITLEELEILDKLPHYCPISAHLEWNLDGLLEKVWEYLDLVRIYTKPKGLNPDYEDPVIVSSKKKTVEDFCNRIHKDMVKQFKYAL

SEQ ID NO: 21421 - protein, 369 aa, Tropaeolum majus
MATVMQKIKDIEDEMARTQKNKATAHHLGLLKAKLAKLRRDLLAPPTKGAGAGAGEGFDVTKSGDARVGLVGFPSVGKSTLLNKLTGTFSEVASYEFTTLTCIPGVITYRGAKIQLLDLPGIIEGAKDGKGRGRQVISTARTCNCILIVLDAIKPITHKRLIEKELEGFGIRLNKEPPNLTFRKKEKGGINFTSTVANTHIDLDTVKAICSEYKIHNADITLRFDATADDLIDVIEGSRIYMPCIYVINKIDQITLEELEILDKLPHYCPVSAHLEWNLDGLLDKVWEYLRLTRIYTKPKGMNPDYEDPVILSTKSTTVEDFCFRIHKDMLKQFKYALVWGSSAKHKPQRVGKEHVLEDEDVVQIIKKV

SEQ ID NO: 21422 - protein, 342 aa, Panicum virgatum
CCSFDQAKLAKLRRELLTPTSKGGGGAGEGFDVTKSGDARVGLVGFPSVGKSTLLNKLTGTFSEVAAYEFTTLTCIPGVIMYKGAKIQLLDLPGIIEGAKDGKGRGRQVISTARTCNVILIVLDAIKPITHKRLIEKELEGFGIRLNKTPPNLTFRKKDKGGINFTSTVTNTHLDLETVKAICSEYRIHNADVSLRYDATADDLIDVIEGSRIYTPCIYVVNKIDQITLEELEILDKLPHYCPISAHLEWNLDGLLEKIWEYLDLVRIYTKPKGLNPDYEDPVIVSSKKKTVEDFCNRIHKDMVKQFKYALVWGSSVKHKPQRVGKEHELEDEDVVQIIKKI

SEQ ID NO: 21423 - protein, 369 aa, Arabidopsis lyrata
MSTIMQKIKEIEDEMAKTQKNKATSHHLGLLKAKLAKLRRDLLAPPTKGGGGGAGEGFDVTKSGDSRVGLVGFPSVGKSTLLNKLTGTFSEVASYEFTTLTCIPGVITYRGAKIQLLDLPGIIEGAKDGKGRGRQVISTARTCNCILIVLDAIKPITHKRLIEKELEGFGIRLNKEPPNLTFRKKDKGGINLTSTVTVTHLDLDTVKAICGEYRIHNADITLRYDATADDLIDVIEGSRIYMPCIYAVNKIDSITLEELEILDKLPHYCPVSAHLEWNLDGLLDKIWEYLDLTRIYTKPKAMNPDYDDPVILSSKKRTVEDFCIRIHKDMLKQFKYALVWGSSAKHKPQRVGKEHELEDEDVVQIVKKI

SEQ ID NO: 21424 - protein, 369 aa, Brassica napus
  Sequence also found in Organisms: Brassica rapa
MSTIMQKIKEIEDEMARTQKNKATAHHLGLLKAKLAKLRRDLLAPPTKGGGAAAGEGFDVTKSGDSRVGLVGFPSVGKSTLLNKLTGTFSEVASYEFTTLTCIPGVITYRGAKIQLLDLPGIIEGAKDGKGRGRQVISTARTCNCIIIVLDAIKPITHKRLIEKELEGFGIRLNKEPPNLTFRKKDKGGINLTSTVTATHLDLDTVKAICSEYRMHNADITLRYDATADDLIDVIEGSRIYMPCIYAVNKIDQITLEELEILDKLPHYCPISAHLEWNLDGLLDKIWEYLDLTRIYTKPKAMNPDYDDPVILSSKKRTVEDFCIRIHKDMLKQFKYALVWGSSAKHKPQRVGREHELEDEDVVQIVKKI

SEQ ID NO: 21425 - protein, 354 aa, Tabernaemontana elegans
MATVMQKIKDIEDEMARTQKNKATAHHLGLLKAKLAKLRRELLAPSSKGGGGAGEGFDVTKSGDARVGLVGFPSVGKSTLLNKLTGTFSEVASYEFTTLTCIPGVIVYRGAKIQLLDLPGIIEGAKDGKGRGRQVISTARTCNCILIVLDAIKPITHKRLIEKELEGFGIRLNKEPPNLTFRRKDKGGINLTSTVNNTNLDLETVKVICSEYRIHNADINLRYDATADDLIDVIEGSRVYMPCIYVVNKIDQITLEELEILDKLPHYCPISAHLEWNLDGLLEKIWEYLNLTRVYTKPKGMNPDYEDPVILSSKRRTVEDFCTRIHKDMVKQFKYALVWGSSAKHKPQRVGKGA

SEQ ID NO: 21426 - protein, 369 aa, Arabidopsis thaliana
MSTIMQKIKEIEDEMAKTQKNKATSHHLGLLKAKLAKLRRDLLAPPTKGGGGGAGEGFDVTKSGDSRVGLVGFPSVGKSTLLNKLTGTFSEVASYEFTTLTCIPGVITYRGAKIQLLDLPGIIEGAKDGKGRGRQVISTARTCNCILIVLDAIKPITHKRLIEKELEGFGIRLNKEPPNLTFRKKDKGGINLTSTVAVTHLDLDTVKAICGEYRMHNADITLRYDATADDLIDVIEGSRIYMPCIYAVNKIDSITLEELEILDKLPHYCPVSAHLEWNLDGLLDKIWEYLDLTRIYTKPKAMNPDYDDPVILSSKKRTVEDFCIRIHKDMLKQFKYALVWGSSAKHKPQRVGKEHELEDEDVVQIVKKI

SEQ ID NO: 21427 - protein, 369 aa, Brassica juncea
MSTIMQKIKEIEDEMGRTQKNKATAHHLGLLKAKLAKLRRDLLAPPTKGGGAAAGEGFDVTKSGDSRVGLVGFPSVGKSTLLNKLTGTFSEVASYEFTTLTCIPGVITYRGAKIQLLDLPGIIEGAKDGKGRGRQVISTARTCNCILIVLDAIKPITHKRLIEKELEGFGIRLNKEPPNLTFRKKDKGGINLTSTVTCTHLDLDTVKAICSEYRMHNADITLRYDATADDLIDVIEGSRIYMPCIYAVNKIDQITLEELEILDRLPHYCPVSAHLEWNLDGLLDKIWEYLDLTRIYTKPKAMNPDYDDPVILSSKKRTVEDFCIRIHKDMLKQFKYALVWGSSAKHKPQRVGREHELEDEDVVQIVKKI

SEQ ID NO: 21428 - protein, 369 aa, Brassica rapa
MSTIMQKIKEIEDEMGRTQKNKATAHHLGLLKAKLAKLRRDLLAPPTKGGGAAAGEGFDVTKSGDSRVGLVGFPSVGKSTLLNKLTGTFSEVASYEFTTLTCIPGVITYRGAKIQLLDLPGIIEGAKDGKGRGRQVISTARTCNCILIVLDAIKPITHKRLIEKELEGFGIRLNKEPPNLTFRKKDKGGINLTSTVTATHLDLDTVKAICSEYRMHNADITLRYDATADDLIDVIEGSRIYMPCIYTINKIDQITLEELEILDKLPHYCPISAHLEWNLDGLLDKIWEYLNLTRIYTKPKAMNPDYDDPVILSSKKRTVEDFCIRIHKDMLKQFKYALVWGSSAKHKPQRVGREHELEDEDVVQIVKKI

SEQ ID NO: 21429 - protein, 369 aa, Raphanus sativus
MSTIMQKIKEIEDEMARTQKNKATAHHLGLLKAKLAKLRRDLLAPPTKGGGAAAGEGFDVTKSGDSRVGLVGFPSVGKSTLLNKLTGTFSEVASYEFTTLTCIPGVITYRGAKIQLLDLPGIIEGAKDGKGRGRQVISTARTCNCIIIVLDAIKPITHKRLIEKELEGFGIRLNKEPPNLTFRKKDKGGINLTSTVTCTHLDLDTVKAICSEYRMHNADITLRYDATADDLIDVIEGSRIYMPCIYAVNKIDQITLEELEILDRLPHYCPVSAHLEWNLDGLLDKIWEYLDLTRIYTKPKAMNPDYDDPVILSSKKRTVEDFCIRIHKDMLKQFKYALVWGSSAKHKPQRVGREHELEDEDVVQIVKKI

SEQ ID NO: 21430 - protein, 368 aa, Physcomitrella patens
MSTVMQKIKDIEDEMARTQKNKATAHHLGLLKAKLAKLRREILAPPSSKGGGAGEGFDVTKSGDSRVGLVGFPSVGKSTLLNKLTGTFSEVASYEFTTLTCVPGVIKYRGSKIQLLDLPGIIEGAKDGKGRGRQVISTARTCNCILIVLDAIKPITHKRLIEKELEGFGIRLNKEPPNMGFRRKDKGGINFTSTVANTHLDLETVKAICGEYKIHNADISLRFDATADDLIDVIEGNRIYMPCIYVVNKIDQITVEELEVLDRLPHYCPISAHLEWNLDGLLDKIWEYLNLIRVYTKPKGNSPDYEDPVILSANKCTVEDFCERIHKDMVKQFKFALVWGSSAKHKPQRVGKEHTLEDEDVVQIIKKV

SEQ ID NO: 21431 - protein, 387 aa, Citrus sinensis
MATVMQKIKDIEDEMARTQKNKATAHHLGLLKAKLAKLRRELLTPTSKGGGGGGGEGFDVTKSGDSRVGLVGFPSVGKSTLLNKLTGTFSEVASYEFTTLTCIPGVITYRGAKIQLLDLPGIIEGAKDGKGRGRQVISTARTCNCILIVLDAIKPITHKRLIEKELEGFGIRLNKQPPNLTFRKKDKGGINFTSTVTNTNLDLDTVKAICSEYRIHNADITLRYDATADDLIDVIEGSRIYMPCIYVINKIDQITLEELEILDKLPHYCPVSAHLEWNLDGLLEKIWEYLNLTRIYTKPKGMNPDYEDPVILSSKKRTVEDFCERIHKDMVKQFKYALVWGSSAKHKPQRVGKEHELEDEDCCSDYQKGVILIRIKICWCYTTKLFC

SEQ ID NO: 21432 - protein, 354 aa, Catharanthus roseus
MATVMQKIKDIEDEMARTQKNKATAHHLGLLKAKLAKLRRELLTPSSKGGGGAGEGFDVTKSGDSRVGLVGFPSVGKSTLLNKLTGTFSEVASYEFTTLTCIPGVIMYRGAKLQLLDLPGIIEGAKDGKGRGRQVISTARTCNCILIVLDAIKPITHKRLIEKELEGFGIRLNKEPPNLTFRRKDKGGINLTSTVNNTNLDLETVKAICSEYRIHNADINLRYDATADDLIDVIEGSRVYIPCIYVVNKIDQITLEELEILDKLPHYCPISAHLEWNLDGLLEKIWEYLSLTRVYTKPKGMNPDYEDPVILSSKRRTVEDFCDRIHKDMVKQFKYALVWGSSAKHKTSEGGQGA

SEQ ID NO: 21433 - protein, 354 aa, Ambrosia trifida
MATVMQKIKDIEDEMAKTQKNKATAHHLGLLKAKLAKLRRELLTPTTKGGGGAGEGFDVTKSGDARVGLVGFPSVGKSTLLNKLTGTFSEVASYEFTTLTCIPGVITYRGAKIQLLDLPGIIEGAKDGKGRGRQVISTARTCNCILIVLDAIKPITHKRLIEKELEGFGIRLNKEPPNLTFRKKEKGGINFTSTVANTHLDVETVKAICSEYKIHNADVTLRFDATADDLIDVIEGSRIYTPCIYVVNKIDQITLEELEILDKLPHYCPVSAHLEWNLDGLLEMIWEYLNLTRIYTKPKGMNPDYEDPVILSSKKKTVEDFCFRIHKDMLKQFKYALVWGSSAKHKPTKSWQGT

SEQ ID NO: 21434 - protein, 368 aa, Ceratodon purpureus
MATVMMKIKDIEDEMARTQKNKATAHHLGLLKAKLAKLRREILAPPSSKGGGAGEGFDVTKSGDSRVGLVGFPSVGKSTLLNKLTGTFSEVASYEFTTLTCVPGVIKYRGSKIQLLDLPGIIEGAKDGKGRGRQVISTARTCNCILIVLDAIKPITHKRLIEKELEGFGIRLNKGPPNMGFKRKDKGGISFTSTVANTHLDLETVKAICGEYKIHNADISLRFDATADDLIDVIEGNRIYMPCVYVVNKIDQITVEELEVLDRLPHYCPVSAHLEWNLDGLLDKIWEYLNLIRVYTKPKGNSPDYEDPVILSAEHCTVEDFCERIHKDMVKQFKFALVWGSSAKHKPQRVGKEHTLEDEDVVQIIKKV

SEQ ID NO: 21435 - protein, 342 aa, Festuca arundinacea
HLGGLKAKLAKLRRELLTPTTKGGGGAGEGFDVTKSGDARVGLVGFPSVGKSTLLNKLTGTFSEVASYEFTTLTCIPGVIMYKGAKVQLLDLPGIIEGAKDGKGRGRQVISTARTCNVILIVLDAIKPITHKRLIEKELEGFGIRLNKTPPNMTFRRKEKGGINFTSTVANTHLDLDTVKAICSEYRIHNADVSLRFDATADDLIDVIEGSRIYMPCIYVVNKIDQITVEELDILDKLPHYCPISAHLEWNLDGLLEMVWEYLDLVRLYTKPKGLNPDYEDPVILSTKRKTVEDFCNQIHKDMAKQFKYALVWGSSVKHKPQRVGKEHELEDEDVIQIIKKI

SEQ ID NO: 21436 - protein, 342 aa, Flaveria ramosissima
HLGLLKAKLAKLRRELLTPTSKGGGGAGEGFDVTKSGDARVGLVGFPSVGKSTLLNKLTGTFSEVASYEFTTLTCIPGVITYRGAKIQLLDLPGIIEGAKDGKGRGRQVISTARTCNCILIVLDAIKPITHKRLIEKELEGFGIRLNKEPPNLTFRKKEKGGINFTSTVANTHLDLETVKAICSEYKIHNADVTLRFDATADDLIDVIEGSRIYTPCIYVVNKIDQITLEELEILDKLPHYCPVSAHLEWNLDGLLEMIWEYLNLTRIYTKPKGMNPDYEDPVILSSKKKTVEDFCIRIHKDMLKQFKYALVWGSSAKHKPQRVGKEHELEDEDVVQIIKKV

SEQ ID NO: 21437 - protein, 390 aa, Chenopodium quinoa
MATVMQKIKDIEDEMARTQKNKATANHLGLLKAKLAKLRRDLLTPTSKGGGGAGEGFDVTKSGDARVGLVGFPSVGKSTLLNKLTGTFSEVASYEFTTLTCIPGVIMYRGAKIQLLDLPGIIEGAKDGKGRGRQVISTARTCNCILIVLDAIKPITHKRLIEKELEGFGIRLNKEPPNLSFRKKEKGGINLTSTVTNTHLDLDTVKAICSEYRIHNADITLRFDATADDLIDVIEGSRVYMPCIYVINKIDQITLEELEILDKLPHYCPISAHLEWNLDGLLEKVWEYLNLTRIYTKPKGLNPDYNDPVILSSRKRTVEDFCERIHKDMVKQFKNALVWGSSVKHKPQRVGKEHELEDEDVVQIIKKDLTEPGIHNFKQLTTSIIPKKFL

SEQ ID NO: 21438 - protein, 354 aa, Cucumis sativus
MARTQKNKATAHHLGLLKAKLAKLRREIIAPSSKGGGGAGEGFDVTKSGDARVGLVGFPSVGKSTLLNKLTGTFSEVASYEFTTLTCIPGVIGYRGAKIQLLDLPGIIEGAKDGKGRGRQVISTARTCNCIIIVLDAIKPITHKRLIEKELEGFGIRLNKEPPNLSFRKKDKGGLNLTSTVTTTHLDLDTVKAICSEYRIHNADITLKYDATADDLIDVIEGSRIYMPCIYAVNKIDQITVEELEILDRLPHYCPVSAHLEWNLDGLLDKVWEYLDLTRIYTKPKGMNPDYEDPVILSSKRRTVEDFCSRIHKDMLKQFKYALVWGSSVKHKPQRVGKEHELEDEDVVQIIKKV

SEQ ID NO: 21439 - protein, 368 aa, Ceratodon purpureus
MATVMMKIKDIEDEMAKTQKNKATSHHLGLLKAKLAKLRREILAPPSSKGGGAGEGFDVTKSGDSRVGLVGFPSVGKSTLLNKLTGTFSEVASYEFTTLTCVPGVIKYRGSKIQLLDLPGIIEGAKDGKGRGRQVISTARTCNCILIVLDAIKPITHKRLIEKELEGFGIRLNKEPPNMGFKKKDKGGISFTSTVANTHLDLETVKAICGEYKIHNADISLRFDATADDLIDVIEGNRIYMPCVYVVNKIDQITVEELEVLDRLPHYCPVSAHLEWNLDGLLDKIWEYLNLTRVYTKPKGNSPDYEDPVILSTGKTTVGDFCERIHKDMVKQFKFALVWGSSAKHKPQRVGKEHVLEDEDVVQIIKKV

SEQ ID NO: 21440 - protein, 339 aa, Lolium multiflorum
GLKAKLAKLRRELLTPTTKGGGGAGEGFDVTKSGDARVGLVGFPSVGKSTLLNKLTGTFSEVASYEFTTLTCIPGVIMYKGAKVQLLDLPGIIEGAKDGKGRGRQVISTARTCNVILIVLDAIKPITHKRLIEKELEGFGIRLNKTPPNMTFRRKEKGGINFTSTVANTHLDLDTVKAICSEYRIHNADVSLRFDATADDLIDVIEGSRIYMPCIYVVNKIDQITVEELDILDKLPHYCPISAHLEWNLDGLLEMVWEYLDLVRLYTKPKGLNPDYEDPVILSTKRKTVEDFCNQIHKDMAKQFKYALVWGSSVKHKPQRVGKEHELEDEDVIQIIKKI

SEQ ID NO: 21441 - protein, 356 aa, Brassica napus
EMGRTQKNKATAHHLGLLKAKLAKLRRDLLAPPTKGGGAAAGEGFDVTKSGDSRVGLVGFPSVGKSTLLNKLTGTFSEVASYEFTTLTCIPGVITYRGAKIQLLDLPGIIEGAKDGKGRGRQVISTARTCNCILIVLDAIKPITHKRLIEKELEGFGIRLNKEPPNLTFRKKDKGGINLTSTVTATHLDLDTVKAICSEYRMHNADITLRYDATADDLIDVIEGSRIYMPCIYTINKIDQITLEELEILDKLPHYCPISAHLEWNLDGLLDKIWEYLNLTRIYTKPKAMNPDYDDPVILSSKKRTVEDFCIRIHKDMLKQFKYALVWGSSAKHKPQRVGREHELEDEDVVQIVKKI

SEQ ID NO: 21442 - protein, 354 aa, Brassica napus
GRTQKNKATAHHLGLLKAKLAKLRRDLLAPPTKGGGAAAGEGFDVTKSGDSRVGLVGFPSVGKSTLLNKLTGTFSEVASYEFTTLTCIPGVITYRGAKIQLLDLPGIIEGAKDGKGRGRQVISTARTCNCILIVLDAIKPITHKRLIEKELEGFGIRLNKEPPNLTFRKKDKGGINLTSTVTATHLDLDTVKAICSEYRMHNADITLRYDATADDLIDVIEGSRIYMPCIYTINKIDQITLEELEILDKLPHYCPISAHLEWNLDGLLDKIWEYLNLTRIYTKPKAMNPDYDDPVILSSKKRTVEDFCIRIHKDMLKQFKYALVWGSSAKHKPQRVGREHELEDEDVVQIVKKI

SEQ ID NO: 21443 - protein, 341 aa, Eschscholzia californica
GLLKAKLAKLRRDLLAPPTKGGGGGAGEGFDVTKSGDSRVGLVGFPSVGKSTLLNKLTGTFSEVASYEFTTLTCIPGVITYRGAKIQLLDLPGIIEGAKDGKGRGRQVISTARTCNCILIVLDAIKPITHKRLIEKELEGFGIRLNKEPPNLSFRRKDKGGINFTSTATNTHLDLETVKAICGEYRIHNADISLRYDATADDLIDVIEGSRVYIPCIYVVNKIDQITLEELEILDKLPHYCPISAHLEWNLDGLLDKIWEYLDLTRIYTKPKGMNPDYEDPVILSSKKRTVEDFCTRIHKDMLKQFKYALVWGSSAKHKPQRVGREHELEDEDVVQIIKKV

SEQ ID NO: 21444 - protein, 341 aa, Orobanche aegyptiaca
LGLLKAKLAKLRREILTPASKGGGGAGEGFDVTKSGDSRVGLVGFPSVGKSTLLNKLTGTFSEVASYEFTTLTCIPGVITYRGAKIQLLDLPGIIEGAKDGKGRGRQVISTARTCNCILIVLDAIKPITHKRLIEKELEGFGIRLNKEPPNLSFRRKDKGGISLTSTVANTHLDLETVKAICGEYRIHNADINLRFDATADDLIDVIEGSRVYIPCIYVVNKIDQITLEELEILDKLPHYCPISAHLEWNLDGLLEKVWEYLDLTRIYTKPKGLNPDYEDPVILSSKRRTVEEFCNRIHKDMLKQFKYALVWGSSVKHKPQRVGKEHELEDEDVVQIIKKV

SEQ ID NO: 21445 - protein, 349 aa, Momordica charantia
RTKLLLITWACSRLNLQSYGGELIAPASKGGGGAGEGFDVTKSGDARVGLVGFPSVGKSTLLNKLTGTFSEVASYEFTTLTCIPGVIGYRGAKIQLLDLPGIIEGAKDGKGRGRQVISTARTCNCIIIVLDAIKPITHKRLIEKELEGFGIRLNKEPPNLSFRRKDKGGINLTSTVANTHLDLDTVKAICSEYRIHNADITLKYDATADDLIDVIEGSRIYMPCIYAVNKIDQITLEELEILDRLPHYCPVSAHLEWNLDGLLDKVWEYLDLTRIYTKPKGMNPDYEDPVILSSKRRTVEDFCSRIHKDMLKQFKYALVWGSSVKHKPQRVGKEHELEDEDVVQIIKKV

SEQ ID NO: 21446 - protein, 328 aa, Cedrus atlantica
RNPCSSYKRRGGAGEGFDVTKSGDSRVGLVGFPSVGKSTLLNKLTGTFSEVASYEFTTLTCIPGVIRYRGAKLQLLDLPGIIEGAKDGKGRGRQVISTARTCNCILIVLDAIKPITHKRIIEKELEGFGIRLNKEPPNLTFRKKDKGGINFTSTVANTHLDLETVKAICGEYRIHNADISLRYDATADDLIDVIEGSRIYMPGIYVVNKIDQITLEELEILDKLPHYCPISAHLEWNLDGLLEMIWEYLNLTRIYTKPKGLNPDYEDPVILSSKSRTVEDFCTRIHKDMLKQFKYALVWGSSAKHKPQRVGKDHELEDEDVVQIIKKI

SEQ ID NO: 21447 - protein, 940 aa, Brachypodium distachyon
MVKAYLRYEPAISFGVVASPESNVVYDPSGRRLLAAALDRFAAWDPKRGLPSSIFTPASSSPSLAVSCIASSPSAASASASSIASGHADGSIRLWDAETGACEATLHGHRSAASALRFSPSGAVLASGSKDCDVILWDVVAQAGLFRLRGHRDQVTDLLFLDSGKKLATCSKDKFIRVWDLDTQHCLQIVGGHHSEVWSMDVDPSEKFLVSGSADPELRVFRVRQSAEDGEDWNKWDVLKLFGEIPRQTKERVQTIRFNKDGSLVACQVAGKTADIYRILDETEAIRKAKRRMHRKKEKALAKAVTAEGNGTVIDPLPAQDSQNPTVVVTDVFKLLQVLRASKKICSVAFSPSNPPKGCLASLSLSLNNNVLETYSVDNEKVSKTHSIEIHGHRSDIRSLALNSEDNLLMSTSHNAVKIWNPSTGDCLRTIDSDYGLCSAFVPGNRYGLIGTKSGTLEIIDINSGNLIDVIEAHAGSIRSIVLIPDEDGTVSARGFVTGSADHDVKFWEYQLVQKSDTDSKHLSVTNVRTLKMNDDVLAVSIGPTGKHIAVALLDCTVKVFFVDTLKFCLSLYGHKLPVLCMDISSDGALIVTGSADKNLKIWGMDFGDCHKSIFAHTDSVMDVKFVYRTHYMFSVGKDRTVKYWDADKFELLLTLEGHHAEVWCLAISSRGDFIVTGSHDRSIRRWDRTEEQLFIEEEREKRLEETFEADLDNAIEHRHGQKDDAPDEGSVGVPGRKTKETVTAADAIIDALDTAEEEEKRLNELKEEQSNAERAKSQPNVIMQGQSPSDYVLNAVSNVRPNDLEQALLSLPFSDALKLMAYLKEWSLIPLKVELTCRVCLVLLQTHHNQLTSTPAARSILTELKGILYGRVKGCKDTIGFNLAAMDHIKELLAMRSDAPFRDAKAKLMEIRQEQSKRSDRSDGTERRKKKKPKASTQS

SEQ ID NO: 21448 - protein, 938 aa, Setaria italica
MVKAYLRYEPAVTFGVIASPESNVCYDPSGRLLLAAALDRLAAWDLKRGLPSVSFAPSSSSPSLAVSCIASSQSAAVSSSIASGHADGSIRLWDAEKGACEATLHGHRSAASALRFAPSGAVLASGSKDCDVILWDVVAQAGLFRLRGHRDQVTDLVFLDSGKKLVSCSKDKFIRVWDLETQHCLQIVGGHRSEIWSMDVDPSERFLVSGSADPELRVFRIRQSVEEGEDWSKWDVLKLFGEIPRQSKERVATVRFNRNGSLVACQVAGKTADIYRVLDETEATRKAKRRMHRKKEKASAKSMIAEGNGTVIDPLPAQDLQNPAVIVTDVFKLLQVLRASKKICSISFSPSNPPKGCLATLSLSLNNNTLETYSVDSEKVSKMYSIEMHGHRSDIRSVSLNSEDNLLMSTSHNAVKIWNPSTGDCLRTIDSGYGLCSAFVGNRFALVGTKSGTLEIINIASGSLTEVIEAHAGSIRSIVPIPDEDGTVGARGFVTGSADHDVKFWEYQLLQKSDNDSKQLTVTNVRTLKMTEDVLAVSISPQGKHIAVALLDCNVKVFHMDTLKHFLNLYGHKLPVLCMDISSDGALIVTGSADKNLKIWGMDFGDCHRSIFAHSDSVMDVKFVYRTHYMFSVGKDRTVKYWDADKFELLLTLEGHHAEVWCLTISSRGDFIVTGSHDRSIRRWDRTEEQLFIEEEKEKRLEETFEADLDNDNEYRYGQKDDAPDEGSVGVPGRKTKETVTSADAIMDALDTAEEEVKRLNQHKLEEQNNGRAARFQPNVIMQGHSPSDYVLNVVSSIRPNDLEQALLALPFSDALKLMSYLKEWSLVPSKVELVCRVCLVLLQTHHNQLTTTPAARSLLTELKDILYCRVKECKDTIGFNLAAMDHLKELLAMRSDAPFRDAKAKLMEIRQELSKRSDRPDGNERRKKKRKKASGES

SEQ ID NO: 21449 - protein, 940 aa, Hordeum vulgare
MVKAYLRYEPALSFGVVASPESNVVYDPSGRRLLAAALDRFAAWDLKRGLPSATFTPSSSSASLAVSCVASSPAAASASASSIASGHADGSIRLWDAETGACEATLHGHRSAASALRFAPSGAVLASGSKDCDVILWDVVAQAGLFRLRGHRDQVTDLLFLDSGKKLVTCSKDKFIRVWDLDTQHCLQIVGGHHSEIWSMDVDPSEKFLVSGSADPELRVFRIRQSVEEGEDWNKWDALKLFGEIPRQSKERIQTIRFNKDGSLVACQVAGKTADIYRILDETEATRKAKRRLHRKKEKAAAKAAAAEGNGTVIDPLPAQDSQNPTVVVTDVFKLLQVLRTSKKICSVAFSPNNPPKGCLATLSLSLNNNVLETYSVDNEKVSKMYSVEIHGHRSDIRSLALNSEDNLLMSTSHNAVKIWNPSTGDCLRTVDSGYGLCSAFVPGNRYGLIGTKTGTLEIIDINSGNSIDVIEAHAGSIRSIVLIPDEDGTVNARGFVTGSADHDVKFWEYQLVQKSDSDTKHLSVTNVRTLKMNDDVLAVSIGPTGKHIAVALLDCTVKVFFLDTLKFCLSLYGHKLPVLCMDISSDGGLIVTGSADKNLKIWGMDFGDCHKSIFAHGDSVMDVKFVPKTHYMFSVGKDRTVKYWDADKFELLLTLEGHHAEVWCLAISSRGDFIVTGSHDRSIRRWDRTEEQLFIEEEREKRLEETFEADLDNAVEDRYGQKDDAPDEGSVGVPGKKTKETVTATDAIIDALDTAEEEEKRLNEQKELQNNGEGSKSKPNVIMQGHSPSEYVLNAVSSVRPNDLEQVLLSLPFSDALKLMAYLKEWSVIPLKVELVCRVCLVLLQTHHNQLTTTPAARSILTELKDILYGRVKDCKDTIGFNLAAMDHIKELLTMRSDAPFRDAKAKLMEIRQEQSKRSDRSGGGERRKKKKPKPSVQS

SEQ ID NO: 21450 - protein, 937 aa, Panicum virgatum
MVKAYLRYEPALTFGVIASPESNVCYDPSGRLLLAAALDRLAAWDLKRGLPSVSFAPSSSSPSLAVSCIASSPSAAVSSLIASGHADGSIRLWDAETGTCEATLHGHRSAASALRFAPSGAVLASGSKDCDVILWDVVAQDGLFRLRGHRDQVTDLVFLDSGKKLVSCSKDKFIRVWDLETQHCLQIVGGHRSEIWSMDVDPSERFLVSGSADPEMRVFRIRQSVQEGEDWSKWDVLKLFGEILRQSKERVATVRFNRNGSLVACQVAGKTADIYRVLDESEAIRKAKRRMHRKKEKASAKSMIAKGNGTVIDPLPASDLQNPAVIVTDVFKLLQVLRASKKICSISFSPGSPRGCLATLSLSLNNNTLETYSVDSEKVSKMYSIEMHGHRSDIRSVSLNSEDNLLMSTSHNAVKIWNPSTGDCLRTIESGYGLCSAFVGNRFALVGTKSGTLEIIDIASGSLTEVIEAHAGSIRSIVPIPDEDGTAGARGFVTGSADHDVKFWEYQQVQKSDNDSKQLTVTNMRTLKMTEDVLAVSISPLGKHIAVALLDCNVKVYHMDTLKHFLNLYGHKLPVLCMDISSDGALIVTGSADKNLKIWGMDFGDCHRSIFAHSDSVMDVKFVYRTHYIFSVGKDRTVKYWDADKFELLLTLEGHHAEVWCLTISSRGDFIVTGSHDRSIRRWDRTEEQLFIEEEKEKRLEETFEADLDNDNEYRYGQKDDAPEEGSVGVPGRKTKETVTSADAIMDALDTAEEELKRLNQHKQEEQNNGTAAKFQPNVIMQGQSPSDYVLNVVSSIRPNDLEQALLALPFSDALKLMSYLKEWSMVPSKVELVCRVCLVLLQTHHNQLTTTPAARSVLTELKDILYSRVKECKDTIGFNLAAMDHIKELLAMRSDAPFRDAKTKLMEIRQELSKRSDRPDGNEKSKKKKKKASGES

SEQ ID NO: 21451 - protein, 937 aa, Sorghum bicolor
MVKAYLRYEPALTFGVIASPESNVVYDPSGRRLLAAALDRLVAWDLKRGLPSVSFAPSSSSFSLAVSCIASSPSAAVSSSIASGHADGSIRLWDAETGGCEATLHGHRSAASALRFGPSGAVLASGSKDCDVILWDVVAQAGLFRLRGHRDQVTDLVFLDSGKKLVSCSKDKFIRVWDLETQHCLQIVGGHRSEIWSMDVDPSERFLVSGSADPELQVFRIRQSVEEGEDWSKWDVLKLFGEIPRQSKERVANVRFNRDGSLVVCQVAGKTADIYRVLDETEAARKAKRRVNRKKEKASAKSMIAEDNGTIIDPLPAKNLQNPTVIVTDVFKLFQVLRASKKICSVAFSPSNPPRGCLAILSLSLNNNMLETYSVDSEKVSKMYSVEMHGHRSDIRSISLNSEDNLLMSTSHNAVKIWNPSTGECLRTIDSGYGLCSTFVGNRFALVGTQSGALEIVDIASGSLTEAIEAHAGSIRSIVPIPDEDGTVGARGFVTGSADHDVKFWEYQLVQKSDNDSKQLTVTNVRTLKMTEDVLAVSISPEGKHIAVALLDCHVKVYHMDTLKPSLNLYGHKLPVLCMDISSDGALLVTGSADKNLKIWGMDFGDCHRSIFAHSDSVMDVKFVYRTHYMFSVGKDRTVKYWDADKFELLLTLEGHHAEVWCLTISSRGDFIVTGSHDRSIRRWDRTEEQLFIEEEKEKRLEETFEADLENDEYRYGQKDDAPDEGSVGVPGRKTKETVTSADAIMDALDTAEEELKRINQHKMEEQINAKAAKFQPNVIMQGHSPSDYVLNVVSNIRPNDLEQALLALPFSDALKLMSYLKEWSLVPSKVELVCRVCLVLLQTHHNQLTATPAARSLLTELKDILYCRVKECKDTIGFNLAAMDHVKELLAMRSDAPFRDAKAKLMEIKQELSKRSSRVDGDEKRKKKRKKTSAES

SEQ ID NO: 21452 - protein, 939 aa, Zea mays
MVKAYLRYEPALTFGVIASPESNVVYDPSGRRLLAAALDRLAAWDIKRGLPSVSFAPSSSSPSLAVSCIASSHSAAVSSSIASGHADGSIRLWDAETGACEATLHGHRSAASALRFGPSGAVLASGSKDCDVILWDVVAQAGLFRLRGHRDQVTDLVFLDSGKKLMSCSKDKFIRVWDLETQHCLQIVGGHRSEIWSMDVDPSERFLVSGSADPELQVFRIRQSVEEGEDWSKWDVLKLFGEIPRQSKERVANVRFNRDGSLVVCQVAGKTADIYRVLDETEAARKAKRRVSRKKEKASAKSMIAEENGTIIDPLPVQNLQNPTVIVTDVFKLFQVLRASKKICSITFSPSNPPRGCLATLSLSLNNNMLETYSVDKEKVSKMYSVEMHGHRSDIRSVSLNSEDNLLMSTSHNAVKIWNPSTGECLRTIDSGYGLSSAFVGNRYALVGTKSGTLEIMDIASGSLTEAIEAHAGSIRSIVPIPDEDGTVGARGFVTGSADHDVKFWEYQLVQKSDNDSKQLTVTNVRTLKMTEDVLAVSISPEGKHIAVALLDCHVKVFHMDTLKPSLNLYGHKLPVLCMDISSDGALLVTGSADKNLKIWGMDFGDCHRSIFAHSDSVMDVKFVYRTHYMFSVGKDRTMKYWDADKFELLLTLEGHHAEVWCLTLSSRGDFVVTGSHDRSIRRWDRTEEQLFIEEEKEKRLEETFEADLENDNDYRYGQKDDAPDEGSVGVPGRKTKETVTSADAIMDALDTAEEELKRINQHKMEEQITAKAAKFQPNVIMQGHSPSDYVLNVVSSIRPNDLEQALLALPFSDALKLMSYLKEWSLVPSKVELVCRVCLVLLQTHHNQLTATPAARSLLTELKDILYCRVKECKDTIGFNLAAMDHIKELLALRSDAPFRDAKAKLMEIKKEQSKRSSSRLDGDEKRKKKRKKASAES

SEQ ID NO: 21453 - protein, 982 aa, Hordeum vulgare
MVKAYLRYEPALSFGVVASPESNVVYDPSGRRLLAAALDRFAAWDLKRGLPSATFTPSSSSASLAVSCVASSPAAASASASSIASGHADGSIRLWDAETGACEATLHGHRSAASALRFAPSGAVLASGSKDCDVILWDVVAQAGLFRLRGHRDQVTDLLFLDSGKKLVTCSKDKFIRVWDLDTQHCLQIVGGHHSEIWSMDVDPSEKFLVSGSADPELRVFRIRQSVEEGEDWNKWDALKLFGEIPRQSKERIQTIRFNKDGSLVACQVAGKTADIYRILDETEATRKAKRRLHRKKEKAAAKAAAAEGNGTVIDPLPAQDSQNPTVVVTDVFKLLQVLRTSKKICSVAFSPNNPPKGCLATLSLSLNNNVLETYSVDNEKVSKMYSVEIHGHRSDIRSLALNSEDNLLMSTSHNAVKIWNPSTGDCLRTVDSGYGLCSAFVPGNRYGLIGTKTGTLEIIDINSGNSIDVIEAHAGSIRSIVLIPDEDGTVNARGFVTGSADHDVKFWEYQLVQKSDSDTKHLSVTNVRTLKMNDDVLAVSIGPTGKHIAVALLDCTVKVFFLDTLKFCLSLYGHKLPVLCMDISSDGGLIVTGSADKNLKIWGMDFGDCHKSIFAHGDSVMDVKFVPKTHYMFSVGKDRTVKYWDADKFELLLTLEGHHAEVWCLAISSRGDFIVTGSHDRSIRRWDRTEEQLFIEEEREKRLEETFEADLDNAVEDRYGQKDDAPDEGSVGVPGKKTKETVTATDAIIDALDTAEEEEKRLNEQKELQNNGEGSKSKPNVIMQGHSPSEYVLNAVSSVRPNDLEQVLLSLPFSDALKLMAYLKEWSVIPLKVELVCRVCLVLLQTHHNQLTTTPAARSILTELKDILYGRVKDCKDTIGFNLAAMDHIKVRCHLPSFLAFWCDHALENIFCCPLGQAMTFFVICCTHIVFQELLTMRSDAPFRDAKAKLMEIRQEQSKRSDRSGGGERRKKKKPKPSVQS

SEQ ID NO: 21454 - protein, 936 aa, Secale cereale
PTSATSRRSPSAWSPPRSPTSSTTPPAAASSPPPSTASPPGTSSAASPPPPSPPLLLRLPRRLLRRLLPRAASASASSVASGHADGSIRLWDAETGACEATLHGHRSAASAIRFAPSGAVLASGSKDCDVILWDVVAQAGLFRLRGHRDQVTDLVFLDSGKKLVTCSKDKFIRVWDLDTQHCLQIVGGHHSEIWSMDVDPSEKFLVSGSADPELRVFRIRQSAEEGEDWNKWDALKLFGEIPRQSKERIQTIRFNKDGSLVACQVAGKTADIYRILDETEATRKAKRRLHRKKEKASAKAAAAEGNGTVIDPLPAQDSQNPTVVVTDVFKLLQVLRTSKKICSVAFSPSNPPKGCLATLSLSLNNNVLETYSVDNEKVSKMYSVEIHGHRSDIRSLALNSEDNLLMSTSHNAVKIWNPSTGDCLRTVDSGYGLCSAFVPGNRYGLIGTKTGTLEIIDINSGNSIDVIEAHAGSIRSIVLIPDEDGTVNARGFVTGSADHDVKFWEYQLVQKSDSDAKYLSVTNVKTLKMNDDVLAVSIGPTGKHIAVALLDCTVKVFFLDTLKFCLSLYGHKLPVLCMDISSDGALIVTGSADKNLKIWGMDFGDCHKSIFAHTDSVMDVKFVPKTHYMFSVGKDRTVKYWDADKFELLLTLEGHHAEVWCLAISSRGDFIVTGSHDRSIRRWDRTEEQLFIEEEREKRLEETFEADLDNAVEDRYGQKDDAPDEGSVGVPGKKTKETVTAADAIIDALDTAEEEEKRLHEQKELQNVGEGTKSKPNVIMQGHSPSEYVLNAVSSVRPNDLEQALLSLPFSDALKLMAYLKEWSLIPLKVELVCRVCLVLLQTHHNQLTTTPAARSILTALKDILYGRVKDCKDTIGFNLAAMDHIKELLTMRSDAPFRDAKAKLMEIRQEQSKRSDRSEGGEKRKKKKPKASVQI

SEQ ID NO: 21455 - protein, 885 aa, Brachypodium distachyon
MASSQGPKKNYRCDRSLQQFYTGGPFAVGSAAPGGEGDAEAFLACACGSELRVVSAADASAIGEPIDGDSEAVTGLALSPDSRLLFAAGHSRLIRVWDLASRTCIRSWKGHDGPVMAMACHASGGLLATAGADKKVCVWDVDGGFCTHFFRGHTGVVTTIMFHKDPKRLLLFSGSDDGTVRVWNLESKKCVAVLKAHFSTVTSLALSEDGQTLLSAGRDKVVNVWDVRKYSSKKTIPTYEMIEAVSFIGPGSGFLACLGVEPANLKKRTDSYFLTVGERGVVRIWCLESTVCVYEQQSSDVTINSENEESRRGFTATIMLPDDRGLLCVTADQQFLFYCCTRTDEGAFQLNLYKRLIGYNDEILDLKFVGEEEQYLAVATNLEQVRVYDVASMSCSYVLAGHTEIVVCLDTCVSASGKTLVVTGSKDNTVRLWDMEKRSCIGTGKGHLGAIGCVAFSKKSKNFFVSGSSDRTIKVWSWDDTLIDADGEVSLKAKAGVAAHDKDINSLSVSPNDGLVCSGSEDRTACIWKLPNLVSSVVLKGHKRGIWSVEFSPVEQCVITSSGDRTVKIWHVTDGSCLKTFEGHTSSVLKASFLSRGTQFVSCGSDGLVKLWTIKTSECIATYDKHDGKVWALAVGRKTEMLATGGTDSDLNLWHDCTTEDKQEDFRKKEEEALRGQELDNAVSDSDYKRAIQLAFELRRPRRLLELFSQLCRKDDPEDPIEKALVGLPKEGLRLLLEYIREWNTKPKFCHVAQFVLFRVLKSFPPTDILEIKGISELLEGLIPYSQRHFSRVDRLVRSTFLLDYTLTRMSVVDPDVDTATTRDVTNSSSVENGEIVLAEPDLGVSQESPEKPGKKRKSSKSSKKVSKKVKASSNGDSKTISVEA

SEQ ID NO: 21456 - protein, 883 aa, Setaria italica
MASTQALKKNYRCDRSLQQFYTGGPFAVGRPPAGEGEGEGGAEADPFLACACGGEVRVVSAADASAIGEPVDGDSEAITALTLSPDSRLLFAAGHSRLIRVWDLATRTCIRSWKGHDGPIMAMACHASGGLLATAGADKKVCIWDVDGGFCTHFLRGHTGIVTTIMFHKDPKRLLLFSGSEDGTVRVWNLETKKCVAVLKEHFSTVTSLTLSDDGQTLLSAGRDKVVTVWDVRKYSSKKTIPTYEMIEAVSFIGSGSELLACLGIELVNMKGGSDGYFLTVGERGVVRIWCLESGRCVFEQQSSDVTVNSENEETRRGFTSAVMLPNDQGLLCVTADQQFLFYCPKKTDEGTFQLSLYRRLVGYNDEILDLKFVGDEEQYLAVATNLEQVRVYDVASMSCSYVLAGHTEIIVCIDTCVSSSGKTLVVTGSKDNTVRLWDAERRRCIGTGKGHLGAVGSVAFSKKSKNFFVSGSSDRTIKIWTWDDTLDDADDEVPLRAKAVVAAHDKDINSLSVSPNDGLVCSGSEDRTACIWKLPNLVSSVVLKGHKRGIWSVEFSLVEQCVMTSSGDRTIKIWSVADGTCLKTFEGHTSSVLRASFLSRGTQVISCGSDGLVKLWTIKTNECIATYDKHDGKVWALAVGRKTEMLATGGTDSILNLWHDCTMEDKQEDFRKKEEEVLRGQELENAVSDADYTKAIQLAFELRRPHRLLELFSQLARRADSEDPIEKALLGLPKDGLRVLLEYIREWNTKPKFCHVAQFVLFRVLRTLPPTDILEIKGISELLEGLIPYSQRHFNRVDRLVRSTFLLDYTLMRMAVVDPDVDAGTTKDDMNGSSVENNETAEAQPASPITEKSSKKRKQGKSSKKGKEKKVKLASKDVSVEA

SEQ ID NO: 21457 - protein, 887 aa, Sorghum bicolor
MASTHALKKNYRCDRSLQQFYTGGPLAVGLAPGGDGEGEGGAQAEAFLACACGGEVRVVSAADASAIGEPVDGDSEAITALALSPDSRLIFAAGHSRLIRVWDLASRTCIRSWKGHDGPIMAMACHASGGLLATAGADKKVCVWDVDGGFCTHFLRGHTGVVTTIMFHKDPKRLLLFSGSEDGTVRVWNLETKKCVAVLKEHFSAVTSLTLSDDGQTLLSAGRDKIVTAWDIRKYSSKKTIPTYEMIEAVSFIGSGSELLACLGIELANIKEKAASYFLTVGERGVVRIWCLESSLCVFEQQTSDVTVNSENEETRRGFTSAVMLPNDQGLLCVTADQQFLFYCPKRTDDGTFELSLYRRLIGYNDEILDLKFVGEEEQYLAVATNLEQVRVYDVASMSCSYVLAGHTEIVVCIDTCVSASGKTLVVTGSKDNTVRLWDVERKSCIGIGKGHLGAVGSVAFSKKTKNFFVSGSSDRTIKVWTWDDALGDAEDEVSLKAKAVVAAHDKDINSLAISPNDGLVCSGSEDRTACIWKLPNLVSSIVLKGHKRGIWSVEFSPIEQCVMTSSGDRTIKIWSVADGSCLKTFEGHTSSVLRASFLSRGTQIVSCGSDGLVKLWTIKTNECIATYDKHDGKVWALAVGMKTEMVATGGTDSVLNLWHDCTKEDKQEDFRKKEEEVLRGQELENAVSDSDYAKAIQLAFELRRPHRLLDLFSQLARRADAEDPIEKALLGLPKDGLRVLLEYVREWNTKPKFCHVAQFVLFRVLRSFSPTDILEIKGISELLEGLIPYSQRHFSRVDRLVRSTFLLDYTLMRMSVVDSDVDAGTIKDEMNGSSVENGELAEPRPASPVPEKSSKKRKSSKSSKKGKEKKVKVASSGHSNDVSVEA

SEQ ID NO: 21458 - protein, 879 aa, Panicum virgatum
MASTQALKKNYRCDRSLQQFYTGGPFAVGRAPAGEAEGEAEPFLACACGGEVRVVSTADASAIGEPVECDSEAITALTVSPDSRLLFAAGHSRLIRVWDLATRTCIRSWKGHDGPIMAMACHASGGLLATAGADKKVCVWDVDGGFCTHFLRGHTGVVTTIMFHKDPKRLLLFSGSEDGTVRVWNLETKKCVTVLKEHFSTVTSLALSDDGQTLLSAGRDKVVTVWDVRKYSSKKTIPTYEMIEAISFIGSGSEVLACLGIELANMKGKMDGYFLTVGERGVVRIWCLESGHCIFEQQSSDVTVNSENEETRRGFTSSVMLPNDQGLLCVTADQQFLFYCPKKTDEGIFQLSLYRRLVGYNDEILDLKFVGDEEQYLAVATNLEQVRVYDVASMSCSYVLAGHTEIVVCIDTCVSSSGKTLIVTGSKDNTVRLWDAERRSCIGTGKGHLGAVGSVAFSKKSKNFFVSGSSDRTIKIWTWDDALGDVDDEVPLRAKAVVAAHDKDINYLAVSPNDGLVCSGSEDRTACIWKLPNLVSSVVLKGHKRGIWSVEFSPVEQCVMTSSGDRTIKIWSVADGSCLKTFEGHTSSVLRASFLSRGTQVISCGSDGLVKLWTIKTNECIATYDKHDGKVWALAVGRKTEMLATGGTDAILNLWHDCTMEDKQEDFRKKEEEVLRGQELENAVSDSDYTKAIQLAFELRRPHRLLELFSQLARRADSEDPIEKALLGLPKDGLRVLLEYIREWNTKPKFCHVSQFVLFRVLRCLPPTDILEIKGISELLEGLIPYSQRHFSRVDRLVRSTFLLDYTLMRMSVVDPDVDAGTAKDDMNGSSVENDETAEACPASPVTEKPSKKRKQGKSSKKGKEKKVKVLSKYVSVEA

SEQ ID NO: 21459 - protein, 886 aa, Zea mays
MASTHVYKKNYRCDRSLQQFYTGGPFAVGLAPGGDGEGGAEAEAFLACACGGEVRVVSAADASAIGEPVDGDSEAITALALSPDSRLIFAAGHSRLIRVWDLASRTCIRSWKGHDGPIMAMACHASGGLLATAGADKKVCVWDVDGGFCTHFLRGHMGVVTTIMFHKDPKRLLLFSGSEDGTVRVWNLETKKCVAVLKEHFSAVTSLALSDDGQTLLSAGRDKIVTAWDIRKYSSKKTIPTYEMIEAVSFIGSGSELLACLGIELANIKEKSAGYFLTVGERGVVRVWCLESCVCVFEQQTSDVTVNSENEETRRGFTSAVMLPNDQGLLCVTADQQFLFYCPKRTDDGDFELSLYRRLIGYNDEILDLKFIGEEEQYLAVATNLEQVRVYDVASMSCSYVLAGHTEIVVCIDTCVSASGKTLVVTGSKDHTVRLWDAERKGCIGIGKGHLGAVGSVAFSKKTNNFFVSGSSDRTIKVWTWDDALGDAEDEVPLKAKAVVAAHDKDINSLAISPNDGLVCSGSEDRTACIWKLPNLVLSVVLKGHKRGIWSVEFSSVEQCVMTSSGDRTIKIWSVADGSCLKTFEGHTSSVLRASFLSRGTQVISCGSDGLVKLWTIKTNECIATYDKHDGKVWALAVGMKTEMVATGGTDAVLNLWHDSTMEDKQEDFRKKEEEVLRGQELENAVSDSDYAKAIQLAFELRRPHRLLDLFSKLARRADAEDPIEKALLGLPTDGLRVLLEYVREWNTKPKFCHVAQFVLFRLLRSFSPTDILEIKGISELLEGLIPYSQRHFSRVDRLVRSTFLLDYTLMRMSVVDPDVDAGTIKDEMNGSSVENGELAEPRPASPVPQKSSKKRKSGKSGKKGKEKKVKVASSGLLSKDVSVEP

SEQ ID NO: 21460 - protein, 880 aa, Triticum aestivum
MALSQGPKNNYRCDRSLQQFYTGGPFAVGRAPRGEGEGDAEEAFLACACGSELRVVSAADASAIGEPIDGDSEAVTGIALSPDSRLLFAAGHSKLIRVWDLASRTCIRSWKGHDGPVMAMSCHASGGLLATAGADKKVCVWDVDGGFCTHFFRGHTGVVTTIMFHRDPKRLLLFSGSDDGTVRVWNLESKKCIAVLNAHFSTVTSLALSEDGLTLLSAGRDKVVNVWDLRKYASKKTIPAYEMIEGVSFIGPGSGILACLGVEAAKLKEKTDGYFLTVGERGIVRIWCLESAVCVFEQQSSDVTINSENEESRRGFTATNMLPDDQGILCVTADQQFLFYSCTRTDEGTFQLNLYKRLIGYNDEILDLKFVGEDEQYLAVATNLEQVRVYDVASMSCSYVLAGHTEIVVCLDTCVSASGKTLVVTGSKDNTVRLWDMEKRSCIGTGKGHLGAIGCVAFSKKSKNFFVSGSSDRTIKVWTWDDTLIDAGGEVPLKAKAGVAAHDKDINSLSVSPNDGLVCSGSEDRTASIWKLPNLVSSVVLKGHKRGIWSVEFSPVEQCVITSSGDKTVKIWHVADGSCLKTFEGHTSSVLRASFLSRGTQFVSCGSDGLVKLWTIKTNECIATYDKHDGKIWALAVGKRTEMLATGGTDSDLNLWHDCTMEDKQEDFLKKEEEVLRGQELENAVSDSDYTRAIQLAFELRRPRRLLELFSQLCRKADPEDPIEKALVGLPKEGLRVLLEYIREWNTKPKFCHVAQFVLFRVLRSLPPTDILEIKGISELLEGLIPYSQRHFSRVDRLVRSTFLLDYTLARMSVVDPDVDAGTTKDSSMNNVEMAPAEPAQDTPEKPGRKRKSSKTTSQSSKKSSKKVKASSSAVVSVEA

SEQ ID NO: 21461 - protein, 887 aa, Zea mays
MASSSTCVLKKNYRCDRSLQQFYTGGPFAVGLAPGGDGEGGAEAEAFLACACGGEVRVVSSADASAIGEPVDGDSEAITALALSPDSRLLFAAGHSRLIRAWDLASRACIRSWKGHDGPIMAMACHVSGGLLATAGADKKVCVWDVDGGFCTHFLRGHTGVVTSVMFHKDPKRLLLFSGSEDGTVRVWNLETKKCVAVLKEHFSAVTSLALSDDGQTLLSAGRDKIVTAWDIRKYSSKKTIPTYEMIEAVSFIGPGSEFLACLGIELANKKEKDTAYFLTVGERGVVRIWCLESCLCVFEQQTSDVTVNSENKETRRGFTSAVMLPNEQGLLCVTADQQFLFYCPKRTDDGTFELSLYRRLIGYNDEILDLKFIGEEEQYLAVATNLEQVRVYDVASMSCSYVLAGHTEIIVCIDTCVSASGKTLVVTGSKDNTVRLWDAERKSCIGIGKGHLGAVGSVAFSKKTKDFFVSGSSDRTIKVWTWDNTLGDAEDEVPLKAKAVVAAHDKDINYLTVSPNDGLVCSGSEDRTACIWKLPNLVFSVALKGHKRGIWSVEFSPVEQCVMTSSGDRTIKIWSVADGSCLKTFEGHTSSVLRASFLSRGTQVVSCGSDGLVKLWTIKTNECIATYDKHDGKVWALAVGRKTEMVATGGTDAVLNLWHDCTMEDKQEDFRKKEQEVLRGQELENAVSDSDYAKAIQLAFELRRPHKLLDLFSQLARRADAEDPIEKALLGLPKDGLRVLLEYAREWNTKPKFCHVAQFVLFRVLRSFSPTDILEIKGISELLEGLIPYSQRHFSRVDRLVRSTFLLDYTLTRMSVVDPDVDAGSIKDEMNGSSVENGELAEPRPASPVPEKSSKKRKSGKSSKKGKEKVMKLASSGLGKGVSVEA

SEQ ID NO: 21462 - protein, 896 aa, Panicum virgatum
MASTQALKKNYRCDRSLQQFYTGGPFAVGRGPAGEAEAEAEPFLACACGGEVRVVSAADASAIGEPVECDSEAITALTLSPDSRLLFAAGHSRLIRVWDLATRTCIRSWKGHDGPIMAMACHASGGLLATAGADKKVCVWDVDGGFCTHFLRGHTGVVTTIMFHKDPKRLLLFSGSEDGTVRVWNLETKKCVAVLKEHFSTVTSLSLSDDGQTLLSAGRDKVVTAWDVRKYSSKKTIPTYEMIEAISFIGSGSEVLACLGIELANMKGKMDGYFLTVGERGVVRIWCLESGHCIFEQQSSDVTVNSENEETRRGFTSAVILPNDQGLLCVTADQQFLFYCPKKTDEGIFQLSLYRRLVGYNDEILDLKFVGDDEQYLAVATNLEQLLPPHAGPCLYTSEISYAVYLHMQVRVYDVASMSCSYVLAGHMEIVVCIDTCVSSSGKTLIVTGSKDNTVKLWDAERRSCIGTGKGHLGAVGSVAFSKKSKNFFVSGSSDRTIKIWTWDDTLDDDEVPLKAKAVVAAHDKDINSLAVSPNDGLVCSGSEDRTACIWKLPNLVSSVVLKGHKRGIWSVEFSPVEQCVMTSSGDRTIKIWSVADGSCLKTFEGHTSSILRASFLSRGTQVISCGSDGLVKLWTIKTNECIATYDKHDGKVWALAVGRKTEMLATGGTDAILNLWHDCTMEDKQEDFRKKEEEVLRGQELENAVSDSDYTKAIQLAFELRRPHRLLELFSQLARRADSEDPIEKALLGLPKDGLRVLLEYIREWNTKPKFCHVSQFVLFRVLRCLPPTDILEIKGISELLEGLIPYSQRHFSRVDRLVRSTFLLDYTLMRMSVVDPDVDAGTAKDDMNGSSVENDETAEACPASPVTEKPSKKRKQGKSSKKGKEKKVKVLSKY

SEQ ID NO: 21463 - protein, 545 aa, Brachypodium distachyon
MEIGGQYPGSSCSKEHQKIYQEWFAFADSDGDGRITGPDAIKFFAMSKLPRADLKQVWAIADSKRLGYLGFGEFVTAMQLVSLAQAGNEITQDSLKRDDLSSLNPPVMEGLDVLLAKSKHLAKRVDPDIDGFPQAQPPSTNHWFSSKSSKKIPLTAVTSVIDGLKKLYVEKLKPLEVTYKFNDFVSPLLTNSDFDAKPMVMLLGQYSTGKTTFIKHLLKTSYPGAHIGPEPTTDRFVVVMSGPDERTIPGNTLAVQADMPFSGLTTFGTSFLSKFECSQMPHPLLEHITFVDTPGVLSGEKQRTQRSYEFTGVTSWFAAKCDLILLLFDPHKLDISDEFKRVIGSLRGHDDKIRVVLNKADQIDTQQLMRVYGALMWSLGKVLNTPEVSRVYIGSFNDKPVNESAVGPIGKELFEREQDDLLSDLKDIPKKACDRRINEFVKRARAAKIHAYIIGHLKNQMPTMMGKAKAQQRLIDNLQDEFAKVQREHHLPAGDFPYVEHFKDVLGGYSIDKFEKVKPKMIQAVDDMLGYDIPELLKNFRNPYE

SEQ ID NO: 21464 - protein, 544 aa, Setaria italica
MEIGQYPASGCSKEHQKIYQEWFALADSDGDGRITGPDAIKFFGMSKLSRPDLKQVWAIADSRRQGYLGFPEFVAAMQLVSLAQAGNEITQDSLKRDDLSSLNPPVMEGLDALLAKSKHVVKRVDPEMDGFPQEQSPLTNKWFSSKSSKKIPLTAVTSVIDGLKKLYIEKLKPLEVTYKFNDFVSPLLTSSDFDAKPMVMLLGQYSTGKTTFIKHLLRTSYPGAHIGPEPTTDRFVVVMSGSDERTIPGNTIAVQADMPFSGLTTFGTAFLSKFECSQMRHPLLEHITFVDTPGVLSGEKQRTQRSYDFTGVTSWFAAKCDLILLLFDPHKLDISDEFKRVIGSLRGHDDKIRVVLNKADQVDTQQLMRVYGALMWSLGKVLNTPEVSRVYIGSFNDKPVNESAVGPLGKELFEREQDDLLSDLKDIPKKACDRRINEFVKRARAAKIHAYIIGHLKKEMPTMMGKAKAQQRLIDNLQDEFAKVQREYHLPAGDFPYVEHFKEVLSGYSFDKFEKVKPKMIQAVDDMLGYDIPELLKNFRNPYE

SEQ ID NO: 21465 - protein, 544 aa, Zea mays
MEIGQYPASGCSKEHQKIYQEWFALADADGDGRITGPDAIKFFGMSKLSRPDLKQVWAIADTRRQGYLGFSEFVTAMQLVSLAQAGNEITQDSLKRDDLSSLNPPVMEGLDALLAKSKHLVKRVDPEMDGYPQEQSPLTNKWFSSKSSKKIPLTAVTSVIDGLKKLYIEKLKPLEVTYKFNDFVSPLLTSSDFDAKPMVMLLGQYSTGKTTFIKHLLRTSYPGAHIGPEPTTDRFVVVMSGSDERTIPGNTIAVQADMPFSGLTTFGTAFLSKFECSQMRHPLLEHITFVDTPGVLSGEKQRTQRSYDFTGVTSWFAAKCDLILLLFDPHKLDISDEFKRVIGSLRGHDDKIRVVLNKADQVDTQQLMRVYGALMWSLGKVLNTPEVSRVYIGSFNDKPVNESAVGPLGKELFEREQDDLLSDLKDIPKKACDRRINEFVKRARAAKIHAYIIGHLKKEMPTMMGKAKAQQRLIDNLPDEFAKVQREYHLPSGDFPYVEHFKEVLSGYSFDKFEKVKPKMIQAVDDMLGYDIPELLKNFRNPYE

SEQ ID NO: 21466 - protein, 544 aa, Pennisetum glaucum
MEIGQNPASGCSKEHQKIYQEWFALADSDGDGRITGPDAIKFFGMSKLSRPDLKQVWAIADSRRQGYLGFPEFVAAMQLVSLAQAGNEITQDSLKRDDLSSLNPPVMEGLDALLAKSKHVVKRVDPEMDGFPQEQSPITNKWFSSKSSKKIPLTAVTSVIDGLKKLYIEKLKPLEVTYKFNDFVSPLLTSSDFDAKPMVMLLGQYSTGKTTFIKHLLRTSYPGAHIGPEPTTDRFVVVMSGSDERTIPGNTIAVQADMPYSGLTTFGTAFLSKFECSQMRHPLLEHITFVDTPGVLSGEKQRTQRSYDFTGVTSWFAAKCDLILLLFDPHKLDISDEFKRVIGSLRGHDDKIRVVLNKADQVDTQQLMRVYGALMWSLGKVLNTPEVSRVYIGSFNDKPVNESAVGPLGKELFEREQDDLLSDLKDIPKKACDRRINEFVKRARAAKIHAYIIGHLKKEMPTMMGKAKAQQRLIDNLPDEFAKVQREYHLPAGDFPYVDHFKEVLSGYSFDKFEKVKPKMIQAVDDMLGYDIPELLKNFRNPYE

SEQ ID NO: 21467 - protein, 544 aa, Saccharum officinarum
MEIGQYPASSCSKEHQKIYQEWFALADADGDGRITGPDAIKFFGMSKLSRPDLKQVWAIADTRRQGYLGFPEFVTAMQLVSLAQAGNEITQDSLKRDDLVSLNPPVMEGLDALLAKSKHLVKRVDPEMDGYPQEQSTLTNKWFSSKSSKKIPLTAVTSVIDGLKKLYIEKLKPLEVTYKFNDFVSPLLTSSDFDAKPMVMLLGQYSTGKTTFIKHLLRTSYPGAHIGPEPTTDRFVVVMSGPDERTIPGNTIAVQADMPFSGLTTFGTAFLSKFECSQMRHPLLEHITFVDTPGVLSGEKQRTQRSYDFTGVTSWFAAKCDLILLLFDPHKLDISDEFKRVIGSLRGHDDKIRVVLNKADQVDTQQLMRVYGALMWSLGKVLNTPEVSRVYIGSFNDKPVNESAVGPLGKELFEREQDDLLSDLKDIPKKACDRRINEFVKRARAAKIHAYIIGHLKKEMPTMMGKAKAQQRLIDNLPDEFAKVQREYHLPLGDFPYVEHFKEVLSGYSFDKFEKVKPKMIQAVDDMLGYDIPELLKNFRNPYE

SEQ ID NO: 21468 - protein, 544 aa, Echinochloa colona
MEIGQYPASGCSKEHQKIYQEWFALADSDGDGRITGPDAIKFFGMSKLSRPDLKQVWAIADSRRQGYLGFAEFVAAMQLVSLAQAGNEITQDSLKRDDLSSLNPPVMEGLDALLAKSKHVVKRVDPEMDGFPQEQSTITNKWFSSKSSKKIPLTAVTSVIDGLKKLYIEKLKPLEVTYKFNDFVSPLLTSSDFDAKPMVMLLGQYSTGKTTFIKHLLKTSYPGAHIGPEPTTDRFVVVMSGSDERTIPGNTIAVQADMPFSGLTTFGTAFLSKFECSQMRHPLLEHITFVDTPGVLSGEKQRTQRSYDFTGVTSWFAAKCDLILLLFDPHKLDISDEFKRVIGSLRGHDDKIRVVLNKADQVDTQQLMRVYGALMWSLGKVLNTPEVSRVYIGSFNDKPVNESAVGPLGKELFEREQDDLLSDLKDIPKKACDRRINEFVKRARAAKIHAYIIGHLKKEMPTMMGKAKAQQRLTDNLQDEFAKVQREHHLPAGDFPYVEHFKEVLSGYSFDKFEKVKPKMIQAVDEMLGYDIPELLNNFRNPYE

SEQ ID NO: 21469 - protein, 544 aa, Sorghum bicolor
MEIGQYPVSSCSKEHQKIYQEWFALADADGDGRITGPDAIKFFGMSKLSRPDLKQVWAISDTRRQGYLGFPEFVTAMQLVSLAQAGNEITQDSLKRDDLISLNPPVMEGLDALLAKSKHLVKRVDPEMDGYPQEQSTLTNKWFSSKSSKKIPLTAVTSVIDGLKKLYIEKLKPLEVTYKFNDFVSPLLTSSDFDAKPMVMLLGQYSTGKTTFIKHLLRTSYPGAHIGPEPTTDRFVVVMSGPDERTIPGNTIAVQADMPFSGLTTFGTAFLSKFECSQMRHPLLEHITFVDTPGVLSGEKQRTQRSYDFTGVTSWFAAKCDLILLLFDPHKLDISDEFKRVIGSLRGHDDKIRVVLNKADQVDTQQLMRVYGALMWSLGKVLNTPEVSRVYIGSFNDKPVNESAVGPLGKELFEREQDDLLSDLKDIPKKACDRRINEFVKRARAAKIHAYIIGHLKKEMPTMMGKAKAQQRLIDNLPDEFAKVQREYHLPSGDFPYVEHFKEVLSGYSFDKFEKVKPKMIQAVDDMLGYDIPELLKNFRNPYE

SEQ ID NO: 21470 - protein, 542 aa, Avena sativa
MEIGAATSCSKEHQKIYHEWFAFADSDGDGRITGPDAIKFFGMSRLPRADLKQVWAIADSKRLGYLGFGEFITSMQLVSLAQAGNEITQDSLKSGDLSSLNPPVMEGLDALLAKSKHLVKRVDQDIDGFPQAQGPSTNHWFTSKSSKKIPLTAVTSVIDGLKRLYIEKLKPLEVTYKFNDFVSPLLTNSDFDAKPMVMLLGQYSTGKTTFIKHLLKTSYPGAHIGPEPTTDRFVVVMSGPDERTIPGNTLAVQADMPFSGLTTFGTSFLSKFECSQMPHPLLEHITFVDTPGVLSGEKQRTQRSYEFTGVTSWFAAKCDLILLLFDPHKLDISDEFKRVIGSLRGHDDKIRVVLNKADQIDTQQLMRVYGALMWSLGKVLNTPEVSRVYIGSFNDKPVKESAVGPIGKELFEKEQDDLLSDLKDIPKKACDRRINEFVKRARAAKIHAYIIGHLKNQMPTMMGKAKAQQRLIDNLEDEFAKVQREHHLPAGDFPYVEHFKDVLGGYSIDKFEKVKPKMIQAVDYMLGYDIPELLKNFRNPYE

SEQ ID NO: 21471 - protein, 545 aa, Triticum aestivum
MEIGGQHPASSCSKEHQKIYRDWFALADSDGDGRITGPDAIKFFAMSSLPRADLKQVWAIADSKRLGYLGFGEFITAMQLVSLAQAGNEISQDSLQREDLISFNPPVMEGLDALLAKSKHLAKRVDQDMDGFPQAQGPSTNHWFNSKSSKKIPLTAVTSVIDGLKRLYIEKLKPLEVTYKFNDFVSPLLTNSDFDAKPMVMLLGQYSTGKTTFIKHLLKTSYPGAHIGPEPTTDRFVVVMSGPDERTIPGNTLAVQADMPFSGLTTFGTSFLSKFECSQMPHPLLEHITFVDTPGVLSGEKQRTQRSYEFTGVTSWFAAKCDLILLLFDPHKLDISDEFKRVIGSLRGHDDKIRVVLNKADQIDTQQLMRVYGALMWSLGKVLNTPEVSRVYIGSFNDKPVKESAVGPIGKELFEKEQDDLLSDLKDIPKKACDRRINEFVKRARAAKIHAYIIGHLKNQMPTMMGKAKAQQKLIDNLEGEFAKVQREHHLPAGDFPYVEHFREALGGYSIDRFEKVKPKMIQAVDDMLGYDIPELLKNFRNPYE

SEQ ID NO: 21472 - protein, 545 aa, Triticum aestivum
MEIGGQHPASSCSKEHQKIYRDWFALADSDGDGRITGPDAIKFFAMSSLPRADLKQVWAIADSKRLGYLGFGEFITAMQLVSLAQAGNEISQDSLQREDLISFNPPVMEGLDAQLAKSKHLAKRVDQDMDGFPQAQGPSTNHWFNSKSSKKIPLTAVTSVIDGLKRLYIEKLKPLEVTYKFNDFVSPLLTNSDFDAKPMVMLLGQYSTGKTTFIKHLLKTSYPGAHIGPEPTTDRFVVVMSGPDERTIPGNTLAVQADMPFSGLTTFGTSFLSKFECSQMPHPLLEHITFVDTPGVLSGEKQRTQRSYEFTGVTSWFAAKCDLILLLFDPHKLDISDEFKRVIGSLRGHDDKIRVVLNKADQIDTQQLMRVYGALMWSLGKVLNTPEVSRVYIGSFNDKPVKESAVGPIGKELFEKEQDDLLSDLKDIPKKACDRRINEFVKRARAAKIHAYIIGHLKNQMPTMMGKAKAQQKLIDNLEGEFAKVQREHHLPAGDFPYVEHFREALGGYSIDRFEKVKPKMIQAVDDMLGYDIPELLKNFRNPYE

SEQ ID NO: 21473 - protein, 545 aa, Triticum aestivum
MEIGGQHPASSCSKEHQKIYRDWFALADSDGDGRITGPDAIRFFAMSSLPRADLKQVWAIADSKRLGYLGFGEFITAMQLVSLAQAGNEISQDSLQREDLISFNPPVMEGLDAQLAKSKHLAKRVDQDMDGFPQAQGPSTNHWFNSKSSKKIPLTAVTSVIDGLKRLYIEKLKPLEVTYKFNDFVSPLLTNSDFDAKPMVMLLGQYSTGKTTFIKHLLKTSYPGAHIGPEPTTDRFVVVMSGPDERTIPGNTLAVQADMPFSGLTTFGTSFLSKFECSQMPHPLLEHITFVDTPGVLSGEKQRTQRSYEFTGVTSWFAAKCDLILLLFDPHKLDISDEFKRVIGSLRGHDDKIRVVLNKADQIDTQQLMRVYGALMWSLGKVLNTPEVSRVYIGSFNDKPVKESAVGPIGKELFEKEQDDLLSDLKDIPKKACDRRINEFVKRARAAKIHAYIIGHLKNQMPTMMGKAKAQQKLIDNLEGEFAKVQREHHLPAGDFPYVEHFREALGGYSIDRFEKVKPKMIQAVDDMLGYDIPELLKNFRNPYE

SEQ ID NO: 21474 - protein, 545 aa, Secale cereale
MEIGGQHPASSCSKEHQKIYRDWFALADSDGDGRITGPDAIRFFAMSSLPRADLKQVWAIADSKRLGYLGFGEFITAMQLVSLAQAGNEISQDSLQREDLISFNPPVMEGLDAQLAKSKHLAKRADQDMDGFPQAQGPSTNHWFNSKSSKKIPLTAVTSVIDGLKRLYIEKLKPLEVTYKFNDFVSPLLTNSDFDAKPMVMLLGQYSTGKTTFIKHLLKTSYPGAHIGPEPTTDRFVVVMSGPDERTIPGNTLAVQADMPFSGLTTFGTSFLSKFECSQMPHPLLEHITFVDTPGVLSGEKQRTQRSYEFTGVTSWFAAKCDLILLLFDPHKLDISDEFKRVIGSLRGHDDKIRVVLNKADQIDTQQLMRVYGALMWSLGKVLNTPEVSRVYIGSFNDKPVKESAVGPIGKELFEKEQDDLLSDLKDIPKKACDRRINEFVKRARAAKIHAYLIGHLKNQMPTMMGKAKAQQKLIDNLEGEFAKVQREHHLPAGDFPYVDHFREALGGYSIDKFEKVKPKMIQAVDDMLGYDIPELLKNFRNPYE

SEQ ID NO: 21475 - protein, 530 aa, Secale cereale
HQKIYRDWFALADSDGDGRITGPDAIRFFAMSSLPRADLKQVWAIADSKRLGYLGFGEFITAMQLVSLAQAGNEISQDSLQREDLISFNPPVMEGLDAQLAKSKHLAKRADQDMDGFPQAQGPSTNHWFNSKSSKKIPLTAVTSVIDGLKRLYIEKLKPLEVTYKFNDFVSPLLTNSDFDAKPMVMLLGQYSTGKTTFIKHLLKTSYPGAHIGPEPTTDRFVVVMSGPDERTIPGNTLAVQADMPFSGLTTFGTSFLSKFECSQMPHPLLEHITFVDTPGVLSGEKQRTQRSYEFTGVTSWFAAKCDLILLLFDPHKLDISDEFKRVIGSLRGHDDKIRVVLNKADQIDTQQLMRVYGALMWSLGKVLNTPEVSRVYIGSFNDKPVKESAVGPIGKELFEKEQDDLLSDLKDIPKKACDRRINEFVKRARAAKIHAYLIGHLKNQMPTMMGKAKAQQKLIDNLEGEFAKVQREHHLPAGDFPYVDHFREALGGYSIDKFEKVKPKMIQAVDDMLGYDIPELLKNFRNPYE

SEQ ID NO: 21476 - protein, 544 aa, Ananas comosus
MDIGSSPVSTCSREDQKIYQEWFSFADSDGDGRITGPDAIKFFGMSKLSRPELKQVWAIADSKRQGFLGFNEFITAMQLVTLAQAGNEITQDTLHHADLSKLSPPIMEGLDVLLAKSKPSPKKSDPDLDGSSQPQIPSTVQWFSSKSTKKIPLSSVTSIIDGLKRLYIEKLKPLEVTYRFNDFVSPLLTNSDFDAKPMVMLLGQYSTGKTTFIKHLLRCGYPGAHIGPEPTTDRFVVVMSGPDERSIPGNTIAVQADMPFSGLTTFGTAFLSKFECSQMPHALLEHITFVDTPGVLSGEKQRTQRSYDFTGVTSWFAAKCDLILLLFDPHKLDISDEFKRVIGSLRGHDDKIRVVLNKADQVDTQQLMRVYGALMWSLGKVLNTPEVVRVYIGSFNDKPVNEAAVGPIGKELFEREQDDLLSDLKDIPKKACDRRINEFVKRARAAKIHAYIVSHLRKEMPAMMGKAKAQQRLIDNLEDEFAKVQREYHLPAGDFPNVDHFREVLGGYNIDKFEKLKPKMIQTVDDMLGYDIPELLRSFRNPYE

SEQ ID NO: 21477 - protein, 543 aa, Elaeis guineensis
MDIVSSPMSTCSREHQKIYKEWFSAADSDGDGRITGTDAIKFFAMSKLSRPELKQVWAIADSKRQGFLGLNEFITAMQLVSLAQAGNEITQDALTHSELDLLKPPVMEGLDILLAKTTSPKKSNPDLDVSSQPPVSLTTQWFSSKSTKKIPLSSVTSIIDGLKRLYIEKLKPLEVTYRFNDFVSPLLTNSDFDAKPMVMLLGQYSTGKTTFIKHLLRSSYPGAHIGPEPTTDRFVVVMSGPDERSIPGNTVAVQADMPFSGLTTFGTAFLSKFECSQMPHPLLEHITFVDTPGVLSGEKQRTQRSYDFTGVTSWFAAKCDLILLLFDPHKLDISDEFKRVIGSLRGHDDKIRVVLNKSDQVDTQQLMRVYGALMWSLGKVLNTPEVMRVYIGSFNDKPINEAAVGPIGKELFEREQDDLLSDLKDIPKKACDRRINEFVKRARAAKIHAYIISHLRKEMPAMIGKAKAQQRLIDNLEDEFPKVQREFHLPAGDFPNVEHFKEVLSGYSIDKFEKLKPKMIQTVDDMLGYDIPELLRSFRNPYE

SEQ ID NO: 21478 - protein, 543 aa, Oryza sativa
MELARSACSKEHHKIYAGWFAVADPDGDGRVTGADATKFFAMSGLSRADLKQVWAIADTKRQGFLGFGEFVAAMQLVSLAQAGEEITQDSLKREDLSSLDPPVMEGLDELLARSKAGVKRVHPEENGAPQVQVHSANSWFSSKSAKKMQVPLTAVTSVIDGLKRLYVEKLKPLEVAYRFNDFASPLLTSSDFDAKPMVMLLGQYSTGKTTFIKHLLQTSYPGAHVGPEPTTDRFVVVMSGSDERTIPGNTIAVQADMPFTGLTTFGGAFLSKFECSQMPHPLLDHITFVDTPGVLSGEKQRTQRSYDFTGITSWFAAKCDLILLLFDPHKLDISDEFKRVIASLRGHDDKIRVVLNKADQVDTQQLMRVYGALMWSLGKVLNTPEVARVYIGSFNDKPVNESAVGPIGKDLFEKEQDDLLCDLKDIPKKACDRRVNEFVKRARAAKIHAYIIGHLKKEMPAMMGKAKAQQRLIDNLGDEFAKVQREYHLPAGDFPDVEHFKEVLGGYNIDKFEKMKPKLVQAVDDMLAYDIPELLKNFRNPYE

SEQ ID NO: 21479 - protein, 543 aa, Cocos nucifera
MDIVSSPMSTCSREHQKIYKEWFSAADSDGDGRITGNDAIKFFAMSKLSRPELKQVWALADSKRQGFLGLNEFITAMQLVSLAQAGNKIIQDALTHSDLDCLKPPVMEGLDILLAKTTSPKKSNPDLDVSSQPQVSSTTQWFSSKSTKKIPLSSVTSIIDGLKRLYIEKLKPLEVTYRFNDFVSPLLTNSDFDAKPMVMLLGQYSTGKTTFIKHLLRSSYPGAHIGPEPTTDRFVVVMSGPDERSIPGNTVAVQADMPFSGLTTFGTAFLSKFECSQMPHPLLEHITFVDTPGVLSGEKQRTQRSYDFTGVTSWFAAKCDLILLLFDPHKLDISDEFKRVIGSLRGHDDKIRVVLNKSDQVDTQQLMRVYGALMWSLGKVLNTPEVMRVYIGSFNDKPINEAAVGPIGKELFEREQDDLLSDLKDIPKKACDRRINEFVKRARAAKIHAYIISHLRKEMPAMIGKAKTQQRLIDNLEDEFAKVQREFHLPAGDFPNVEHFKEVLSGYSIDKFEKLKPKMIQVVDDMLGYDIPELLRSFRNPYE

SEQ ID NO: 21480 - protein, 544 aa, Manihot esculenta
MEISSGPIGSCSKENQKTYLEWFNFADSDGDGRITGSDAIKFFGMSNLSRQDLKQVWAISDSKRQGYLGFNEFIGAMQLVSLAQAGHEITSDLLKSDVDFENLKPPSMEGLDALIAKKRTSKSSDPDINVSPPVETSPSVSWFSSKSSKKVPLSSVTSIFDGLKRLYIQKLKPLEVTYRFNDFVSPLLTNSDFDAKPMVMLLGQYSTGKTTFIKHLLKSGYPGAHIGPEPTTDRFVVVMSGTDERSIPGNTVAVQADMPFNGLTTFGTAFLSKFECSQMPHPLLEHITFVDTPGVLSGEKQRTQRAYDFTGVTSWFAAKCDLILLLFDPHKLDISDEFKRVISSLRGHDDKIRVVLNKADQVDTQQLMRVYGALMWSLGKVLNTPEVMRVYIGSFNDKPVNEAAVGPIGKELFEKEQDDLLLDLKDIPKKACDRRINEFVKRARAAKIHAYIISHLKKEMPAMMGKAKAQQRLVDNLVDEFRKVQREFHLPPGDFPNVEHFREVLTGYSIDKFEKLKPKMIQAVDDMLGYDIPELLKNFRNPYD

SEQ ID NO: 21481 - protein, 547 aa, Sorghum bicolor
MEIARAAAGVACSKEHQRIYAEWFALADPDGDGRVTGADATSFFGMSALSRADLKQVWAIADSKRQGYLGFAEFVTAMQLVSLAQAGNEITEDSLKREDLSTLDPPVMEGVDGLLARSKAVVKRIHPDDNGTAQVQAPSMYHWFGSKAAQKVQMPLTAVTSVIDGLKRLYVEKLKPLEVAYRYNDFASPLLTNSDFDAKPMVMLLGQYSTGKTTFIKHLLKTSYPGAHVGPEPTTDRFVVVMSGSDGRTIPGNTIAVQADMPFTGLTTFGGAFLSKFECSQMPHPLLEHITFVDTPGVLSGEKQRTQRSYDFTGVTSWFAAKCDLILLLFDPHKLDISDEFKRVISSLRGHDDKIRVVLNKADQVDTQQLMRVYGALMWSLGKVLNTPEVVRVYIGSFNDKPVNDSAVGPIGKDLFEREQDDLLCDLKDIPKKACDRRVNEFVKRARAAKIHAYIIGHLKKEMPAMMGKAKAQQRLIDNLGEEFAKVQREYHLPAGDFPDVEHFKQVLGGYSIDKFEKLKPKMVQAVDDMLAHDIPELLKNFRNPYE

SEQ ID NO: 21482 - protein, 547 aa, Setaria italica
MEIARAAAGVACSKEHQRIYAEWFALADPDGDGRVTGADATSFFVMSGLSRADLKQVWAIADSKRQGYLGFAEFVTAMQLVSLAQAGNEITQDSLNREDLSTLDPPVMEGVDELVARSKAVVKRVHPEDNGTPQVQASSIYHWFGSKSAQKAQMPLTAVTSVIDGLKRLYLEKLKPLEVAYRFNDFASPLLTSSDFDAKPMVMLLGQYSTGKTTFIKHLLKTSYPGAHVGPEPTTDRFVVVMSGPDGRTIPGNTIAVQADMPFTGLTTFGGAFLSKFECSQMPHPLLEHITFVDSPGVLSGEKQRTQRSYDFTGVTSWFAAKCDLILLLFDPHKLDISDEFKRVISSLRGHDDKIRVVLNKADQVDTQQLMRVYGALMWSLGKVLNTPEVVRVYIGSFNDKPVNETAVGPIGKDLFEREQDDLLCDLKDIPKKACDRQVNEFVKRARAAKIHAYIIGHLKKEMPAMMGKAKAQQRLIDNLEDEFAKVQREYHLPAGDFPDVEHFKQVLGGYNIDKFEKLKPKMVQAVDDMLAYDIPELLKNFKNPYE

SEQ ID NO: 21483 - protein, 547 aa, Zea mays
MDIARAAAGVACCKEHQRIYAEWFALADPDGDGRVTGADATSFFAMSALSRADLKQVWAIADSRRQGYLGFAEFVTAMQLVSLAQAGNEITQDSLKREDLSTLDPPVMEGVDELLARSKAVVKRVHPDDNGTTQAQAPSIYHWFGSKSAQKVQMPLTAVTSVIDGLKRLYVEKLKPLEVAYRYNDFSHPLLTNSDFEAKPMVMLLGQYSTGKTTFIKHLLKTSYPGAHVGPEPTTDRFVVVMSGSDGRTIPGNTIAVQADMPFTGLTTFGGAFLSKFECSQMPHPLLEHITFVDTPGVLSGEKQRTQRSYDFTGVTSWFAAKCDLILLLFDPHKLDISDEFKRVISSLRGHDDKIRVVLNKADQVDTQQLMRVYGALMWSLGKVLNTPEVVRVYIGSFNDKPVNDSAVGPIGKDLFEREQDDLLCDLKDIPKKACDRRVNEFVKRARAAKIHAYIIGHLKKEMPAMMGKAKAQQRLIDNLDEEFAKVQREYHLPAGDFPDVEHFKQVLGGYSIDKFEKLKPKMVQAVDDMLAHDIPELLKNLRNPYE

SEQ ID NO: 21484 - protein, 534 aa, Echinochloa colona
KEHQKIYAEWFALADPDGDGRVTGADATSFFGMSGLSRADLKQVWAIADSKRQGYLGFAEFVTAMQLVSLAQAGNEITQDSLKREDLSTLDPPAMEGVDELVARSKAIVKRVHPDDNGTPQVQASSIYHWFGSKSAQKVQMPLTAVTSVIDGLKRLYVEKLKPLEVAYRFNDFANPLLTSSDFDAKPMVMLLGQYSTGKTTFIKHLLKTSYPGAHVGPEPTTDRFVVVMSGSDGRTIPGNTIAVQADMPFTGLTTFGGAFLSKFECSQMPHPLLEHITFVDTPGVLSGEKQRTQRSYDFTGVTSWFAAKCDLILLLFDPHKLDISDEFKRVISSLRGHDDKIRVVLNKADQVDTQQLMRVYGALMWSLGKVLNTPEVVRVYIGSFNDKPVNDSAVGPIGKDLFEREQDDLLCDLKDIPKKACDRRVNEFVKRARSAKIHAYIIGHLKKEMPAMMGKAKAQQRLIDNLEDEFAKVQREYHLPAGDFPDVEHFKQVLGGYSIDKFEKLKPKMVQAVDDMLAYDIPELLKNFRNPYE

SEQ ID NO: 21485 - protein, 547 aa, Hordeum vulgare
MEIARSVASLGCSKEHQRIYADWFALADPDGDGRVTGADATKFFAMSGLSRADLKQVWAIADSKRQGYLGFGEFAAAMQLVSLAQAGNEITQDSLKREDLSSFDPPVMKGLDELLARSMAIVNVVRPQENGTSQVQAPSTNSWFSSKSSKKIQTPLTAVTSVIDGLKRLYIEKLKPLEVAYRFNDFASPLLTNSDFDAKPMVMLLGQYSTGKTTFIKHLLKTNFPGAHIGPEPTTDRFVVVMSGSDERTVPGNTIAVQADMPFNGLTTFGGAFLSKFECSQMPHPLLDHITFVDTPGVLSGEKQRTQRSYDFTGVTSWFAAKCDVILLLFDPHKLDISDEFKRVISSLRGNEDKIRVVLNKADQVDTQQLMRVYGALMWSLGKVLNTPEVMRVYIGSFNDKPVNESAVGPIGKELFEKEQEDLLADLKDIPKKACDRRVNEFVKRARAAKIHAYIIGQLKKEMPAMIGKAKAQQRLIDNLQDEFAKVQREYHLPAGDFPDVEHFKQVLAGYSIDKFEKIKPKMVQAVDDMLAHDIPDLLKNFSNPYQ

SEQ ID NO: 21486 - protein, 545 aa, Vitis vinifera
MEIDSGPISSCSKQNQMIYQEWFNFADSDSDGRITGNDAIKFFAMSNLPRPDLKQVWAIADTKRQGFLGLKEFITAMQLVSLAQAGHAITQDLLHSEVDLGNLNPPQMEGLAALLAKKKRAHKTSDPDINGSSQPQPSPTASWFTSKSSKKVPLSSVTSIIDGLKRLYIQKLKPLEVTYRFNDFASPLLTNSDFDAKPMVMLLGQYSTGKTTFIKHLLKSSYPGAHIGPEPTTDRFVVVMSGPDERSIPGNTIAVQADMPYSGLTTFGTAFLSKFECSQMPHSLLEHITFVDTPGVLSGEKQRTQRAYDFTGVTSWFAAKCDLILLLFDPHKLDVSDEFKRVISSLHGHDDKIRVVLNKADQVDTQQLMRVYGALMWSLGKVLNTPEVMRVYIGSFNDKPVNEAAVGPIGKELFEKEQENLLSDLKDIPKKACDRRINEFVKRARAAKIHAYIISHLKKEMPTMMGKAKTQQRLIDNLEDEFAKVQREFHLPAGDFPNVDHFREVLSGYSIDKFERLKPKMIQTVDDMLGYDIPELLKSFRNPYD

SEQ ID NO: 21487 - protein, 547 aa, Secale cereale
MEIARSAAAVGCSKEHQRIYADWFAIADPDGDGRVTGADATKFFAMSGLSRADLKQVWAIADSKRQGYLGFGEFAAAMQLVSLAQAGNEITQDSLKREDLSSLDPPVMKGLDELLARSMAIVNVVRPQENGTSQVQAPSTNSWFSSKSAKKIQTPLTAVTSVIDGLKRLYIEKLKPLEVAYRFNDFASPLLTNSDFDAKPMVMLLGQYSTGKTTFIKHLLKSNFPGAHIGPEPTTDRFVVVMSGSDERTVPGNTIAVQADMPFNGLTTFGGAFLSKFECSQMPHPLLDHITFVDTPGVLSGEKQRTQRSYDFTGVTSWFAAKCDVILLLFDPHKLDISDEFKRVISSLRGNEDKIRVVLNKADQVDTQQLMRVYGALMWSLGKVLNTPEVMRVYIGSFNDKPVNESAVGPIGKELFEKEQEDLLADLKDIPKKACDRRVNEFVKRARAAKIHAYIIGQLKKEMPAMMGKAKAQQRLIDNLQDEFAKVQREYHLPAGDFPDVEHFKQVLAGYSIDKFEKIKPKMVQAVDDMLAHDIPDLLKNFSNPYQ

SEQ ID NO: 21488 - protein, 545 aa, Brachypodium distachyon
MEIAAAAVGCSKEHQKIYADWFALADPDGDGRVTGSDATKFFAMSGLSRSDLKQVWAIADSKRQGYLGFGEFAAAMQLVSLAQAGKEITQNSLKLEDLSSLDPPVMKGLDELLARSMAIVNVVRKEENYTPQVQAPFANNWFGSKSAKKMQTPLTAVTSVVDGLKRLYVEKLKPLEVAYRFNDFASPLLTNSDFDAKPMVMLLGQYSTGKTTFIKHLLKTSYPGAHVGPEPTTDRFVVVMSGPDERTVPGNTIAVQADMPFNGLTTFGGAFLSKFECSQMPHPLLEHITFVDTPGVLSGEKQRTQRSYDFTGVTSWFAAKCDLILLLFDPHKLDISDEFKRVISSLRGHDDKIRVVLNKADQVDTQQLMRVYGALMWSLGKVLNTPEVMRVYIGSFNDKPVNESAVGPIGKDLFEKEQEDLLADLKDIPKKACDRRVNEFVKRARAAKIHAYIIGHLKKEMPAVMGKAKAQQRLIDNLQDEFAKVQREYHLPAGDFPDAEHFKEVLGGYSIDKFEKMKPKMVQAVDDMLAYDIPELLKNLSNPYQ

SEQ ID NO: 21489 - protein, 544 aa, Lippia dulcis
MEIDSVPISRCSKEHQKIYQEWFSFADSDGDGRLTGGDATKFFSMSNLPRQDLKLVWAIADSKRQGFLGFKEFVTAMQLVSLAQTGNVLTSDVLNSTVDYENLQPPTMEDLDALLVKKKRSSIEPEQNGSPQVQSSPAAGWFTSTKSAKKVSLSSVTSIIDGLKKLYVQKLKPLESTYRFNDFVSPLLTNSDFDAKPMVMLLGQYSTGKTTFIKHLLRTSYPGAHIGPEPTTDRFVVVMNGPDERSIPGNTVAVQADMPFSGLTTFGTAFLSKFECSQMPHPLLEHITFVDTPGVLSGEKQRTQRSYDFTGVTSWFAAKCDLILLLFDPHKLDISDEFKRVIGSLRGHDDKIRVVLNKADQVDTQQLMRVYGALMWSLGKVLNTPEVMRVYIGSFNDKPINEAASGPIGKELFEKEQDDLLTDLKDIPKKACDRRINEFVKRARAAKIHAYIISHLKKEMPAMMGKAKTQQRLIDNLPDEFAKVQREHHLPAGDFPNVEHFREALSGYNLDKFEKLKPKMIQAVDDMLGYDIPDLLKNFRNPYD

SEQ ID NO: 21490 - protein, 542 aa, Papaver somniferum
MEIDSGPISTCSKEHQKIYQTWFNHADTDGDGRVTGNDATKFFALSNLSRPELKQVWAISDSKRLGFLGFKEFVTAMQLVSLAQAGHEITEGLLTAELDLESLNPPVMEGLDALLAKKRSPKKVEPDLSISPQPSISANWFTSKSTKKVPLSSVTSIIDGLKRLYIEKLKPLEVAYKFNDFVSPLLTNSDFDARPMVMLLGQYSTGKTTFIKHLLKSSYPGAHIGPEPTTDRFVVVMSGPDGRSIPGNTIAVQADMPFSGLTTFGTAFLSKFQCSQMPHPLLEHITFVDTPGVLSGEKQRTQRSYDFTGVTSWFAAKCDLILLLFDPHKLDISDEFKRVIGSLRGHDDKIRVVLNKADQVDTQQLMRVYGALMWSLGKVLNTPEVMRVYIGSFNDKPVNEAAIGPLGKELFEKEQEDLLADLKDIPKKACDRRINEFVKRARAAKIHAYIISHLRKEMPAMMGKAKAQQRLIDNLEDEFAKVQREFHLPAGDFPNVDHFREVLSGYSIDKFEKLKPKLIQTVDDMLGYDIPDLLKNFKNPYE

SEQ ID NO: 21491 - protein, 546 aa, Panax ginseng
MEISSAPISQCSKEHQKIYQEWFNSADSDSDERITGGDAIKFFSMSNLPRPDLKQVWAIADSKRQGFLGFKEFITAMQLVSLAQAGKAITTDLLNSEVDFENLNPPIMDGLDVLLAKQKCTPKTSETERNGTSPVQPSPAASWFSSSKSSKKLSLASVTSIVDGLKKLYIQKLKPLEVTYRFNDFVSPLLTNSDFDAKPMVMLLGQYSTGKTTFIKHLLRTSYPGAHIGPEPTTDRFVVVMNGPDERSIPGNTIAVQADMPYSGLTTFGTAFLSKFECSQMPHPLLEHITFVDTPGVLSGEKQRTQRSYDFTGVTSWFAAKCDLILLLFDPHKLDISDEFKRVISSLRGHDDKIRVVLNKADQVDTQQLMRVYGALMWSLGKVLNTPEVMRVYIGSFNDKPVNVAAAGPLGRELFEKEQEDLLTDLKDIPKKACDRRINEFVKRARAAKIHSYIISHLKREMPAMMGKAKAQQRLIDNLAEEFGKVQREHHLPAGDFPNVEHFREILNGYNIDKFEKFKPKMIQAVDDMLGYDIPDLLKNFRNPYD

SEQ ID NO: 21492 - protein, 546 aa, Panax ginseng
MDISSAPISQCSKEHQKIYQEWFNYADSDSDGRITGGDAIKFFSMSNLPRPDLKQVWAIADSKRQGFLGFKEFITAMQLVSLAQAGKAITNDLLNSEVDFENLNPPTMDGLDVLLAKQKRTPKTSETETNGTSPVQPSPAASWFSSSKSSKKLSLASVTSIVDGLKKLYIQKLKPLEVTYRFNDFVSPLLTNSDFDAKPMVMLLGQYSTGKTTFIKHLLRTSYPGAHIGPEPTTDRFVVVMNGPDERSIPGNTIAVQADMPYSGLTTFGTAFLSKFECSQMPHPLLEHITFVDTPGVLSGEKQRTQRSYDFTGVTSWFAAKCDLILLLFDPHKLDISDEFKRVISSLRGHDDKIRVVLNKADQVDTQQLMRVYGALMWSLGKVLNTPEVMRVYIGSFNDKPVNVAAAGPLGRELFEKEQEDLLTDLKDIPKKACDRRINEFVKRARAAKIHSYIISHLKREMPAMMGKAKAQQRLIDNLAEEFGKVQREHHLPAGDFPNVEHFREILNGYNIDKFEKFKPKMIQTVDDMLGYDIPDLLKNFRNPYD

SEQ ID NO: 21493 - protein, 544 aa, Chenopodium quinoa
MEISTGPISTCSKEHQKIYQQWFPVADSDGDGRITGNDATKFFAMSNLSRSDLKQVWALADTKRQGYLGFKEFVAAMQLISLAQAGKELTSDLLSNAAMEDIQLPIMEGLDALLAKKKKTTTTYVEPELNGSPQQSPPTSNWFSSKPSKKIPLSAVTSIVDGLKRLYIEKLKPLETTYRFHDFVSPPLTNSDFDAKPMVMLLGQYSTGKTTFIKHLLKCEYPGAHIGPEPTTDRFVVVMSGPDERSIPGNTIAVQADMPFSGLTNFGGAFLSKFQCSQMPHPLLEHITFVDTPGVLSGEKQRTQRSYDFTGVISWFAAKCDLILLLFDPHKLDISDEFKRVISSLRGHDDKIRVVLNKADQVDTQQLMRVYGALMWSLGKVLNTPEVSRVYIGSFNDKPIDSEAVGPMGKDLFEREQNDLLTDLKDIPKKACDRRINEFVKRARAAKIHAYIISHLKKEMPSMMGKAKTQQRLIDNLEDEFLKVQREFHLPAGDFPYVEHFREVLGGYSIDKFEKLKPKMIQAVDDMLGYDIPELLKNFRNPYE

SEQ ID NO: 21494 - protein, 544 aa, Manihot esculenta
MEISTGPICSCSKENQKIYLEWFNFADSDGDGRITGSDAIKFFGISNLSRQDLKQVWAIADSKRQGFLGFNEFVSAMQLVSLAQAGHEIRNDILNSNVDFGNLKPASMEGLDALIAKKRSSKLSDPDTNGSPPVQTSPSVNWFSSKSSKKVPLSSVTSIIDGLKRLYIQKLKPLEVTYRFNDFVSPLLTNSDFDAKPMVMLLGQYSTGKTTFIKHLLKSGYPGAHIGPEPTTDRFVVVMSGTDERSIPGNTVAVQADMPFNGLTTFGTAFLSKFECSQMPHPLLEHITFVDTPGVLSGEKQRTQRAYDFTGVTSWFAAKCDLILLLFDPHKLDVSDEFKRVISSLRGHDDKIRVVLNKADQVGTQQLMRVYGALMWSLGKVLNTPEVVRVYIGSFNDKPVNEAAVGPIGKELFEKEQDDLLADLKDIPKKACDRRINEFVKRARAAKIHAYIISHLKKEMPAMMGKAKAQQRLIDNLADEFGKVQREFHLPPGDFPNVEYFREVLSGYNIDKFEKLKPKMIQAVDDMLGYDIPELLKNFRNPYD

SEQ ID NO: 21495 - protein, 545 aa, Eucalyptus grandis
MEISPVPISTCSKENQQIYQEWFDYADSDGDGRITGSDATKFFAMSNLPRPDLKQVWAIADSKRQGFLGFGEFITAMQLVSLAQAGQSITQDLSSSEVDLVNLGPPKMTGLDSLLAKKRPSPRTNESDSNGSSHSQPSPASGWFSSKPSKKISLSSVTSIVDGLKRLYIQKLKPLEVTYRFNDFVSPLLTNSDFDAKPMVMLLGQYSTGKTTFIKHLLQSSYPGAHIGPEPTTDRFVVVMSGPDERSIPGNTVAVQADMPYSGLTTFGTAFLSKFECSQMPHPLLEHITFVDTPGVLSGEKQRTQRAYDFTGVTSWFAAKCDLILLLFDPHKLDVSDEFKRVISSLRGHDDKIRVVLNKADQVDTQQLMRVYGALMWSLGKVINTPEVMRVYIGSFNDKPVNEAATGPIGKELFEKEQEDLLSDLKDIPKKACDRRINEFVKRARAAKIHAYIISHLKKEMPAMMGKAKTQQRLIDNLEDEFAKVQREFHLPPGDFPNVEHFRERLSGYNLDKFEKLKPKMIQAVDDMLGYDIPDLLKHFRNPYD

SEQ ID NO: 21496 - protein, 545 aa, Ocimum basilicum
MEIDYAPISRCSKEHQKIYQEWFACADSDGDGRLTGGDAIKFFSMSSLPRQDLKQVWAIADTKRQGFLGFKEFITAMQLISLAQAGQTLTSDILSSQVDFESIQPPTMEGLDVLLTQKKKRLSSEPDQNGSSQVQSSPSASWFTSTKSAKKVSLSSVTSIIDGLKKLYVQKLKPLETTYRFNDFVSPFLSNSDFDAKPMVMLLGQYSTGKTTFIKHLLRTSYPGAHIGPEPTTDRFVVVMNGPDERSIPGNTVAVQADMPFSGLTTFGTAFLSKFECSQMPHPLLEHITFVDTPGVLSGEKQRTQRSYDFTGVTSWFAAKCDLILLLFDPHKLDISDEFKRVIGSLRGHDDKIRVVLNKADQVDTQQLMRVYGALMWSLGKVLNTPEVMRVYIGSFNDKPINEASVGPIGKELFEKEQEDLLSDLKDIPKKACDRRINEFVKRARAAKIHAYIISHLKKEMPAMMGKAKTQQRLIDNLPDEFAKVQREHHLPAGDFPHIEHFRETLSGYSIDKFEKLKPKLIQCVDDMLGYDIPELLKNFRNPYD

SEQ ID NO: 21497 - protein, 493 aa, Leymus cinereus x Leymus triticoides
DLKQVWAIADSKRLGYLGFSEFITAMQLVSLAQAGNEIAQDSLQRDDLISFNPPVMEGLDALLAKSKHLAKRVDQDMDGFPQAQGPSTNHWFNSKSSKKIPLTAVTSVIDGLKRLYIEKLKPLEVTYKFNDFVSPLLTNSDFDAKPMVMLLGQYSTGKTTFIKHLLKTSYPGAHIGPEPTTDRFVVVMSGPDERTIPGNTLAVQADMPFSGLTTFGTSFLSKFECSQMPHPLLEHITFVDTPGVLSGEKQRTQRSYEFTGVTSWFAAKCDLILLLFDPHKLDISDEFKRVIGSLRGHDDKIRVVLNKADQIDTQQLMRVYGALMWSLGKVLNTPEVSRVYIGSFNDKPVKESAVGPIGKELFEKEQDDLLSDLKDIPKKACDRRINEFVKRARAAKIHAYIIGHLKNQMPTMMGKAKAQHKLIDNLEDEFAKVQRDHHLPAGDFPYVEHFRDAFGGYSIDKFEKVKPKMIQAVDDMLGYDIPELLKNFRNPYE

SEQ ID NO: 21498 - protein, 544 aa, Phalaenopsis aphrodite
MDILAPVISSCSREHQKIYQEWFAFADSDGDGRITGNDAIRLFGMSKLSRAELKQVWAIADSKRQGFLGFSEFITAMQLISLAQAGNEITPDMLNNIDLRSLKPPDMDGLDVLIAKNRPSPRKSSPDLDVAPATQVSLSTQWFNSKSTKKIPLSSVTSIIDGLKRLYIEKLKPLEVTYHFNEFVSPSLTNSDFDAKPMVMLLGQYSTGKTTFIKHLLGTTYPGAHIGPEPTTDRFVVVMAGPDERSIPGNTIAVQADMPFSGLTTYGTAFLSKFQCSQMPHPLLEQITFVDTPGVLSGEKQRTQRSYDFTGVTSWFAAKCDLILLLFDPHKLDISDEFKRVISSLRGHDDKVRVVLNKADQIDTQQLMRVYGALMWSLGKVLNTPEVMRVYIGSFNDKPVNEAAVGPIGKDLFEREQDDLLSDLKDVPKKACDRKINEFVKRARAAKIHAYIISHLKKEMPSMMGKAKTQQRLCDNLEDEFMKVQREHHLPAGDFPSVEHYRGMLGGYNIDKFERLKSKMIQSVDDMLGYDIPELLKNFRNPYE

SEQ ID NO: 21499 - protein, 497 aa, Secale cereale
LPRADLKQVWAIADSKRLGYLGFGEFITAMQLVSLAQAGNEISQDSLQREDLISFNPPVMEGLDAQLAKSKHLAKRADQDMDGFPQAQGPSTNHWFNSKSSKKIPLTAVTSVIDGLKRLYIEKLKPLEVTYKFNDFVSPLLTNSDFDAKPMVMLLGQYSTGKTTFIKHLLKTSYPGAHIGPEPTTDRFVVVMSGPDERTIPGNTLAVQADMPFSGLTTFGTSFLSKFECSQMPHPLLEHITFVDTPGVLSGEKQRTQRSYEFTGVTSWFAAKCDLILLLFDPHKLDISDEFKRVIGSLRGHDDKIRVVLNKADQIDTQQLMRVYGALMWSLGKVLNTPEVSRVYIGSFNDKPVKESAVGPIGKELFEKEQDDLLSDLKDIPKKACDRRINEFVKRARAAKIHAYLIGHLKNQMPTMMGKAKAQQKLIDNLEGEFAKVQREHHLPAGDFPYVDHFREALGGYSIDKFEKVKPKMIQAVDDMLGYDIPELLKNFRNPYE

SEQ ID NO: 21500 - protein, 544 aa, Ananas comosus
MDLVSSPKSSCSRELQQTYQQWFSVADSDGDGRITGKDALKFFAMSKLSRPELKQVWAIADSKRQGFLGFQEFIGAMQLVSLAQEGHEINQDILSNADLESLKPPAMEGLDILLAKKKRSEKKSDPNLDAPRQPEAPPSARWFSSKSSKKIPLKSVTSIVDGLKKLYIEKLKPLEVTYQFNDFVSPLLTNSDFDARPMVMLLGQYSTGKTTFIKHLLKSTYPGAHIGPEPTTDRFVVITSGPDERSIPGNTIAVQADMPYGGLTAFGSAFLSKFECSQMPHPLLEHITFVDTPGVLSGEKQRTQRSYDFTGVTSWFAAKCDLVLLLFDPHKLDISDEFKRVIGSLRGHDDKIRVVLNKADQVDTQQLMRVYGALLWSLGKVLNTPEVMRVYIGSFNDKPVNEAAIGPIGKELFEREQEDLLSDLKDIPKKACDRRINEFVKRARAAKIHAYIISHLKKEMPAMMGKAKTQQRLIDNLEDEFAKVQKEFHLPPGDFPNVEQFREVLSGYNIDKFEKLKPKMVQAVDDMLAFDIPELLRKFRNPYE

SEQ ID NO: 21501 - protein, 543 aa, Aquilegia formosa
MEIVSGPISSCSKENQKIYQEWFNYADSDGDGRITGNDAIKFFAISNLSRPELKQVWAIADSKRQGFLGFKEFIAAMQLISLAQDGHEITEGLLNSTVDLEDVKPPAMENLDALLAKKRSPKKESEFKVTSPPKSSVSAQWFTTKSVKKVSLSSVTSIVDGLKRLYLEKLKPLEMAYRFNDFVSPTLTNSDFDSKPMVMLLGQYSTGKTTFIKHLLRSSYPGAHIGPEPTTDRFVVVMSGPDERSIPGNTIAVQADMPFSGLTTFGTAFLSKFQCSQMPHPLLEHITFVDTPGVLSGEKQRTQRSYDFTGVTSWFAAKCDLILLLFDPHKLDISDEFKRVIGSLRGHDDKIRVVLNKADQVDTQQLMRVYGALMWSLGKVLNTPEVMRVYIGSFNDKPVNEALIGPIGKELFEKEQDDLLSDLKDIPKKACDRRINEFVKRARAAKIHAYIMSHLKKEMPAMMGKAKAQQRLIDNLEDEFAKVQREHHLPIGDFPNVEHFREVLSGYSIDKFEKLKPKMVQAVDDMLGYDIPELLKNFKNPYE

SEQ ID NO: 21502 - protein, 547 aa, Theobroma cacao
MEIGAGRIGSCSKEHQQIYQEWFSFVDSDNDGRITGTDAIKFFGMSNLSRQDLKQVWAIADSKRQGYLGFKEFVFAMQLVSLAQDGHEISHDLLNGDVDFENAKPPVMEGLDALIMKKKHSSKSTSPASNANGSSPMQSSPAAQWFSSKSSKKISMSSVTSIIDGLKRLYIQKLKPLEVTYRFNDFVSPLLTNSDFDAKPMVMLLGQYSTGKTTFIKHLLKSSYPGAHIGPEPTTDRFVVVMSGTDERSVPGNTIAVQADMPFSGLTTFGTAFLSKFECSQMPHPLLEHITFVDTPGVLSGEKQRTQRAYDFTGVTSWFAAKCDLILLLFDPHKLDVSDEFKRVIYSLRGHDDKIRVVLNKADQVDTQQLMRVYGALMWSLGKVLNTPEVVRVYIGSFNDKPVNEAATGPIGKELFEKEQEDLLADLKDIPKKACDRRINEFVKRARAAKIHAHIIGHLRKEMPTMMGKAKTQQRLIDNLADEFGKVQRDHHLPPGDFPNVEHFREVLSGYNFDKFEKLKPKMIQAVDDMLGYDIPELLKTFRNPYD

SEQ ID NO: 21503 - protein, 545 aa, Nicotiana benthamiana
MEFDTSPINRCSKEHEKIYQEWFNFADSDGDGRLTGRDATKFFAMSNLPRPELKQVWAIADSKRQGFLSFREFVIAMQLVSLAQAGHAVTNDLLNADVDFENLLPPAMDGLDVFLAKKKPMPKNEPEQNGSAPVPSAPATSWFSSSKSAKKVSLTSVTSIVDGLKKLYIQKLKPLEVAYHFNDFVSPLLANSDFDAKPMVMLLGQYSTGKTTFIKHLLKTSYPGAHIGPEPTTDRFVVVMNGPDERSIPGNTIAVQADMPFSGLTTFGTAFLSKFECSQMPHPLLEHITLVDTPGVLSGEKQRTQRSYDFTGVTSWFAAKCDLILLLFDPHKLDISDEFKRVIASLRGHDDKIRVVLNKADQVDTQQLMRVYGALMWSLGKVLNTPEVARVYIGSFNDKPMNEAATGPLGKELFEKEQDDLLTDLKNIPKKACDRRINEFVKRARAAKIHAYIIGHLRKEMPAMIGKAKTQQRLIDELENEFGKVQREFHLPAGDFPNVEHFREGLGGYSFDRFEKLKPKMIQDVDDMLGYDIPELLKNFRNPYD

SEQ ID NO: 21504 - protein, 543 aa, Spinacia oleracea
EISTGPISSCSKEHQKIYQQWFPVADSDGDGRITGNDATKFFSMSNLSRSDLKQVWAFADTKRQGYLGFKEFVAAMQLISLAQAGNELTSDLLSNAVMEDIQLPVMEGLDVLLAKKKKTMATYVEPEINGSPQQSPPTSSWFSSKSSKKIPLSAVTSIVDGLKRLYLEKLKPLETTYRFHDFVSPALANSDFDAKPMVMLLGQYSTGKTTFIKHLLKCEYPGAHIGPEPTTDRFVVVMSGPDERSIPGNTIAVQADMPFSGLTNFGGAFLSKFQCSQMPHPLLEHITFVDTPGVLSGEKQRTQRSYDFTGVISWFAAKCDLILLLFDPHKLDISDEFKRVISSLRGHDDKIRVVLNKSDQVDTQQLMRVYGALMWSLGKVLNTPEVSRVYIGSFNDKPIDTEVIGPMGRDLFEKEQNDLLNDLKDIPKKACDRRINEFVKRARAAKIHAYIISHLKKEMPSMMGKSKAQQRLIDNLEDEFLKVQREFHLPAGDFPYVEHFREVLGGYSIDKFEKLKPKMIQAVDDMLGYDIPELLKNFRNPYE

SEQ ID NO: 21505 - protein, 544 aa, Mimulus guttatus
MEIDSAPISRCSKEHQKIYQDWFSFADSDGDGRLTGADATKFFSLSNLPRQDLKLVWAIADSKRQGFLGFKEFITAMQLVSLAQAGHALTSDILSSEVDFENLQTPALDGLGALLTKKKRLSNEPEQNGSPQVQSSLAASWFSSSKSAKKISLSSVTSIVDGLKRLYIQKLKPLETTYQFNDFVSPSLTNSDFDAKPMVMLLGQYSTGKTTFIKHLLRTSYPGAHIGPEPTTDRFVVVMNGPDERSVPGNTIAVQADMPFSGLTTFGSAFLSKFECSQMPHPLLEHITFVDTPGVLSGEKQRTQRSYDFTGVTSWFASKCDLILLLFDPHKLDISDEFKRVIGSLRGHDDKIRVVLNKADQVDTQQLMRVYGALMWSLGKVLNTPEVNRVYIGSFNDKPINEAAAGPLGRELFEKEQDDLLSDLKDIPKKACDRRINEFVKRARAAKIHAYIISHLKKEMPAMMGKAKAQQKLIDNLPDEFAKVQREHHLPAGDFPNVEHFREVLSGYSLDRFEKLKPKMIQSVDDMLGYDIPDLLKNFRNPYD

SEQ ID NO: 21506 - protein, 547 aa, Citrullus lanatus
MEIASYPIGSCSREHQKIYQEWFDYADSDGDGRITGNDAIKFFSMSTLPRQDLKQVWAIADSKRQGYLGFKEFITAMQLVSLAQSGGEVTHDVLTSNSEVDLKSLNPPRMEGLDVILAKKARKQKSNDHETNGSSKGQSPVSASWFSSKSSKKIPLSSVTSIVDGLKRLYIQKLKPLEVSYRFNDFVSPLLTNSDFDAKPMVMLLGQYSTGKTTFIKHLLKSSYPGAHIGPEPTTDRFVVVMSGPDERSIPGNTIAVQADMPFNGLTTFGTSFLSKFECSQMPHPLLEHITFVDTPGVLSGEKQRTQRAYEFTSVTSWFAAKCDLILLLFDPHKLDISDEFKRVIASLRGHDDKIRVVLNKADQVDTQQLMRVYGALMWSLGKVLNTPEVVRVYIGSFNDKPVNEAATGPLGKELFEKEQEDLLSDLKDIPKKACDRRINEFVKRARAAKIHAYIISHLRKEMPAMIGKAKTQQRLIDNLEDEFGKVQREHHLPAGDFPNVDQFREILGGYNFDKFEKLKPKMIQSVDDMLGYDVPELLKNFRNPYD

SEQ ID NO: 21507 - protein, 550 aa, Ricinus communis
MEISAGPVGSCSKENQKIYLEWFAFADSDGDGRITGNDAIKFFGMSNLSRQDLKQVWAIADSKRQGYLGFNEFITSMQLISLAQAGHQIAHDLLSSQVDFENLRPPTMEGLDELLEQKKRRRSRSRDFDVNGTPPVETSPSVNWFSPKSSSKSSKKVPLSSVTSIIDGLKRLYIQKLKPLEVTYRFNDFVSPLLTNSDFDAKPMVMLLGQYSTGKTTFIKHLLKSSYPGAHIGPEPTTDRFVVVMSGTDERSIPGNTVAVQADMPFNGLTTFGTAFLSKFECSQMPHPLLEHITFVDTPGVLSGEKQRTQRSYDFTGVTSWFAAKCDLILLLFDPHKLDVSDEFKRVISSLRGHDDKIRVVLNKADQVDTQQLMRVYGALMWSLGKVLNTPEVVRVYIGSFNDKPINEDAIGPIGKELFEKEQEDLLSDLKDIPKKACDRRINEFVKRARAAKIHAYIISHLKKAMPTMVGKAKAQQRLIDNLGEEFGKVQREFHLPPGDFPNVEQFREVLSGYSIDKFEKLKPKMIQAVDDMLGYDIPELLKNFRNPYG

SEQ ID NO: 21508 - protein, 530 aa, Allium cepa
KEHQKIYQQWFSVADADGDGRVTGTDAIKFFSMSNLSRPELKQVWALADSKRQGFLGLGEFVIAMQLISYIQAGNEITQDALTSTELKNMEPPVMEGLDALIARTKALAKKHSPEKEAVPPVNTSLQWFTSKPTKKIPMSSVTSIIDGLKRLYIEKLKPLEVTYRFNDFVSPLLTSSDFDAKPMVMLLGQYSTGKTTFIKHLLKSSYPGAHIGPEPTTDRFVVVMSGPDERNIPGNTIAVQADMPYSGLTTFGTAFLSKFECSQMPHPLLEHITFVDTPGVLSGEKQRTQRSYDFTGVTSWFAAKCDLILLLFDPHKLDISDEFKRVIGSLRGHDDKIRVVLNKADQIDTQQLMRVYGALMWSLGKVLNTPEVMRVYIGSFNDKPVNGNMVGPIGKDLFEKEQDDLLSDLKDIPKKACDRRINEFVKRARAAKIHAYIISQLKKEMPAMMGKAKAQQRLIDNLEDEFAKVQREYHLPAGDFPNVERFREVLGGYSIDKFEKLKPKLVQAVDDMLGYDIPELLKNFRNPYE

SEQ ID NO: 21509 - protein, 545 aa, Vitis vinifera
MEIASVPISSCSKHNQKIYQEWFNYADSDNDGRITGNDATKFFAMSNLSRSELKQVWAIADSKRQGFLGFREFITAMQLVSLAQAGNEITSDILKTTVDLENLEPPSMEGLNALLAKNKASTNNGELELNGDSRPQPSPSAPWFTSKSVKKAPLNSVTSIIDGLKRLYNEKLKPLEVTYRYNDFVSPLLTHSDFDAKPMVMLLGQYSTGKTTFIKHLLGCNFPGAHIGPEPTTDRFVVVMSGPDERSIPGNTIAVNAEMPFNGLTTFGGAFLSKFECSQIPHSLLEHITFVDTPGVLSGEKQRTQRSYDFTGVISWFAAKCDLILLLFDPHKLDISDEFKRVIASLRGNDDKIRVVLNKADQVDTQQLMRVYGALMWSLGKVLNTPEVVRVYIGSFNDKPVNEAAVGPIGKDLFEKEQDDLLADLIDIPKKACDRRINEFVKRARAAKIHAYIISHLKKEMPAMMGKAKAQQRLTDNLEDEFAKIHREFHLPAGDFPNVEHFREVLNGYSIDKFEKLKPKMIQAVDDMLGYDIPELLKNFRNPYE

SEQ ID NO: 21510 - protein, 545 aa, Solanum lycopersicum
MEFDTSPINRCSKEHEKIYQQWFNFADSDGDGRLTGGDAIKFFAMSNLPRPELKQVWAIADSKRQGFLNFRDFVVGMQLVALAQAGHAVTSDLLNADVDFENLPPPAMEGLDVLLAKKKLMPKSEQDQNGSAPVPAAPTTSWFSSSKSSKKISLTSVTSIVDGLKKLYIQKLKPLEVAYHFNDFVSPLLTNSDFDAKPMVMLLGQYSTGKTTFIKHLLKMSYPGAHIGPEPTTDRFVVVMNGPDERSIPGNTIAVQADMPFSGLTTFGTAFLSKFECSQMAHPLLEHFTLVDTPGVLSGEKQRTQRSYDFTGVTSWFAAKCDLILLLFDPHKLDISDEFKRVIASLRGHDDKIRVVLNKADQIDTQQLMRVYGALMWSLGKVLNTPEVARVYIGSFNDKPMREAAAGPLGKELFEKEQDDLLTDLKDIPKKACDRRINEFVKRARAAKIHAYIISHLRKEMPAMIGKAKTQQRLIDELENEFGKVQREFHLPAGDFPNVEHFREVLGGYSFDRFEKLKPKMIQDVDDMLGYDIPELLKNFRNPYD

SEQ ID NO: 21511 - protein, 543 aa, Triphysaria pusilla
MEIDSAPISRCSKEHQKIYQKWFSYFDSDGDGRLTGADATKFFSMSNLSRQDLKQVWAIADSKRQGYLGLKEFITAMQIVSLAQSGHGITSDLLASEDVDFENLQPPTMEGLDVLLAKKKRSSGEHNGTLQTQTSASAGWFTSTKSAKKVPLNSVTSIIDGLKKLYVQKLKPLEVTYRFNDFVSPVLGNSDFDAKPMVMLLGQYSTGKTTFIKHLLRSSYPGAHIGPEPTTDRFVVVMNGPDERSIPGNTIAVQADMPYSGLTTFGSAFLSKFECSQMPHPLLEHITFVDTPGVLSGEKQRTQRSYDFTGVTSWFAAKCDLILLLFDPHKLDISDEFKRVIGSLRGHDDKIRVVLNKADQVDTQQLMRVYGALMWSLGKVLNTPEVNRVYIGSFNDKPINEAAAGPLGKELFEKEQDDLLTDLKDIPKKACDRRINEFVKRARAAKIHAYIISHLKKEMPAMMGKAKTQQRLIDNLADEFAKVQREYHLPAGDFPNPEQFKEVLSGYNIDKFEKLKPKMIQNVDDMLGYDIPDLLKNFRNPYD

SEQ ID NO: 21512 - protein, 544 aa, Castanea mollissima
MEIASIPITTCSKEHQQIYQEWFNYADADTDGRITGNDATKFFAMSNLSRQDLKQVWAIADSKRQGYLGFKEFIAAMQLVSLAQAGHAVTQDFLNSDVDLSSLKPPVMEGLDALIAKKKRKEKTSEHESNGSSHGPSPSANWFSSKSAKNVPLSSVTSIVDGLKRLYLQKLKPLEVTYRFNDFVSPLLANSDFDAKPMVMLLGQYSTGKTTFIKHLLKSGYPGAHIGPEPTTDRFVVVMSGPDERSIPGNTIAVQADMPFSGLTTFGTAFLSKFECSQMPHPLLEHITFVDTPGVLSGEKQRTQRAYDFTGVTSWFAAKCDLILLLFDPHKLDVSDEFKRVISSLRGHDDKIRVVLNKADQIDTQQLMRVYGALMWSLGKVINTPEVMRVYIGSFNDKPVNESATGPIGKELFEKEQEDLLSDLKDIPKKACDRRINEFVKRARAAKIHAYIISHLKKEMPAMIGKAKTQQRLIDNLLDEFGKVQREFHLPPGDFPNVDHFKEILSGYNIDKFEKLKPKMIQAVDDMLGYDIPDLLKNFRNPYD

SEQ ID NO: 21513 - protein, 543 aa, Cicer arietinum
MEFDPVPIGSCSKEHQNIYQNWFSYADSDGDGRITGNDATKFFSMSNLSRQDLKQVWAIADSKRQGYLGFQEFIIAMQLVSLAQSGHPITHDLLSSDVDLKDLKPPTLEGLDVLLAKNKHKQKDVDVNGSSQLQPSLSSSWFSSKSTKKVPLSSVTSIIDGLKRLYIQKLKPLEVTYRFNDFVSPLLTNSDFDAKPMVMLLGQYSTGKTTFIKHLLKCSYPGAHIGPEPTTDRFVVVMSGSDARSIPGNTVAVQADMPFSGLTTFGTAFLSKFECSQMPHPLLEHITFVDSPGVLSGEKQRTQRAYDFTGVTSWFAAKCDLILLLFDPHKLDISDEFNRVISSLRGHDDKIRVVLNKADQVDTQQLMRVYGALMWSLGKVLNTPEVIRVYIGSFNDKPVNNAVSGPIGKELFEKEQEDLLSDLKDIPKAACDRRINEFVKRARAAKIHAYIISHLKKEMPAMMGKAKAQQKLIDNLAGEFGKVQREFHLPPGDFPNVEHFRESLRGYNIDKFEKLKPKMIQVVDDMLAYDIPNLLKNFKNPYD

SEQ ID NO: 21514 - protein, 543 aa, Medicago truncatula
MEFDPIPIGSCSKDHQNIYQQWFNHADSDGDGRITGNDATKFFAMSNLSRQHLKQVWAIADSKRQGYLGFQEFIIAMQLVSLAQSGHPITHDLLNSDVDLKNLKPPILEGLDALLAKKKHKQSELDVNGSSQLQPSPSSSWFSSKSTKKVPLSSVTSIIDGLKRLYIQKLKPLEVTYRFNDFVSPLLTNSDFDAKPMVMLLGQYSTGKTTFIKHLLKCSYPGAHIGPEPTTDRFVVVMSGPDERSIPGNTVAVQADMPFSGLTTFGTAFLSKFECSQMPHPLLEHITFVDSPGVLSGEKQRTQRAYDFTGVTSWFAAKCDLILLLFDPHKLDISDEFNRVISSLRGHDDKIRVVLNKADQVDTQQLMRVYGALMWSLGKVLNTPEVTRVYIGSFNDKPVNDAVSGPIGKELFEKEQEDLLSDLKDIPKAACDRRINEFVKRARAAKIHAYIISHLKKEMPAMMGKAKAQQKLIDNLAGEFGKVQREFHLPPGDFPNVEHFRESLSGYNIDKFEKLKPKMLQVVDDMLAYDIPNLLKNFKNPYD

SEQ ID NO: 21515 - protein, 544 aa, Quercus alba
MEIASIPITTCSKEHQQIYQEWFNYADADTDGRITGNDATKFFAMSNLSRQDLKQVWAIADSKRQGYLGFKEFIAAMQLVSLAQAGHAVTHDLLNSDVDLSSLKPPVMEGLDALIAKKKRKEKTSELESNGSLHGPSPSANWFSSKSAKNVPLSSVTSIVDGLKRLYLQKLKPLEVTYRFNDFVSPLLANSDFDAKPMVMLLGQYSTGKTTFIKHLLKSGYPGAHIGPEPTTDRFVVVMSGPDERSIPGNTIAVQADMPFSGLTTFGTAFLSKFECSQMPHPLLEHITFVDTPGVLSGEKQRTQRAYDFTGVTSWFAAKCDLILLLFDPHKLDVSDEFKRVISSLRGHDDKIRVVLNKADQIDTQQLMRVYGALMWSLGKVINTPEVMRVYIGSFNDKPVNESATGPIGKELFEKEQEDLLSDLKDIPKKACDRRINEFVKRARAAKIHAYIISHLKKEMPAMIGKAKTQQRLIDNLLDEFGKVQREFHLPPGDFPNVEHFKEILSGYNIDKFEKLKPKMIQAVDDMLGYDIPDLLKNFRNPYD

SEQ ID NO: 21516 - protein, 545 aa, Arabidopsis lyrata
MEIESVAAGSCSKENQLIYKEWFEFADSDGDGRITGNDAIKFFTMSNLPRPELKQIWAIADSKRQGYLAFKDFIVAMQLVSLAQTGHEISHEILNSDVDFKNINPPTMEGLGVLMAKKKHSSKSSDPNMNGSPAADTSLTAHWFSSKSSKKISLSSVTSIVDGLKRLYIQKLKPLEVAYRFNDFVSPLLTNSDFDAKPMVMLLGQYSTGKTTFIKHLLKSSYPGAHIGPEPTTDRFVVVMSGPDERSIPGNTVAVQADMPFSGLTTFGTAFLSKFECSQMPHPLLEHVTFVDTPGVLSGEKQRTQRAYDFTGVTSWFASKCDLILLLFDPHKLDVSDEFKRVISSLRGHDDKIRVVLNKADQVDTQQLMRVYGALMWSLGKVLNTPEVSRVYIGSFSDKPINEAATGPIGRELFEKEQDDLLADLKDIPKKACDRRINEFVKRARAAKIHAYIISHLKKEMPAIMGKAKAQQKLIDNLEDEFGKVQREHHLPKGDFPNVDHFREVLSGYNIDKFEKLKPKMLQTVDDMLGYDIPELLKNFRNPYD

SEQ ID NO: 21517 - protein, 545 aa, Gossypium raimondii
MEIGSGRIGSCSKEHQKIYQEWFNFADSDNDGRITGNDAIKFFGISNLSRPDLKQVWATADSKRQGFLGFKEFVFAMQLVSLAQEGHQISHDLLNGDVDFENIKPPVMEGLDALIMRKKQSSKSSSLESNGSSSNQTSPASQWFSSKSSKKISLSSVTSIIDGLKRLYLQKLKPLEVTYHFNDFVSPLLTNSDFDAKPMVMLLGQYSTGKTTFIKHLLKTSYPGAHIGPEPTTDRFVVVMSGTDERSVPGNTIAVQADMPFSGLTTFGTAFLSKFECSQMPHPLLEHVTFVDTPGVLSGEKQRTQRAYDFTGVTSWFAAKCDLILLLFDPHKLDVSDEFKRVIYSLRGHDDKIRVVLNKADQVDTQQLMRVYGALMWSLGKVLNTPEVVRVYIGSFNDKPVNEAATGPIGKELFEKEQEDLLSDLKDIPKKACDRRINEFVKRARAAKIHAYIIAHLKKEMPSMIGKAKTQQRLIDNLEGEFGKVQRDHHLPPGDFPNVEHFKEILSGYNFDKFEKLKPKMIQAVDDMLGYDIPELLKTFRNPYD

SEQ ID NO: 21518 - protein, 543 aa, Lupinus angustifolius
MEFDSFPIGTCSKDNQQIYQEWFNYADSDSDGRITGNDATKFFSMSNLSRQDLKQVWAIADSKRQGYLGFTEFIIAMQLVSLAQSGHPVTHDLLTSDVDLTNLKPPTMEGLDVLLSKRKHKQKDLDVNGSSQLQPSPSSNWFSSKSTKTLPLSSVTSIIDGLKRLYVQKLKPLEVTYRFNDFVSPLLTNSDFDAKPMVMLLGQYSTGKTTFIKHLLKSGYPGAHIGPEPTTDRFVVVMSGPDERSIPGNTIAVQADMPFSGLTTFGTAFLSKFECSQMPHPLLEHITFVDTPGVLSGEKQRTQRAYAFTDVTSWFAAKCDLILLLFDPHKLDVSDEFKRVISSLRGHDDKIRVVLNKADKVDTQQLMRVYGALMWSLGKVLNTPEVMRVYIGSFNDKPINDVLSGPIGKELFEKEQDDLLSDLKDIPKKACDRRINEFVKRARAAKIHAYIISHLKKEMPAMIGKAKAQQKLIDNLEGEFGKVQREFHLPPGDFPDVEHFRETLNGYNIDKFEKLKPKMIQTVDDMLGYDIPNLLKNFRNPYD

SEQ ID NO: 21519 - protein, 545 aa, Populus trichocarpa
MEISSGAIGSCSKDQKTMYQEWFHYADSDGDGRITGNDATKFFSLSKLSRQDLKPVWAIADSKRQGYLGFIEFIIAMQLVSLAQSGREITNDILNSDVDFQSLKPPSMEGLDALMAKKRRSLKSNDNEANGTPTVQSTPSANWFSSKPSRKASLSSVTSIIDGLKRLYIQKLKPLEVTYRFNDFVSPALTNSDFDAKPMVMLLGQYSTGKTTFIKHLLRSSYPGAHIGPEPTTDRFVVVMSGTDERSVPGNTIAVQADMPFSGLTTFGTAFLSKFECSQMPHPLLEHITFVDTPGVLSGEKQRTQRAYDFTGVTSWFAAKCDLILLLFDPHKLDVSDEFKRVISSLHGHDDKIRVVLNKADQVDTQQLMRVYGALMWSLGKVLNTPEVMRVYIGSFNDKPVNEAAVGPIGKELFEKEQEDLLSDLKNIPKKACDRRINEFVKRARAAKIHAYIISHLKKEMPAMMGKAKAQQRLLDNLAEEFGKVQREFHLPPGDFPNVEQFREVLSGYNFDKFEKLKPKMIQAVDDMLGYDIPDLLKNFRNPYD

SEQ ID NO: 21520 - protein, 545 aa, Solanum phureja
MEFDTNPINRCSKEHEKIYQQWFNFADSDGDGRLTGGDATKFFAMSSLPRPELKQVWAIADSKRQGFLSFRDFVVGMQLVALAQAGHAVTSDLLNADVDFENLPPPAMEGLDVLLAKKKLMPKSEQDQNGSAPVPAAPTTSWFSSSKSSKKISLTSVTSIVDGLKKLYIQKLKPLEVAYHFNDFVSPLLTNSDFDAKPMVMLLGQYSTGKTTFIKHLLKMSYPGAHIGPEPTTDRFVVVMNGPDERSIPGNTIAVQADMPFSGLTTFGTAFLSKFECSQMAHPLLEHFTLVDTPGVLSGEKQRTQRSYDFTGVTSWFAAKCDLILLLFDPHKLDISDEFKRVIASLRGHDDKIRVVLNKADQVDTQQLMRVYGALMWSLGKVLNTPEVARVYIGSFNDKPMREAAAGPLGKELFEKEQDDLLTDLKNIPKKACDRRINEFVKRARAAKIHAYIISHLRKEMPAMIGKAKTQQRLIDELENEFGKVQREFHLPAGDFPNVEHFREVLGGYSFDRFEKLKPKMIQDVDDMLGYDIPELLKNFRNPYD

SEQ ID NO: 21521 - protein, 545 aa, Fragaria vesca
MEISSVPISSCSKEHQKIYREWFQFADSDSDGRITGSDAIKFFSMSNLSRQDLKQVWAITDSKRQGFLGFTEFVAAMQLVSLAQAGNEITNDLLTRNADLENLKPPVMEGLDVLLAKKKRSNKTNENEVNGNPVVQQSPSALWFSSKSSKKVPLSAVTSIVDGLKRLYVQKLKPLEVTYKFNDFVSPLLTNSDFDAKPMVMLLGQYSTGKTTFIKHLLKTSYPGAHIGPEPTTDRFVVVMSGSDERSVPGNTIAVQADMPFSGLTSFGTAFLSKFECSQMPHPLLEHITFVDTPGVLSGEKQRTQRAYNFTGVTSWFASKCDLILLLFDPHKLDVSDEFKRVISSLRGHDDKIRVVLNKADQIDTQQLMRVYGALMWSLGKVLNTPEVMRVYIGSFNDKPVNEAASGPIGKELFEREQEDLLADLKDIPKKSCDRRINEFVKRARAAKIHAYIISHLRKEMPALIGKAKTQQKLTDNLEDEFKKVQREFHLPPGDFPNVEQFRETLSGYSFDNFEKLKPSMIKAVDDMLGYDIPELLKNFRNPYD

SEQ ID NO: 21522 - protein, 545 aa, Eutrema halophilum
MEIDSIAAGSCSKENQMIYKEWFEFADSDGDGRITGNDAIKFFSMSNLPRPELKQVWAIADAKRQGYLGFKEFIVAMQLVSLAQTGHEISHEVLHSDVDFKNMNPPIMEGLGVLMAKKKHSSKSSDPSVNGSPAADTSLTAHWFSSKSSKKISLSSVTSIVDGLKRLYIQKLKPLEVAYRFNDFVSPLLTNSDFDAKPMVMLLGQYSTGKTTFIKHLLKANYPGAHIGPEPTTDRFVVVMSGPDERSIPGNTVAVQADMPFSGLTTFGTAFLSKFECSQMPHPLLEHVTFVDTPGVLSGEKQRTQRAYEFTGVTSWFASKCDLILLLFDPHKLDVSDEFKRVISSLRGHDDKIRVVLNKADQVDTQQLMRVYGALMWSLGKVLNTPEVVRVYIGSFSDKPINEAATGPIGRELFEMEQDDLLSDLKDIPKKACDRRINEFVKRARAAKIHAYIISHLKKEMPAIMGKAKAQQKLIDNLEDVFGKVQREHHLPKGDFPNVEHFREVLIGYNIDKFEKLKPKMLQTVDDMLGYDIPELLKNFRNPYD

SEQ ID NO: 21523 - protein, 545 aa, Arabidopsis thaliana
MEIESVAAGSCSKENQMIYKEWFEFSDSDGDGRITGNDAIKFFTMSNLPRPELKQIWAIADSKRQGYLGFKEFIVAMQLVSLAQTGHEISHEVLISDVDFKNINPPTMEGLGVLMAKKKHSSKSSDPNMNGSPAADTSLTAHWFSSKSSKKISLSSVTSIVDGLKRLYIQKLKPLEVAYRFNDFVSPLLTNSDFDAKPMVMLLGQYSTGKTTFIKHLLKSTYPGAHIGPEPTTDRFVVVMSGPDERSIPGNTVAVQADMPFSGLTTFGTAFLSKFECSQMPHPLLEHVTFVDTPGVLSGEKQRTQRAYDFTGVTSWFASKCDLILLLFDPHKLDVSDEFKRVISSLRGHDDKIRVVLNKADQVDTQQLMRVYGALMWSLGKVLNTPEVSRVYIGSFSDKPINEAATGPIGRELFEKEQDDLLADLKDIPKKACDRRINEFVKRARAAKIHAYIISHLKKEMPAIMGKAKAQQKLIDNLEDEFGKVQREHHLPKGDFPNVDHFREVLSGYNIDKFEKLKPKMLQTVDDMLGYDIPELLKNFKNPYD

SEQ ID NO: 21524 - protein, 545 aa, Daucus carota
MEINSSSISRCSKHHQNIYQDWFNFADSDSDGRLTGADAIKFFSMSNLPRPDLKQVWAIADSKRQGFLGFNEFVTAMQLVSLAQSGQPLTSDLLNSEVDFENLNLPTMDGLDILLAKQKRASKTNEDELNGSPVQPSTSANWFSSSKSSKKLSLASVTSIIDGLKKLYIQKVRPLEVTYRFNDFVSPLLTNSDFDAKPMVMLLGQYSTGKTTFIKHLLKSSYPGAHIGPEPTTDRFVVVMNGPDERSIPGNTVAVQADMPYSGLTTFGTAFLSKFECSQMPHPLLEHITFVDTPGVLSGEKQRTQRSYDFTGVTSWFASKCDLILLLFDPHKLDISDEFKRVISSLRGHDDKIRVVLNKADQVDTQQLMRVYGALMWSLGKVLNTPEVMRVYIGSFNDKPINVAAAGPLGQELFEREQEDLLADLRDIPKKACDRRINEFVKRARAAKIHSYIISHLRKEMPAMMGKAKAQQRLIDNLEDEFKKVQREHHLPAGDFPNVDHFRETLSGYNIDKFEKLKPKMIQTVDDMLGYDIPNLLKNFSNPYG

SEQ ID NO: 21525 - protein, 542 aa, Cirsium arvense
MEIDSAAISRCSTEHQKIYKIWFSAADSDGDGRITGGDATNFFVMSNLSRQDLKQVWAIADSRRQGFLGFKEFITAMQLISMAQAGHALSSDLLNSDVDFENLKPPVMDGLDALLAKKKRSNDSESNGSSQLQTSSTSSWFTSSKSAKKVPLTAVTSIIDGLKKLYIQKLKPLEVTYQFNDFVSPLLTNSDFDAKPMVMLLGQYSTGKTTFIKHLLRSSYPGAHIGPEPTTDRFVVVMNGPDERSIPGNTVAVQADMPYSGLTNFGTAFLSKFECSQMPHPLLEHITFVDTPGVLSGEKQRTQRSYDFTGVTSWFAAKCDLILLLFDPHKLDISDEFKRVISSLRGNDDKIRVVLNKADQVDTQQLMRVYGALMWSLGKVLNTPEVMRVYIGSFNDKPINSVTAGPIGTELFEKEQDDLLSDLKDIPKKACDRRINEFVKRARAAKIHAFIISHLKKEMPAMMGKAKTQQKLIDNLEDVFAKVQREHHLPAGDFPYVESFRERLSGYNLDKFEKLKPKMIQTVDDMLGYDIPDLLKNFKNPY

SEQ ID NO: 21526 - protein, 546 aa, Capsicum annuum
MEFDTNPINQCSKEHEKIYQQWFNFADSDGDGRLTGGDATKFFAMSNLPRPDLKQVWAIADSKRQGFLSFREFIVSMQLVSLAQAGHAVTNDLLNADVDFENLPPPTMEGLDVLLAKKKLMPKSEADQTAGSAPVQAAPATSWFSSSKSSKKISLSSVTSIVDGLKKLYIQKLKPLEVAYHFNDFVSPLLTDSDFDAKPMVMLLGQYSTGKTTFIKHLLKMSYPGAHIGPEPTTDRFVVVMNGPDERSIPGNTIAVQADMPFSGLTTFGTAFLSKFECSQMSHPLLEHFTLVDTPGVLSGEKQRTQRSYDFTGVTSWFAAKCDLILLLFDPHKLDISDEFKRVIASLRGHDDKIRVVLNKADQVDTQQLMRVYGALMWSLGKVLNTPEVARVYIGSFNDKPMREAATGPLGKELFEKEQDDLLTDLKNIPKKACDRRINEFVKRARAAKIHAYIIGHLRKEMPAMIGKAKTQQRLIDELETEFGKVQREFHLPAGDFPNVEHFREVLSGYSFDRFEKLKPKMIQDVDDMLGYDLPELLNNFRNPYD

SEQ ID NO: 21527 - protein, 543 aa, Glycine max
MEFDPIPIGSCSKEHQMIYKEWFNYADSDSDGRITGSDATKFFAMSNLSREDLKQVWAIADSKRQGYLGFTEFIIAMQLVSLAQSGHSITPDLLTSDVDFTNGKPPSMEGLDVLLVKKKHKQKEVDANGSSQLQPSPSSNWFSSKSTKKVPLSSVTSIIDGLKRLYIQKLKPLEVTYRFNDFVSPLLTNSDFDAKPMVMLLGQYSTGKTTFIKHLLKSSYPGAHIGPEPTTDRFVVVMSGSDERSVPGNTVAVQADMPFSGLTTFGTAFLSKFVCSQMPHPLLEHITFVDTPGVLSGEKQRTQRAYDFTGVTSWFAAKCDLILLLFDPHKLDISDEFNRVISSLRGHDDKIRVVLNKADQVDTQQLMRVYGALMWSLGKVLKTPEVMRVYIGSFNDKPVNDAATGPLGKELFEKEQDDLLSDLKDVPKAACDRRINEFVKRARAAKIHAYIISHLKKEMPAMIGKAKAQQKLIDNLAAEFGKVQREFHLPPGDFPNVEFFRERLSGYNIDKFEKLKPKMTQAVDDMLAYDIPNLLKNFRNPYD

SEQ ID NO: 21528 - protein, 545 aa, Cannabis sativa
MEIASSPIFSCSKEHQRIYHEWFLYADSDGDGRITGNDALKFFALSNLSRQDLKQVWAVADSKRQGYLGFGEFVAAMQLVSLAQTGLEITHDLLNSNVDFETLDPPVMEGLAELLSKKKSPQKISELDLNGGSIVQHSPSSQWFSSKSSKKVSLSSVTSIVDGLKRLYLKKLKPLEDAYRFNDFVSPSLTNSDFDAKPMVMLLGQYSTGKTTFIKHLLRGSYPGAHIGPEPTTDRFVVVMSGPDERSIPGNTVAVQADMPFSGLTTFGTAFLSKFECSQMPHPLLEHITFVDTPGVLSGEKQRTQRAYDFTGVTSWFASKCDLILLLFDPHKLDVSDEFKRVISSLRGHDDKIRVVLNKADQVDTQQLMRVYGALMWSLGKVINTPEVMRVYIGSFNDKPVNEAATGPLGKELFEREQEDLLADLKDIPKKACDRRINEFVKRARAAKIHAYIISHLKKEMPAMMGKAKAQQKLIDNLGDAFAKVQREFHLPPGDFPNVEQFKETLKGYNIDKFEKLKPKMIQAVDDMLGYDIPELLKSFRNPYN

SEQ ID NO: 21529 - protein, 541 aa, Prunus mume
MEISSVPISSCSKEHQKIYQEWFRFADSDSDGRITGNDAIKFFGMSNLNRQDLKQVWAIADSKRQGYLGFSEFVAAMQLVSLAQGGHDISHDLLNSNVDLENLNPPVMEGLDALLAKKKQLHKMNENEVNGTAVVEQSPSALWFSSKSSKKVPLSSVTSIIDGLKRLYVQKLKPLEVTYRFNDFVSPLLTNSDFDAKPMVMLLGQYSTGKTTFIKHLLKRAHIGPEPTTDRFVVVMSGPDGRSVPGNTIAVQADMPFSGLTKFGTAFLSKFECSQMPHSLLEHITFVDTPGVLSGEKQRTQRAYDFTGVTSWFAAKCDLILLLFDPHKLDVSDEFKRVISSLHGHDDKIRVVLNKADQIDTQQLMRVYGALMWSLGKVLNTPEVMRVYIGSFNDKPVNEAATGPVGKELFEKEQEDLLADLKDIPKKSCDRRINEFVKRARAAKIHAYIISHLKKEMPAMLGKAKTQQRLIDNLEDEFGKVQREFHLPPGDFPDVDHFRDILSGYNIDKFEKLKPKMIEAVDEMLGYDIPELLKNFRNPYG

SEQ ID NO: 21530 - protein, 549 aa, Glycine max
MEFDPIPIGSCSKEHQMIYKEWFNYADSDSDGRITGSDATKFFAMSNLPREDLKQVWAIADSKRQGYLGFTEFIIAMQLVSLAQSGHSITPDLLTSDVDFTNGKPPSMEGLDVLLVKKKHKQKEVDANAISNNAGSSQLQPSPSSNWFSSKSTKKVPLSSVTSIIDGLKRLYIQKLKPLEVTYRFNDFVSPLLTNSDFDAKPMVMLLGQYSTGKTTFIKHLLKSSYPGAHIGPEPTTDRFVVVMSGSDERSVPGNTVAVQADMPFSGLTTFGTAFLSKFVCSQMPHPLLEHITFVDTPGVLSGEKQRTQRAYDFTGVTSWFAAKCDLILLLFDPHKLDISDEFNRVISSLRGHDDKIRVVLNKADQVDTQQLMRVYGALMWSLGKVLKTPEVMRVYIGSFNDKPVNDAATGPLGKELFEKEQDDLLSDLKDVPKAACDRRINEFVKRARAAKIHAYIISHLKKEMPAMIGKAKAQQKLIDNLAAEFGKVQREFHLPPGDFPNVEFFRERLSGYNIDKFEKLKPKMTQAVDDMLAYDIPNLLKNFRNPYD

SEQ ID NO: 21531 - protein, 545 aa, Centaurea maculosa
MEIDSASISRCSVEHQKIYKIWFTAADSDGDGRITGGDALNFFVMSNLSRQDLKQVWAIADSKRQGFLGFKEFITAMQLISMAQAGHALSSDLLNSDVDFENLKPPVMDGLDILLAKKKRPTSESESNGSSQLQSSSSPSTWFTSSKSAKKVPLTAVTSIIDGLKKLYIQKLKPLEVTYQFNDFVSPLLTNSDFDAKPMVMLLGQYSTGKTTFIKHLLRSSYPGAHIGPEPTTDRFVVVMNGPDERSIPGNTVAVQADMPYSGLTNFGTAFLSKFECSQMPHPLLEHITFVDTPGVLSGEKQRTQRSYDFTGVTSWFAAKCDLILLLFDPHKLDISDEFKRVISSLRGNDDKIRVVLNKADQVDTQQLMRVYGALMWSLGKVLQTPEVMRVYIGSFNDKPINSVTAGPIGTELFEKEQDDLLSDLKDIPKKACDRRINEFVKRARAAKIHAFIISHLKKEMPAMMGKAKTQQKLIDNLEDVFAKVQREHHLPAGDFPYVESFRERLSGYSLDKFEKLKPKMIQTVDDMLGYDIPDLLKNFKNPYD

SEQ ID NO: 21532 - protein, 485 aa, Lolium multiflorum
ADSKRLGYLGFGEFVTAMQLVSLAQTGDEITPDSIKRDDLSSLNTPAMEGLDTLLARSKHLVKRVDQAGDGFPQAQGPSTDHWFTSKSSKKIPLTAVTSVIDGLKRLYIEKLKPLEVAYKFNDFVSPLLTNSDFDAKPMVMLLGQYSTGKTTFIKHLLKTSYPGAHIGPEPTTDRFVVVMSGPDERTIPGNTLAVQADMPFSGLTTFGTSFLSKFECSQMPHPLLEHITFVDTPGVLSGEKQRTQRSYEFTGVTSWFAAKCDLILLLFDPHKLDISDEFKRVIGSLRGHDDKIRVVLNKADQIDTQQLMRVYGALMWSLGKVLNTPEVSRVYIGSFNDKPVKESAVGPIGKELFEKEQDDLLSDLKDIPKKACDRRINEFVKRARAAKIHAYIIGHLKNQMPTMMGKAKAQQRLIDNLEDEFAKVQREHHLPAGDFPFVDHFRDVLGGYSIDKFEKVKPKMIQAVDDMLGYDIPELLKNFRNPYE

SEQ ID NO: 21533 - protein, 546 aa, Brassica juncea
MEIDSVAAGSCSKENQLIYKEWFEFADSDGDGRITGSDAIKFFSMSNLPRPELKQVWAIADAKRQGYLGFKDFIVAMQLVSLAQTGHEISHDVLHSDVDFKNMNPPVMEGLGVLMAKKKHSSSKSNDLSVNGSPSADASLTAHWFSSKSSKKISLSSVTSIVDGLKRLYIQKLKPLEVAYRFNDFVSPLLTNSDFDAKPMVMLLGQYSTGKTTFIKHLLKASYPGAHIGPEPTTDRFVVVMSGPDERSIPGNTVAVQADMPFSGLTTFGTAFLSKFECSQMPHPLLEHVAFVDTPGVLSGEKQRTQRAYDFTGVTSWFASKCDLILLLFDPHKLDVSDEFKRVISSLRGHDDKIRVVLNKADQVDTQQLMRVYGALMWSLGKVLNTPEVSRVYIGSFSDKPINEAATGPIGRELFEKEQDDLLADLKDIPKKACDRRINEFVKRARAAKIHACIISHLKKEMPAIMGKAKAQQKLIDNLEDVFGKVQREHHLPKGDFPNVEQFREVLSGYNIDKFEKLKPKMLQTVDDMLGYDIPELLKNFRNPYD

SEQ ID NO: 21534 - protein, 546 aa, Brassica oleracea
MEIDSVAAGSCSKENQLIYKEWFEFADSDGDGRITGNDAIKFFSMSNLPRPELKQVWAIADAKRQGYLGFKDFIVAMQLVSLAQTGHEISHDVLHSDVDFKNMNPPVMEGLGVLMAKKKHSSSKSSDLNVNGSPSADASLTAHWFSSKSSKKISLSSVTSIVDGLKRLYIQKLKPLEVAYRFNDFVSPLLTNSDFDAKPMVMLLGQYSTGKTTFIKHLLKASYPGAHIGPEPTTDRFVVVMSGPDERSIPGNTVAVQADMPFSGLTTFGTAFLSKFECSQMPHPLLEHVAFVDTPGVLSGEKQRTQRAYDFTGVTSWFASKCDLILLLFDPHKLDVSDEFKRVISSLRGHDDKIRVVLNKADQVDTQQLMRVYGALMWSLGKVLNTPEVSRVYIGSFSDKPINEAATGPIGRELFEKEQDDLLADLKDIPKKACDRRINEFVKRARAAKIHACIISHLKKEMPAIMGKAKAQQKLIDNLEDVFGKVQREHHLPKGDFPNVEQFREVLSGYNIDKFEKLKPKMLQTVDDMLGYDIPELLKNFRNPYD

SEQ ID NO: 21535 - protein, 521 aa, Chelidonium majus
NYADADGDGRITGNDATKFFAMSNLSRPELKQVWAISDSKRQGFLGFKEFITAMQLVSLAQAGHELTEGLLSSAVDLENLNPPVMEGLDPLLAKKRLTQKIEPELDLIAQPQLSPAANWFTTKSTKKVPLSSVTSIIDGLKRLYIQKLKPLEVTYRFNDFVSPLLANSDFDAKPMVMLLGQYSTGKTTFIKHLLRSNYPGAHIGPEPTTDRFVVVMSGPDERDIPGNTIAVQADMPYSGLTSFGTAFLSKFQCSQMPHPLLEHITFVDTPGVLSGEKQRTQRSYDFTGVTSWFAAKCDLILLLFDPHKLDISDEFKRVIGSLRGHDDKIRVVLNKADQVDTQQLMRVYGALMWSLGKVLNTPEVMRVYIGSFNDKPVNEAAIGPIGKELFEKEQEDLLSDLKDIPKKACDRRINEFVKRARAAKIHAYIISHLRKEMPAMMGKAKAQQRLIDNLEDEFAKVQREFHLPAGDFPNVEHFREVLSGYSIDKFEKLKPKMIQAVDDMLGYDIPELLKSFKNPYE

SEQ ID NO: 21536 - protein, 543 aa, Nicotiana benthamiana
MEFDNSPINECSKNHEKIYQQWFNFADSDGDGRLTGMDATNFLAMSKLPRDHLKQVWAIADSKRQGFLSFKEFITAMQLVSLAQAGHAVTSDSLNAEVDFETLQLPTMEGLDGLLAKKKRVAKWAPDSNGSLMLSSRANWFSSSKSSKKVPSNYVTSIIDGLKKLYVKKLKPLEVTYHFSDFVSPLLANSDFDAKPMVMLLGQYSTGKTTFIKHLLRTSYPGAHIGPEPTTDRFVVVMNGPDERTVPGNTIAVQADMPFSGLTTFGTAFLSKFECSQMPHPLLENITIVDTPGVLSGEKQRTQRSYDFTGVTSWFAAKCDLILLLFDPHKLDISDEFKRVIASLQGHDDKIRVVLNKADQVDTQQLMRVYGALMWSLGKVLNTPEVTRVCIGSFNDRPINEALTGPLGKELFEKEQDDLLTDLKNIPKKACDRRINEFVKRARAAKIHAHIISHLKKEMPAMMGKSKKQKRLIDNLEDEFVKIQKEHHLPAGDFPNVEHFREVLSGYNIDKFEKLKPKLIQAVDDMLGCDIPELHKNFRNPYG

SEQ ID NO: 21537 - protein, 545 aa, Citrus sinensis
MEIGTGPIGSCSKDHQKIYLEWFNYADSDGDGRITGNDATKFFALSNLSRQDLKQVWAIADAKRQGYLGYREFIAAMQLISLVQDGHQVTHDLWNSDVDFQNLKPPAMEGLDKLLANKRHSSKTSDPNLNGSLQPQPSPSANWFSSKSSKKISMSSVTSIIDGLKRLYIQKLKPLEVTYRFNDFVSPLLTNSDFDAKPMVMLLGQYSTGKTTFIKHLLRTSYPGAHIGPEPTTDRFVVVMSGVDDRSIPGNTVAVQADMPFSGLTTFGTAFLSKFECSQMPHSLLEHITLVDTPGVLSGEKQRTQRAYDFTGVTSWFAAKCDLILLLFDPHKLDISDEFKRVITSLRGHDDKIRVVLNKADQVDTQQLMRVYGALMWSLGKVLNTPEVVRVYIGSFNDKPVNESAFGPLGKELFEKEQDDLLSDLKDIPKKACDRRINEFVKRARAAKIHAYIISHLRKEMPAMMGKAKTQQKLIDNLAEEFGKVQKEFHLPPGDFPNVEHFKEILSGYSFDKFEKLKPKMIQVVDDMLGYDIPDLLKNFRNPYD

SEQ ID NO: 21538 - protein, 544 aa, Arachis hypogaea
MEFDPIPIGSCSKENQIIYQQWFNYADSDGDGRITGSDATKFFAMSNLSRQDLKQVWAIADSKRQGYLGFAEFIIAMQLISLAQSGQPITQDLLSSGVELKNLKPPTMDGLDVLMAKKRHKEKEVDSNGSSPLQPSPSSSSWFSSKSTKRVSLSSVTSIIDGLKKLYIQKLRPLEATYRFNDFVSPLLTNSDFEAKPMVMLLGQYSTGKTTFIKHLLKSSYPGAHIGPEPTTDRFVVVMSGPDERSIPGNTVAVQADMPFSGLTSFGTAFLSKFECSQMPHPLLDHITFVDSPGVLSGEKQRTQRAYDFTGVTSWFAAKCDLILLLFDPHKLDISDEFKRVISSLRGHDDKIRVVLNKADQVDTQQLMRVYGALMWSLGKVLNTPEVMRVYIGSFNDKPINDAVSGPIGKELFEKEQEDLLSDLKDIPKKACDRRINEFVKRARAAKIHAYIISHLKKEMPAMMGKAKAQQKLIDNLAAAFGKVQREFHLPPGDFPDVEHFRETLSGYNFDKFEKLKPKMIQAVDDMLGYDIPNLLKNFRNPYD

SEQ ID NO: 21539 - protein, 544 aa, Silene vulgaris
MEIASDPIGSCTKEHQKVYQQWFAVADSNGDGRITGNDATKFFAMSNLSRSDLKQVWAFADTKREGYLGFKQFVAAMQLISLAQAGHELTADLLSSADMEEIQLPVMEGLDTLIAKMKKTSTYVEPELNGSPQRQSPQASNWFSSKPSKKVSLSAVTSIIDGLKRLYLDKLKPLETTYRFHDFVSPPLASSDFDAKPMVMLLGQYSTGKTTFIKHLLQCEYPGAHIGPEPTTDRFVCVMSGPDERSIPGNTIAVQADMPFSGLSNFGGAFLSKFQCSQMPHPLLEHITFVDTPGVLSGEKQRTQRSYDFTGVISWFAAKCDLILLLFDPHKLDISDEFKRVISSLRGHDDKIRVVLNKADQVDTQQLMRVYGALMWSLGKVLNTPEVSRVYIGSFNDKPIKEDSIGPMGRELFEKEQNDLLADLKDIPKKACDRRINEFVKRARAAKIHAYIISHLKKEMPAMIGKGKAQQRLIDNLEGEFAKVQREFHLPAGDFPYVEHFREVLGGYSIDKFEKLKPKMIQAVDDMLGYDIPELLKNFRNPYD

SEQ ID NO: 21540 - protein, 546 aa, Brassica rapa
MEIDSVAAGSCSKENQLIYKEWFEFADSDGDGRITGSDAIKFFSMSNLPRPELKQVWAIADAKRQGYLGFKDFIVAMQLVSLAQTGHEISHDVLHSDVDFKNMNPPVMEGLGVLMAKKKHSSSKSNDLSVNGSPSADASLTAHWFSSKSSKKISLSSVTSIVDGLKRLYIQKLKPLEVAYRFNDFVSPLLTNSDFDAKPMVMLLGQYSTGKTTFIKHLLKASYPGAHIGPEPTTDRFVVVMSGPDERSIPGNTVAVQADMPFSGLTTFGTAFLSKFECSQMPHPLLEHVAFVDTPGVLSGEKQRTQRAYDFTGVTSWFASKCDLILLLFDPHKLDVSDEFKRVISSLRGHDDKIRVVLNKADQVDTQQLMRVYGALMWSLGKVLNTPEVSRVYIGSFSDKPINEAATGPIGRELFEKEQDDLLADLKDIPKKACDRRINEFVKRARAAKIHACIISHLKKEMPAIMGKAKAQQKLIDNLEDVFGKVQREHHLPKGVFPNVEQFREVLSGYNIDKFEKLKPKMLQTVDDMLGYDIPELLKNFRNPYD

SEQ ID NO: 21541 - protein, 544 aa, Cichorium intybus
MEIDSAAISRCSAEHQKIYKDWFSAADSDGDGRLTGGDATNFFVMSNLSRQDLKQVWAIADSRRQGFLGFKEFITAMQLISMAQTGHTLSSDLLNSDVDYENLKPPVMDGLDVLLAKKKRSKNDLESNGSPEVQTSSSSSWFTSSKSAKKVPLTAVTSIIDGLKKLYIQKLKPLEVTYQFNDFVSPLLTNSDFDAKPMVMLLGQYSTGKTTFIKHLLRSSYPGAHIGPEPTTDRFVVVMNGPDERSIPGNTVAVQADMPYSGLTNFGTAFLSKFECSQMPHPLLEHITFVDTPGVLSGEKQRTQRSYDFTGVTSWFAAKCDLILLLFDPHKLDISDEFKRVISSLRGNDDKIRVVLNKADQVDTQQLMRVYGALMWSLGKVLNTPEVMRVYIGSFNDKPINRVTAGPIGTELFEKEQDDLLADLKDIPKKACDRRINEFVKRARAAKIHAFIISHLKKEMPAMMGKAKTQQKLIDNLEDVFAKVQREHHLPAGDFPYVESFRERLSGYNLDKFEKLKPKMIQTVDDMLGYDIPDLLKNFRNPYD

SEQ ID NO: 21542 - protein, 547 aa, Eucalyptus grandis
MEIKSGALGSCSKDHQRIYQEWFHFADSDGDGRITGNAATKFFAMSKLSRQELKQVWAIADSKRQGFLSLHEFIIAMQLISLAQEGVELTPGSLKFEADVEKIDPPMMEGLDALVAKSKNSTVVVDPETNGSAPPVPPPSSQWFASKSGRKAQAPQYSVTSIVDGLKKLYIEKLKPLEVAYRFNDFVSPLLTNSDFDAKPMVMLLGQYSTGKTTFIKHLLRCDYPGAHIGPEPTTDRFVVVMSGPDERSIPGNTIAVHADMPFNGLTKFGGAFLSKFECSQMPHPLLDQITFVDTPGVLSGEKQRTQRSYDFTGVISWFAAKCDLILLLFDPHKLDISDEFKRVIASLRGNDDKIRVVLNKADQVDTQQLMRVYGALMWSLGKVLNTPEVARVYIGSFNDKPVNDGIVGPIGRDLFEKEQDDLLADLIDIPKKACDRRINEFVKRARAAKIHAYIISHLKKEMPAMMGKAKAQQRLIDNLEDEFAKVQRDYHLPAGDFPSVDHFREVLSGYNIDKFEKLKPKMIQAVDDMLGYEIPELLKNFRNPYE

SEQ ID NO: 21543 - protein, 546 aa, Flaveria ramosissima
MEIDSAAITRCSPEHQKIYNEWFNVADTDGDGRVTGVDATNFFIMSNLARQDLKQVWAIADSKRQGFLGFKEFITAMQLISMAQAGHELSSDLLNSEVDFENLKPPVMDGLDVLLARKRRPKSDSESNGNSPLQTSPTASSSWFTSPKSAKKVPLTAVTSIIDGLKKLYIQKLKPLEVTYQFNDFVSPLLTNSDFDAKPMVMLLGQYSTGKTTFIKHLLRSSYPGAHIGPEPTTDRFVVVMNGPDERSIPGNTVAVQADMPYSGLTNFGTAFLSKFECSQMPHPLLEHITFVDTPGVLSGEKQRTQRSYDFTGVTSWFAAKCDLILLLFDPHKLDISDEFKRVISSLRGNDDKIRVVLNKADQVDTQQLMRVYGALMWSLGKVLNTPEVMRVYIGSFNDKPINTVTSGPIGTELFEKEQEDLLSDLKDIPKKACDRRINEFVKRARAAKIHAFIISHLKKEMPAMMGKAKAQQKLIDNLEDVFAKVQREHHLPAGDFPYVESFRERLSGYNLDKFEKLKPKMIQTVDDMLGYDIPDLLKNFRNPYD

SEQ ID NO: 21544 - protein, 545 aa, Citrus clementina
MEIGTGPIGSCSKDHQKIYLEWFNYADSDGDGRITGNDATKFFALSNLSRQDLKQVWAIADAKRQGYLGYREFIAAMQLISLVQDGHQVTHDLWNSDVDFQNLKPPAMEGLDKLLANKRHSSKTSDPNLNGSLQPQPSPSANWFSSKSSKKISMSSVTSIIDGLKRLYIQKLKPLEVTYRFNDFVSPLLTNSDFDAKPMVMLLGQYSTGKTTFIKHLLRTSYPGAHIGPEPTTDRFVVVMSGVDDRSIPGNTVAVQADMPFSGLTTFGTAFLSKFECSQMPHSLLEHITLVDTPGVLSGEKQRTQRAYDFTGVTSWFAAKCDLILLLFDPHKLDISDEFKRVITSLRGHDDKIRVVLNKADQVDTQQLMRVYGALMWSLGKVLNTPEVVRVYIGSFNDKPVNESAFGPLGKELFEKEQDDLLSDLKDIPKKACDLRINEFVKRARAAKIHAYIISHLRKEMPAMMGKAKTQQKLIDNLAEEFGKVQKEFHLPPGDFPNVEHFKEILSGYSFDKFEKLKPKMIQVVDDMLGYDIPDLLKNFRNPYD

SEQ ID NO: 21545 - protein, 544 aa, Cichorium intybus
MEIDSAAISRCSAEHQKIYKDWFSAADSDGDGRLTGGDATNFFVMSNLSRQDLKQVWAIADSRRQGFLGFKEFITAMQLISMAQTGHTLSSDLLNSDVDYENLKPPVMDGLDVLLAKKKRSKNDLESNGSPEVQTSSSSSWFTSSKSAKKVPLTAVTSIIDGLKKLYIQKLKPLEVTYQFNDFVSPLLTNSDFDAKPMVMLLGQYSTGKTTFIKHLLRSSYPGAHIGPEPTTDRFVVVMNGPDERSIPGNTVAVQADMPYSGLTNFGTAFLSKFECSQMPHPLLEHITFVDTPGVLSGEKQRTQRSYDFTGVTSWFAAKCDLILLLFDPHKLDISDEFKRVISSLRGNDDKIRVVLNKADQVDTQQLMRVYGALMWSLGKVLNTPEVMRVYIGSFNDKPINRVTAGPIGTELFEKEQDDLLADLKDIPKKACDRRINEFVKRARAAKIHAFIISHLKREMPAMMGKAKTQQKLIDNLEDVFAKVQREHHLPAGDFPYVESFRERLSGYNLDKFEKLKPKMIQTVDDMLGYDIPDLLKNFRNPYD

SEQ ID NO: 21546 - protein, 526 aa, Euphorbia peplus
LEWFNLADADGDGRITGSDAINFFSMSNLSRQDLKQVWAIADSKRQGYLGFNEFVTSMQLVSLAQAGNEITHDVLQRDVDIVNLNPPAMEGLDKMLAKKRRKSTSSEPDGNGTIPSESSPSANWFSSKSSKKVSLSSVTSIIDGLKRLYIQKLKPLEVAYRFNDFVSPLLTNSDFDAKPMVMLLGQYSTGKTTFIKHLLKCGYPGAHIGPEPTTDRFVVVMSGPDERSIPGNTIAVQADMPFNGLTTFGSAFLSKFECSQMPHSLLEHITFVDTPGVLSGEKQRTQRAYDFTGVTSWFAAKCDLILLLFDPHKLDVSDEFKRVISSLRGHDDKIRVVLNKADQVDTQQLMRVYGALMWSLGKVLNTPEVSRVYIGSFNDKPVNENAVGPLGKELFEREQEDLLSDLKDIPKKACDRRINEFVKRARAAKIHAYIISHLKKEMPAMMGKSKAQQRLMENLETEFGKVQKEFHLPSGDFPNVDHFREVLSGYNIDKFEKLKPKMIQAVDDMLGYDIPELLKNFRNPYD

SEQ ID NO: 21547 - protein, 546 aa, Flaveria ramosissima
MEFDSSAISRCSVEHQKIYNEWFNVADSDGDGRVTGVDATNFFVMSNLARQDLKQVWAIADSKRQGFLGLKEFITAMQLISMAQAGHELSGDLLNSEVDFENLKPPVMDGLDVLLARKRRPKSEPESNGNSPLHPSPTASSSWFTSPKSAKKVPLTAVTSIIDGLKKLYIQKLKPLEVTYQFNDFVSPLLTNSDFDAKPMVMLLGQYSTGKTTFIKHLLRSSYPGAHIGPEPTTDRFVVVMNGPDERSIPGNTVAVQADMPYSGLTNFGTAFLSKFECSQMPHPLLEHITFVDTPGVLSGEKQRTQRSYDFTGVTSWFAAKCDLILLLFDPHKLDISDEFKRVISSLRGNDDKIRVVLNKADQVDTQQLMRVYGALMWSLGKVLNTPEVMRVYIGSFNDKPINTVNSGPIGTELFEKEQEDLLSDLKDIPKKACDRRINEFVKRARAAKIHAFIISHLKKEMPSMMGKAKAQQKLIDNLEDVFAKVQREHHLPAGDFPYVESFRERLSGYNLDKFEKLKPKMIQTVDDMLGYDIPDLLKNFRNPYD

SEQ ID NO: 21548 - protein, 546 aa, Flaveria ramosissima
MEFDSAAISRCSAEHQKIYNEWFNVADSDGDGRVTGVDATNFFVMSNLARQDLKQVWAIADSKRQGFLGLKEFITAMQLISMAQSGHELSSDLLNSEVDFENLKPPVMDGLDVLLARKRRPKSEPESNGNSPLQTSPTASSSWFTSSKSAKKVPLTAVTSIIDGLKKLYIQKLKPLEVTYQFNDFVSPLLTNSDFDAKPMVMLLGQYSTGKTTFIKHLLRSSYPGAHIGPEPTTDRFVVVMNGPDERSIPGNTVAVQADMPYSGLTNFGTAFLSKFECSQMPHPLLEHITFVDTPGVLSGEKQRTQRSYDFTGVTSWFAAKCDLILLLFDPHKLDISDEFKRVISSLRGNDDKIRVVLNKADQVDTQQLMRVYGALMWSLGKVLNTPEVMRVYIGSFNDKPINTVNSGPIGTELFEKEQEDLLSDLKDIPKKACDRRINEFVKRARAAKIHAFIISHLKKEMPSMMGKAKAQQKLIDNLEDVFAKVQREHHLPAGDFPYVESFRERLSGYNLDKFEKLKPKMIQTVDDMLGYDIPDLLKNFRNPYD

SEQ ID NO: 21549 - protein, 545 aa, Nicotiana benthamiana
MEFDTSPINRCSKEHEKIYQQWFGLADSDGDGRLTGGDAIKFFALSNLPRQELKQVWAIADSKRQGFLGFREFITAMQLVSLAQAGHPVTSDVLNAEVNFENLQPPTLEGLDLLQAKKKRTPKSKPEQNGNPTAQSSVSANWFSSSTSVKKVSLSSVTSIIDGLKKLYIQKLKPLEVAYRFNDFVSPFLTNSDFDAKPMVMLLGQYSTGKTTFIKHLLRTSYPGAHIGPEPTTDRFVVVMNGPDERSIPGNTIAVQADMPFSGLTTFGTAFLSKFECSQMPHPLLEHITFVDTPGVLSGEKQRTQRSYDFTGVTSWFASKCDLILLLFDPHKLDISDEFKRVIASLRGHDDKIRVVLNKADQVDTQQLMRVYGALMWSLGKVLNTPEVSRVYIGSFNDKPINEAATGPVGKELFEKEQDDLLTDLKNIPKKACDRRINEFVKRARAAKIHSYIISHLKKEMPAMIGKSKTQQKLIDNLEDQFVKVQKEHHLPPGDFPNLEHFREVLSGYNIDKFEKLKPKLIQSVDDMLGYDIPELLKNFRNPYD

SEQ ID NO: 21550 - protein, 545 aa, Solanum tuberosum
MEFDTSPINRCSKDHEKIYQQWFSLADSDGDGRLTGGDAIKFFAMSNLPRQDLKQVWAIADSKRQGFLGFREFIAAMQLVSLAQAGHPVSSDLLNAEVDFENLQPPSLEGLDLLQTKKKRMPKSEPEQNGSSTVQSSATANWFSSSSSVKKVSLSSVTSIVDGLKKLYLQKLRPLEATYHYNDFVSPLLTNSDFDAKPMVMLLGQYSTGKTTFIKHLLGTSYPGAHIGPEPTTDRFVVVMNGPDERSIPGNTIAVQANMPFSGLTTFGSAFLSKFECSQMPHPLLEHITFVDTPGVLSGEKQRTQRSYDFTGVTSWFASKCDLILLLFDPHKLDISDEFKRVIASLRGHDDKIRVVLNKADQVDTQQLMRVYGALMWSLGKVLNTPEVARVYIGSFNDKPINEAAIGPIGKELFEKEQDDLLTDLKNIPKKACDRRINEFVKRARAAKIHSYIISHLKKEMPAMMGKAKTQQKLIDNLEDQFMKVQKEHHLPAGDFPNVEHFREVLSGYNIDKFEKLKPKLIQSVDDMLGYDIPELLKNFRNPYD

SEQ ID NO: 21551 - protein, 546 aa, Flaveria ramosissima
MEFDSAAISRCSAEHQKIYNEWFNVADSDGDGRVTGVDATNFFVMSNLARQDLKQVWAIADSKRQGFLGLKEFITAMQLISMAQSGHELSSDLLNSEVDFENLKPPVMDGLDVLLARKRRPKSEPESNGNSPLHTSPTASSSWFTSPKSAKKVPLTAVTSIIDGLKKLYIQKLKPLEVTYQFNDFVSPLLTNSDFDAKPMVMLLGQYSTGKTTFIKHLLRSSYPGAHIGPEPTTDRFVVVMNGPDERSIPGNTVAVQADMPYSGLTNFGTAFLSKFECSQMPHPLLEHITFVDTPGVLSGEKQRTQRSYDFTGVTSWFAAKCDLILLLFDPHKLDISDEFKRVISSLRGNDDKIRVVLNKADQVDTQQLMRVYGALMWSLGKVLNTPEVMRVYIGSFNDKPINTVNSGPIGTELFEKEQEDLLSDLKDIPKKACDRRINEFVKRARAAKIHAFIISHLKKEMPSMMGKAKAQQKLIDNLEDVFAKVQREHHLPAGDFPYVESFRERLSGYNLDKFEKLKPKMIQTVDDMLGYDIPDLLKNFRNPYD

SEQ ID NO: 21552 - protein, 546 aa, Helianthus annuus
MEIDSSAISRCSVEHQKIYTEWFSVADSDGDGRVTGVDATNFFVMSNLARPDLKQVWAIADSKRQGFLGLKEFITAMQLISMAQAGHVLNSDLLNSDVDFENLKPPVMDGLDALLARKRRPKSEPESNGNSPLQTSPSASSSWFTSPKSAKKVPLTAVTSIIDGLKKLYIQKLKPLEVTYQFNDFVSPLLTNSDFDAKPMVMLLGQYSTGKTTFIKHLLRSSYPGAHIGPEPTTDRFVVVMNGPDERSIPGNTVAVQADMPYSGLTNFGTAFLSKFECSQMPHPLLEHITFVDTPGVLSGEKQRTQRSYDFTGVTSWFAAKCDLILLLFDPHKLDISDEFKRVIASLRGNDDKIRVVLNKADQVDTQQLMRVYGALMWSLGKVLNTPEVMRVYIGSFNDKPINSVTAGPIGTELFEKEQEDLLSDLKDIPKKACDRRINEFVKRARAARIHAFIISHLKKEMPSMMGKAKAQQKLIDNLEDVFAKVQREQHLPAGDFPFVESFRERLNGYNFDKFEKLKPKLIQTVDDMLGYDIPDLLKNFSNPYD

SEQ ID NO: 21553 - protein, 546 aa, Helianthus annuus
MEIDSSAISRCSVEHQKIYTEWFSVADSDGDGRVTGVDATNFFVMSNLARPDLKQVWAIADSKRQGFLGLKEFITAMQLISMAQAGHVLSSDLLNSDVDFENLKPPVMDGLDALLARKRRPKSEPESNGNSPLQTSPSASSSWFTSPKSAKKVPLTAVTSIIDGLKKLYIQKLKPLEVTYQFNDFVSPLLTNSDFDAKPMVMLLGQYSTGKTTFIKHLLRSSYPGAHIGPEPTTDRFVVVMNGPDERSIPGNTVAVQADMPYSGLTKFGTAFLSKFECSQMPHPLLEHITFVDTPGVLSGEKQRTQRSYDFTGVTSWFAAKCDLILLLFDPHKLDISDEFKRVIASLRGNDDKIRVVLNKADQVDTQQLMRVYGALMWSLGKVLNTPEVMRVYIGSFNDKPINSVTAGPIGTELFEKEQEDLLSDLKDIPKKACDRRINEFVKRARAARIHAFIISHLKKEMPSMMGKAKAQQKLIDNLEDVFAKVQREQHLPAGDFPFVESFRERLNGYNFDKFEKLKPKLIQTVDDMLGYDIPDLLKNFSNPYD

SEQ ID NO: 21554 - protein, 544 aa, Artemisia annua
MEIDSSSLSRCSAEHQKVYTDWFTLADSDGDGRITGGDAKNFFVMSGLSGHDLKQVWAIADSRRQGYLGFKEFITAMQLISLAQAGQVLRSDILQSDVDFEYLHPPTLDGLDAFIAKKKRSKSDFESNGSPEVQTSPSSSWFTSTKSAKKVSLSNVTSIIDGLKKLYIQKLKPLEVTYQFNDFVSPLLTNSDFDAKPMVMLLGQYSTGKTTFIKHLLRSSYPGAHIGPEPTTDRFVVVMNGPDERSIPGNTVAVQADMPYSGLTNFGTAFLSKFECSQMPHPLLEHITFVDTPGVLSGEKQRTQRSYDFTGVTSWFAAKCDLILLLFDPHKLDISDEFKRVISSLRGNDDKIRVVLNKADQVDTQQLMRVYGALMWSLGKVLNTPEVMRVYIGSFNDKPINSVKAGPIGTELFEKEQDDLLSDLKDIPKKACDRRINEFVKRARAAKIHAFIISHLKKEMPSMMGKAKAQQKLIDNLEDVFAKVQREHHLPAGDFPYVENFREKLGGYNLDNFQKLKPKMIQTVDDMLGYDIPDLLKNFRNPYD

SEQ ID NO: 21555 - protein, 545 aa, Solanum phureja
MEFDTSPINRCSKDHEKIYQQWFSLADSDGDGRLTGGDAIKFFAMSNLPRQDLKQVWAIADSKRQGFLGFREFIAAMQLVSLAQAGHPVSSDLLNAEVDFENLQPPSLEGLDLLQTKKKRMPKSEPEQNGSSTVQSSATANWFSSSSSVKKVSLSSVTSIVDGLKKLYLQKLKPLEATYHFNDFVSPLLTNSDFDAKPMVMLLGQYSTGKTTFIKHLLGTSYPGAHIGPEPTTDRFVVVMNGPDERSIPGNTIAVQANMPFSGLTTFGSAFLSKFECSQMPHPLLEHITFVDTPGVLSGEKQRTQRSYDFTGVTSWFASKCDLILLLFDPHKLDISDEFKRVIASLRGHDDKIRVVLNKADQVDTQQLMRVYGALMWSLGKVLNTPEVARVYIGSFNDEPINEAAIGPIGKELFEKEQDDLLTDLKNIPKKACDRRINEFVKRARAAKIHSYIISHLKKEMPAMIGKAKTQQKLVDNLEDQFMKVQKEHHLPAGDFPNVEHFREVLSGYNIDKFEKLKPKLIQSVDDMLGYDIPELLKNFRNPYD

SEQ ID NO: 21556 - protein, 545 aa, Solanum lycopersicum
MEFDTSPINRCSKDHEKIYQQWFSLADSDGDGRLTGGDAIKFFAMSNLPRQDLKQVWAIADSKRQGFLGFREFIAAMQLVSLAQAGHPVSSDLLNAEVDFENLQPPSLEGLDLLQTKKKRMPKSEPEQNGSSTMQSSATANWFSSSASVKKVSLSSVTSIVDGLKKLYLQKLKPLEATYHFNDFVSPLLTNSDFDAKPMVMLLGQYSTGKTTFIKHLLGTSYPGAHIGPEPTTDRFVVVMNGPDERSIPGNTIAVQANMPFSGLTTFGSAFLSKFECSQMPHPLLEHITFVDTPGVLSGEKQRTQRSYDFTGVTSWFASKCDLILLLFDPHKLDISDEFKRVIASLRGHDDKIRVVLNKADQVDTQQLMRVYGALMWSLGKVLNTPEVARVYIGSFNDKPINDAAIGPIGKELFEKEQDDLLTDLKNIPKKACDRRINEFVKRARAAKIHSYIISHLKKEMPAMIGKAKTQQKLIDNLEDQFMKVQKEHHLPAGDFPNVEHFREVLNGYNIDKFEKLKPKLIQSVDDMLGYDIPELLKNFRNPYD

SEQ ID NO: 21557 - protein, 542 aa, Cucumis sativus
MEIGSYPIGSCSRDHQKIYQEWFDYADSDGDGRITGNDAIKFFSMSTLPRQDLKQVWAIADSKRQGYLGFKEFVTAMQLVSLAQSGGEVTHDVLTSNSEATLSLQFMNGGSFMLLLSSFNLVIDDFAGSSKGQSPVSASWFSSKSSKKIPLSSVTSIVDGLKRLYIQKLKPLEVSYRFNDFVSPLLANSDFDAKPMVMLLGQYSTGKTTFIKHLLKSSYPGAHIGPEPTTDRFVVVMSGPDERSIPGNTIAVQADMPFNGLTTFGTSFLSKFECSQMPHPLLEHITFVDTPGVLSGEKQRTQRAYEFTSVTSWFAAKCDLILLLFDPHKLDISDEFKRVIASLRGHDDKIRVVLNKADQVDTQQLMRVYGALMWSLGKVLNTPEVVRVYIGSFNDKPVNEAVTGPLGKDLFEKEQEDLLSDLKDIPKKACDRRINEFVKRARAAKIHAYIISHLRKEMPTMIGKAKTQQRLIDNLADEFGKVQREYHLPAGDFPNVEQFRETLSGYNFDKFEKLKPKMIQSVDDMLGYDVPDLLKNFRNPYD

SEQ ID NO: 21558 - protein, 546 aa, Echinacea purpurea
MEIDSSAISRCSLEHQKIYQEWFSVADSDGDGRLTGSDATNFFVMSNLARPDLKQVWAIADSKRQGFLGFKEFITAMQLISMAQAGHVLSSDLLNSEVDFENLKPPVMDGLDVLLARKRRPKSDPESNGNSPLQTSPSLSSSWFTSAKSAKKVPLTAVTSIIDGLKKLYIQKLKPLEVTYQFNDFVSPLLTNSDFDAKPMVMLLGQYSTGKTTFIKHLLRSSYPGAHIGPEPTTDRFVVVMNGSDERSIPGNTVAVQADMPYSGLTNFGTAFLSKFECSQMPHPLLEHITFVDTPGVLSGEKQRTQRSYDFTGVTSWFAAKCDLILLLFDPHKLDVSDEFKRVISSLRGNDDKIRVVLNKADQVDTQQLMRVYGALMWSLGKVLNTPEVMRVYIGSFNDKPINSVTSGPIGTELFEKEQEDLLSDLKDIPKKACDRRINEFVKRARAARIHAFIISQLKKEMPSMMGKAKAQQKLIDNLEDVFAKVQREQHLPAGDFPYVESFRERLSGYNFDKFEKLKPKLIQTVDDMLGYDIPDLLKNFSNPYE

SEQ ID NO: 21559 - protein, 545 aa, Brassica oleracea
MEIDSVAAGSCSKENQIIYKDWFEFADSDGDGRITGSDAIKFFSMSNLPRPELKQVWAIADAKRQGYLGFKEFIVAMQLVSLAQTGHEISHEVLHSDAVDFKNMNPPVMDGLIVLMAKKKKHSPKSSDPNGSPAADASLTAHWFSSKSSKKISLSSVTSIIDGLKRLYIQKLKPLEVAYQFNDFVSPLLTNSDFDAKPMVMLLGQYSTGKTTFIKHMLKSSYPGAHIGPEPTTDRFVVVMSGPDERSIPGNTVAVQADMPFSGLTSFGTAFLSKFECSQMPHPLLEHITFVDTPGVLSGEKQRTQRAYEFTGVTSWFASKCDLILLLFDPHKLDVSDEFKRVISSLRGHDDKIRVVLNKADQVDTQQLMRVYGALMWSLGKVLNTPEVARVYIGSFSDKPINEASTGPIGRELFEMEQEDLLSDLKNIPKKACDRRINEFVKRARAAKIHAYIISHLKKEMPAIMGKAKAQQKLLDNLEDVFGKVQREHHLPKGDFPNVDQFREVLSGYNFDKFEKLKPKMLQTVDDMLGYDIPELLKNFKNPYD

SEQ ID NO: 21560 - protein, 544 aa, Brassica rapa
MEIDSVAAGSCSKENQIIYKDWFEFADSDGDGRITGSDAIKFFSMSNLPRPELKQVWAIADAKRQGYLGFKEFIVAMQLVSLAQTGHEISHEVLHSDVDFKNMNPPVMDGLIVLMAKKKKHSPKSSDPNGSPAADASLTAHWFSSKSSKKISLSSVTSIIDGLKRLYIQKLKPLEVAYQFNDFVSPLLTNSDFDAKPMVMLLGQYSTGKTTFIKHMLKSSYPGAHIGPEPTTDRFVVVMSGPDERSIPGNTVAVQADMPFSGLTSFGTAFLSKFECSQMPHPLLEHITFVDTPGVLSGEKQRTQRAYEFTGVTSWFASKCDLILLLFDPHKLDVSDEFKRVISSLRGHDDKIRVVLNKADQVDTQQLMRVYGALMWSLGKVLNTPEVARVYIGSFSDKPINEVSTGPIGRELFEMEQEDLLSDLKNIPKKACDRRINEFVKRARAAKIHAYIISHLKKEMPAIMGKAKAQQKLLDNLEDVFGKVQREHHLPKGDFPNVDQFREVLSGYNFDNFEKLKPKMLQTVDDMLGYDIPELLKNFKNPYD

SEQ ID NO: 21561 - protein, 543 aa, Chrysanthemum coronarium
EIDSSSLSRCSAEHQKVYTDWFTLADSDGDGRITGGDAKNFFVMSGLSGHDLKQVWAIADSRRQGYLGFKEFITAMQLISLAQAGQVLRSDILQSDVDFEYLHPPTLDGLDAFIAKKKRSKSDFESNGSPEVQTSPSSSWFTSTKSAKKVSLSNVTSIIDGLKKLYIQKLKPLEVTYQFNDFVSPLLTNSDFDAKPMVMLLGQYSTGKTTFIKHLLRSSYPGAHIGPEPTTDRFVVVMNGPDERSIPGNTVAVQADMPYSGLTNFGTAFLSKFECSQMPHPLLEHITFVDTPGVLSGEKQRTQRSYDFTGVTSWFAAKCDLILLLFDPHKLDISDEFKRVISSLRGNDDKIRVVLNKADQVDTQQLMRVYGALMWSLGKVLNTPEVMRVYIGSFNDKPINSVKAGPIGTELFEKEQDDLLSDLKDIPKKACDRRINEFVKRARAAKIHAFIISHLKKEMPSMMGKAKAQQKLIDNLEDVFAKVQREHHLPAGDFPYVENFRERLSGYNLDNFQKLKPKMIQTVDDMLGYDIPDLLKNFRNPYD

SEQ ID NO: 21562 - protein, 544 aa, Chrysanthemum coronarium
MEFDSSSLSRCSAEHQKVYTDWFNLADSDGDGRITGGDAKTFFVMSGLSGHDLKQVWAIADSRRQGYLGFKEFVTAMQLISLAQAGQVLRSDILQSDVDFEYLHPPTLDGLDAFIAKKKRSKSDFESNGSPEVQTSPSSSWFTSSKSAKKVSLSNVTSIIDGLKKLYIQKLKPLEQTYQFNDFVSPLLTNSDFDAKPMVMLLGQYSTGKTTFIKHLLRSSYPGAHIGPEPTTDRFVVVMNGPDERSIPGNTVAVQADMPYSGLTNFGTAFLSKFECSQMPHPLLEHITFVDTPGVLSGEKQRTQRSYDFTGVTSWFAAKCDLILLLFDPHKLDISDEFKRVIASLRGNDDKIRVVLNKADQVDTQQLMRVYGALMWSLGKVLNTPEVMRVYIGSFNDKPINTATAGPLGTELFEKEQEDLLSDLKDIPKKACDRRINEFVKRARAAKIHAFIISHLKKEMPSMMGKAKAQQKLIDNLEDVFAKVQREHHLPAGDFPYVENFRERLGGYNLDNFQKLKPKMIQTVDDMLGYDIPDLLKNFRNPYD

SEQ ID NO: 21563 - protein, 543 aa, Musa acuminata
MNLVSSSVASCPKEKQKIYQEWFSVADKDGDGRITGNDALKFFAMSKLSRSELKQVWAIADSKRQGFLDLQEFINAMQLVALAQEGHEMTPDLLNHADLENLKPPVMEGLDIRLAKSKRSEKKSDPCSDVPPQPQSPASARWFNSKSAKKIPSKSVTSIIDGLKKLYIEKLKPLEVTYQFSDFVSPLLTNSDFDAKPMVMLLGQYSTGKTTFIKHLLKSSYPGAHIGPEPTTDRFVVITSGPDERSIPGNTIAVQADMPYNGLTAFGTGFLSKFECSQMPHPLLEHITFVDTPGVLSGEKQRTQRSYDFTGVTSWFAAKCDLVLLLFDPYKLDISDEFKRVIGSLRGHDDKIRVVLNKADQVDTQQLMRVYGALLWSLGKVLNTPEVMRVYIGSFNDKPINEAEHAVIGKLFEKEQEDLLSDLNDIPKKACDRRINEFVKRARAAKVHACIISHLKKEMPAMMGKAKAQQKLIDNLEEEFLKVQKEFHLAPGDFPNVDQFREVLGGYNIDKFEKMKHKMIQAVDDMLGYDIPELLKRFRNPYD

SEQ ID NO: 21564 - protein, 541 aa, Malus domestica
MEIGSGRTGVCPKEHQKIYQEWFNLVDSDGDGRITGNEATKFFAMSKLSREELKQVWAIADTKRQGFLGFSEFVTAMQMISLAQEHELSPDILKTAVDWENIKPPVIEGLDDLIAKTKSLTTYGVEVNGTAQFQPSVQRFGSKSAKKLPPNAVTSIVDGLKRLYNEKLKPLELAYRFNDFASPSLTNSDFDAKPMVMLLGQYSTGKTTFIKHLLRCDYPGAHIGPEPTTDRFVVVMSGPDERSIPGNTIAVHADMPFSGLTTFGGAFLSKFECSQMPHPLLDEITFVDTPGVLSGEKQRTQRSYDFTGAISWFAAKCDVILLLFDPHKLDISDEFKRVISSLRGHDDKIRVVLNKADQVDTQQLMRVYGALMWSLGKVLNTPEVVRVYIGSFNDKPVNEGVVGPIGKELFEKEQDDLLSDLVDIPKKACDRRINEFVKRARAAKIHAYIMSHLKKEMPAVMGKSKAQRKLIDNLEEEFAKVQRDFHLPAGDFPDVEHFREVLGGYSIDKFDKLKPKMIQAVDDMLGYDIPELLKKFRNPYN

SEQ ID NO: 21565 - protein, 541 aa, Musa acuminata
MDIVSYSISKENDKIYQNWFSFADSDGDGRLTGTDAIKFFAMSNLPRGDLKQVWAIADSRRQGYLGFKEFVIAMKLVSLAQEGNEITQVALAHADLEKVNPPVMEGLDTFLSTNKPSIKEIDPEQDVNSQPQTPKLQWFGTKSTKKIPLSSVTSIIDGLERLYIQKLKPLEVTYQFSDFGSSLLTSSDFDAKPMVMLLGQYSTGKTTFIKHLLKCSYPGAHIGPEPTTDRFVVVMLGPDERTIPGNTIAVQADMPFTGLTTYGNAFLSKFECSQMPHSLLEHITFVDTPGVLSGEKQRTQRSYDFTGVTSWFAAKSDLILLLFDPHKLDISDEFKRVIGSLRGHDDKIRVVLNKADQIDTQQLMRVYGALTWSLGKVLNTPEVMRVYIGSFNDKPVNSMAVGPVGKELFEKEQDDLLSDLKDIPKKACDRKINEFVKRARAAKIHAYIISHLRNQMPAMLGKTKAQQRLINNLENEFAKVQRDYHLPPGDFPDVQHFKEVLSGYNIDKFEKLKPKMIQAVDDMLAFDIPELLRKFRNPYGQ

SEQ ID NO: 21566 - protein, 542 aa, Chrysanthemum coronarium
IDSSSLSRCSAEHQKVYTDWFTLADSDGDGRITGGDAKNFFVMSGLSGHDLKQVWAIADSRRQGYLGFKEFITAMQLISLAQAGQVLRSDILQSDVDFEYLHPPTLDGLDAFIAKKKRSKSDFESNGSPEVQTSPSSSWFTSTKSAKKVSLSNVTSIIDGLKKLYIQKLKPLEVTYQFNDFVSPLLTNSDFDAKPMVMLLGQYSTGKTTFIKHLLRSSYPGAHIGPEPTTDRFVVVMNGPDERSIPGNTVAVQADMPYSGLTNFGTAFLSKFECSQMPHPLLEHITFVDTPGVLSGEKQRTQRSYDFTGVTSWFAAKCDLILLLFDPHKLDISDEFKRVISSLRGNDDKIRVVLNKADQVDTQQLMRVYGALMWSLGKVLNTPEVMRVYIGSFNDKPINSVKAGPIGTELFEKEQDDLLSDLKDIPKKACDRRINEFVKRARAAKIHAFIISHLKKEMPSMMGKAKAQQKLIDNLEDVFAKVQREHHLPAGDFPYVENFRERLSGYNLDNFQKLKPKMIQTVDDMLGYDIPDLLKNFRNPYD

SEQ ID NO: 21567 - protein, 544 aa, Chrysanthemum coronarium
MDIDSSSLSRCSAEHQKVYTDWFTLADSDGDGRITGGDAKNFFVMSGLSGHDLKQVWAIADSRRQGYLGFKEFITAMQLISLAQSGQVLRSDILQSDVDFEYLHPPTLDGLDAFIAKKKRSKSDFESNGSPEVQTSPSSSWFTSTKSAKKVSLSNVTSIIDGLKKLYIQKLKPLEVTYQFNDFVSPLLTNSDFDAKPMVMLLGQYSTGKTTFIKHLLRSSYPGAHIGPEPTTDRFVVVMNGPDERSIPGNTVAVQADMPYSGLTNFGTAFLSKFECSQMPHPLLEHITFVDTPGVLSGEKQRTQRSYDFTGVTSWFAAKCDLILLLFDPHKLDISDEFKRVISSLRGNDDKIRVVLNKADQVDTQQLMRVYGALMWSLGKVLNTPEVMRVYIGSFNDKPINSVKAGPIGTELFEKEQDDLLSDLKDIPKKACDRRINEFVKRARAAKIHAFIISHLKKEMPSMMGKAKAQQKLIDNLEDVFAKVQREHHLPAGDFPYVENFRERLSGYNLDNFQKLKPKMIQTVDDMLGYDIPDLLKNFRNPYD

SEQ ID NO: 21568 - protein, 544 aa, Chrysanthemum coronarium
MEIDSSSLSRCSAEHQKVYTDWFTLADSDGDGRITGGDAKNFFVMSGLSGHDLKQVWAIADSRRQGYLGFKEFITAMQLISLAQSGQVLRSDILQSDVDFEYLHPPTLDGLDAFIAKKKRSKSDFESNGSPEVQTSPSSSWFTSTKSAKKVSLSNVTSIIDGLKKLYIQKLKPLEVTYQFNDFVSPLLTNSDFDAKPMVMLLGQYSTGKTTFIKHLLRSSYPGAHIGPEPTTDRFVVVMNGPDERSIPGNTVAVQADMPYSGLTNFGTAFLSKFECSQMPHPLLEHITFVDTPGVLSGEKQRTQRSYDFTGVTSWFAAKCDLILLLFDPHKLDISDEFKRVISSLRGNDDKIRVVLNKADQVDTQQLMRVYGALMWSLGKVLNTPEVMRVYIGSFNDKPINSVKAGPIGTELFEKEQDDLLSDLKDIPKKACNRRINEFVKRARAAKIHAFIISHLKKEMPSMMGKAKAQQKLIDNLEDVFAKVQREHHLPAGDFPYVENFRERLSGYNLDNFQKLKPKMIQTVDDMLGYDIPDLLKNFRNPYD

SEQ ID NO: 21569 - protein, 545 aa, Citrullus lanatus
MEIGSGAIGSCSKEQLKIFQEWFGLADSDGDGRVTGNDAIQFFSMSHLSRAELKQVWAIADSKRQGYLGFNEFVTAMQLISLAQAGYDLNSDILKKAAGMEEIKLPVLEGLDALVTKTKRLAISSQHETNGATQPMPPPSTPWFASKSGSKISHTAVTSIIDGLKKLYNEKLKHLEATYRFNDFVSPFLTSSDFDAKPMVMLLGQYSTGKTTFIKHLLKCNYPGAHIGPEPTTDRFVVVMSGPDERSVPGNTIAVQADMPFSGLTSFGGAFLSKFECSQMPHSLLDQITFVDTPGVLSGEKQRTQRSYDFTGVISWFAAKCDLILLLFDPHKLDISDEFKRVIGSLRGQDDKIRVVLNKADQVDTQQLMRVYGALMWSLGKVLNTPEVVRVYIGSFNDKPVNEASVGPIGRDLFVKEQDDLLADLIDIPKKACDRRINEFVKRARAAKIHAYIISHLKKEMPAMMGKAKTQQRLIDNLEDEFGKVQREYHLPAGDFPNVEHFREVLNGYSIDKFEKLKPKMIQAVDDMLGYDIPELLKNFKNPYE

SEQ ID NO: 21570 - protein, 286 aa, Glycine max
MDVSELAKKLGLSDSKLLVRKAAELRRLCDVQFDSSVIGVGEVAKSLICLEIAATRLGVLFDRSSAVRLSGMSERAYIRSYNSLHNGLGVKMKLDVRELAIQFGCVRIIPFVRDGLKLYKDRFVSSLPASRRASADFTRPVFTAVAFYLCAKKHKLKVDKLKLIELCGTSESEFSSVSATMKDLCHDVFGVAKEKKDPKEVQSNRDLLDVLPSKRKAEDGGYSSEDGPELSSYKKAKKMEKHDYEKWKSSVLSSNKQNKKAPCKRTRQTSLNFLKEPSDNQELEAI

SEQ ID NO: 21571 - protein, 286 aa, Cajanus cajan
MDVFELAKKLALSDSKLVVQKAAELRRLCDVQFDSSVIGVGEVAKSLICLEIAATRLGVIFDRSSAVRLSGMSERAYIRSYNSLHNGLGVKMKIDVRELAIQFGCVCIIPLVRDGLKLYKDRFVSSLPVSRRASAVFTRPVFTAVAFYLCAKKHKLKVDKLKLIELCGTSESEFSSVYVTMKDLCHDVFGVAKEKKDPKELQSNRDLLDVLPSKRKAEEGGSSDDGAELSSYKKAKKMGKRDYEKWKSSVLASNRQKKTKAPCKRTKQTRLNFIKESPDTKELEAM

SEQ ID NO: 21572 - protein, 287 aa, Lupinus angustifolius
MDLPQIAKKLGLSDSKLVIRKAAELRRLSDLQFDCSAIGVGEVAKAVICLEIAATRLGTLFDRSCAVKLSGMSERAYIRSYNSLHNGLGVKVKLDVRELAIQFGCVRIIPFVRDGLKLYKDRFLSSLPASRRASADFTRPVFTAVAFYLCAKKHKLKVDKIKLIELCGTSESEFSSVSTTMKDLCHDVFGVAKEKKDAREVQSNRDLLDVLPCKRKPEDGGYLSDDEPELSSYKKRKQMEKGDYEKWKSSVLASNEENKTKAACKRTTQTSLQFFKEAPDTKKLEAI

SEQ ID NO: 21573 - protein, 287 aa, Cicer arietinum
MDISEIAKKLGFSDSKLLIRKAAELRRLCDVHFDSSVIGVGEVAKAIICMEIAATRLGVLFDRSSAVRLSGMSERAYIRSYNSLHNGLGVKLKLDVRELAIQFGCVRIIPYVRDGLKIYKDRFLSSLPAARRASADFTRPVFMAVAFYLCAKKQKLKVDKIKLIELCGTSESEFSSVSTTMKDLCHDVFGVAKEKKDPKEVKTNRDLLDALPSKRKAEDGGYLSDDGAEISSYKKRKQMETRDYQKWKSSVLASNKQDKTEAPYKKPKQTRLNFAKETPETQKLEAI

SEQ ID NO: 21574 - protein, 287 aa, Medicago truncatula
MDISEIAKKLKLSDSKLLIRKAAELRRLCDVHFDSSIIGVGEVAKAIICMEIAATKLGVLFDRSSAVKLSGMSDRGYIRSYNSLHNTIGVKLKLDVRELAIQFGCVRIIPFVRDGLKLYKERFLSSLPAARRASADFTRPVFMAVAFYLCAKKHKLKVDKIKLIELCGTSESEFSSVSTTMKDLCHDVFGVAKEKKDPKEVKTNRDLLDVLPSKRKAEDGGYLSDDGEEVSSYKKRKQMETKDYEKWKSSVLTSNKQDKKEVPSKKPKQTRLNFVKEAPETQKLEAM

SEQ ID NO: 21575 - protein, 287 aa, Medicago truncatula
MDISEIAKKLKLSDSKLLIRKAAELRRLCDVHFDSSIIGVGEVAKAIICMEIAATKLGVLFDRSSAVKLSGMSDRGYIRSYNSLHNTIGVKLKLDVRELAIQFGCVRIIPFVRDGLKLYKERFLSSLPAARRASADFTRPVFMAVAFYLCAKKHKLKVDKIKLIELCGTSESEFSSVSTTMKDLCHDVFGVAKEKKDPKEVKTNRDLLDVLPSKRKAEDGGYLSDDGAEVSSYKKRKQMETKDYEKWKSSVLTSNKQDKKEVPSKKPKQTRLNFVKEAPETQKLEAM

SEQ ID NO: 21576 - protein, 1555 aa, Glycine max
MGSASLLNPSQPGVKKNSKSKQKSVVSKTEEKVMVKDKQKKRSLLESSEQPAATRKMPKRAAACKNLKEKSFLISEKSCLIEMEKDQIVEEESLAVRMTAGQDDGRPNRRITEFILHDATGKAQPLEVLEVNELFITGLILPLEVSTGKKKEKGVKCEGFGRVESWDISGYEDGSPVIWLSTDIADYDCQKPAASYKKVYDLFLEKARACIEVYLKLAKSSGGDPDISLDELLAGMVRSMSGSKCFSGTASIKDFVISHGEFIYKQLIGLDMTSKANDRTFADIPALIALRDESKKQANYVHAQVMPSNGSLRIDSGVGDEENKNQMDSVASVNEEDEDAKLARLLQEEEYWQSMKQKKNSRPTSVSNKYYIKINEDEIANDYPLPAYYKTSLQETDEFIVFDNDYDIYDTQDLPRSMLHNWSLYNSDARLVSLELLPMKPCSDIDVAIFGSGIMTSDDGSGFHLDTEAGQSSSVGSGAQVADGMPIYLSAIKEWMIEFGSAMIFISIRTDLAWYRLGKPAKQYAPWYDTVLKTARLAISIITLLKEQSRVSRLSFGDVIRKVSEFNQKDGSYISSDPLTVERYVVVHGQIILQLFAEFPDDNIRKSSFVTGLTNKMEERHHTKWLVKKKKVVPRSEPNLNPRAAVGPVVSKRKAMQATTTRLINRIWGEYYSNHLPEDSKEGIASELKDEDEVEEQEENEDDDNEEETILLEGTPKAHSASKQTKKISADTEIRWEGEPEGKTSSGYPVYKQAIIRGEVISVGRSVLVEVDETDEFPDIYYVEYMFESKIGRKMFHGRMMQCGCQTVLGNAANEREVFLTNECRDLGLHDVKQTVVVNIQNRPWGHQHRKDNIIADRVDRTQAEERKKKGLPTDYYCKSLYWPERGAFFTLPHDTLGLGSGVCPSCKIQDAEKEKDVFKVNSSKSGFLFNGTEYSLDDYVYVSPFEFEEKIEQGTHKSGRNVGLKAYVVCQVLEIVVKKEIKQAEIKSTQVKIRRFFRPEDLSNEKAYCSDIREVYYSDETYIISVESIEGKCQVRKKNDIPECSALGGIFQNVFFCELLYDPATGSLKKLPAHIKVKYSSGQTSDAAARKRKGKCIEGDGVSESTKEGKTLNDKRLATLDIFAGCGGLSEGLQQSGVSSTKWAIEYEEPAGDAFKANHPEALVFINNCNVILRAVMEKCGDTDDCISTSEAAELAAKLDEKEISSLPMPGQVDFINGGPPCQGFSGMNRFNQSSWSKVQCEMILAFLSFADYFRPRYFLLENVRNFVSFNKGQTFRLTLASLLEMGYQVRFGILEAGAFGVSQSRKRAFIWAASPEDVLPEWPEPVHVFSAPELKITLSENVQYAAVRSTANGAPLRAITVRDTIGDLPAVGNGASKGNMEYQNDPVSWFQKKIRGDMVVLTDHISKEMNELNLIRCQKIPKRPGADWRDLPEEKIKLSSGQVVDLIPWCLPNTAKRHNQWKGLFGRLDWQGNFPTSVTDPQPMGKVGMCFHPDQDRILTVRECARSQGFPDSYEFAGNIIHKHRQIGNAVPPPLASALGRKLKEAVDSKSST

SEQ ID NO: 21577 - protein, 1555 aa, Glycine max
MGSASLLNPSQPGVKKNSKSKQKSVVSKTEEKVMVKDKQKKRSLLESSEQPAATRKMPKRAAACKNLKEKSFLISEKSCLIEMEKDQIVEEESLAVRMTAGQDDGRPNRRITEFILHDATGKAQPLEVLEVNELFITGLILPLEVSTGKKKEKGVKCEGFGRVESWDISGYEDGSPVIWLSTDIADYDCQKPAASYKKVYDLFLEKARACIEVYLKLAKSSGGDPDISLDELLAGMVRSMSGSKCFSGTASIKDFVISHGEFIYKQLIGLDMTSKANDRTFADIPALIALRDESKKQANYVHAQVMPSNGSLRIDSGVGDEENKNQMDSVASVNEEDEDAKLARLLQEEEYWQSMKQKKNSRPTSVSNKYYIKINEDEIANDYPLPAYYKTSLQETDEFIVFDNDYDIYDTQDLPRSMLHNWSLYNSDARLVSLELLPMKPCSDIDVAIFGSGIMTSDDGSGFHLDTEAGQSSSVGSGAQVADGMPIYLSAIKEWMIEFGSAMIFISIRTDLAWYRLGKPAKQYAPWYDTVLKTARLAISIITLLKEQSRVSRLSFGDVIRKVSEFNQKDGSYISSDPLTVERYVVVHGQIILQLFAEFPDDNIRKSSFVTGLTNKMEERHHTKWLVKKKKVVPRSEPNLNPRAAVGPVVSKRKAMQATTTRLINRIWGEYYSNHLPEDSKEGIASELKDEDEVEEQEENEDDDNEEETILLEGTPKAHSASKQTKKISADTEIRWEGEPEGKTSSGYPVYKQAIIRGEVISVGRSVLVEVDETDEFPDIYYVEYMFESKIGRKMFHGRMMQCGCQTVLGNAANEREVFLTNECRDLGLHDVKQTVVVNIQNRPWGHQHRKDNIIADRVDRTQAEERKKKGLPTDYYCKSLYWPERGAFFTLPHDTLGLGSGVCPSCKIQDAEKEKDVFKVNSSKSGFLFNGTEYSLDDYVYVSPFEFEEKIEQGTHKSGRNVGLKAYVVCQVLEIVVKKEIKQAEIKSTQVKIRRFFRPEDLSNEKAYCSDIREVYYSDETYIISVESIEGKCQVRKKNDIPECSALGGIFQNVFFCELLYDPATGSLKKLPANIKVKYSSGQTSDAAARKRKGKCIEGDGVSESTKEGKTLNDKRLATLDIFAGCGGLSEGLQQSGVSSTKWAIEYEEPAGDAFKANHPEALVFINNCNVILRAVMEKCGDTDDCISTSEAAELAAKLDEKEISSLPMPGQVDFINGGPPCQGFSGMNRFNQSSWSKVQCEMILAFLSFADYFRPRYFLLENVRNFVSFNKGQTFRLTLASLLEMGYQVRFGILEAGAFGVSQSRKRAFIWAASPEDVLPEWPEPVHVFSAPELKITLSENVQYAAVRSTANGAPLRAITVRDTIGDLPAVGNGASKGNMEYQNDPVSWFQKKIRGDMVVLTDHISKEMNELNLIRCQKIPKRPGADWRDLPEEKIKLSSGQVVDLIPWCLPNTAKRHNQWKGLFGRLDWQGNFPTSVTDPQPMGKVGMCFHPDQDRILTVRECARSQGFPDSYEFAGNIIHKHRQIGNAVPPPLASALGRKLKEAVDSKSST

SEQ ID NO: 21578 - protein, 1536 aa, Cajanus cajan
NDKKSKQKSVASKTEVEVMAKDKQKKRNLSENTAAMRKMPKRAAACTNMKEKSFSISEKSCLIETEEDQIVEEEILAVRMTAGQDDGRPNRRITEFILHGESGTRQPLEMLEVYDLYISGVILPLEASTGKKKEKGVRCEGFGRIESWDISGYEDGSPVIWLSTDVADYECHKPATSYKKYYDHFFEKARACIEVYKKLAKSSGGDPDISLDELLAGMVRSMSDSKCFTGTASIKDFVISQGEFIYKQLIGLDMTSKTNDRMFADIPALVALRDESKKQANYVHAQVMPSDGTLRIGSGIGDEENKNQMDLVASVDEEDEDAKLARLLQEEEYWQSMKQKKNSRSTPTSNKYYIKINEDEIANDYPLPAYYKTSVQEADEFILFDNDYDAYNTEDLPKSMLHNWSLYNSDARLVSLELLPMKPCSDIDVTIFGSGSMTPDDGSGFHLDTEPGQCSSTGSGAQVADGIPIYLSAIKEWMIEFGSSMVFISIRTDLAWYRLGKPSKQYAPWYDTVLKTARLAISIITLLKEQSRVSRLSFGDVIKKVSEFNQKHSSYISSDPLTVERYVVVHGQIILQLFAEFPDDMIRKSAFVTGLANKMEERHHTKWLVKKKKVVPRSEPNLNPRAAVGPIVSKRKAMQATTTRLINRIWGEYYSNHLPEDSKEGTATELKDEDEVEEQEENEDEDNEDETILLEGTPKPHSASKQTKTFSAETEIRWEGEPEGKTSSGYHVYKQAIIHGEVVSVGSSVLVEVEEADELPDIYYVEYMFESKNGRKMFHGRMMQRGFQTVLGNAANEREVFLTNECRDLGLQDVKQTVVVSIQKKPWGHQHRKDNIAADRVDRARAEERKKKRLPTEYYCKSLYWPERGAFFSLPFNTMGLGSGVCPSCKIQDTQKEKDIFKVLSSKSGFLLKGTEYSLNDYIYASPFEFEEKIEQGTHKSGRNVGLKAYVVCQVLEIIVKKEIKQADSRSTQIKIRRFFRPEDVSDEKAYSSDIREVYYSEETHIICVQSVEGKCEVRKKNDISEPSAPGFFQNVFFCEYLYEPASGSLKKLPAHIKVKYSSGQTSDAAARKRKGKCKEGDGVPESDKEGKTLTEKRLATLDIFAGCGGLSQGLHQSGVSSTKWAIEYEEPAGDAFKANHPEALVFINNCNVILRAVMEKCGDTDDCISTSEAAELAAKLDEKEISSLPMPGQVDFINGGPPCQGFSGMNRFNQSSWSKVQCEMILAFLSFADYFRPRYFLLENVRNFVSFNKGQTLRLTLASLLEMGYQVRFGILEAGTFGVSQSRKRAFIWAASPEDVLPEWPEPVHVFSAPELKIKLSENVQYAAVRSTANGAPLRSITVRDTIGDLPPVGNGASKGVMEYQNDPVSWFQKKIRGDIALLTDHISKEMNELNLIRCQRIPKRPGADWRDLPDEKVNLSTGQIVDLIPWCLPNTAKRHNQWKGLFGRLDWQGNFPTSITDPQPMGKVGMCFHPDQDRILTVRECARSQGFPDSYQFCGNIIHKHRQIGNAVPPPLALALGRKLKEAVDSKSFT

SEQ ID NO: 21579 - protein, 1554 aa, Phaseolus vulgaris
MGSASLLDSSEPGEKNAKGKGKLESAVSRRGGEPMAKTKQKKRSLAESTDQPSSSRKMPKRAAACKDLKEKSFSISDKSCRIEIEKDQIVDEEIVAVRLTAGQDDGRPNRRISEFILHDENGNIQPLEMLEVIDLYVTGFILPLEPSIGKKKEKGIKCEGFGRLESWDISGYEDGSPVIWISTDVADYDCQKPAASYRNFYDHFFEKARVCIEVYKKIAKSSGGDPNISLDELLAGMARTMSGNKWLCGAATIKEFVISLGEFVYKQLIGLDLTSKANDMMFADISALIALRDEYMRHGNPAHAQVIPSNGSLRIGSGTGNGEETDQMDSVKPANGEAEDLKLARLLQDEEYWRCMRQNKNYGPLPVANKYYIKINEDEIANDYPLPAFYKTSLQETDEYIVFDNGYDMHGFDDLPRTKLHNWSLYNSDARLVSLELLPMQACSDIDVTIFGSGVMTSDDGCGFNLDSDAGQSSSTTSEPQVAEGMPIYLSAIKEWLIEFGSSMIFTSIRTEMAWYRLGKPSKQYAPWYDTVLKTARLAIAMITLLKEQSRVSRLSFGDVIKKVSESNQEDKSYISSDPLAVERYVVVHGQIILQLFAHFPDDQIRRSPFVTGLMNKMEERHHTKWLVNKRKIFPRSVPNLNPRAAVGPIVSKRKAMQATTTKLINRIWGEYYSNHLPEDSKEGPVSELKEEDELEEQEENEDEDNEEEPILLEGTSKKHSDSKQTKTFSVNAKIKWEGKPEGKTSSGYPIYKQAIINGEVISVGKSVLVEVDEFPDMYYVEYMFESKIGRKMFHGRMMQYGCHTVIGNAANEREVFLTNECRDMGLQDVKQTVVVNIQKRPWGHQHRKDNIIADRVDRARAEERKKKGLPTEYYCKSLYWPERGAFFSLPFDTLGQGSGICSSCKMHDVEKAKDIFTVNSSKSGFLFKGTEYSLNDYVYVSPFEFEEKIEQGTHKSGRNVGLKAYVVCQVLEIVVKREIKHTEIKSTQVKIRRFFRPEDVSSEKAYCSDMQEVYYSDETHIISVDSIEGKCEVRKKRDIPEQSALGMFQNVFFCELLYDPATGSLKKLPAHIKVKYSTGQTSDAAARKRKGKCKEGDDDSESSKEGKTLNEKRLATLDIFAGCGGLSQGLEQSGVSSTKWAIEYEEPAGDAFKANHPEALVFVNNCNVILRAVMEKCGDMDDCISTTEAAELAAKLDEEEISSLPMPGQVDFINGGPPCQGFSGMNRFNQSSWSKVQCEMILAFLSFADYFRPRYFLLENVRNFVSFNKGQTFRLTLASLLEMGYQVRFGILEAGAFGVSQSRKRAFIWAACPDDVLPEWPEPLHVFSAPELKITLSEKVQYAAVRSTASGAPLRAITVKDTIGDLPSVGNGASKGNMEYQNDPASWFQKKIRGEMVVLTDHISKEMNELNMLRCQRIPKRPGADWRDLPAEKVTLSSGQVVDLIPWCLPNTAKRHNQWKGLFGRLDWQGNFPTSITDPQPMGKVGMCFHPVQDRILTVRECARSQGFPDSYKFSGSIIHKHRQIGNAVPPPLAFALGRSLKEAVNSKNKSST

SEQ ID NO: 21580 - protein, 1535 aa, Lotus japonicus
MNRKSQKKPVVSKTKDEVKAGDKKKRSLSKSSEQPAATCKRPKRAAACENFKEKSFSISEKSCLIESKKDQIVDEEILAVRLTCGQDDGRPNRRLTDFILHDESGTAQPLEMLEINDLFITGVISPLEGSTEKKKENGVRCEGFGRIESWDISGYEDGSPVIWISTDIADYDCLKPAPSYKKFYDHFFEKARACIEVYKKLAKSSGGDPDISLDELLAGIARSMSGSKFFSGTASLKDFVISQGEFIYKQLIGLDMSDKTNDKMFADIPALVSLRDESKKQANYAHAQVAPSNGSLRIDSGIEDEEKKDPMDSIPSLAEEDDDVKLARLLQEEENWKSMKQKKNPRSASSNKYYIKINEDEIANDYPLPAYYKTSLQETDEFIVFDNDYDIYDTEELPRSMLHNWTLYNSDARLVSLELLPMKPCSEIDVTIFGSGIMTSDDGSGFHLDTESGQSSSTASGAQETDGMPIYLSAIKEWMIEFGSSMIFISIRTDMAWYRLGKPSKQYAPWYDTVMKTARVATSIITLLKEQSRVSRLSFGDVIKKVAEFTQNHKSYISSDASKVESYVVVHGQIILQLFAEYPDEKIRKSPFISGLVNKMEARHHTKWLVKTKKVLTRSEPNLNPRAAVSIVSKRKAMQATTTKLINRIWGEYYSNHMPEDSKEGTASELKDEDEVEEQEENEDEDAEETICLEGTQKSHSVSTQTKTFSADGEIRWEGEPEGKTCSGNLLYKQAIIHGEVVSVGKSVLVEVDELGELPDIYYVEYMFESKNGKKMFHGRMMQRGCETVLGNTANEGEVFLSNECRDLGLQDVKQTVVVNIQKRPWGHQHRKDNIIADKMDRARAEERKKKGLPTEYYCKSLYWPERGAFFSLPFDTLGLGSGVCHSCKLNEDQKEKDIFKINSSKSGFLLRGTEYSLDDYVYVSPLYFDEKIAQGTYKSGRNVGLKAYVVCQVLEIIVQKEIKKAEIKSTEVKVRRFFRPDDVSNEKAYCSDVQEVYYSNETHIISVESIEGKCEIRKKKDILESSSPGIFQNVFFCEHLYDPATGSIKQLPTQIKVKYSSGHTADAAARKKKGKCTEGDDISDTDKERNLSNEKRLATLDIFAGCGGLSEGLQQSGIASTKWAIEYEEPAGNAFKANHPDALVFINNCNVILRAVMEKCGDLDDCISTTEAAELAAKLDENESSSLPIPGQVDFINGGPPCQGFSGMNRFNQSTWSKVQCEMILAFLSFADYFRPRYFLLENVRTFVSFNKGQTFRLTLASLLEMGYQVRFGILEAGAYGVSQSRKRAFIWAASPEDVLPEWPEPLHVFSAPELKIRLSGNVQYAAVRSTSDGAPLRAITVRDTIGDLPPVGNGASKTNMEYQHDPVSWFQKKIRRDMAVLTDHISKEMNELNLIRCQKIPKRPGADWRDLPDEKIKLSTGQVVDLIPWCLPNTAKRHNHWKGLFGRLDWQGNFPTSITDPQPMGKVGMCFHPDQDRILTVRECARSQGFPDNYQFSGNIIHKHRQIGNAVPPPLAFALGRKLKEAVDSKGST

SEQ ID NO: 21581 - protein, 1559 aa, Lupinus angustifolius
MGSASLQDSSQPSTCSDPGVKSSQEKKKTVDCKTEEEVMARGKQKKRSLPEQSEQPTGTRKMPKRAAASKNLKEKSFSIPGKSCLIETKNDRVVDEELLAIRLTSEQDDGRPNRRLTDFILHDENGTPQPLEVLEVNDLYITGVILPLEGSTEKKKEKERVRCEGFGRIETWDISGYEEGSPVIWLSTDVADYDCLKPAPSYKKIYDHFFEKARACIEVYKKLAKSAGGDPDISLDELLAGIARSMIGSKSFSGTTSVKDFVISQGQFIYKQLIGLDMTSKTKDKMFVDIPALVALRDESKKQANYVHAEVKPSNGSLRIDSGVGDEENKSQMNSMTEVAEEDEDAKLARLLQEEEQWRSMKQKKNPRSVSSSNKYYIKIDEDEIANDYPLPVYYKTSLQETDEFIVFDNDYDVYDIEDLPRSMLHNWSLYNSDARLISLELLPMKSCSDIDVTIFGSGVMTADDGSGFHLDTDTDQSSSISSGALVADGIPIYLSAIKEWMIEFGSSMIFISIRTDMAWYRLGRPSKQYAPWYDTVLKTARLAIDIITLLKGQSRVSRLSFGDAIKKVSEFTPKDKSYISSDPLSVERYIVVHGQIVLQLFAEYPDDTIRKSPFVTGLMSQMEARRHTKWLVKKKKVVPKSEPNLNPRAAVASIVSKRKAMQATTTKLINRIWGEYYSNHLPEDAEEGAASEVKDEDELEEQEENEEEDIEEMLCLEGTQKAHSVSKQIKTFSADSEIRWGGGPEGKTSYGYLLYKEAIIHEEVISVGGSVLVEVDEADELPDIYYVEYMFEAKGGKKMFHGRRMQHGCSTVLGNTANERELFLTNECRDLRLEDVKQAAIVDLRKMPWGHQHRKDNIASDKTDRARAEDRKKKGLPTEYYCKSLYWPERGAFFSLPSDTLGLGSGICHSCNLKEAEREKENFKVNSSKSSFLFNGSEYALHDYIYVSPFDFDERIEQGTHKSGRNVGLKAYVVCQVLEIIVKKEIKQAEMKSTQVKVRKFFRPEDISNEKAYCSDVQEVYYSDETHIISVQSIEGKCEVRKKNDVPACSASGLFQNVFFCEHLYDPATGSLKKLPAHIKVKYSSGHTCDAAARKRKGKSKEGESLPEPEKERKTSDEKRLATLDIFAGCGGLSEGLQQSGIAQTKWAIEYEEPAGDAFRANHPEALVFVNNCNVILRAVMEKCGDTDDCISTSEASELAAKLDEKEIDNLPMPGQVDFINGGPPCQGFSGMNRFNQSSWSKVQCEMILAFLSFADYFRPRYFLLENVRNFVSFNKGQTFRLTLASLLEMGYQVRFGILEAGAFGVSQSRKRAFIWAASPEDVLPEWPEPMHVFSAPELKISLSEGVQYAAVRSTANGAPLRAITVRDTIGDLPPVGNGASKSNMEYGQEPVSWFQRNIRGDMVVLTDHISKEMNELNLIRCQKIPKRPGADWRDLPEEKITLSTGQVVDLIPWCLPNTAKRHNQWKGLFGRLDWDGNFPTSITDPQPMGKVGMCFHPDQDRILTVRECARSQGFPDSYQFSGNIIHKHRQIGNAVPPPLAFALGRKLKEAVESKNSN

SEQ ID NO: 21582 - protein, 1553 aa, Medicago truncatula
MGSASLLNSSDPGVKDSTSKEDPVVSNTEEEDMAGGKQKKRSLSESNEQPAPTRKMPKRSASAASKNLKEKSFSKSDKSDLIETKKDQVVEEEFLAVRMTAGQEDGRPNRRLTDFILHDESGAAQQLEMLELNDLFITGLILPLEASTDKKKEQGVRCEGFGRIESWDISGYEEGAPVIWISTDIADYDCLKPAASYKKYYDQFFEKARACIEVYKKLTKSAGGDPDISLDELLAGLARTMSGSKYFSGAASLKEFIISQGDFIYKQLIGLDMTLKANDKGFTEIPALAALRDESKKQTNFANAQVMPSNATLRIGSGTGDEEKKDQMAVDEEDEDAKLARLLQEEEYWKSKKQRKNPRSSSSSNKFYIKINEDEIANDYPLPAYYKTSLQETDEFIVFDNDYDVYDTEDLPRSMLHNWALYNSDSRLISLELLPMKPCSEIDVTIFGSGVMTSDDGSGFNLDTEAGQSSSASGEQATDGIPIYLSAIKEWMIEFGSSMVFISIRTDMAWYRLGKPSKQYSPWYDTVLKTARIAISIITLLKEQSRVSRLTFGDVIKKVSEFSQDNKSYISSDPLAVERYVVVHGQIILQLFAEFPDEKIRKCPFVAGLTSKMEARHHTKWLMKKKKVLPRSEPNLNPRAAMAPVVSKRKAMQATTTKLINKIWGEYYSNHLPEDSKEVIASEVKDDDDEAEEQEQEENDDEDAEVETVLLEGMQKPHSVSKQTKAFSDDGEIRWEGGPEGKTSSGLLLYKQAIIHGEVVSIGTSVSVEVDESDELPDIYYVEYMFESKGGKKMFHGRMMQHGCQTVLGNAANEREVFLTNECRDLGLQNVKQINVASIRKTPWGHQHRKNTIIADKIDRERAEESKKKGLPTEYYCKSLYWPERGAFFSLPFDTLGLGSGVCQSCQLQEAEEEKDVFKINSSKSSFVLEGTEYSLNDYVYVSPFEFEEKIEQGTHKSGRNVGLRAYVICQVLEIIAKKETKQAEIKSTDIKVRRFFRPEDVSSEKAYCSDVQEVYYSDEACTISVQSIEGKCEVRKKIDVPEGCAPGIFHNIFFCELLYDPATGALKKLPAHIKVKYSTGHTADAAARKKKGKCKEGDNISEPDPERKTSNEKRLATLDIFAGCGGLSEGLHQSGVSSTKWAIEYEEPAGNAFKANHPEALVFINNCNVILRAIMEKCGDIDDCITTTEAAELASKLDEKDLSNLPLPGQVDFINGGPPCQGFSGMNRFNTSTWSKVQCEMILAFLSFADYFRPRYFLLENVRNFVSFNKGQTFRLTLASLLEMGYQVRFGILEAGAFGVSQSRKRAFIWAASPEDVLPEWPEPMHVFSAPELKITLSENVQYAAVRSTANGAPLRAITVRDTIGELPVVGNGASRTNMEYQSDPVSWFQKKIRGNMAVLTDHISKEMNELNLIRCQKIPKRPGCDWRDLPEEKIKLSSGQLVDLIPWCLPNTAKRHNQWKGLFGRLDWQGNFPTSITDPQPMGKVGMCFHPDQDRILTVRECARSQGFPDRYQFYGNIIHKHRQIGNAVPPPLAFALGTKLKEAVDSKSSK

SEQ ID NO: 21583 - protein, 1579 aa, Medicago truncatula
MGSASLLNSSDPGNVDDYDAYKSLICISRSAPIPCVAFTLLSLDPVVSNTEEEVMAGGKQKKRSLSESSEQPAPTRKMPKRSASATSKNLKEKSFSKSDKSDLIETKKDQVVEEEFLAVRMTAGQENGRPNRRITDFILHDESGAAKQLEMLEINDLFITGLILPLEASTYKKKEQGVRCEGFGRIESWAISGYEEGAPVIWISTDIADYDCQKPAASYKKYYDQFFEKARACIEVYKKLTKSAGGDPDISLDELLAGLARSMSGSKYFSGAASLKEFIISQGDFIYKQLIGLDMTLKANDKGFTEIPALSALRDESKKQANFANAQVMPSNATLRIGSGTGNEEKKDQMDSVDEEDEDAKLARLLQEEEYWKSKKQRKNPRSSSSSNKFYIKINEDEIANDYPLPAYYKTFLQETDEFIVFDNDYDVYDTDDLPRSMLHNWVLYNSDSRLISLELLPMKPCSEIDTIFGSGVMTSDDGSGFNLDTEAGQSSSASGEQATNGIPIYLSAIKEWMIEFGSTMVFISIRTDMAWYRLGKPSKQYSPWYDTILKTARVAISIITLLKEQSRVSRLSFGDVIKKVSEFSQDNKSYISSDALAVETYVVVHGQIILQLFAEFPEEKIRKCPFVAGLTSKMEARHHTKWLMKKKKVLPRSEPNLNPRAAMAPVVSKRKAMRATTTKLINKIWGEYYSNHLPEDSKEVIASEVKDDDDEAEEQEQEQEQEENEDEDAEVETVLLEGMQKPHSVSKQTKAFSDDGEIRWEGVPEGKTSSGLFLYKQAIIHGEVVSVGISVSVAVDASDELPDIYYVEYMFESNGGKKMFHGRMMQHGCQTVLGNAANEREVFLTNECRDLGLQDVKQINVVSIQKTPWGHQHRKDNIIADKIDRERAEERKKKGLPTEYYCKSLYWPERGAFFSLPFDTLGLGSGVCQSCKLQEAEKEKDVFKVNSSKSSFVLEGTEYSLNDYVYVSPFEFEEKIEQGTHKGGRNVGLRAYVICQVLEIIAKKETKQAEIKSTDIKVRRFFRPEDVSSEKAYCSDVQEVYYNDETCTISVQSIEGKCEVRKKIDVPEGCAPGIFHNIFFCELLYDPATGALKKLPAHIKVKYSTGHTADAAARKKKGKCKEGDNISKPDLERKTLNEKRLATLDIFAGCGGLSEGLHQSGVSSTKWAIEYEEPAGNAFKANHPEALVFINNCNVILRAIMEKCGDIDDCISTTEAAELSSKLDEKDLSNLPLPGQVDFINGGPPCQGFSGMNRFNTSTWSKVQCEMILAFLSFADYFRPRYFLLENVRNFVSFNKGQTFRLTLASLLEMGYQVRFGILEAGAFGVSQSRKRAFIWAASPEDVLPEWPEPMHVFSAPELKITLSENVQYAAVRSTANGAPLRAITVRDTIGELPAVGNGASRTNMEYQSDPVSWFQEKIRGNMAVLTDHISKEMNELNLIRCQKIPKRPGCDWRDLPDEKIKLSSGQLVDLIPWCLPNTAKRHNQWKGLFGRLDWQGNFPTSITDPQPMGKVGMCFHPDQDRILTVRECARSQGFPDCYQFYGNIIHKHRQIGNAVPPPLAFALGTKLKEAVDSKSAK

SEQ ID NO: 21584 - protein, 327 aa, Phaseolus vulgaris
MRSTMLKCITIVLVVYLMNQNAHCELQVGFYSYSCGMAEFIVKDEVRKAVSNNPGIAAGLVRMHFHDCFIRGCDASVLLDSTPSNTAEKDSPANKPSLRGYEVIDHAKAQLEAVCPGIVSCADIVAFAARDSVELAGGLGYDVPAGRRDGRISLASDTRTELPPPTFNVNQLTQLFARKGLTQDEMVTLSGAHTIGRSHCSSFSNRLYNFSGTSSKDPSLDPSYAALLKRQCPQGSTNPNLVVPMNPSSPGIADVGYYVDILSNRGLFTSDQTLLTNAETASQVKQNARDGYQWASKFADAMVKMGQISVLTGNAGEIRTNCRVVSS

SEQ ID NO: 21585 - protein, 327 aa, Vigna unguiculata
MRSTMLKCITIVSVIYLLNQNAHCELQVGFYSYSCGMAEFIVKDEVRKAVSTNPGFAAGLVRMHFHDCFIRGCDASVLLDSTPSNTAEKDSPANKPSLRGYEVIDHAKAKLEAVCPGIVSCADILAFAARDSVEFAGGLGYDVPAGRRDGRISLASDTRTELPPPTFNVNQLTQLFARKGLTQDEMVTLSGAHTIGRSHCSSFSNRLYNFSASSRQDPSLDPSYAALLKRQCPQGSTNPNLVVPMNPSSPGIADVGYYVDILSNRGLFTSDQTLLTDAETASQVEQNARDSYQWASKFADAMVKMGQISVLTGNAGEIRTNCRVVSS

SEQ ID NO: 21586 - protein, 327 aa, Cajanus cajan
MKSKKLKCITIIFLIYLLNQNAHCELQVGFYSYSCGMAEFIVKDEVRNSVTRNPGLAAGLVRMHFHDCFIRGCDASVLLDSTPSNTAEKDSPANKPSLRGYEVIDNAKAKLEAVCPGVVSCADIVAFAARDSVELAEGVGYDVPAGRRDGRISLASDTRTELPPPTFNVNQLTQLFAKKGLTQDEMVTLSGAHTIGRSHCTAFSSRLYNFSSTSSQDPSLEPSYAARLKRQCPQGSTNPNLVVSMDPSSPAIADVGYYLNILTNRGLFTSDQTLLSNAETASQVNQYARNSYLWANKFADAMVKMGQISVLTGNAGEIRTNCRVVNG

SEQ ID NO: 21587 - protein, 327 aa, Lupinus angustifolius
MSSRKLNCVIIVLVTYLLSQNAHSELQVGFYSYSCGMAEFIVKDEVTKSYNGNPGIAAGLVRMHFHDCFIRGCDASVLLDSTPSNTAEKDSPANKPSLRGFEVIDNAKARLEEMCKGIVSCADIIAFAARDSVELARGLGYDVPAGRRDGRISLVSDTRTDLPPPTFNVNQLTQLFAKKGLTQEEMVTLSGAHTIGRSHCSAFSNRLYNFSATSRQDPSLDPSYAALLKRQCPQGNTNQNLVVPMDPSSPGTIDAGYYSDILVNRALFTSDQTLLTNTETASQVNQNARDPYQWASKLADAMVKMGQIGVLTGNAGEIRTNCRVVNS

SEQ ID NO: 21588 - protein, 324 aa, Lotus japonicus
MKFNCAIIVLVIFLLNQNAYSELEVGYYSYSCGMAEFIVKDEVRRSVTKNPGIAAGLVRMHFHDCFIRGCDASVLLDSTPSNTAEKDSPANKPSLRGFEVIDSAKAKLEAVCKGVVSCADIIAFAARDSVELAGGVGYDVPAGRRDGRISLASDTRTDLPPPTFNVNQLTQLFAKKGLTQEEMVTLSGAHTIGRSHCAAFSSRLYNFSSTSRQDPSLDPSYVSLLKRQCPQGSTNQNLVVPMDPSSPGVADAGYYIDILANRGLFTSDQALLTNTHTASQVNQNARDPNLWANKFADAMVKMGQISVLTGNAGEIRESCRVVNS

SEQ ID NO: 21589 - protein, 327 aa, Medicago truncatula
MNPKKLNYAIIVLVIYFLNGNAHSQLEVGFYTYSCGMAEFIVKDEVRKSFNKNPGIAAGLVRMHFHDCFIRGCDASVLLDSTLSNIAEKDSPANKPSLRGFEVIDNAKAKLEEECKGIVSCADIVAFAARDSVELAGGLGYDVPAGRRDGKISLASDTRTELPPPTFNVNQLTQLFAKKGLTQDEMVTLSGAHTIGRSHCSAFSKRLYNFSSTSIQDPSLDPSYAALLKRQCPQGNTNQNLVVPMDPSSPGTADVGYYNDILANRGLFTSDQTLLTNTGTARKVHQNARNPYLWSNKFADAMVKMGQVGVLTGNAGEIRTNCRVVNS

SEQ ID NO: 21590 - protein, 327 aa, Cicer arietinum
MYPKKLNYVITILVIYFLNVSAHSQLEVGFYSYSCGMAELIVKDEVRKSFNKNPGIAAGLVRMHFHDCFIRGCDASVLLDSTPSNTAEKDSPANKPSLRGFEVIDNAKAKLEAVCNGTVSCADIIAFAARDSVELAGGIGYDVPAGRRDGKISLASDTRTDLPPPTFNVNQLTQLFAKKGLTQEEMVTLSGAHTIGRAHCSAFSNRLYNFSSTLKQDPNLDSSYVPLLKRQCPQGNTNPNLAVPMDPSSPGTADVGYYINILEDRGLFTSDQTLLTNTGTARQVNKNARNPYLWADKFADAMVKMGQIGVLTGNAGEIRTNCRMVNS

SEQ ID NO: 21591 - protein, 668 aa, Glycine max
MAETLSPNPTMDQKQRLRILSPTSPFILGSNDDKLERAQARDARATAIRRKSLALNQPLQPNSDPCLNKQQIIDLFQNCIKLASENKINQKNTWELNLIDHLTDIIKAEEENDAETNFQKASCTLEAGVKIYSLRVDSVHSEAYKVLGGMNRAGQEAEEDTTLNGVNIESGQVESRKETSKKLSPLSTLESSFEALNVKKFDAAFVVDPLYRQTTAKFDEGGAKGLLMNNLGVYGDCRVLFDSQEVPAKCMASQNQSDISDTIDLSFAKDCIDQMVLDMRVKDEISPSLRTIVNQFDESNRRPADIQLQGQNSAEDLDNADNNENGFYREEYENCMAWSDDRDDQTVVADPGYNDADPSFPSYPQDNDEPFPSPEIDMDGRFENVDGYLFLSLGFSSKQNAWAGPDHWKYRKSKVSEVHPTSEDGSTLKSRQPKSKRQTEVDLNFTNSLEKKMLDTFSPPKNPKLLLLPESRLPCNTKLPEDCHYQPEDLVKLFLLSNVKCLGRKANRFSDGSREQSDEYESFPSWDNGSVCGDDAGDYGGDLHGDMEDTDTLVTQPRQVSKIEVQYDKTSKQVDVHALKITLWDHVQESVKLPLEGQKDTLSFRNILANFPSECNAAATISDISPHLCFICLLHLANEKGLSIQNSPNLDDLAIRFPQVADSMRGTV

SEQ ID NO: 21592 - protein, 667 aa, Phaseolus vulgaris
MAETLSPNPLVGQKQRFRIQSPTANFFLGSNNDQLERAEARAARAAAIRRKSLGFSQPLQANSDPCLNKQQILDLFQNCIKLASENKINQKNTWELNLIDHLTDIIKGEQEDDAETNFQKASCTLEAGVKIYSLRVDSVHSEAYKVLGGMNRAGQEAEQDTSLDGVNIESGQEENRKETSKKLSPLSTLESSFEALNVKKFDAAFVVDPLYRQTTAKFDEGGAKGLLMNNLGVYGGCRVLFDSLEVPAKCMAKQNQSDISDTIDLSFVKDCMEQMVLDMRVKDEISPTLRTIVSLFDESNRRPTDVQHHDKNSAEDLDASSFNNESGFDREEYGNSMTWSDDHDDQTVVADVGYNDDDPSFPNYPQDNDEPFPSPDADMDDRFDNVDGYLFLSLGFNSKQNAWAGPDHWKYRKSKASEVHPTSEDGSIIKSRLPKSKRQAEVELNFTNSLEKEMLDIFSTPKNPKSLLLPESRLPCNTKLPEDCHYHPEDLVKLFLLSNVKVVSFMFFSDGSREQSNEYESFPSWDNGSVGGDDYGDYGGDLHSDMEDSNTLITQPRQVNKIEVQYDKTSKQVDVHALKITIWDHVQESVKLPLQGQKDTLSFRNILANFPSECNAAATISDISPHLCFICLLHLANEKGLSIQNCSNLDDLTICLPHVADSLRGTV

SEQ ID NO: 21593 - protein, 668 aa, Cajanus cajan
MAEALSPNPTVGPKQRLRIQSPTSPFFLGSNDDQLERAQARAARAAAIRRRSLALNQPLQANSDPCLNKQQILDLFQNCIKLASENKINQKNTWELNLIDHLTDIIKAEEENDAETNFQKASCTLEAGVKIYSLRVDSVHSEAYKVLGGMNRAGQEAEQDTTLEGDNIESGQEESRKEPNKKLSPLTTLESSFEGLNAKKFDAAFVVDPLYRQTTAKFDEGGAKGLLMNNLGVYGGCRVLFDSLEVPAKYMGSQNQSDISDTIDLSFVRDCIEQMVLDLRVKDEISPTLRTIVNQFDENNRRPIDFQLHSQDAAEDHDAAFNDVNGFDHDDHDENCTAWGDDHDDQTDVPDLGCNDADPSFPSYPQDNEPFSSPDGDMDERFENVDGYLFLSLGFSSKQNAWAGPDHWKFRKSKVSEVHPTSEDGSTLKSRQTKSKRQAEVDLNFTNSLEKKMLDIFSPPKNPKLLLLPESRLPCNTKLPEDCHYQPENLVMLFLLSNVKCLGRRANKFSDGSREQYNEYESVPSWDNGSVCGDDSGGYEGDLHSDMEDSNNLINQPRQVNKIEVQYDKTSKQVDVQALKFTLWDHVQESVKLPLQDQKDTISFKNILANLPSECNAAATISDISPHLCFICLLHLANEKGLSIQSCPDLDDLAIRLPHVADSIRGTV

SEQ ID NO: 21594 - protein, 674 aa, Lupinus angustifolius
MAETLSPNPGGQKQRLPMAARIQSPTSPFFLGSNDDQLERARARAARAAAIRSRNVSANLNSQSQDSDPCLDKQQILDLFQNCIKLASENKINQKNTWGLNLIDHLTDIIKAEEEGDSTETNFQKASCTLEAGVKIYSLRVDSVHSEAYKVLGGMNRAGQEAEQETPLEVANVESGQEESRKETNKKLSPLSTLESSFEVLNVKKFDAAFVVDPLYRQTTARFDEGGAKGLLMNNLGVYGGCRVLFDSQEVPARCMASQNQHDVSDTIDLSFMKDCVEQMVSDMRMKDEISPTIRTIVNQFDENNRRPTNFQIDGQNSAEDLDAAFDCEIESDRVEYENYTAWTDDHDNQTFVADLGSNDADPSFPSYPEENEGFPSQGQDPDMDDRFENVDGYLFFSLGFSSKQNAWAGPDHWKYRKSKVTEVHPTNEDGPTLKTKQPRSKKQAEVDLNFTSSFEKKMADIFAPPKNPKSLLLPESRLPCNTKLPEDCHYQPEDLIKLFLLPNVKCLGRRAKRFSDGSREQPNDYEAFPSWDNGSACGGEPGDYEGDFHSDIEDSGTLITQPRQVNKIEVQYDKTSKRIDVQALKITLWDHVQESAKLPLQDQNGTVSFKNMLANFPGECNAAAAISDISPHLCFICLLHLANEKGLSIQSCSNLDDLAICLPHVDDAISGAV

SEQ ID NO: 21595 - protein, 426 aa, Glycine max
MEFLKIKKFRKSQKANGEKDLADKAVPEPEEPKLNTDGPDQCKSENADSAGEAEDDDDFITNEVKRRLKELRRNSFMVLIPEEDSCPEEGEDEEEEEAGETCSNEWRDVEAEGQQWWRGFDAVFEKYCERMLFFDRMSTQQLSEVGKGSQYTSTPSPRSASKKLASPLRCLSLKKFEEPDDETEHLQQPEHDPYQDIETAYVGQICLTWEALHCQYSHMSQKISWQHDNPTCYNHSAQEFQQFQVLLQRFIENEPFEQGRRAEIYARTRNNLPKLLQVPNIRGSDHELTDDSEMRVLAPDLIGIIESSILTFHLFMKRDKKKSSGATNQNQLDTPLQQIQSTLEKKVVKLKELRRKKKNWKKNSWPQKHEDIQVLLGLIDVKILSRVLRMTRMTREQLFWCEEKMKKLDLSNSRLERDPCPILFPC

SEQ ID NO: 21596 - protein, 428 aa, Cajanus cajan
MEFLKIKKFRKSHKADGDKDLADKAAPEPEEPKLNTDGSDQCKSENADSAGEAEDDDDFITNEVKRRLKELRRNSFMVLIPEEDSCPEDGEDEEEEGETSSNEWRDVEAEGQQWWRGFDAVFEKYCERMLFFDRMSTQQLSEVGKGLRHTSTPSPRSASKKLASPLRCLSLKKFEGPDDETEHLQQPENDPYHDIETAYVGQICLTWEALHCQYSHMSQKISWQHDNPTCYNHSVQEFQQFLVLLQRFIENEPFEQGHRAEIYARTRNNLPKLLQVPNIRGSDHVLTDDSETKVLAPDLIRIIESSILTFHLFLKRDKKKSSGATNLFGNQNQLATPLQQIHSTLEKKVVKLKELRRKKKGWKKNSWPQKHEDIQLLLGLIDVKILSRVLRMTRMTREQLFWCEEKIKKLDLSNNRLERDPCPVLFPC

SEQ ID NO: 21597 - protein, 430 aa, Cicer arietinum
MDFLKIKKFRKSQKADIKKDLAEKAVLEPDELKPNSGGPDQCKSENADSAGDAEDDDDFITNEVKRRLKELRRNSFMVLIPEEDSCLEEGEDEEDEGEAVSNEWRDVEAEGQQWWRGFDAVFEKYCERMLFFDRMSVQHLSEIGKGSQNTSTPSPSPRSTSKKLASPLRCLSLKRFEEPDDETEHLQHPENNPYQDIETAYVGQICLTWEALHCQYSHMSYKISWQHENPTCYNRSAQEFQQFQVLLQRFIENEPFEQGLRPEIYARTRNTLPKLLQVPNIRGSDHELTDDSDMRVLAPDLIGIIENSILTFHLFLKRDKKKSSGVSNLFGNQNQLATPLQQVQSTLEKKVVKLKELRRRKKGWRKNSWPQKHEDIQLLLGLIDVKIISRVLRMTRMTREQLFWCEEKMKKLDLSNSRLERDPCPILFPC

SEQ ID NO: 21598 - protein, 430 aa, Trifolium pratense
MDFLKIKKFRKSQKPGVEKDLVDRAVPEPEESRPNTGDLDQCKSENADSAGDAEDDDDFITNEVKRRLKELRRNSFMVLIPEEDSCLEEGEDEEEEGETVSNEWRDVEAEGQQWWRGFDAVFEKYCERMLFFDRMSVQHLSEIGKGSQNTSTPSPSPRSTSKKLASPLRCLSLKRFEEPDDETEHLQQPENHPYLDIETAYVGQICLTWEALHCQYCHMSYKISWQNENPTCYNRSAQEFQQFQVLLQRFIENEPFEQGLRPEIYARTRNTLPNLLQVPNIRGSDHELTDESDMRVLAPDLITIIENSILTFHLFLKRDKKKSSGVINLFGNQNQLATPLQQVQSTLEKKVAKLKELRKRKKGWRKSSWPQKHEDIQLLLGLIDAKILSRVLRMTRMTREQLFWCEEKMKKLDLSNSRLERDPCPILFPC

SEQ ID NO: 21599 - protein, 428 aa, Trifolium pratense
MDFLKIKKFRKSQKPGVEKDLVDRAVPEPEESRPNTGDPDQYKSENADSAADAEDDDDFITNEVKRRFKELRRNSFMALIPEEDSCLEEGEDEEEDSETVSNEWRDVEAEGLQWWRGFDAVFEKYSERMLFFDRMSAQHLGEIGKGSQNTSTPSPRSTSKKLASPLRCLSLKKFEEPDDETEHLQQPENNPYLDIETAYVGQICLTWEALHCQYCHMSYKISWQHENPTCYNRSAQEFQQFQVLLQRFIENEPFEQGLRPEIYARTRNTLPKLLQVPNIRGSDQELTDESDMRVLAPDLIRIIENSILTFHLFLKRDKKKSSGVINLFGNQNQLATPLQQVQSTLEKKVAKLKELRKRKKGWRKSSWPQKHEDIQLLLGLIDAKILSRVLRMTRMTREQLFWCEEKMKKLDLSNSRLERDPCPILFPC

SEQ ID NO: 21600 - protein, 425 aa, Medicago truncatula
MDFLKIKKFRKSQKAGVVKDLVDKAVSEPEEPKPSTGDPDQCKSENADSCADAEDDDDFITNEVKRRLKELRRNSFMVLIPEEDSCLEEGEDEEEEGETVPNEWRDVEAEGQQWWRGFDAVFEKYCERMLFFDRMNVQHLGEIGKGSQNTSTPSPRSTSKKLASPLRCLSLKKFEGPDDETEHLQEPENIPYLDIETAYVGQICLTWEALHCQYSHMSYKISWQHENPTCYSRSAQEFQQFQVLLQRFIENEPFEQGPRPEIYARSRNTLPKLLQVPNIRGSDHEITDESDIRVLAPDLIRIIENSILTFRLFLKRDKKKSSVINLFGNQNQLATPLQQVQSTLEKKVVKLKELRKKGWRKNSWPQKHEDVQLLLGLIDAKILSRVLRMTRMTREQLFWCEEKMKKLDLSNNRLERDPCPILFPC

SEQ ID NO: 21601 - protein, 429 aa, Arachis hypogaea
MDFLKIKKFRKSQKADGGKDLVNKDVLEPEEPKPNSGGPDQCKSVNADPVAETEDDDDFITNEVKRRLKELRRNSFMVLIPEEDSCPEEGEDEEDEGETSSNDWRDVEAEGQQWWRGFDAVYEQYCERMLFFDRMSTQQLNEVGKGPQYPSTPSPRSASRKLASPLRCLSLKKFEGPDDETEHLQQPEHDPYQDIETAYVGQMCLTWEALHCQFSHLSHKISWQPENPTCYNHSAQQFQQFQVLLQRFIENEPFEQGLRAEIYARTRNTLPKLLQVPNIQGSEHEFIDESDSRVLAPDLVKIIESSILTFHQFLKRDKKKSGGVINLFGNQSQLATPLHQVQSTLEKKVLKLKEVRRKKKGWKKNSWPEKHEDIQLLLGLIDVKILSRVLRMTRMSREQLFWCEEKIKKLDFLSNGRLERDPCPSLFPC

SEQ ID NO: 21602 - protein, 428 aa, Lupinus angustifolius
MDFLKIKKFIKSHTADGENGLADKAVPEPEEPKPNTVGPDWCKSENDDSVTEAEDDDDFITNEVKRRLKELRRNSFMVLIPEEDSCPEEGEDKEEAGETGFNEWRDVEAEGQQWWRGFDAVFEKYCERMLFFDRMSMQQLNEVGKGTQPPLTPSPRSASKKLASPFRCLSLKKIEEPDDEMEHLQQPENDPYQDIETAYVGHICLTWEALHCQYSHMSQKISWQPENPTCYNHSTQQFQQFQVLLQRFIENEPFEQGARAEIYARTRKTLPKLLQVPNIQGSDPKSTDESDMRVLAPDLIKAIESSILTFYLFLKRDKKKSSSTINLFGNQSQLSTPLHQVQSTLEKKVVKLKELRRKKKGCKMNCWPQKHEEIQLLLGLIDMKILSRVMRMTKISREQLFWCEEKMKKVDVSNSKLERDPCPILFPC

SEQ ID NO: 21603 - protein, 962 aa, Glycine max
MTVKTPGTPASKIDRTPVSTLGAARAREEKIVVTVRLRPLNRREQLAKDQVAWDCINDYTIVYKPPAHERTSQPASFTFDKVFGPASVTEAVYEEGVKKVALSALTGINATVFAYGQTSSGKTYTMRGITEKAVYDIYKHIMNTPERDFTIKISGLEIYNENVRDLLNSESGRSLKLLDDPEKGTVVEKLVEETAKDDKHLRHLISICEAQRQVGETALNDNSSRSHQIIRLTIQSTLRENADCVKSFVATLNFVDLAGSERAAQTHADGTRLKEGCHINLSLMTLTTVIRKLSVGKRSGHIPYRDSKLTRILQHSLGGNARTAIVCTLSPALSHVEQSRNTLLFATRAKEVTNNAQVNVVVSDKQLVKHLQKEVARLEAVLRTPDPSKEKDWKIQQMEMEIEELRRQRDLAQTQADELRRKLQDDQKVSNPVESPHLPVKKCLSFTGALSSLKPELGCERVRSSTLRQSMRQSSTAPFTLMHEIRKLEHLQEQLGEEANRALEVLQKEVACHRLGNQDAAETIAKLQAEIRGMRAVRSTTPKNVEVGSMVSINKSVSANLKEEITRLHSQGSTIANLEQQLENVQRSIDKLVMSLPNNFQHSPSEASPKNKKEHKRKKLLPLSSSNAANRQNFLRSPCSPLSTTQQVLESDIENRVPENDDIVSTDTLPESEKETPSKSEEAGDVSSKENTPGYRRSSSVNMKKMQKMFQNAAEENVRSIRAYVTELKERVAKLQYQKQLLVCQVLELEANEANGHNIDNEEYSCEPEEPQVSWQITFKEQQQEILELWDLCYVSIIHRTQFYLLFKGDPADQIYMEVELRRLTWLQQHLAELGNASPAPHVGEEPTISLSSSIRALKREREFLAKRLTTRLSLEEREALYMKWDVPLDGKQRKMQFISKLWTDPHDQIHVQESAEIVARLVGFRTGGNMSKEMFELNFVLPSDKRPWLMGWNHLTNLLNL

SEQ ID NO: 21604 - protein, 961 aa, Cajanus cajan
MTMKTPGTPASKIDRTPVSTPGGARAREEKIVVTVRLRPLNRREQLAKDQVAWDCINDYTIVYKPPTHDRASQPASFTFDKVFGPASLTEAVYEEGVKKVALSALTGINATVFAYGQTSSGKTYTMRGITEKAVNDIYEHIMNTPERDFTIRISGLEIYNENVRDLLNSESGRSLKLLDDPEKGTVVEKLVEETAKDDQHLRHLISICEAQRQVGETALNDNSSRSHQIIRLTIQSTLRENADCVKSFVATLNFVDLAGSERAAQTHADGTRLKEGCHINLSLMTLTTVIRKLSVGKRSGHIPYRDSKLTRILQHSLGGNARTAIVCTLSPALSHVEQSRNTLLFATRAKEVTNNAQVNVVVSDKQLVKHLQKEVARLEAVLRTPDPSKEKDWKIQQMEMEIEELKRQRDLAQIQVDELRRKLQDDQKVSNPVESPHLPVKKCLSFTGALSSLKPELGCERVRSSTLRQSIRQSSTAPFTLMHEIRKLEHLQEQLGEEANRALEVLQKEVACHRLGNQDAAETIAKLQAEIREMRSVRSTPKDVEVGSMVSVNKSVSANLKDEITRLHSQGSTIANLEQQLENVQRSIDKLVMSLPNNFQHSPSEASPKNKKEHKRKKLLPLSSSNITNRPNFLRSPCSPLSTTQQVLESDIENIAPENDDLVSIDTLPESEKETPSKSEETGDVSSKENPSGYRRSSSVNMKKMQKMFQNAAEENVRSIRAYVTELKERVAKLQYQKQLLVCQVLELEANEANGHNIDNEEYPCEPEEPQVSWQITFKEQRQQILELWDLCYVSIIHRTQFYLLFKGDPADQIYMEVELRRLTWLQEHLAELGNASPAPHVGEEPAISLSSSLRALKREREFLAKRLTSRLSLEEREMLYMKWDVPLDGKQRRLQFISKLWTDPHDQNHVQESAEIVAKLVGFQTGGNMSKEMFELNFVLPSDKRPWLMGWNPISNFLNL

SEQ ID NO: 21605 - protein, 962 aa, Cicer arietinum
MTVKTPGTPASKIDRTPVSTPGGPRSREEKIVVTVRLRPLNRREQLAKDQVAWDCIDDYTIVYKPPPHERASQPASFTFDKVFGPASVTEAVYEEGVKNVALSALMGINATVFAYGQTSSGKTYTMRGITEKAVNDIYNHIMNNPERNFTIKISGLEIYNENVRDLLNSEPGRSLKLLDDPEKGTVVEKLVEETAKDDKHLRHLISICEAQRQVGETALNDNSSRSHQIIRLTIQSTHREEADCVKSFVATLNFVDLAGSERAAQTHADGTRLKEGCHINLSLMTLTTVIRKLSVGKRSGHIPYRDSKLTRILQHSLGGNARTAIICTLSPALCHVEQSRNTLYFATRAKEVTNNAQVNMVVPDKQLVKHLQKEVARLEAVLRTPDPSKEKDWKIQQMEMEIEELKRQRDQAQTQVDELRRKLQEDQQVSKPLEPAHASAKKCLSFTGALSSPKPGLGCERVRNASLRQSMRQSSTAPFTLMHEIRKLEHLQEQLGEEANRALEVLQKEVACHRLGNQDAAETIAKLQAEIREMRSVKPIPKEIVVGSMVSVHKSVSANLKEEITRLHSQGSTIANLEQQLENVQRSIDKLVMSLPNNFQTLTSEASPKHKKEHKRKKLIPLSSSNTANRPNFIRSPCSPLSTTQQVLEIDIENKAPENDDNVSTEIHPDSEKDTTPLKSEETGDVTSRENTPGYRRSSSVNMKKMQKMFQNAAEENVRSIRAYVTELKERVAKLQYQKQLLVCQVLELEANEASGHNIEDEVYTGELEEPQVSWQVTFREQQQQILELWDACYVSIIHRTQFYLLFKGDQADQIYMEVELRRLTWLQQHLAELGNASPAPHAGDEPTVSLSSSMRALKREREFLAKRLISRLAPEEREALYIKWDVPLDGKQRKMQFVSKLWTDPYDRKHVQESAEIVAKLVDFCTGGNMSKEMFELNFVLPSDKRPWLMGWNHLTNLLNL

SEQ ID NO: 21606 - protein, 964 aa, Medicago truncatula
MTVKTPGTPASKIDRTPVSTPGGPRAREDKIVVTVRLRPLNRREQLAKDQVAWDCIDDYTIMYKPPPNERATQPASFTFDKVFGPASITDAVYEEGVKNVALSALMGINATVFAYGQTSSGKTYTMRGITEKAVNDIYNHILNNPERNFTIKISGLEIYNENVKDLLNSEPGKSLKLLDDPEKGTVVEKLVEETARDDQHLRHLISICEAQRQVGETALNDNSSRSHQIIRLTIQSTLRETADCVKSFVATLNFVDLAGSERAAQTHADGTRLKEGCHINLSLMTLTTVIRKLSIGKRSGHIPYRDSKLTRILQHSLGGNARTAIICTLSPALSHVEQSRNTLYFATRAKEVTNNAQVNMVVPEKQLVKHLQKEVARLEAALHTPDPSKEKDWKIQQMEMEIEELRRQRDQAQTQVDELRRKLQEDQQVSKPLEPAHPSVKKCLSFTGALSSPKPGLGCERVRNTSLRQSMRQSSTAPFALMHEIRKLEHLQEQLGEEANRALEVLQKEVACHRLGNQDAAETIAKLQSEIREMRSVKPIPKEVVVGGMVSVHKSVSANLKEEITRLHSQGSTIANLEQQLENVQRSIDKLVMSLPNNFQTLTSEASPKNKKEHKRKKLIPLCSSNSTNRPNFIRSPCSPLSTTQQVMESDIENKAPENDDNVSTEIHPESEKNTPTKSEDAGDVTSKENTPSPGYRRSSSVNMKKMQKMFQNAAEENVRSIRAYVTELKERVAKLQYQKQLLVCQVLELEANEASGQDIEEEVYTGEPEEPQVSWQVTFKEMQHQILELWDVCYVSIIHRTQFYLLFKGDPADQIYMEVELRRLTWLQQHLAELGNASPAPTVGGDELTISLSSSMRALKREREFLAKRLISRLTPEEREILYMKWDVPLDGKQRKMQFVSKLWTDPCDQRHVQESAEIVAKLVGFCTGGNMSKEMFELNFVLPSDKRPWLMGWNHLTNLLNL

SEQ ID NO: 21607 - protein, 961 aa, Lupinus angustifolius
MTVRTPGTPASKIDRTPVSTPGGPRVREEKIVVTVRLRPLNRREQLAKDQVAWDCVDDYTIVYKSPSHERTAQSASFTFDKVFGPACLTESVYEGVKNVALSALMGINSTIFAYGQTSSGKTYTMRGITEKAVNDIYEHIMNTPERNFTIKISGLEIYNENVRDLLNSESGRNLKLLDDPEKGTVVEKLVEETAKDDKHLRHLISICEAQRQVGETALNDNSSRSHQIIRLTIQSAQRENADCVRSFVATLNFVDLAGSERAAQTQADGTRLREGCHINLSLMTLTTVIRKLSVGKRSGHIPYRDSKLTRILQHSLGGNARTAIICTLSPALSHLEQSRNTLFFATRAKEVTNNAQVNMVVSEKQLVKHLQKEVARLEAELCTPDPSKEKDWKIQQMEMEIEELRRQRDLAHAQVDELRKKLQDDQQQVSNQLESQHLPVKKCLSFTGAALPKPKLGSERVRNTILRQSMRQSSTAPFTLMHEIRKLEHLQEQLGEEANRALEVLQKEVACHRLGNQDAAETIAKLQAEIREMRFVRPAPKEVEVGNMVSVHKSVSANLKEEITRLHSQGSTIANLEQQLENVQRSIDKLVMSLPNNFQQITSEASPKHKKEHKKKKLLPLSSSNAVNRPNFLRSPCSPLSTTQQVLESEIENKAPEVNDDTVSIETLPESEKDTPSKSEDGGDVSSKENTPGHRRCSSVNMKKMQKMFQNAAEENVRSIRAYVTELKERVAKLQYQKQLLVCQVLELEANEANGQDIGSEEYSGEPEEPQVSWQITFKEQRQQIIELWDVCYVSIIHRTQFYLLFKGDQADEIYMEVELRRLTWLQQHLAEIGNASPAPHVGDEPTVSLSSSMRALKREREFLAKRLTSRLTPEERDALYIKWDVPLDGKQRRLQFVNKLWTDPHDPRHVQESAEIVAKLVGFCTGGNMSKEMFELNFVLPSDKRPWLMGWNPITNLLNL

SEQ ID NO: 21608 - protein, 962 aa, Lupinus angustifolius
MTMRTPGTPASKIDRTPVSTPGGPRAKEEKIMVTVRLRPLNRREQLAKDQVAWDCINDYTIMYKPPPHERVAQPASFSFDKVFGPACLTESVYEGVKNVALSALMGINSTIFAYGQTSSGKTYTMRGITEKAVNDIYEHIMNTPERNFTIQISGLEIYNENVRDLLNSESGRNLKLLDDPEKGTVVEKLVEETAKDDKHLRHLISICEAQRQVGETALNDNSSRSHQIIRLTIKSTQRDNADCVRSFVATLNFVDLAGSERAAQTQADGTRLREGCHINLSLMTLTTVIRKLSVGKRSGHIPYRDSKLTRILQHSLGGNARTAIICTLSPALSHVEQSRNTLFFAIRAKEVTNNAQVNMVVSEKQLVKHLQKEVARLEAELRTPDPSKEKDWKIQQMEMEIEELRHQRDLAQSQVDELRKKLQDDQQQVSNQLESQHMSVKKCLSFTGVALPKPKLGFDRVRNSTLRQSMRQSSTAPFTLMHEIRKLEHLQEQLGEEANRALEVLQKEVACHRLGNQDAAETIAKLQAEIREMRFVRPAPKEVEDGNMISVHKSVSANLKDEISRLHFQGSTIANLEQQLENVQRSIDKLVMSLPNNFQQITSEASPKHKKEPKRKKLLPLSSSNAANLPNFIRSPCSPLSTTQQVLESDIENKAPKENDDVVSTDTVQESEKDTPTKSEEGGDVSSKENNSGNRRCSSVNMKKMQKMFQNAAEENVRSIRAYVTELKERVAKLQYQKKLLVCQVLELEANEANGHDIENEEYICEPEEPQVPWEITFRDQRQQIIELWDVCYVSIIHRTQFYLLFKGDTADQIYMEVELRRLTWLRQHLAEIGNASPAPHVGDEPTISLSSSMRALKREREFLAKRLTSRLTQEERDALYIKWDVPFDGKQRRLQFVSKLWTDPHDPRHVQESAEIVAKLVGFCTGGNISKEMFELNFVRPSEKRPWLMGWNPTITNFLNL

SEQ ID NO: 21609 - protein, 964 aa, Theobroma cacao
MTVRTPGTPASKTDRTPVTTPGGPKSKEEKIVVTVRLRPLSKREQLAKDQVAWDCVDEHTIVSKHPAQERTAQPTSFTFDKVFGPSSLTETVYEDGVKNVALSSLMGINATIFAYGQTSSGKTYTMRGITEKAVNDIYQHILNTPERDFTIKISGLEIYNENVRDLLNSESDRNLKLLDDPEKGTVVEKLVEETASNDQHLRHLISICEAQRQVGETALNDTSSRSHQIIRLTIQSTLRENSDCVRSFVASLNFVDLAGSERASQTHADGARLREGCHINLSLMTLTTVIRKLSVGKRSGHIPYRDSKLTRILQHSLGGNARTAIICTLSPALSHFEQSRNTLFFATRAKEVTNNAQVNMVVSDKQLVKHLQKEVARLEAELRTPDPSREKDLKIQQMEMEIEELKRQRDLAQSQVDELRRKLQEDQQISNPLESSRPSVKKCLSYSGVLSPKLDGKELGRNDRTRKTMLRQSMRQSSTAPFTLMHEIRKLEHLQEQLGEEANRALEVLQKEVACHRLGNQDAAETIAKLQAEIREMRSVRSIPKEVEVGTAIAPNKSVSANLKEEITRLHSQGSTIADLEEQLENVQKSIDKLVMSLPSNNQESNREATPKTKSQSKKKKLLPLASSNAANRQNFIRSPCSPLSTSRQILEPENEENRPPEDDDIVSKETLPESEKETPVKSEEGGDVSSKEGTPGYRRSSSVNMRKMQKMFQNAAEENVRSIRAYVTELKERVAKLQYQKQLLVCQVLELEANEAAGYNIEDDESAIEPEEPQVAWHVTFREQRQQIIELWDVCYVSIIHRTQFYLLFKGDPADQIYMEVELRRLNWLQQHFAELGNASPALVGDESSVSLSSSIRALKREREFLAKRLTSRLSVEERDALYIKWDVPLDGKQRKLQFINKLWTDPHDAKHIEESAQIVAKLVGFCEGGNMSKEMFELNFALPADKRPWVVGWNQISNLLNL

SEQ ID NO: 21610 - protein, 976 aa, Prunus persica
MTVKTPGTPASKIDRTPVSTPTSKIDRTPVSTPGGPRAKEEKIVVTVRLRPLSKREQLAKDQVAWECIDDTTIVYKPPPQERSAQPAPFTFDKVFGPSCVTETVYEEGVKNVALSSLMGINATIFAYGQTSSGKTYTMRGITEKAVIDIYNHIMNTPERDFTIKISGLEIYNENVRDLLNSESGRNLKLLDDPEKGTVVEKLVEETASNDQHLRHLISICEAQRQVGETALNDNSSRSHQIIRLTIESTLRENSDCVRSFVASLNFVDLAGSERASQTHADGARLREGCHINLSLMTLTTVIRKLSVGKRSGHIPYRDSKLTRILQHSLGGNARTAIICTLSPALSHFEQSRNTLFFATRAKEVTNNARVNMVVSDKQLVKHLQKEVARLEAELRTPDPSTEKDLKIQQMEMEMEELRRQRDLAQSQVDELRQKLKEDQQGSNPLELPHPSVKKCLSYTGVLSTKLDTKEIGRGDRARNTMLRQSMRQSSAAPFTLMHEIRKLEHLQEQLGEEANRALEVLQKEVACHRLGNQDAAETIANLQAEIREMRAVRSEPKEVEVGTVVATNKSVSANLKEEITRLHSQGSTIANLEEQLESVQKSIDKLVMSLPSNYEQYNSESTPKSKKEPKKKKLQPLASSNVPNRQNFIRSPCSPLSTSRQIAESEIENRAPENDDVLSGETQPESEKGTPTKNEECGDVSSKENTPGGYRRSSSVNMKKMQKMFQNAAEENVRNIRTYVTELKERVAKLQYQKQLLVCQVLELEANEAAGYDIENDENTCEPEEPMVSWQITFKEQRQQIIELWDLCFVSIIHRTQFYLLFKGDPADQIYVEVELRRLTWLQHHLAELGSASPAHVGDEPTVSLSSSIRALKREREFLAKRLTSRLTAEERDALYMKWDVPLEGKQRKMQFVNKLWTDPHDAKHIQESAEIVAKLVGFCESGNMSKEMFELNFVLPSDKRSWIMGWNPISNLLNL

SEQ ID NO: 21611 - protein, 976 aa, Prunus mume
MTVKTPGTPASKIDRTPVSTPTSKMDRTPVSTPGGPRAKEEKIVVTVRLRPLSKREQLAKDQVAWECIDDTTIVYKPPPQERSAQPAPFTFDKVFGPSCVTETVYEEGVKNVALSSLMGINATIFAYGQTSSGKTYTMRGITEKAVIDIYNHIMNTPERDFTIKISGLEIYNENVRDLLNSESGRNLKLLDDPEKGTVVEKLVEETASNDQHLRHLISICEAQRQVGETALNDNSSRSHQIIRLTIESTLRENSDCVRSFVASLNFVDLAGSERASQTHADGARLREGCHINLSLMTLTTVIRKLSVGKRSGHIPYRDSKLTRILQHSLGGNARTAIICTLSPALSHFEQSRNTLFFATRAKEVTNNARVNMVVSDKQLVKHLQKEVARLEAELRTPDPSTEKDLKIQQMEMEMEELRRQRDLAQSQVDELRQKLKEDQQGSNPLELPHPSVKKCLSYTGVLSTKLDTKEIGRGDRARNTMLRQSMRQSSAAPFTLMHEIRKLEHLQEQLGEEANRALEVLQKEVACHRLGNQDAAETIANLQAEIREMRAVRSEPKEVEVGTVVATNKSVSANLKEEITRLHSQGSTIANLEEQLESVQKSIDKLVMSLPSNYEQYNSESTPKSKKEPKKKKLQPLASINVPIRQNFIRSPCSPLSTSRQIAESEIENRAPENDDILSGETQPESEKGTPTKNEECGDVSSKENTPGGYRRSSSVNMKKMQKMFQNAAEENVRNIRTYVTELKERVAKLQYQKQLLVCQVLELEANEAAGYDIENDENTCEPEEPMVSWQITFKEQRQQIIELWDLCFVSIIHRTQFYLLFKGDPADQIYVEVELRRLTWLQHHLAELGNSSPAHVGDEPTVSLSSSIRALKREREFLAKRLTSRLTVEERDALYMKWDVPLEGKQRKMQFVNKLWTDPHDAKHVQESAEIVAKLVGFCESGNMSKEMFELNFVLPSDKRSWITGWNPISNLLNL

SEQ ID NO: 21612 - protein, 963 aa, Ricinus communis
MTVRTPGTPASKIDRTPATTPGPKSKEEKIVVTVRLRPLNKKEQLAKDQVAWECVDDHTIVFKPPTQERTAQSTPFTFDKVFGPTSLTESVYEDGVKNVALSALMGINATIFAYGQTSSGKTYTMRGITEKAVNDIYNHILNTPQRDFTIKISGLEIYNENVRDLLNSESGRSLKLLDDPEKGTVVEKLVEETATNDQHLRHLISICEAQRQVGETALNDTSSRSHQIIRLTIESTLRENSDCVRSFVASLNFVDLAGSERASQTHADGARLREGCHINLSLMTLTTVIRKLSVGKRSGHIPYRDSKLTRILQHSLGGNARTAIICTLSPALSHVEQSRNTLFFATRAKEVTNNAQVNMVVSDKQLVKHLQKEVARLEAELRTPDPSKEKDLKIQQMEREIEELRRQRDLAQSQVDELQKKLQEDQQASSTLESPPRPSVKKCLSYSDALLSKLENKEISRCDRARKTMLRQSMRQSSTAPFTLMHEIRKLEHLQEQLGEEANRALEVLQKEVACHRLGNQDAAETIAKLQAEIREMQSIQPASKEVEIGSVVAPNKSVSANLKDEITRLHSQGSTIANLEEQLENVQKSIDKLVMSLPSNDSQLNCEAPAKAKNQQKKKKVLPLASSNGANRQNFLRSPCSPLSTSRQVLENEIENRAPENEDFTSGETQPESEKETPTKSEECGDVSSKEGTPGYRRSSSVNMKKMQKMFQNAAEENVRSIRAYVTELKERVAKLQYQKQLLVCQVLELEANEAAGYNLEDEEGTIEPEPQVSWQITFREQRQQIIELWDLCSVSIIHRTQFYLLFKGDPADQIYMEVELRRLNWLQQHFAEIGNASPAPHVGDEPTISLSSSIRALRREREFLAKRLTSRFNVEEREALYMKWDVPLEGKQRRLQFVYKLWTNPHDPRHIHESAEIVAKLVGFCEGGNMSKEMFELNFALPTDKRPWIMGWNPISNLLHL

SEQ ID NO: 21613 - protein, 974 aa, Malus domestica
MTVKTPGTPASKVDRTPASTPASKIDRTPVSTPGGPRAKEEKIVVTVRLRPLNKREQLAKDQVAWECLDDNTIVYKPPPQERSVQPAPFTFDKVFGPTSLTEAVYEEGVKNVALSSLMGINATIFAYGQTSSGKTYTMRGITEKAVIDIYNHIINTPERDFTIKISGLEIYNENVRDLLNSESGRSLKLLDDPEKGTVVEKLVEETASNDQHLRHLISICEAQRQVGETALNDNSSRSHQIIRLTIESTLRENSDCVRSFVASLNFVDLAGSERASQSLADGARLREGCHINLSLMTLTTVIRKLSSGKRSGHIPYRDSKLTRILQHSLGGNARTAIICTLSPALSHFEQSRNTLFFATRAKEVTNNARVNMVVSDKQLVKHLQKEVARLEAELRTPDPLREKELKIQQMEMEIEELRRQRDRAQSQVLELQQKLQEDPQGSNPSGIPHPSVKKCLSYTGVLSTKPDKKDIGPGDRARNLRQSMRQSSTAPFTLMHEIRKLEHLQEQLGEEANRALEVLQKEVACHRLGNQDAAETIANLQAEIREMRSVRSVPKEVELGTVVATNKSVSANLKEEITRLHSQGSTIENLEEQLESVQKSIDKLVMSLPSNYQECNIEASSKPKKESKKKKCLPLASSNIANRQNFIRSPCSPLSASRQIAESETENRAPENDDIVSGEIQPESEKGTPTKNEECGDVSSKESTPTGYRRSSSVNMKKMQKMFQNAAEENVRNIRTYVTELKERVAKLQYQKQLLVCQVLELEANEAAGYNLENDEDTCETEEPQVSWQITFKEQRQQIIELWDLCFVSIIHRTQFYLLFKGDPADQIYMEVELRRLTWLQQHLAELGDASPAHVGDEPRVSLSSSMRALKREREFLAKRLSSRLTAEERDALYMKWDVPLEGKHRKLQFVNKLWQDPHDPRHIQESAEVVAKLVGFCESGNLSREMFELNFVLPSDRRPWMMGWNQISNLLNL

SEQ ID NO: 21614 - protein, 965 aa, Populus trichocarpa
MTIRTPGTPASKIDRTPATTPGGAKAKEEKIVVTVRLRPLNKKEQLAKDQVAWDCVDDHTIVFKPPSQERAAQPASFVFDKVFDPSSITEAVYEDGVKNVALSALMGINATIFAYGQTSSGKTYTMRGITEKAVNDIYKHIINTPERDFTIRISGLEIYNENVRDLLNSESGRNLKLLDDPEKGTVVEKLVEETASNDKHLRHLISICEAQRQVGETALNDTSSRSHQIIRLSIESTLRENSDCVRSFVASLNFVDLAGSERASQTHADGARLREGCHINLSLMTLTTVIRKLSVGKRSGHIPYRDSKLTRILQHSLGGNARTAIICTLSPALSHVEQSRNTLYFATRAKEVTNNAHVNMVVSDKQLVKHLQKEVARLEAVLRTPDPSTEKDLKIQEMEMEMEELKRQRDLAQFEVDELRRKLQEDRQASSTLESPCPSVKKCLSYSDASLPNLDSKEPSRSDRTRKTMLRQSMRQSSTAPFTLMHEIRKLEHLQEQLGEEANRALEVLQKEVACHRLGNQDAAETIAKLQAEIREMRTIQPVPKEVEAGSVVAPNKSVSANLKDEITRLHSQGSTIADLEEQLENVQKSIDKLVMSLPNNNPQSNCEVTPKAKNQQKKKKILPLASSNGSNRQNFIRSPCSPLSTSRQILEKEIENRDPYNDDIVASETLPESEKETHKKNEEGGDVSSREGTPGYRRSSSVNMKKMQKMFQNAAEENVRNIRAYVTELKERVAKLQYQKQLLVCQVLELEANEAAGYNIEEEEENNINEQEEPQVSWHVTFREQRQLIIELWDVCYVSIIHRTQFYLLFSGDPADQIYMEVELRRLTWLQKHLAELGNASPAHFGDESTISLSSSIRALKREKEFLAKRLASRLTTEERDALYIKWNVPLDGKQRRLQFVNKLWTDPHDVKHIQESADIVAKLVGFCEGGNMSKEMFELNFALPTDKRPWIMGWNPISNLLHL

SEQ ID NO: 21615 - protein, 964 aa, Populus trichocarpa
MTLRTPGTPASKIDRTPATTPGGPKAKEEKIVVTVRLRPLNKKEQLAKDQIAWDCVDDHTIVFKPPPQERAAQPASFIFDKVFGPSSITEAVYEDGVKNVALSALMGINATIFAYGQTSSGKTYTMRGITDKAVNDIYKHIMNTPERDFTIRISGLEIYNENVRDLLNSESGRNLKLLDDPEKGTVVEKLVEETASNDQHLRHLISICEAQRQVGETALNDTSSRSHQIIRLTIESTLRENSDCVRSFVASLNFVDLAGSERASQTHADGARLREGCHINLSLMTLTTVIRKLSVGKRSGHIPYRDSKLTRILQHSLGGNACTAIICTLSPALTHVEQSRNTLYFATRAKEVTNNAHVNMVVSDKQLVKHLQKEVARLEAELRTPDPSREKDFKIRQMEMEMEELRRQRDLAQSEVDELRRKLQEDRQVSSTLESPRPLVKKCLSYSDASLPNLDIKESSHCDRTRKTLLRQSMRQSSTAPFTLMHEIRKLEHLQEQLGEEANRALEVLQKEVACHRLGNQDAAETIAKLQAEIRDMRTIQPVPKEVEIGSVVAPNKSVNANLKDEITRLHSQGSTFADLEEQLENVQKSIDKLVMSLPNNNPQSNCEAASKAKNQQKKKKILPLASSNGTNRQNFIRSPCSPLSTSRQVLESEIENRAPNNDDIVVSETMSESEKETPTKIEEGGDISSKEGTPGGYRRSSSVNMKKMQKMFQNAAEENVRSIRTYVTELKERVAKLQYQKQLLVCQVLELEANEAAGYTIEEEENINEPEQPQVSWHVTFREQRQLIIELWDMCYVSIIHRTQFYLLFKGDPADQIYMEVELRRLTWLQQHLAELGNASPAHFGDEPTISLSSSIRALKREKEFLAKRLTSRLTAEERDELYIKWNVPLDGKQRRLQFVNKLWTDPHDAKHIQESADIVAKLVGFCEGGKMSKEMFELNFALPTDKRPWITGWNQISNILHL

SEQ ID NO: 21616 - protein, 960 aa, Citrullus lanatus
MTIKTPATPASKTERTPASTPGGPRSKEEKIVVTVRLRPLSKKEQQAKDQMAWECIDDHTIVYKPQPQERQTQPASFTFDKVFSPTSLTEAVYEEGVKNVALSALMGINATIFAYGQTSSGKTFTMRGITEKAVNDIYKHISNTPERDFTIRISGLEIYNENVRDLLNTKSGRNLKLHDDPEKGTMVEKLVEETANNDQHLRHLISICEAQRQVGETALNDYSSRSHQIIRLTIQSTLRENSDCVRSFVASLNFVDLAGSERASQTHADGARLREGCHINLSLMTLTTVIRKLSLGKRSGHIPYRDSKLTRILQHSLGGNARTAIICTLSPALTHVEQSRNTLYFATRAKEVTNNAQVNMVVSDKQLVKHLQKEVARLEAELRTPDPKREKDLKIQQMEMEIEELKRQRDLAQSQVDELRRKLEEDQQGSNPIESARPPVKKCLSFTGTLPQKLDSKDLGRGMILRQSMMRQSSTAPFTLMHEIRKLEHLQEQLGEEANRALEVLQKEVACHRLGNQDAAETIAKLQAEIREMRSVRSEPKEVEVGNTIATNQSVGANLKEEITRLHSQGSTIANLEEQLENVQKSIDKLVMSLPSNYQQFMSSESTPKQKSYTKKKKLLPLASSNVTNRQNFLRSPCSPSTTPQQVLESDTENRAPENDDDFSSEILLESEKETPTKSEEGGDVSSKENTPCYRRSSSVNMKKMQKMFQNAAEENVRSIRAYVTELKERVAKLQYQKQLLVCQVLELEANEAAGNKLDCDENTFEQDDDQVPWHVTFREQRQQIIELWDACYVSIIHRSQFYLLFKGDEADQIYLEVEMRRLTWLQDHLAEFGNASPAHFGDEPTISRSSSMRALRREREFLAKRLTSRLSAEERDALYIKWEVPLEGKQRKIQFVNKLWTNPHDPKHIQDSAEIVAKLVGFCEGGNMSREMFELNFVVPSDKRPWIMGWNPISNLLNL

SEQ ID NO: 21617 - protein, 978 aa, Fragaria vesca
MTVRTPGTPSSKIDKTPVTTPSSRIDRTPVSTPGGPRGAKEEKIVVTVRLRPLSKREQLAKDQVAWECVDDNTIVSKPQDRSTQPASFTFDKVFGPTSITDTVYEEGVKNVALSSLMGINATIFAYGQTSSGKTYTMRGITEKAVIDIYNHIMNTPERDFTIKISGLEIYNENVKDLLNSESGRNLKLLDDPEKGTVVEKLVEETASNDQHLRHLISICEAQRQVGETALNDNSSRSHQIIRLTIESTLRENSDCVRSFVASLNFVDLAGSERASQTHADGARLREGCHINLSLMTLTTVIRKLSVGKRSGHIPYRDSKLTRILQHSLGGNARTAIICTLSPAMSHLEQSRNTLFFATRAKEVTNNARVNMVISDKQLVKHLQKEVARLEAELRTPATPDPSMEKDMKIQQMKMEIEELKRQRDLAQSQVIELCQKLKEDPQVSNPLELPHPSVKKCLSYTGELPTKLDAKELGRGDKARNIKLRQSMRQSSAAPFTLMHEIRKLEHLQEQLGNEANRALEVLQKEVACHRLGNQDAAETIANLQAEIREMRSVRSVPKEVDVGTVVATNKSVSANLKDEITRLHSQGSTIANLEEQLESVQKSIDKLVMSLPSNFEQCNSEAPPKSKKESKKKKLSPLSSSNVSNRPNFIRSPCSPLSASRQIVESDEIENRVPQHDDTLFSETQPESEKGTPTKSEDCGDVSSKENTPYRRSSSVNMKKMQKMFQNAAEENVRSIRTYVTELKERVAKLQYQKQLLVCQVLELEANEAAGYDMENDEITCEQEEPQIPWQITFKDQRQQIIELWDLCYVSIIHRTQFYMLFKGDPADQIYVEVELRRLTWLQEHLAELGNASPAPHVGDEPTVSLSSSIRALKREREFLAKRVTSRLSAEERDALYIKWDVPLEGKQRRMQFVNKLWIDPHDAKHIQESAEIVAKLVGFCESGNMPKEMFELNFALPSDRRPWIMGWNPISNLLNL

SEQ ID NO: 21618 - protein, 962 aa, Gossypium raimondii
MTVRTPGTPARKIDRTPVTTPGGPKSKEEKIVVTVRLRPLSKREQLAKDQVAWDCKDDYTIVSKHPSQERTSQPPPFIFDKVFGPSCLNETVYEGVKTVALSALGGINATIFAYGQTSSGKTYTMRGITEKAVNDIYHHIMNTPERDFTIKISGLEIYNENVRDLLNSESGRNLKLLDDPEKGTVVEKLVEETVSNDQHLRHLISICEAQRQVGETALNDTSSRSHQIIRLTIQSTLRENSDCVRSFVASLNFVDLAGSERASQTHADGARLKEGCHINLSLMTLTTVIRKLSVGKRSGHIPYRDSKLTRILQHSLGGNARTAIICTLSPALSHFEQSRNTLFFATRAKEVTNNAQVNMVVSDKQLVKHLQKEVARLEAELRTPDLSREKDLKIQQMEMEIEELKRQRDLAQSEVDELRRKLQDDQQTSNPIELPRPSMQKCLSYSDVLSPKLDRKEIDHNDKTRKTLLRQSMRQSSTAPFTLMHEIRKLEHLQEQLGEEANRALEVLQKEVAYHRLGNQDAAETIAKLQAEIREMCAVRSIKKEVDVGTTIAPNRSVSANLKEEITKLHSQGSTIANLEEQLENVQKSIDKLVMSLPSSNQESNGEAASKTKNQSIKNSLLPLTSSNVANRQNFIKSPCSSLSTSQQIMEPDNEENRPPEDDDIVSKETLPESEKGTPARSEQVGDVSSKESTPYRRQSSVNMKKMRKMFQNAAEENVRSIRAYVTELKERVAKLQYQKQLLVCQVLELEANEAAGYNLEVDESAIEPEEPQVPWHVTFKEQRQQIMELWDVCYVSIIHRTQFYLLFRGDPADQIYMEVELRRLNWMQHHFAELGNASPALVGDEPTVSLSSSIRALKHEREFLAKRLTSRLSVEERDALYIKWDVPLEGKQRKMQFINKLWTDPHDVKNIEESAQIVAKLVGFSEGGNMSREMFELNFALPADKSPWTVGWNQISNLLNL

SEQ ID NO: 21619 - protein, 962 aa, Citrus clementina
MTVRTPGTPASKSERATPTQTPASTPGGPKPREEKIVVTVRLRPLNKREQLAKDQVAWDCVDDHTIVYKPQPHERVSQPSSFSFDKVFGPSCLTETVYEEGVKNVALSALMGINATIFAYGQTSSGKTYTMRGITEKAVVDIYNHIMNTPERDFTIKISGLEIYNENVRDLLNSESGRNLKLLDDPEKGTVVEKLVEETANNDQHLRHLISICEAQRQVGETALNDTSSRSHQIIRLSIQSTLRENSDCVRSFVASLNFVDLAGSERASQTHADGARLREGCHINLSLMTLTTVIRKLSVGKRSGHIPYRDSKLTRILQHSLGGNARTAIICTLSPALSHFEQSRNTLFFATRAKEVTNNAQVNMVVSDKQLVKHLQKEVARLEAELRTPDPSREKDLKIQQMEMEIEELKRQRDVAQSEVDELRRKLQEDQQTSNPLDPSVKKCLSYSGVLSPKLDGKELGRFDKIRKTMSRQSMRQSSTAPFTLMHEIRKLEHLQEQLGEEANRALEVLQKEVACHRLGNQDAAETIARLQAEIREMRAVRSVSKEVEVGTVIAPNKSVCANLKEEITRLHSQGSTIEDLEEQLENVQKSIDKLVMSLPTNNQQPDSESTPKAKKKKKLLPLASSNVNRQNFIKSPCSPLSTSRQILESETENRPPENDNMAVENLPESEKGTPTKSEEGGAVSSREGTPGSGYRRSSSVNMKKMQKMFQNAAEENVRSIRAYVTELKERVAKLQYQKQLLVCQVLEMEANEAAGYNMENDENIVETEEPEVAWHITFREQRQQIIELWDVCFVSIIHRTQFYLLFKGDPADQIYMEVELRRLTWLQQHLSELGNASPLPVAGGEPTISLSSSIRALKREREFLAKRLSSRLTAEERDSLYIKWDVQLDGKHRRLQFVSKLWTDPHDPRHVQESAEIVAKLVGFCEGGNMSKEMFELNFAIPADKRPWMMGWNQISNLLL

SEQ ID NO: 21620 - protein, 962 aa, Citrus sinensis
MTVRTPGTPASKSERATPTQTPASTPGGPKPREEKIVVTVRLRPLNKREQLAKDQVAWDCVDDHTIVYKPQPHERVAQPSSFSFDKVFGPSCLTETVYEEGVKNVALSALMGINATIFAYGQTSSGKTYTMRGITEKAVVDIYNHIMNTPERDFTIKISGLEIYNENVRDLLNSESGRNLKLLDDPEKGTVVEKLVEETANNDQHLRHLISICEAQRQVGETALNDTSSRSHQIIRLSIQSTLRENSDCVRSFVASLNFVDLAGSERASQTHADGARLREGCHINLSLMTLTTVIRKLSVGKRSGHIPYRDSKLTRILQHSLGGNARTAIICTLSPALSHFEQSRNTLFFATRAKEVTNNAQVNMVVSDKQLVKHLQKEVARLEAELRTPDPSREKDLKIQQMEMEIEELKRQRDVAQSEVDELRRKLQEDQQTSNPLDPSVKKCLSYSGVLSPKLDGKELGRFDKIRKTMSRQSMRQSSTAPFTLMHEIRKLEHLQEQLGEEANRALEVLQKEVACHRLGNQDAAETIARLQAEIREMRAVRSVSKEVEVGTVIAPNKSVCANLKEEITRLHSQGSTIEDLEEQLENVQKSIDKLVMSLPTNNQQPDCESTPKAKKKKKLLPLASSNVNRQNFIKSPCSPLSTSPQILESETENRPPENDNMAVENLPESEKGTPTKSEEGGAVSSREGTPGSGYRRSSSVNMKKMQKMFQNAAEENVRSIRAYVTELKERVAKLQYQKQLLVCQVLEMEANEAAGYNMENDETIVETEEPEVAWHITFREQRQQIIELWDVCFVSIIHRTQFYLLFKGDPADQIYMEVELRRLTWLQQHLSELGNASPLPVAGGEPTISLSSSIRALKREREFLAKRLSSRLTAEERDSLYIKWDVQLDGKHRRLQFVSKLWTDPHDPRHVQESAEIVAKLVGFCEGGNMSKEMFELNFAIPADKRPWMMGWNQISNLLL

SEQ ID NO: 21621 - protein, 975 aa, Cannabis sativa
MTVRTPGTPSSKIDRAPGTPSSKIDRTPVSTPGGPRAKEEKIVVTVRLRPLSKREQLAKDQVAWECIDDNTIVYKPTFQDRSAQPATFTFDKVFGPSSLTETVYDGVKNVALSALMGINATIFAYGQTSSGKTYTMRGVTEKAVNDIYNHILNTPERDFNIKISGLEIYNENVRDLLNTDSGRNLKLLDDPEKGTVVEKLVEETAKDDQHLRHLINICEAQRQVGETALNDTSSRSHQIIRLTIESTVRENSGCVRSFVASLNFVDLAGSERASQTHADGARLREGCHINLSLMTLTTVIRKLSVGKRSGHVPYRDSKLTRILQHSLGGNARTAIICTLSPALTHVEQSRNTLLFASRAKEVTNNAQVNMVVSDKQLVRHLQKEVARLEAELRTPDPAREKDMKIQQMEMEIEELRRQRDLAQSQVDELRKKLDDDQQGSTLIESPPTSVKKCLSYSEAFSRKSDSKVLGRVDKARSTMLRQSVRQSSAAPFTLMHEIRKLEHLQEALGEEANRALEVLQKEVACHRLGNQDAAETIAKLQAEIREMRSVRSAPREVDVGNVIATNKSVSANLKDEITRLHSQGSTIADLEEQLENVQKSIDKLVMSLPNNFQQPNFDPSPKTNKEFKKKKLLPLSSSNAVNRQTFIRSPCSPLSTSEQVFEPEIENRYPENDDNLSIDTLPESEKETPTKSEGGDISSKENTPGGYRRSSSVNMKKMQKMFQNAAEENVRSIRAYVTELKERVAKLQYQKQLLVCQVLELEANEAAGYSIEDDENECEPGMPQVSWQITFKEQRQQIIELWDMCFVSIIHRTQFYLLFKGDPADQIYMEVELRRLTWLQQHLTQMGNASPAPGPGGEDATVSFSSSIRAIRREREFLAKRLTSRLTAEERDMLYMKWDVPLEGKQRKIQFVNKLWTDPHDAKHVQESAEIVAKLVGFCEGGNLSREMFQLNFALPGDKRPWLMGWNQLSNLLHL

SEQ ID NO: 21622 - protein, 963 aa, Gossypium raimondii
MTVKTPGTPSNKIDKTPVTTPGGPKSKEEKIVVTVRLRPLSKREQLAKDQVAWDCVDDHTIVSKHPSQERTAQPSSFTFDKVFGPSCLNETVYEGVKNVALSALGGINATIFAYGQTSSGKTYTMRGITEKAVNDIYQHIMNTPERDFTIKISGLEIYNENVRDLLNSESGRNLKLLDDPEKGTVVEKLVEETASNDQHLRHLISICEAQRQVGETALNDSSSRSHQIIRLTIESTLRENSDCVRSFVASLNFVDLAGSERASQTNADGARLREGCHINLSLMTLTTVIRKLSVGKRSGHIPYRDSKLTRILQHSLGGNARTAIICTLSPALSHFEQSRNTLFFATRAKEVTNNAQVNMVVSNKQLVKHLQKEVARLEAELRTPDPSREKDLKIQQMEIEIEELKRQRDLAQSQVDELRRKLQEDQQILNPIESPSPSVKKCLSYSDVLSPKLDGKDLGRHDKTRKTMLLRQSMRQSSTAPFALMHEIRKLEHLQEQLGEEANRALEVLQKEVACHRLGNQDAAETIAKLQAEIREMRSVRSDPKEVEVGAAIAPNKSVSANLKEEITRLHSQGSTIADLEEQLENVQKSIDKLVMSLPSNQESNCEATPKTKNQSKKKKLLPLTSSHVTNRPNFIKSPCAPLSTSRQVVEPENEENRPPEDDDNVSKDTIIEFEKETPVKSEDCGDVTSKEGTPGYRRSSSVNMKKMQKMFQNAAEENVRSIRAYVTELKERVAKLQYQKQLLVCQVLELEANEAAGYNLEDNESEIEHEEPQVAWHVTFKEQRRQIIELWDVCYVSIIHRTQFYLLFKGDPADQIYMEVELRRLNWLQQHFAELGNASPAITGDEPTVSLSSSIRALKREREFLAKRLTTRLTFDERDALYIKWNVPLDGKHRRLQFINKLWTDPHDPKHIEESAQIVAKLVGFCESGNLSKEMFELNFALPADKKPWMVGWNQISNLLNL

SEQ ID NO: 21623 - protein, 183 aa, Glycine max
MGGNSDSNCSITPRHYNTHKVFLFCNYILLGAASSCIFLTLSLRLIPSLCGFFFILLQVFTIAGAVSGCAAVGANRWYSAHMVATVLTAIFQGSVSVLVFTRTGDFLGQLKSYVREEDGAVILKLAGGLTILIFVLEWVVLTLAFFLKYYACVEGNSGAVVPVRSGKVQQDEDLKDWPWPFQV

SEQ ID NO: 21624 - protein, 184 aa, Vigna unguiculata
MGLSTMNSSSSITPRHYNTHKVFLFCNYILLGAASSCIFLTLSLRLIPSLCGFFFILLQIFTIAGAVSGCAAVGANSWYSAHMVATVLTAIFQGSVSVLVFTRTGDFLGQLKSYVREEDGAVILKLAGGLTILIFCLEWVVLTLAFFLKYYACVEGSNGAIVPMKSGKVQQDEDLKDWPWPFQV

SEQ ID NO: 21625 - protein, 182 aa, Phaseolus vulgaris
MGLSTMNSSITPRHYNTHKVFLFCNYILLGAASSCIFLTLSLRLIPSLCGFFFILLQVFTIAGAISGCAAVGANSWYSAHMVATVLTAIFQGSVSVLVFTRTGDFLGQLKSYVREEDGAVILKLAGGLTILIFCLEWVVLTLAFFLKYYACVEGSNGAIVAMKSGKVQQDEDLKDWPWPFQV

SEQ ID NO: 21626 - protein, 182 aa, Cajanus cajan
MGLSTMNTSITPRHYNTHKVFLFCNYILLGAASSCIFLTLSLRLIPSLCGFFLILLHVLTIAGAVAGCAAVGTNRWYSAHMVATVLTAIFQGSVAVLVFTRTGDFLGELKSYVREEDGAVILKLGGGLTILIFCLEWVVLVLAFFLKYYACVEGNSGAVVPVRSGKVQQDEDLKDWPWPFQV

SEQ ID NO: 21627 - protein, 187 aa, Acacia harpophylla
MGISMNSQSASSITRHDHTYKVFLFCNYILLGAASSCIFLTLSLRLIPSVCGFFLILLHVLTIAGAVSGCAAASAGASLWYSAHMVATVLTAIFQGSVSVLIFTRTGDFLGQLKSYVREEDGSVILKLAGGLSILIFCLEWVVLTLAFFLKYYAHIIGDSGANTVAMRSAKVQQEEDLKDWPWPFQV

SEQ ID NO: 21628 - protein, 186 aa, Trigonella foenum-graecum
MGALSMNNHPPTITPRHYNIHKLFLFCNYVLLGAASSCIFLTLSLRLYPSVCGYFLILLHIFTIAGAVSGCAAVGANRWYSAHMVATVLTAIFQGSVSVLVFTRTSDFLGELKSYVREEDGSVILKLSGGLAILIFFLEWVVLTLAFFLKYYACVEGRNTCRTVVLGSAKVQQDEDLKDWPWPFQV

SEQ ID NO: 21629 - protein, 191 aa, Populus trichocarpa
MGASITLGSTNSSVSQSHYHTHRVFLFCNYILLGAASSCIFLTLSLRLVPSICGFFLILLHVFTIAGAVSGCAAASSGTNRWYAAHMVATVLTAIFQGSVSVLIFTRTGDFLGNLKSYVREEDGDVILKLAGGLCVVIFCLEWVVLTLAFFLKYYAYVEGDANNGGDIAMRRSAKVQQDEDLKDWPWPFQV

SEQ ID NO: 21630 - protein, 185 aa, Vicia sativa
MGLSMNNHPAAITPRHYNIHKLFLFCNYVLLGAASSCIFLTLSLRLIPSVCGFFLILLHIFTIAGAVSGCAAVGANRWYSAHMVATVLTAIFQGSVSVLVFTRTADFLGELKSYVREEDGSVILKLSGGLAILIFFLEWVVLTLAFFLKYYASVEGGNNSRAIVLGSAKVQQDEDLKDWPWPFQV

SEQ ID NO: 21631 - protein, 427 aa, Cajanus cajan
MGSELIFRGHEAQPVDDAYSPKPQKPWLSVTRPIHYMLREQRLVFVLVGVIIASLFFTLVPSSSSMSSSPYEALPISYFERESRVPAYHHRLPAVHSVGKVPLGIKRKGLRIVVTGGAGFVGSHLVDRLIGRGDSVIVVDNFFTGRKENVMHHFGNPRFELIRHDVVEPLLLEVDQIYHLACPASPVHYKFNPVKTIKTNVVGTLNMLGLAKRVGARFLLTSTSEVYGDPLQHPQKETYWGNVNPIGVRSCYDEGKRTAETLTMDYHRGAGVEVRIARIFNTYGPRMCLDDGRVVSNFVAQALRKEPLTVYGDGKQTRSFQYVSDLVEGLMRLMEGEHVGPFNLGNPGEFTMLELAKVVQETIDPDARIEYRPNTEDDPHKRKPDISRAKELLGWEPKVDLRKGLPLMVSDFRQRIFGDHKEGATVA

SEQ ID NO: 21632 - protein, 429 aa, Phaseolus vulgaris
MGSELIFRGHEAQPVNDAYSPKPNKPWLSVTRPIHYMLREQRLLFVLLGVIIATLFFTLIPSSSTSSPTVPYDPLPISYFDGESKLPAYHHRIAAAVHSVGKVPLGIKRKGLRIVVTGGAGFVGSHLVDRLIARGDSVIVVDNFFTGRKENVMHHFGNPRFELIRHDVVEPLLLEVDQIYHLACPASPVHYKFNPVKTIKTNVVGTLNMLGLAKRVGARFLLTSTSEVYGDPLQHPQKETYWGNVNPIGVRSCYDEGKRTAETLTMDYHRGAGVEVRIARIFNTYGPRMCLDDGRVVSNFVAQALRKEPLTVYGDGKQTRSFQYVSDLVEGLIRLMGGEHVGPFNLGNPGEFTMLELAKVVQETIDPDARIEYRPNTEDDPHKRKPDIGRAKELLGWEPKVDLHKGLPLMVSDFRLRIFGDHKEGATVA

SEQ ID NO: 21633 - protein, 435 aa, Trifolium pratense
MSSELTFRGHEAQQVNDEYSPKPNKPWLSAIRPIRYMLREQRLVFVLIGIVIATLFFTLAPSTSTKSSSSSFSTVHYDSHPISYFENEPKTTPYHQQRAAAVVHSFGKVPLGIKRKGLRIVVTGGAGFVGSHLVDRLIARGDSVIVVDNFFTGRKENVMHHFGNPRFELIRHDVVEPLLLEVDQIYHLACPASPVHYKFNPVKTIKTNVVGTLNMLGLAKRVGARFLLTSTSEVYGDPLQHPQKETYWGNVNPIGVRSCYDEGKRTAETLTMDYHRGAGVEVRIARIFNTYGPRMCLDDGRVVSNFVAQALRKEPLTVYGDGKQTRSFQYVSDLVEGLMRLMEGEHVGPFNLGNPGEFTMLELAKVVQETIDPDAKIEYRPNTEDDPHKRKPDITKAKEQLGWEPKVDLHKGLPLMVSDFRQRIFGDHKEGGSVA

SEQ ID NO: 21634 - protein, 432 aa, Trifolium pratense
MSSELTFRGHEAQQVNDEYSPKPNKPWLSAIRPIRYMLREQRLVFVLIGIVIATLFFTLAPSTTKSPSSFSTVHYDSHPISYFENEPKSTPYHQRAAAVVHSFGKIPLGIKRKGLRIVVTGGAGFVGSHLVDRLIARGDSVIVVDNFFTGRKENVMHHFGNPRFELIRHDVVEPLLLEVDQIYHLACPASPVHYKFNPVKTIKTNVVGTLNMLGLAKRVGARFLLTSTSEVYGDPLQHPQKETYWGNVNPIGVRSCYDEGKRTAETLTMDYHRGAGVEVRIARIFNTYGPRMCLDDGRVVSNFVAQALRKEPLTVYGDGKQTRSFQYVSDLVEGLMRLMEGEHVGPFNLGNPGEFTMLELAKVVQETIDPDAKIEYRPNTEDDPHKRKPDITKAKEQLGWEPKVDLHKGLPLMVSDFRQRIFGDHKEGGTVA

SEQ ID NO: 21635 - protein, 433 aa, Cicer arietinum
MSSELIFRGHETQQVNDEYSPKPNKPWLSVIRPIRYMLLEQRIVFVLIGIVIATLFFTLVPNSSSNSSSSAFSTVHYDAHPISYFEHESKNTPYQQRAAVVHSFGKIPLGIKRKGLRIVVTGGAGFVGSHLVDRLIARGDSVIVVDNFFTGRKENVMHHFGNPRFELIRHDVVEPLLLEVDQIYHLACPASPVHYKFNPVKTIKTNVVGTLNMLGLAKRVGARFLLTSTSEVYGDPLQHPQKETYWGNVNPIGVRSCYDEGKRTAETLTMDYHRGAGVEVRIARIFNTYGPRMCLDDGRVVSNFVAQALRKEPLTVYGDGKQTRSFQYVSDLVEGLMRLMEGEHVGPFNLGNPGEFTMLELAKVVQETIDPDAKIEYRPNTEDDPHKRKPDITKAKEQLGWEPKVDLHKGLPLMVSDFRQRIFGDHKEGGTVA

SEQ ID NO: 21636 - protein, 435 aa, Medicago truncatula
MSSELTFRGHETQQVNDEYSPKPNKPWLSVIRPIRYMLREQRLVFVLIGIVIASVFFTIIPSSSTSSSSSFSTRPYESDSISYFDRESKTTPAVYKQRAASVVHSSGKIPLGIKRKGLRIVVTGGAGFVGSHLVDRLMARGDSVIVVDNFFTGRKENVMHHFGNPRFELIRHDVVEPLLLEVDQIYHLACPASPVHYKFNPVKTIKTNVVGTLNMLGLAKRVGARFLLTSTSEVYGDPLEHPQKETYWGNVNPIGVRSCYDEGKRTAETLTMDYHRGAGVEVRIARIFNTYGPRMCLDDGRVVSNFVAQALRKEPLTVYGDGKQTRSFQYVSDLVEGLMRLMEGEHVGPFNLGNPGEFTMLELAKVVQETIDPDAKIVYRDNTEDDPHKRKPDISNAKEHLGWEPKVDLRKGLPLMVSDFRQRIFGDHKEGGSDA

SEQ ID NO: 21637 - protein, 391 aa, Glycine max
MGSELIFRGHETQPVDDAYSPKPHKPWLTVTRPIHYMLREQRLLFVLLGVIIATLFFTFVPSSSPSASSSSVSYESLPISYFERESKIPAYHHRVAAAVHSVGKVPLGIKRKGLRIVVTGGAGFVGSHLVDRLIARGDSVIVVDNFFTGRKENVMHHFGNPRFELIRHDVVEPLLLEVDQIYHLACPAEVYGDPLQHPQKETYWGNVNPIGVRSCYDEGKRTAETLTMDYHRGAGVEVRIARIFNTYGPRMCLDDGRVVSNFVAQALRKEPLTVYGDGKQTRSFQYVSDLVEGLIRLMEGEHVGPFNLGNPGEFTMLELAKVVQETIDPDARIEYRPNTEDDPHKRKPDISRAKDQLGWEPKVDLRKGLPLMVSDFRQRIFGDQKEKATVA

SEQ ID NO: 21638 - protein, 436 aa, Vicia sativa
MSSELTFRGHETQQVNDEYSPKPNKPWLSEIRPIRYMLREQRLVFVLIGIAIATLFFTFAPSSSTSSSASSSFSTVRYEPHPISYFEHESESKVTPYQRHTAAVHSVGKVPLGLKRKGLRIVVTGGAGFVGSHLVDRLIERGDSVIVVDNFFTGRKENVMHHFGNPRFELIRHDVVEPLLLEVDQIYHLACPASPVHYKFNPVKTIKTNVVGTLNMLGLAKRIGARFLLTSTSEVYGDPLQHPQKETYWGNVNPIGVRSCYDEGKRTAETLTMDYHRGAEVEVRIARIFNTYGPRMCLDDGRVVSNFVAQALRKEPLTVYGDGKQTRSFQYVSDLVEGLMRLMEGEHVGPFNLGNPGEFTMLELAKVVQETIDPEAKIEYRPNTEDDPHKRKPDITKAKEQLGWEPKVDLHTGLPLMVSDFRQRIFGDHKEGGTVA

SEQ ID NO: 21639 - protein, 433 aa, Arachis hypogaea
MGGSSELIFRGHESQPINDDYSPKPNKRWLSFTLNPINYLLREQRLLFTLLGVFIATAFFTLLPSHNTNLNQYDTVPIPYFTQHDSVFPTNHQSNRHVAAVHSFGKVPLGIKRKGLRIVVTGGAGFVGSHLVDRLIARGDSVIVVDNFFTGRKENVMHHFGNPRFELIRHDVVEPLLLEVDQIYHLACPASPVHYKFNPVKTIKTNVVGTLNMLGLAKRVGARFLLTSTSEVYGDPLQHPQKETYWGNVNPIGVRSCYDEGKRTAETLTMDYHRGAGVEVRIARIFNTYGPRMCLDDGRVVSNFVAQALRKEPMTVYGDGKQTRSFQYVSDLVEGLMRLMEGEHVGPFNLGNPGEFTMLELAKVVQETIDPDASIEYRPNTEDDPHKRKPDISRAKELLGWEPKVDLRKGLPLMVSDFRQRIFGDHKEGSTVA

SEQ ID NO: 21640 - protein, 430 aa, Lupinus angustifolius
MGSELIFRGHETQPINDDYSPKHNKQWHSVTRPIHYLLREQRLLFILIGVAIATVFFLLIPSNSPTSNSLYEPLPISYMDHESNQWDHKPRPLIGFHSVGKVPLGIKRKGLRIVVTGGAGFVGSHLVDRLIARGDSVMVVDNFFTGRKENVMHHFGNSRFELIRHDVVEPILLEVDQIYHLACPASPVHYKFNPVKTIKTNVVGTLNMLGLAKRVGARFLLTSTSEVYGDPLEHPQKETYWGNVNPIGVRSCYDEGKRTAETLAMDYHRGAGVEVRIARIFNTYGPRMCLDDGRVVSNFVAQALRKEPLTVYGDGKQTRSFQYVSDLVEGLMRLMEGEHVGPFNLGNPGEFTMLELAKVVQETIDPDAKIEYRDNTEDDPHKRKPDISKAKEQLGWEPKVDLRKGLPLMVSDFRQRIFGDHKEGATATFA

SEQ ID NO: 21641 - protein, 435 aa, Euonymus alatus
MGSELIYRGHEEAQPTADGYSPKPAKPWLSVVRPIRYLLREQRLIFVLVGIAVATVFFTLLPSSSHRSYRHESYVPISYFGRDSYRQSNKPYEQHRMFVHSSGKVPLGLKRKGLRIVVTGGAGFVGSHLVDRLIARGDSVIVVDNFFTGRKENVMHHFSNPRFELIRHDVVEPLLLEVDQIYHLACPASPVHYKFNPVKTIKTNVVGTLNMLGLAKRVGARFLLTSTSEVYGDPLQHPQVETYWGNVNPIGVRSCYDEGKRTAETLTMDYHRGAGVEVRIARIFNTYGPRMCIDDGRVVSNFVAQALRKEPLTVYGDGKQTRSFQYVSDLVEGLMRLMEGEHVGPFNLGNPGEFTMLELAQVVQETIDPNAKIEFRPNTEDDPHKRKPDITRAKDLLGWEPKVSLRKGLPLMVSDFRQRVFGDHKEGSTTSTGSS

SEQ ID NO: 21642 - protein, 420 aa, Glycine max
MSSSTGLIFRGHEAQPMDDAYYPKPQKPWLSFRYLLREQRLHFLLLGIVLATLFFFLLPSGLHDPFPTPYLEPTRWPTNSPSYDVVSVHSVGKIPLGIKRKGLRIVVTGGAGFVGSHLVDRLIARGDSVIVVDNFFTGRKENVMHHFGNPNFELIRHDVVEPLLLEVDQIYHLACPASPVHYKFNPVKTIKTNVVGTLNMLGLAKRVGARFLLTSTSEVYGDPLEHPQKETYWGNVNPIGVRSCYDEGKRTAETLTMDYHRGAGVEVRIARIFNTYGPRMCLDDGRVVSNFVAQALRKEPLTVYGDGKQTRSFQYVSDLVEGLMRLMEGEHVGPFNLGNPGEFTMLELAKVVQETIDPEAKIEYRPNTEDDPHKRKPDISRAKEQLGWEPKVDLRKGLPLMVSDFRQRIFGDQKEGTTSA

SEQ ID NO: 21643 - protein, 379 aa, Glycine max
MGSELIFRGHETQPVDDAYSPKPHKPWLTVTRPIHYMLREQRLLFVLLGVIIATLFFTFVPSSSPSASSSSVSYESLPISYFERESKIPAYHHRVAAAVHSVGKVPLGIKRKGLRIVVTGGAGFVGSHLVDRLIARGDSVIVVDNFFTGRKENVMHHFGNPRFELIRHDVVEPLLLEVYGDPLQHPQKETYWGNVNPIGVRSCYDEGKRTAETLTMDYHRGAGVEVRIARIFNTYGPRMCLDDGRVVSNFVAQALRKEPLTVYGDGKQTRSFQYVSDLVEGLIRLMEGEHVGPFNLGNPGEFTMLELAKVVQETIDPDARIEYRPNTEDDPHKRKPDISRAKDQLGWEPKVDLRKGLPLMVSDFRQRIFGDQKEKATVA

SEQ ID NO: 21644 - protein, 432 aa, Quercus alba
MSSELIFRGHESQPVSDTYTPKQPKPWFSVTQPIRYMLREQRLVFVLVGIAIATVVFTLLPSSSTSRVEYGHFTIPETTTRLSQYDQKPMYEHRSAFHMYSSGKVPLGLKRKGLRIVVTGGAGFVGSHLVDRLMERGDSVIVVDNFFTGRKENVMHHFGNPRFELIRHDVVEPLLLEVDQIYHLACPASPVHYKFNPVKTIKTNVVGTLNMLGLAKRVGARFLLTSTSEVYGDPLQHPQVETYWGNVNPIGVRSCYDEGKRTAETLTMDYHRGAGVEVRIARIFNTYGPRMCIDDGRVVSNFVAQALRKEPMTVYGDGKQTRSFQYVSDLVEGLMRLMEGEHVGPFNLGNPGEFTMLELAGVVRETIDPDAKIEYKPNTEDDPHKRKPDITKAKELLGWQPKVELRKGLPLMVSDFRKRIFGDHKEGGATTA

SEQ ID NO: 21645 - protein, 434 aa, Mimulus guttatus
MGSELIFRGHESQPVSDAYSPKPAKPWLTVTRPIHYLLREQRLVFVLVGIAIATLFFTVVPTSNSPHAPIPDAFISSELTQLHQPHRSMYQNGHLATGFGINSVGKIPLGLKRKGLRIVVTGGAGFVGSHLVDRLISRGDSVIVVDNFFTGRKENVVHHFGNPRFELIRHDVVEPLLLEVDQIYHLACPASPVHYKHNPVKTIKTNVVGTLNMLGLAKRVGARFLLTSTSEVYGDPLQHPQVETYWGNVNPIGVRSCYDEGKRTAETLTMDYHRGAGVEVRIARIFNTYGPRMCIDDGRVVSNFVAQALRKEPLTVYGDGKQTRSFQYVSDLVEGLMRLMEGEHVGPFNLGNPGEFTMLELAQVVQETIDPNAKIEFRPNTEDDPHKRKPDITKAKDQLGWEPKVPLRKGLPMMVSDFRQRIFGDHKENVATSA

SEQ ID NO: 21646 - protein, 439 aa, Tripterygium wilfordii
MGSELIYRGHEEAQPTADGYSPKPAKPWFSVVRPLRYLLREQRLIFVVVGIAIATVFFTLLQSSSPASYRHESYVPISGSISYFDRDSNRQSNKPYEQHRMLVHSSGKVPLGLKRKGLRIVVTGGAGFVGSHLVDRLIARGDSVIVVDNFFTGRKENVMHHFSNPRFELIRHDVVEPLLLEVDQIYHLACPASPVHYKFNPVKTIKTNVVGTLNMLGLAKRVGARFLLTSTSEVYGDPLQHPQVETYWGNVNPIGVRSCYDEGKRTAETLTMDYHRGASVEVRIARIFNTYGPRMCIDDGRVVSNFVAQALRKEPLTVYGDGKQTRSFQYVSDLVEGLMRLMEGEHVGPFNLGNPGEFTMLELAQVVQETIDPNAKIEFRPNTEDDPHKRKPDITKAKDQLGWEPKVSLRKGLPLMVADFRQRIFGDHKEGNTTPAVAS

SEQ ID NO: 21647 - protein, 433 aa, Gossypium hirsutum
  Sequence also found in Organisms: Gossypium raimondii
MGSSELIFRGHETQPVSDSYSPKPDKPWASVTRPIRYMLREQRLLFVFLGIAIATLIFTLFPASRAPQHNFADSITYFPIDTQSKFSNPHRLGFGSSNPTGKIPLGLKRKGLRIVVTGGAGFVGSHLVDRLIARGDSVMVVDNFFTGRKENVMHHFGNPNFELIRHDVVEPLLLEVDQIYHLACPASPVHYKFNPVKTIKTNVVGTLNMLGLAKRVGARFLLTSTSEVYGDPLQHPQKETYWGNVNPIGVRSCYDEGKRTAETLTMDYHRGAGVEVRIARIFNTYGPRMCIDDGRVVSNFVAQALRKEPLTVYGDGKQTRSFQYVSDLVEGLMRLMEGEHVGPFNLGNPGEFTMLELAEVVQETIDPNAKIEFRPNTEDDPHKRKPDISRAKELLGWEPKVSLRKGLPLMVSDFRQRIFGDHKEGSSNNEASS

SEQ ID NO: 21648 - protein, 433 aa, Castanea mollissima
MGSELIFRGHESQPVSDTYTPKEPKPWFSVTQPIRYMLREQRLVFVLVGIAIATIVFTLLPASSSTSRAEYGHFTIPETTTRLSLYDQKPMYEHRSAFHMYSSGKVPLGLKRKGLRIVVTGGAGFVGSHLVDRLMERGDSVIVVDNFFTGRKENVMHHFGNPRFELIRHDVVEPLLLEVDQIYHLACPASPVHYKFNPVKTIKTNVVGTLNMLGLAKRVGARFLLTSTSEVYGDPLQHPQVETYWGNVNPIGVRSCYDEGKRTAETLTMDYHRGAGVEVRIARIFNTYGPRMCIDDGRVVSNFVAQALRKEPMTVYGDGKQTRSFQYVSDLVEGLMRLMEGEHVGPFNLGNPGEFTMLELAGVVRETIDPDAKIEYRPNTEDDPHKRKPDITKAKELLGWQPKVELRKGLPLMVSDFRKRIFGDHKEGSATTA

SEQ ID NO: 21649 - protein, 441 aa, Euonymus alatus
MGSELIYRGHEEAQPTTDGYSPKPPKPWLSAVRPISYLLREQRLIFVIVGIAIATVFFTLLPSSSHGSYRHESYVPITDSISHFGRDSYPQSNKPYEQHRMLVHSSGKVPLGLKRKGLRIVVTGGAGFVGSHLVDRLIARGDSVIVVDNFFTGRKENVMHHFPNPRFELIRHDVVEPLLLEVDQIYHLACPASPVHYKFNPVKTIKTNVVGTLNMLGLAKRVGARFLLTSTSEVYGDPLQHPQVETYWGNVNPIGVRSCYDEGKRTAETLTMDYHRGAGVEVRIARIFNTYGPRMCIDDGRVVSNFVAQALRKEPLTVYGDGKQTRSFQFVSDLVEGLMRLMEGEHVGPFNLGNPGEFTMLELAQVVQETIDPNAKIEFRPNTEDDPHKRKPDITRAKDLLGWEPKVSLRKGLPLMVSDFRQRIFGDHKEGSSSTTSTVSS

SEQ ID NO: 21650 - protein, 428 aa, Glycine max
MSSSSSGLIFRGHEAHPMDDAYYPKPQKPWLSFGYLLREQRLHFLLLGFVLATLFFFLLPSSSPSQPLGAHDPFPTPYLEPTRWPTNSRSYDVVSVHSVGKIPLGIKRKGLRIVVTGGAGFVGSHLVDRLIARGDSVIVVDNFFTGMKENVMHHFGNPNFELIRHDVVEPLLLEVDQIYHLACPASPVHYKFNPVKTIKTNVVGTLNMLGLAKRVGARFLLTSTSEIYGDPLEHPQKETYWGNVNPIGVRSCYDEGKRTAETLTMDYHRGAGVEVRIARIFNTYGPRMCLDDGRVVSNFVAQALRKEPLTVYGDGKQTRSFQYVSDLVEGLMRLMEGEHVGPFNLGNPGEFTMLELAKVVQETIDPEAKIEYRPNTEDDPHKRKPDISRAKEQLGWEPKVDLRKGLPLMVSDFRQRIFGDQKEGTTSA

SEQ ID NO: 21651 - protein, 438 aa, Fagus grandifolia
MASELIFRGHESQPVSDTYSPKQIKPWFSVTQPIRYMLREQRLVFVLVGIAIATIVFTLIPSSSRVDYSHLTIHDTYFDHDTTRLNPINHDKPLYEHRSAFKNYNSGGKVPLGLKRKGLRIVVTGGAGFVGSHLVDRLIERGDSVIVVDNFFTGRKENVMHHFGNPRFELIRHDVVEPLLLEVDQIYHLACPASPVHYKFNPVKTIKTNVVGTLNMLGLAKRVGARFLLTSTSEVYGDPLQHPQVETYWGNVNPIGVRSCYDEGKRTAETLTMDYHRGAGVEVRIARIFNTYGPRMCIDDGRVVSNFVAQALRKEPMTVYGDGKQTRSFQYVSDLVEGLMRLMEGEHVGPFNLGNPGEFTMLQLANVVQETIDPDAKIEYRPNTEDDPHKRKPDITKAKELLGWEPKVELRKGLPLMVSDFRKRIFGDHKEEGATTAK

SEQ ID NO: 21652 - protein, 428 aa, Lactuca sativa
MGSELIYRGHEPHPTSDLYSPKPNKPWSAVIPPIRYMLREQRLVFVLIGIAISTFFFTLIPSSTTFSSPTISAYTSYAVSGSAQLMNPGRPAYRFNSGGKIPLGLKRKGLRIVVTGGAGFVGSHLVDRLIERGDSVIVVDNFFTGNKENVMHHFGNPRFELIRHDVVEPLLLEVDQIYHLACPASPVHYKYNPVKTIKTNVVGTLNMLGLAKRVGARFLLTSTSEVYGDPLQHPQVETYWGNVNPIGVRSCYDEGKRTAETLTMDYHRGAGVEVRIARIFNTYGPRMCIDDGRVVSNFVAQALRKEPMTVYGDGKQTRSFQFVSDLVEGLMRLMEGEHVGPFNLGNPGEFTMLELAQVVQETIDPDAKIEFRPNTEDDPHKRKPDITKAKDLLGWEPKVALRKGLPMMVSDFRQRIFGDHNKDQAATA

SEQ ID NO: 21653 - protein, 415 aa, Glycine max
MSSSTGLIFRGHEAQPMDDAYYPKPQKPWLSFRYLLREQRLHFLLLGIVLATLFFFLLPSGLHDPFPTPYLEPTRWPTNSPSYDVVSVHSVGKIPLGIKRKGLRIVVTGGAGFVGSHLVDRLIARGDSVIVVDNFFTGRKENVMHHFGNPNFELIRHDVVEPLLLEVDQIYHLACPASPVHYKFNPTNVVGTLNMLGLAKRVGARFLLTSTSEVYGDPLEHPQKETYWGNVNPIGVRSCYDEGKRTAETLTMDYHRGAGVEVRIARIFNTYGPRMCLDDGRVVSNFVAQALRKEPLTVYGDGKQTRSFQYVSDLVEGLMRLMEGEHVGPFNLGNPGEFTMLELAKVVQETIDPEAKIEYRPNTEDDPHKRKPDISRAKEQLGWEPKVDLRKGLPLMVSDFRQRIFGDQKEGTTSA

SEQ ID NO: 21654 - protein, 431 aa, Aristolochia fimbriata
MGSELIYRRHENQPVPDTYSPKQPKPWLAVERPVRYLLREQRLLFVLVGMALATLVFTLAPRAPLSPVKSTRPTTSDFTALESLSHRVAFETQPSYSFNPGGKIPLGLKRKGLRIVVTGGAGFVGSHLVDRLIKRGDSVIVVDNFFTGRKENVMHHFGNPRFELIRHDVVEPLLLEVDQIYHLACPASPVHYKFNPVKTIKTNVVGTLNMLGLAKRVGARFLLTSTSEVYGDPLQHPQVETYWGNVNPIGVRSCYDEGKRTAETLTMDYHRGAGVEVRIARIFNTYGPRMCIDDGRVVSNFVAQALRKEPLTVYGDGKQTRSFQYVSDLVEGLIRLMEGEHVGPFNLGNPGEFTMLELAKVVQETIDPNARIEFRPNTEDDPHKRKPDITRAKEMLGWEPKVALRQGLPLMVKDFRTRVFGDQKEASSVAS

SEQ ID NO: 21655 - protein, 441 aa, Malus domestica
MGSELIFRGHEADQQVADTYSPKPPKPWASVTRPIHYLLREQRLVFILVGIAIATVVFTLLPSSAPISPYATGNVPISNEYVRYDFDSSATAHYKPAYDRRFGLNSWNSGGKVPLGLKRKGLRIVVTGGAGFVGSHLVDRLIERGDSVIVVDNFFTGRKENVMHHFGNPRFELIRHDVVEPLLLEVDQIYHLACPASPVHYKFNPVKTIKTNVVGTLNMLGLAKRIGARFLLTSTSEVYGDPLQHPQVETYWGNVNPIGVRSCYDEGKRTAETLTMDYHRGAGVEVRIARIFNTYGPRMCIDDGRVVSNFVAQALRKEPMTVYGDGKQTRSFQYVSDLVEGLMRLMEGEHVGPFNLGNPGEFTMLELAKVVQETIDPAAKIEYRPNTEDDPHKRKPDITKAKDLLGWQPKVSLQKGLPLMVSDFRKRIFGDHKEEGATTAL

SEQ ID NO: 21656 - protein, 441 aa, Tripterygium wilfordii
MEKGSELTYRGHEEAQPTADGYTPKPPKPWLSVVRLIRYLLREQRLIFVLVGIAIATVFFALFPSSSHRSYRHESDVPILDSISYFGRDSYRQSNKPYEQHRMLVHSIGKVPLGLKRKGLRIVVTGGAGFVGSHLVDRLIARGDSVIVVDNFFTGRKENVMHHFSNPRFELIRHDVVEPLLLEVDQIYHLACPASPVHYKFNPVKTIKTNVVGTLNMLGLAKRVGARFLLTSTSEVYGDPLQHPQVETYWGNVNPIGVRSCYDEGKRTAETLTMDYHRGAGVEVRIARIFNTYGPRMCIDDGRVVSNFVAQALRKEPLTVYGDGKQTRSFQYVSDLVEGLMRLMEGEHVGPFNLGNPGEFTMLELAQVVQETIDPNAKIEFRANTEDDPHKRKPDITKAKDQLGWEPKVSLRKGLPLMVSDFRQRIFGDHKEGSTTSTVSS

SEQ ID NO: 21657 - protein, 440 aa, Theobroma cacao
MGSELIYRGHETHPASDSYSPKPVKPWASVIRPIRYMLREQRLLFVLVGIAIATLIFTIFPTSRAPHVPHHHFTTSISDSITYFPIEPQNKFSYPHRVGFESANPTGKIPLGLKRKGLRIVVTGGAGFVGSHLVDRLIARGDSVIVVDNFFTGRKENVMHHFGNPNFELIRHDVVEPLLLEVDQIYHLACPASPVHYKFNPVKTIKTNVVGTLNMLGLAKRVGARFLLTSTSEVYGDPLQHPQKETYWGNVNPIGVRSCYDEGKRTAETLTMDYHRGAGVEVRIARIFNTYGPRMCIDDGRVVSNFVAQALRKEPLTVYGDGKQTRSFQYVSDLVEGLMRLMEGEHVGPFNLGNPGEFTMLELAEVVQETIDPNAKIEFRPNTEDDPHKRKPDISRAKELLGWQPKVSLRKGLPLMVSDFRQRIFGDHKEGSNTNNASTS

SEQ ID NO: 21658 - protein, 427 aa, Cichorium intybus
MGSELIYRGHEPQPTSDLYSPKPNKPWSAVIPPIRYMLREQRLVFVLIGIAIATFFFAFIPSSTTFSPPTTSAYTSYSVSGSAQIINPQRPVYRFQSGGKIPLGLKRKGLRIVVTGGAGFVGSHLVDRLIERGDSVIVVDNFFTGNKDNVMHHFGNPRFELIRHDVVEPLLLEVDQIYHLACPASPVHYKYNPVKTIKTNVVGTLNMLGLAKRVGARFLLTSTSEVYGDPLQHPQVETYWGNVNPIGVRSCYDEGKRTAETLTMDYHRGAGVEVRIARIFNTYGPRMCIDDGRVVSNFVAQALRKEPMTVYGDGKQTRSFQFVSDLVEGLMRLMEGEHVGPFNLGNPGEFTMLELAQVVQETIDPDAKIEFRPNTEDDPHKRKPDITKAKDLLGWEPKVALRKGLPMMVSDFRQRIFGDHKDMGATV

SEQ ID NO: 21659 - protein, 445 aa, Prunus mume
MGSELIFRGHDEAQHVADTYSPKPPKPWASVTRPIGYLLREQRLVFVLVGIAIATVGFTLLPSSRSSDVNGSVPISNEYVRYDFDSSTHLTHKPAYERRFGLTNWNSGGKVPLGLKRKGLRIVVTGGAGFVGSHLVDRLIERGDSVIVVDNFFTGRKENVMHHFGNPRFELIRHDVVEPLLLEVDQIYHLACPASPVHYKFNPVKTIKTNVVGTLNMLGLAKRIGARFLLTSTSEVYGDPLQHPQVETYWGNVNPIGVRSCYDEGKRTAETLTMDYHRGAGVEVRIARIFNTYGPRMCIDDGRVVSNFVAQALRKEPMTVYGDGKQTRSFQYVSDLVEGLMRLMEGEHVGPFNLGNPGEFTMLELAKVVQETIDPDAKIEYRPNTEDDPHKRKPDITKAKDLLGWQPKVSLQKGLPLMVSDFRKRIFGDHKEAGSTTTPTTTTTM

SEQ ID NO: 21660 - protein, 442 aa, Citrus clementina
  Sequence also found in Organisms: Citrus sinensis
MGSELIYRGHDSQLATDSYSPKPIKPWFAVTQPIRYMLREQRLVFVLVGIAIATLFFTVIPTSYPASYGGARGHVAISDSLSYYPVETYQRAYNPRVGFGAVNSGGKIPLGLKRKGLRIVVTGGAGFVGSHLVDRLIARGDSVIVVDNFFTGRKENVMHHFGNPNFELIRHDVVEPLLLEVDQIYHLACPASPVHYKFNPVKTIKTNVVGTLNMLGLAKRVGARFLLTSTSEVYGDPLQHPQKETYWGNVNPIGVRSCYDEGKRTAETLTMDYHRGAGVEVRIARIFNTYGPRMCIDDGRVVSNFVAQALRKEPLTVYGDGKQTRSFQFVSDLVEGLMRLMEGEHVGPFNLGNPGEFTMLELAQVVQETIDPNAKIEFRPNTEDDPHKRKPDISRAKELLGWEPKVSLRKGLPKMVKDFRQRIFGDHKEGGAGATPDTTSSA

SEQ ID NO: 21661 - protein, 432 aa, Vaccinium corymbosum
MGSELIYRGHETQSQSDAYSPKQPKPWLTVIRPIRYLLREQRLLFVLIGIVIATLFFTLLPPSSSPQNTNSLYFEPDSTQLSHRVFYQSNSGGPFNSGGKIPLGLKRKGLRIVVTGGAGFVGSHLVDRLIGRGDSVIVVDNFFTGRKENLMRHFGNPRFELIRHDVVEPILLEVDQIYHLACPASPVHYKFNPVKTIKTNVVGTLNMLGLAKRVGARFLLTSTSEVYGDPLQHPQVETYWGNVNPIGVRSCYDEGKRTAETLTMDYHRGAGVEVRIARIFNTYGPRMCIDDGRVVSNFVAQALRKEPLTVYGDGKQTRSFQYVSDLVEGLMRLMEGEHVGPFNLGNPGEFTMLELAQVVQETIDSNAKIEYRPNTEDDPHKRKPDITRAKELLGWEPKVSLRKGLPLMVSDFRQRIFGDHKEDGASTTMSSD

SEQ ID NO: 21662 - protein, 436 aa, Panax ginseng
MGSELIYRGHESQPMADEYSPKPNKPWLFVIRPIRYMLREQRLIFVLVGIAIATLVFSILPSSSNSPYAADGSGPNAISDSYLSTQYPHGATYQNRAAGLRAFSSGGKIPLGLKSKGLRIVVTGGAGFVGSHLVDRLMARGDSVIVVDNFFTGRKENVMHHFGNPRFELIRHDVVEPLLLEVDQIYHLACPASPVHYKHNPVKTIKTNVVGTLNMLGLAKRIGARFLLTSTSEVYGDPLQHPQVETYWGNVNPVGVRSCYDEGKRTAETLTMDYHRGAGVEVRIARIFNTYGPRMCIDDGRVVSNFVAQALRKEPLTVYGDGKQTRSFQYVSDLVDGLMRLMEGEHVGPFNLGNPGEFTMLELAQVVQETIDPNAKIEFRPNTEDDPHKRKPDITKAKDLLGWEPKVPLRKGLPLMVSDFRQRVFGDQKEGDTTSA

SEQ ID NO: 21663 - protein, 444 aa, Prunus persica
MGSELIFRGHEAQHVADTYSPKPPKPWASVTRPIGYLLREQRLVFVLVGIAIATVGFTLLPSSRSPYVNGNVPISNEYVRYDFDSSTHLTHKPAYERRFGLTNWNSGGKVPLGLKRKGLRIVVTGGAGFVGSHLVDRLIERGDSVIVVDNFFTGRKENVMHHFGNPRFELIRHDVVEPLLLEVDQIYHLACPASPVHYKFNPVKTIKTNVVGTLNMLGLAKRIGARFLLTSTSEVYGDPLQHPQVETYWGNVNPIGVRSCYDEGKRTAETLTMDYHRGAGVEVRIARIFNTYGPRMCIDDGRVVSNFVAQALRKEPMTVYGDGKQTRSFQYVSDLVEGLMRLMEGEHVGPFNLGNPGEFTMLELAKVVQETIDPDAKIEYRPNTEDDPHKRKPDITKAKDLLGWQPKVSLQKGLPLMVSDFRKRIFGDHKEAGSTTTPTTTTTM

SEQ ID NO: 21664 - protein, 429 aa, Taraxacum officinale
MGSELIYRGHEPLPTSDLYSPKPNKPWSAVIPPIRYMLREQRLVFVLIGIAIATFFFSFIPSSTTSSSPTISAYTSYAVAGSAQLMNPRRPAYRYNSGGKIPLGLKRKGLRIVVTGGAGFVGSHLVDRLIERGDSVIVVDNFFTGNKDNVMHHFGNPRFELIRHDVVEPLLLEVDQIYHLACPASPVHYKYNPVKTIKTNVVGTLNMLGLAKRVGARFLLTSTSEVYGDPLQHPQVETYWGNVNPIGVRSCYDEGKRTAETLTMDYHRGAGVEVRIARIFNTYGPRMCIDDGRVVSNFVAQALRKEPMTVYGDGKQTRSFQFVSDLVEGLMRLMEGEHVGPFNLGNPGESTMLELAQVVQETIDPDAKIEFRPNTEDDPHKRKPDITKAKDLLGWEPKVALRKGLPMMVSDFRQRIFGDHNDMSQGATA

SEQ ID NO: 21665 - protein, 439 aa, Panax ginseng
MASELIYRGHESQPANDEYSPKPNKPWLSVIRPIRYMLREQRLIFVFVGIAIATLFFAILPSSSITTTTYVSGRRGPISISDPYFSSTQHPHWAAYQNRAVRFESFNPGGKIPLGLKRKGLRIVVTGGAGFVGSHLVDRLIARGDSVIVVDNFFTGRKENVMHHFGNPRFELIRHDVVEPLLLEVDQIYHLACPASPVHYKFNPVKTIKTNVVGTLNMLGLAKRIGARFLLTSTSEVYGDPLQHPQVETYWGNVNPIGVRSCYDEGKRTAETLTMDYHRGAGVEVRIARIFNTYGPRMCIDDGRVVSNFVAQALRKEPLTVYGDGKQTRSFQYVSDLVEGLMRLMEGEHVGPFNLGNPGEFTMLELAQVVQETIDPNAKIEFRPNTEDDPHKRKPDITKAKDLLGWEPKVALRKGLPLMVQDFRQRVFGDQKEDGTTSA

SEQ ID NO: 21666 - protein, 432 aa, Amaranthus tuberculatus
MASELIFRGHETQLKSDEYYPKPPKPWLTVTRPFHYLLREQRLVFLILGIAIAALIFSVFPSSSSPSSPINYNMHESIGGESFLTAESTRLMPHRVMDGFRSGKVPLGLKRKGLRIVVTGGAGFVGSHLVDRLIARGDSVIVVDNFFTGRKENVMHHFSNPRFELIRHDVVEPLLLEVDQIYHLACPASPVHYKHNPVKTIKTNVVGTLNMLGLAKRVGAKFLLTSTSEVYGDPLEHPQKETYWGNVNPIGVRSCYDEGKRTAETLTMDYHRGAGVEVRIARIFNTYGPRMCIDDGRVVSNFVAQALRKEPMTVYGDGKQTRSFQFVSDLVDGLMRLMEGEHVGPFNLGNPGEFTMLELAKVVQETIDPNAKIEFRPNTEDDPHKRKPDISRAKELLGWEPKIPLRKGLPMMVSDFRQRIFGDQKGGDTTAF

SEQ ID NO: 21667 - protein, 442 aa, Chenopodium quinoa
MASELIFRGGHESHLKSDEYDSPKPLKPWLTVTRPIHYLLREQRLVFLVLGIGIATLIFSLTPSSSSSSPSSKIDINMLHDSIGGESFLTAESTRLIPTHHSRVSDGFRSGKVPLGLKRKGLRIVVTGGAGFVGSHLVDRLIARGDSVIVVDNFFTGRKENVMHHFGNPRFELIRHDVVEPLLLEVDQIYHLACPASPVHYKHNPVKTIKTNVVGTLNMLGLAKRVGARFLLTSTSEVYGDPLEHPQKETYWGNVNPIGVRSCYDEGKRTAETLTMDYHRGAGVEVRIARIFNTYGPRMCIDDGRVVSNFVAQALRKEPMTVYGDGKQTRSFQFVSDLVEGLMRLMEGEHVGPFNLGNPGEFTMLELAKVVQETIDPNAKIEFRPNTEDDPHKRKPDISKAKELLGWEPKIALRKGLPMMVSDFRQRIFGDQKGGDTTTTAF

SEQ ID NO: 21668 - protein, 423 aa, Glycine max
MSSSSSGLIFRGHEAHPMDDAYYPKPQKPWLSFGYLLREQRLHFLLLGFVLATLFFFLLPSSSPSQPLGAHDPFPTPYLEPTRWPTNSRSYDVVSVHSVGKIPLGIKRKGLRIVVTGGAGFVGSHLVDRLIARGDSVIVVDNFFTGMKENVMHHFGNPNFELIRHDVVEPLLLEVDQIYHLACPASPVHYKFNPTNVVGTLNMLGLAKRVGARFLLTSTSEIYGDPLEHPQKETYWGNVNPIGVRSCYDEGKRTAETLTMDYHRGAGVEVRIARIFNTYGPRMCLDDGRVVSNFVAQALRKEPLTVYGDGKQTRSFQYVSDLVEGLMRLMEGEHVGPFNLGNPGEFTMLELAKVVQETIDPEAKIEYRPNTEDDPHKRKPDISRAKEQLGWEPKVDLRKGLPLMVSDFRQRIFGDQKEGTTSA

SEQ ID NO: 21669 - protein, 435 aa, Valeriana officinalis
MGSSELFYRGHDSQPSSAAYSPKPSKPLLTVIRPIRYMLKEQRLIFVFLGIAIATLVFTFIPAASKSSPLRESTRGRLALSDPYFSVESGYHSHAAAAIGSFHSGGKIPLGLKRKGLRIVVTGGAGFVGSHLVDRLMARGDSVIVVDNFFTGRKENVMHHFGNPRFELIRHDVVEPLLLEVDQIYHLACPASPVHYKFNPVKTIKTNVVGTLNMLGLAKRVGARFLLTSTSEVYGDPLQHPQVETYWGNVNPIGVRSCYDEGKRTAETLTMDYHRGAGVEVRIARIFNTYGPRMCIDDGRVVSNFVAQALRKEPLTVYGDGKQTRSFQYVSDLVEGLMRLMEGEHVGPFNLGNPGEFTMLDLAQVVQETIDPNAKIEFKPNTEDDPHKRKPDITKAKDLLGWEPKIALRKGLPLMVSDFRQRIFGDHKDHSSSSE

SEQ ID NO: 21670 - protein, 436 aa, Humulus lupulus
MSSALTFRGHETQPVADTYSPKPPKPWLAVTRPIRYILREQRLIFVLIGIAIATLGFTLLPSNQAPQRYSSAIFDSFPAELESSHLSHRPVYNERRFGIQSWNSGGKIPLGLKRKGKRIVVTGGAGFVGSHLVDRLMERGDSVIVVDNFFTGRKENVMHHFGNPRFELIRHDVVEPLLLEVDQIYHLACPASPVHYKFNPVKTIKTNVVGTLNMLGLAKRVGARFLLTSTSEVYGDPLQHPQVETYWGNVNPIGVRSCYDEGKRTAETLTMDYHRGAEVEVRIARIFNTYGPRMCIDDGRVVSNFVAQALRKEPMTVYGDGKQTRSFQYVSDLVEGLMRLMEGEHVGPFNLGNPGEFTMLELAKVVQETIDPDAKIEHRPNTEDDPHKRKPDITKAKEQLGWEPKVSLRKGLPLMVKDFRQRIFGDHKEGGSSTTA

SEQ ID NO: 21671 - protein, 434 aa, Ocimum basilicum
MASELIFRGHESHQVSDVYSPKPAKPWLSVTRPIRYLLREQRLVFVFVGIAIATLFFTVIPSSSNSMKSPISDSYIPSELTQSQPHRSMYQNGHLTTGFGINSVGKIPLGLKRKGLRIVVTGGAGFVGSHLVDRLIARGDSVIVVDNFFTGRKENLVHHFGNPRFELIRHDVVEPLLLEVDQIYHLACPASPVHYKHNPVKTIKTNVVGTLNMLGLAKRVGARFLLTSTSEVYGDPLQHPQVETYWGNVNPIGVRSCYDEGKRTAETLTMDYHRGAGVEVRIARIFNTYGPRMCIDDGRVVSNFVAQALRKEPLTVYGDGKQTRSFQFVSDLVEGLMRLMEGEHVGPFNLGNPGEFTMLELAEVVQETIDPNAKIEFRPNTEDDPHKRKPDISKAKELLGWEPKVPLRKGLPMMVSDFRQRIFGDHKQDSATSA

SEQ ID NO: 21672 - protein, 439 aa, Panax ginseng
MASELIYRGHESQPANDEYSPKPNKPWLSVIRPIRYMLREQRLIFVFVGIAIATLFFAILPSSSITTTTYVSGRRGPISISDPYFSSTQHPHWAAYQNRAVRFESFNPGGKIPLGLKRKGLRIVVTGGAGFVGSHLVDRLIARGDSVIVVDNFFTGRKENVMHHFGNPRFELIRHDVVEPLLLEVDQIYHLACPASPVHYKHNPVKTIKTNVVGTLNMLGLAKRIGARFLLTSTSEVYGDPLQHPQVETYWGNVNPIGVRSCYDEGKRTAETLTMDYHRGAGVEVRIARIFNTYGPRMCIDDGRVVSNFVAQALRKEPLTVYGDGKQTRSFQYVSDLVEGLMRLMEGEHVGPFNLGNPGEFTMLELAQVVQETIDPNAKIEFRPNTEDDPHKRKPDITKAKDLLGWEPKVPLRKGLPLMVQDFRQRVFGDQKEDDTTSA

SEQ ID NO: 21673 - protein, 439 aa, Panax ginseng
MASELIYRGHESQPANDEYSPKPNKPWLSVIRPIRYMLREQRLIFVFVGIAIATLFFAILPSSSITTTTYASGRRGPISISDPYFSSTQQPHWAAYQNRAVRFGSFNTGGKIPLGLKRKGLRIVVTGGAGFVGSHLVDRLIARGDSVIVVDNFFTGRKENVMHHFGNPRFELIRHDVVEPLLLEVDQIYHLACPASPVHYKHNPVKTIKTNVVGTLNMLGLAKRIGARFLLTSTSEVYGDPLQHPQVETYWGNVNPIGVRSCYDEGKRTAETLTMDYHRGAGVEVRIARIFNTYGPRMCIDDGRVVSNFVAQALRKEPLTVYGDGKQTRSFQYVSDLVEGLMRLMEGEHVGPFNLGNPGEFTMLELAQVVQETIDPNAKIEFRPNTEDDPHKRKPDITKAKDLLGWEPKVALRKGLPLMVQDFRQRVFGDQKEDGTTSA

SEQ ID NO: 21674 - protein, 443 aa, Populus trichocarpa
MGSSELIFRGHDETQPASDAYSPKPPKPWLAVTRPIRYLLLEQRLVFILVGIAIATLFFTLLPSSSSSSPYEHDPIPNTFSHFSHELTTPMRYKYYEPLRVGLQSANSGGKIPLGLKSKSLRIVVTGGAGFVGSHLVDRLIARGDSVIVVDNFFTGRKENVMHHFKNPRFELIRHDVVEPLLLEVDQIYHLACPASPVHYKHNPVKTIKTNVVGTLNMLGLAKRVGARFLLTSTSEVYGDPLQHPQVETYWGNVNPIGVRSCYDEGKRTAETLTMDYHRGAGVEVRIARIFNTYGPRMCIDDGRVVSNFVAQALRKEPMTVYGDGKQTRSFQFVSDLVEGLMRLMEGEHVGPFNLGNPGEFTMLELAQVVQETIDPNARIEFRPNTEDDPHKRKPDITKAKDLLGWEPKISLRQGLPMMVSDFRQRVFGDHKEEGTTSTMSTS

SEQ ID NO: 21675 - protein, 436 aa, Spinacia oleracea
MASELIFRGGHESPLKSDEYDSPKPQKPWLTVTRPIHYLLREQRLVFLIVGIVIATLIFSLLPSSTVTTTPSLNYNMHDSIGGESFLTAESTRLMPTHRVTDGFRSGKVPLGLKRKGLRIVVTGGAGFVGSHLVDRLIARGDSVIVVDNFFTGRKENVMHHFGNPRFELIRHDVVEPLLLEVDQIYHLACPASPVHYKHNPVKTIKTNVVGTLNMLGLAKRIGARFLLTSTSEVYGDPLEHPQKETYWGNVNPIGVRSCYDEGKRTAETLAMDYHRGAGVEVRIARIFNTYGPRMCIDDGRVVSNFVAQALRKEPMTVYGDGKQTRSFQFVSDLVEGLMRLMEGEHVGPFNLGNPGEFTMLELAKVVQETIDPNAKIEFRPNTEDDPHKRKPDISKAKELLGWEPKIALRKGLPMMVSDFRQRIFGDQKGGDTTAF

SEQ ID NO: 21676 - protein, 436 aa, Mesembryanthemum crystallinum
MGSELIFRGHEAQHQSDEYSPKPPKPWLAVTRPIHYLLREQRLVFLLAGIAIATVIFAFSPSSSTSSSAATFASNTYMHDSIGGESFLTAEPTRLVPHRVVDAFRSGKVPLGLKRKGLRIVVTGGAGFVGSHLVDRLIKRGDSVIVVDNFFTGRKENVMHHFGNPRFEMIRHDVVEPILLEVDQIYHLACPASPVHYKHNPVKTIKTNVVGTLNMLGLAKRVGARFLLTSTSEVYGDPLEHPQKETYWGNVNPIGVRSCYDEGKRTAETLAMDYHRGAGVEVRIARIFNTYGPRMCIDDGRVVSNFVAQALRKEPMTVYGDGKQTRSFQFVSDLVEGLMRLMEGEHVGPFNLGNPGEFTMLELAKVVQETIDPNAKIEFRPNTEDDPHKRKPDISKAKEQLGWEPKIPLKEGLPMMVSDFRQRIFGDQKQADTTAF

SEQ ID NO: 21677 - protein, 444 aa, Vitis vinifera
MGSELIFRGHETQPMADGYSPKPPKPWLSVVRPIRYMLREQRLLFTLVGIAIATVVFLLLPSSPAPYTHRFDPISDSYFPSETTTQLAHRVAYAGHGGGGFGFVNSGGKVPLGLKRKGLRIVVTGGAGFVGSHLVDRLIRRGDSVIVVDNFFTGRKENVMHHFGNPRFELIRHDVVEPLLLEVDQIYHLACPASPVHYKFNPVKTIKTNVVGTLNMLGLAKRVGARFLLTSTSEVYGDPLQHPQVETYWGNVNPIGVRSCYDEGKRTAETLTMDYHRGAEVEVRIARIFNTYGPRMCIDDGRVVSNFVAQALRKEPLTVYGDGKQTRSFQYVSDLVEGLIRLMEGEHVGPFNLGNPGEFTMLELAQVVQETIDPNAKIEFRPNTEDDPHKRKPDISKAKDLLGWEPKVALRKGLPLMVSDFRERIFGDHKEDGATTTTSSSSSS

SEQ ID NO: 21678 - protein, 423 aa, Phaseolus vulgaris
MASGLVFRGHEAQPVNDADFPKPQKPWFFLRYILREQRLHFLFLGVLLASVFFFFLLPSSSSPPVRAHDPFPASFLARDDLTLWPTTNTRSYDVAVHSVGKIPLGIKRKGLRVVVTGGAGFVGSHLVDRLISRGDSVIVVDNFFTGRKENVMHHFGNPNFELLRHDVVEPLLLEVDQIYHLACPASPVHYKFNPTNVVGTLNMLGLAKRIGARFLLTSTSEVYGDPLQHPQKETYWGNVNPIGVRSCYDEGKRTAETLAMDYHRGAGVEVRIARIFNTYGPRMCLDDGRVVSNFVAQALRKEALTVYGDGKQTRSFQYVSDLVEGLMRLMEGEHVGPFNLGNPGEFTMLELAKVVQETIDPEAKIEYRPNTEDDPHKRKPDITRAKELLGWEPKVDLRKGLPLMVSDFRQRIFGDQKEGATST

SEQ ID NO: 21679 - protein, 446 aa, Manihot esculenta
MPSELIFRGHDEAQHITDSYSPKPPKRWLSISRPIRYMLREQRLVFVLVGIVIATLFFTVRPSSSRAPYVPHHKHKPISDSLDHFSRVSVPARYKLYEPHGTGFGSMNTGGKIPLGLKRKGLRIVVTGGAGFVGSHLVDRLIERGDSVIVVDNFFTGRKENVMHHFKNPRFELIRHDVVEPLLLEVDQIYHLACPASPVHYKHNPVKTIKTNVVGTLNMLGLAKRVGARFLLTSTSEVYGDPLQHPQVETYWGNVNPIGVRSCYDEGKRTAETLTMDYHRGAGVEVRIARIFNTYGPRMCIDDGRVVSNFVAQALRKEPLTVYGDGKQTRSFQYVSDLVEGLMRLMEGEHVGPFNLGNPGEFTMLELAQVVQETIDPNARIEFRPNTEDDPHKRKPDITKAKDLLGWEPKISLRKGLPLMVSDFRQRIFGDHKEDTTTTRSTVSTT

SEQ ID NO: 21680 - protein, 444 aa, Manihot esculenta
MGSELIFRGHDDTQHETDSYSPKPPKRWLSFTRPIRYMLREQRLVFVLVGIVIATLFFTVLSSSSKAPYVHHHKYEPISDALAHFSSESASSRYKLYEPRMAGFGSMNSGGKIPLGLKRKGLRIVVTGGAGFVGSHLVDRLIERGDSVIVVDNFFTGRKENVMHHFKNPRFELIRHDVVEPLLLEVDQIYHLACPASPVHYKHNPVKTIKTNVVGTLNMLGLAKRVGARFLLTSTSEVYGDPLQHPQVETYWGNVNPIGVRSCYDEGKRTAETLTMDYHRGAGVEVRIARIFNTYGPRMCIDDGRVVSNFVAQALRKEPLTVYGDGKQTRSFQYVSDLVEGLMRLMEGEHVGPFNLGNPGEFTMLELAQVVQETIDPNARIEFRPNTEDDPHKRKPDITKAKDMLGWEPKISLRKGLPLMVSDFRQRIFGDHNEASTTSNISTA

SEQ ID NO: 21681 - protein, 439 aa, Chenopodium quinoa
MASELIFRGGHEAHLKSDEYDSPKPLKPWLTVTRPIHYLLREQRLVFLVLGIGIATLIFSLTPSNTSSSNIDINMHDSIGGESFLTAESTRLIPTHHGRVSDGFRSGKVPVRARKRKGLRIVVTGGAGFVGSHLVDRLIARGDSVIVVDNFFTGRKENVMHHFGNPRFELIRHDVVEPLLLEVDQIYHLACPASPVHYKHNPVKTIKTNVVGTLNMLGLAKRVGARFLLTSTSEVYGDPLEHPQKETYWGNVNPIGVRSCYDEGKRTAETLAMDYHRGAGVEVRIARIFNTYGPRMCIDDGRVVSNFVAQALRKEPMTVYGDGKQTRSFQFVSDLVEGLMRLMEGEHVGPFNLGNPGEFTMLELAKVVQETIDPNAKIEFRPNTEDDPHKRKPDIGKAKELLGWEPKIALRKGLPMMVSDFRQRIFGDQKGGDTTTTAF

SEQ ID NO: 21682 - protein, 442 aa, Gossypium hirsutum
MGSELIYRGHETQLASDSYSPKPVKPWASVTRVVRYMLREQRLLFVLVGIAIATLVFNIFPASRAAHGPHLHSTTPLLDSIPYFPIETQNKFSYAHRLGFGSGNPTGKIPLGLKRKGLRIVVTGGAGFVGSHLVDRLIARGDSVIVVDNFFTGRKENVMHHFGNPNFELIRHDVVEPLLLEVDQIYHLACPASPVHYKFNPVKTIKTNVVGTLNMLGLAKRVGARFLLTSTSEVYGDPLQHPQKETYWGNVNPIGVRSCYDEGKRTAETLTMDYHRGAGVEVRIARIFNTYGPRMCIDDGRVVSNFVAQALRKEPLTVYGDGKQTRSFQYVSDLVEGLMRLMEGEHVGPFNLGNPGEFTMLELAEVVQETIDPNAKIEFRPNTEDDPHKRKPDISRAKELLGWQPKVSLRKGLPLMVSDFRQRIFGDHKVGSSTTTTNDSSS

SEQ ID NO: 21683 - protein, 442 aa, Gossypium raimondii
MGSELIYRGHETQLASDSYSPKPVKPWASVTRVVRYMLREQRLLFVLVGIAIATLVFNVFPASRAAHGPHLHSTTPLLDSIPYFPIETQNKFSYAHRLGFGSGNPTGKIPLGLKRKGLRIVVTGGAGFVGSHLVDRLIARGDSVIVVDNFFTGRKENVMHHFGNPNFELIRHDVVEPLLLEVDQIYHLACPASPVHYKFNPVKTIKTNVVGTLNMLGLAKRVGARFLLTSTSEVYGDPLQHPQKETYWGNVNPIGVRSCYDEGKRTAETLTMDYHRGAGVEVRIARIFNTYGPRMCIDDGRVVSNFVAQALRKEPLTVYGDGKQTRSFQYVSDLVEGLMRLMEGEHVGPFNLGNPGEFTMLELAEVVQETIDPNAKIEFRPNTEDDPHKRKPDISRAKELLGWQPKVSLRKGLPLMVSDFRQRIFGDHKVGSSTTTTNDSSS

SEQ ID NO: 21684 - protein, 439 aa, Nicotiana benthamiana
MASELIYRGPESQPVPDVYTPKPDKPWLSVIRPIRYLLREQRIVFLFAGIAIASLIFALLPSSRSGSLNYANNAIYDSYLPSESTQPQVAHRMIYQNRPGFGSFNSGGKIPLGLRRKGLRIVVTGGAGFVGSHLVDRLIARGDSVIVVDNFFTGRKENVMHHFGNPRFELIRHDVVEPLLLEVDQIYHLACPASPVHYKHNPVKTIKTNVVGTLNMLGLAKRVGARFLLTSTSEVYGDPLEHPQKETYWGNVNPIGVRSCYDEGKRTAETLTMDYHRGAGVEVRIARIFNTYGPRMCIDDGRVVSNFVAQALRKEPLTVYGDGKQTRSFQFVSDLVEGLMRLMEGEHVGPFNLGNPGEFTMLELAKVVQETIDPNAQIEFRPNTEDDPHKRKPDISRAKELLGWEPKVALRKGLPMMVQDFRQRIFGDHKEDTSSATTA

SEQ ID NO: 21685 - protein, 439 aa, Fragaria vesca
MGSELIFRGGHDEAQPASDTYSPKRPKPWASVTRPIGYLLREQRLIFILVGIVIATVCFTLLPSSRPAFHGQNPIPNDFVRFDFESTHLSHKPAYERRFGLTNYNSGGKVPLGLKRKGLRIVVTGGAGFVGSHLVDRLMERGDSVIVVDNFFTGRKENVQHHFGNPRFELIRHDVVEPLLLEVDQIYHLACPASPVHYKFNPVKTIKTNVVGTLNMLGLAKRVGARFLLTSTSEVYGDPLQHPQVETYWGNVNPIGVRSCYDEGKRTAETLTMDYHRGAGVEVRIARIFNTYGPRMCIDDGRVVSNFVAQALRKEPMTVYGDGKQTRSFQYVSDLVDGLMRLMEGEHVGPFNLGNPGEFTMLELAKVVQETIDKDAKIEFRPNTEDDPHKRKPDITKAKDLLGWQPKVSLRKGLPLMVSDFSKRIFGDHKEAAGATTTM

SEQ ID NO: 21686 - protein, 441 aa, Gossypium hirsutum
MGSELIYRGSETQPSSDSYSPKPVKPWASVTRTIHYLLREQRLLFVFVGIAIATLIFTVFPTSPAPYVAPHSRFTTLIPDSITYFPIETQQKFSSAHRLGFGSANPTSKIPLGLKRKGLRIVVTGGAGFVGSHLVDRLIARGDSVIVVDNFFTGRKQNVMHHFGNPNFELIRHDVVEPLLLEVDQIYHLACPASPVHYKFNPVKTIKTNVVGTLNMLGLAKRVGARFLLTSTSEVYGDPLQHPQKETYWGNVNPIGVRSCYDEGKRTAETLTMDYHRGAGVEVRIARIFNTYGPRMCIDDGRVVSNFVAQALRKEPLTVYGDGKQTRSFQYVSDLVEGLMRLMEGEHIGPFNLGNPGEFTMLELAEVVQETIDPNAKIEFRPNTEDDPHKRKPDISRAKELLGWEPKVSLRKGLPLMVSDFRQRIFGDHKEGSNTNNASSS

SEQ ID NO: 21687 - protein, 430 aa, Euphorbia peplus
MGSELIFRGHEDSQHTAEEYSPKPPKRWLFVTRPIRYILREQRLLFTLIGISIATLFFTFLPSSSPAPHELITDSLSHFDSSIPSRHKYYEPAQLVGFGIGMNSGGKIPLGLRRKGMRIVVTGGAGFVGSHLVDRLMERGDSVIVVDNFFTGRKENVMHHFKNPRFEMIRHDVVEPLLLEVDQIYHLACPASPVHYKHNPVKTIKTNVVGTLNMLGLAKRVGARFLLTSTSEVYGDPLQHPQVETYWGNVNPIGVRSCYDEGKRTAETLTMDYHRGAGVEVRIARIFNTYGPRMCIDDGRVVSNFVAQALRKEPLTVYGDGKQTRSFQYVSDLVEGLMRLMEGEHVGPFNLGNPGEFTMLELAQVVQETIDPNARIEFRPNTEDDPHKRKPDITKAKDLLGWEPKVSLRKGLPLMVSDFRQRVFGDHKED

SEQ ID NO: 21688 - protein, 441 aa, Gossypium raimondii
MGSELIYRGSETQPSSDSYSPKPVKPWASVTRPIHYLLREQRLLFVFIGIAIATLIFTVFPTSPAPYVAPHSRFTTLIPDSITYFPIETQQKFSSAHRLGFGSANPTGKIPLGLKRKGLRIVVTGGAGFVGSHLVDRLIARGDSVIVVDNFFTGRKQNVMHHFGNPNFELIRHDVVEPLLLEVDQIYHLACPASPVHYKFNPVKTIKTNVVGTLNMLGLAKRVGARFLLTSTSEVYGDPLQHPQKETYWGNVNPIGVRSCYDEGKRTAETLTMDYHRGAGVEVRIARIFNTYGPRMCIDDGRVVSNFVAQALRKEPLTVYGDGKQTRSFQYVSDLVEGLMRLMEGEHIGPFNLGNPGEFTMLELAEVVQETIDPNAKIEFRPNTEDDPHKRKPDISRAKELIGWEPKVSLRKGLPLMVSDFRQRIFGDHKEGSNTNNASSS

SEQ ID NO: 21689 - protein, 433 aa, Rosmarinus officinalis
MASELIFRGHESQPVSDTYSPKPPKPWLSVARPIRYILREQRLVFVFVGIAIATLFFTMLPAGSNPHAPIADSYIPSELTQSRPHRSMYQNGHLATGFGINSVGKIPLGLKRKGLRIVVTGGAGFVGSHLVDRLMARGDSVIVVDNFFTGRKENLVHHFGNPRFELIRHDVVEPLLLEVDQIYHLACPASPVHYKHNPVKTIKTNVVGTLNMLGLAKRVGARFLLTSTSEVYGDPLQHPQVETYWGNVNPIGVRSCYDEGKRTAETLTMDYHRGAGVEVRIARIFNTYGPRMCIDDGRVVSNFVAQALRKEPLTVYGDGKQTRSFQFVSDLVEGLMRLMEGEHVGPFNLGNPGEFTMLELAQVVQETIDPNAKIEFKPNTEDDPHKRKPDISKAKELLGWEPKIALRKGLPMMVSDFRQRIFGDHKQDVATSA

SEQ ID NO: 21690 - protein, 440 aa, Rosa hybrid cultivar
MGSELIFRGGHDEAQPASDTYSPKRPKPWASVTRPIGYLLREQRLIFILVGIAIATVCFTLLPSSRSPSYHGHNPIPNDFVKFDFESTHLSHKPTYERRFGLTNYNSGGKVPLGLKRKGLRIVVTGGAGFVGSHLVDRLMERGDSVIVVDNFFTGRKENVQHHFGNPRFELIRHDVVEPLLLEVDQIYHLACPASPVHYKFNPVKTIKTNVVGTLNMLGLAKRVGARFLLTSTSEVYGDPLQHPQVETYWGNVNPIGVRSCYDEGKRTAETLTMDYHRGAGVEVRIARIFNTYGPRMCIDDGRVVSNFVAQALRKEPMTVYGDGKQTRSFQYVSDLVDGLMRLMEGEHVGPFNLGNPGEFTMLELAKVVQETIDKDAKIEFRPNTEDDPHKRKPDITKAKDLLGWQPKVSLHKGLPLMVSDFSKRIFGDHKEAAGATTTM

SEQ ID NO: 21691 - protein, 430 aa, Silene vulgaris
MASELIFRGGHESQYKSDSYSPKPDKPFLLTTVTRPIHYLLREQRLVFLLIGAAIAFLLFTSLSPTTAPSTVTSTAFSDDSFLSTELTRINPRRAAFDSFRSGKAPLGLKRKGLRIVVTGGAGFVGSHLVDRLIARGDSVIVVDNFFTGNKENVMHHFGNPRFELIRHDVVEPILLEVDQIYHLACPASPVHYKHNPVKTIKTNVVGTLNMLGLAKRVGARFLLTSTSEVYGDPLEHPQKETYWGNVNPIGVRSCYDEGKRTAETLAMDYHRGAGVEVRIARIFNTYGPRMCIDDGRVVSNFVAQALRKEPMTVYGDGKQTRSFQYVSDLVEGLMRLMEGEHVGPFNLGNPGEFTMLELAKVVQETIDPNAKIEFRPNTEDDPHKRKPDITRAKEMLGWEPKIPLHKGLPMMVSDFRQRIFGDQKSGDAL

SEQ ID NO: 21692 - protein, 442 aa, Gossypium hirsutum
MGSELIYRGHETQLASDSYSPKPVKPWASVTRAVRYMLREQRLLFVLVGIAVATLVFTVFPASRAAHGPHLHSTTPLLDSIPYFPIETQNKFSYAHRLGFGSGNPTGKIPLGLKRKGLRIVVTGGAGFVGSHLVDRLIARGDSVIVVDNFFTGRKENVMHHFGNPNFELIRHDVVEPLLLEVDQIYHLACPASPVHYKFNPVKTIKTNVVGTLNMLGLAKRVGARFLLTSTSEVYGDPLQHPQKETYWGNVNPIGVRSCYDEGKRTAETLTMDYHRGAGVEVRIARIFNTYGPRMCIDDGRVVSNFVAQALRKEPLTVYGDGKQTRSFQYVSDLVEGLMRLMEGEHVGPFNLGNPGEFTMLELAEVVQETIDPNAKIEFRPNTEDDPHKRKPDISRAKELLGWQPKVSLRKGLPLMVSDFRQRIFGDHKVGSTTTTTNDSSS

SEQ ID NO: 21693 - protein, 434 aa, Lippia dulcis
MTSELIFRGHESHSATDSYSPKPPKPWLTVTRPIRYLLREQRLVFIFIGVAIATLFFSILPSASDNRHAPISDSYIPSELTRPQPHRSVYQNGHLATGFGINSVGKIPLGLKRKGLRIVVTGGAGFVGSHLVDRLIGRGDSVIVVDNFFTGRKENVAHHFRNPRFELIRHDVVEPLLLEVDQIYHLACPASPVHYKHNPVKTIKTNVVGTLNMLGLAKRVGARFLLTSTSEVYGDPLQHPQVETYWGNVNPIGVRSCYDEGKRTAETLTMDYHRGAGVEVRIARIFNTYGPRMCIDDGRVVSNFVAQALRKEPLTVYGDGKQTRSFQFVSDLVEGLMRLMEGEHVGPFNLGNPGEFTMLELAQVVQETIDPNAKIEFKPNTEDDPHKRKPDIAKAKDLLGWEPKIPLRKGLPMMVSDFRQRIFGDHKENADSSA

SEQ ID NO: 21694 - protein, 440 aa, Solanum melongena
MASELIYRGPESLPVPDGYTPKPHKPWLNVIRPVRYLLREQRIVFLLAGIVIASVFFAVLPSSRSGGSSYADAGIYDSYLPSESSQSQVAHRMAYQNRVGVGSFNSGGKIPLGLKRKGLRIVVTGGAGFVGSHLVDRLIARGDSVIVVDNFFTGRKENVMHHFGNPRFELIRHDVVEPLLLEVDQIYHLACPASPVHYKHNPVKTIKTNVVGTLNMLGLAKRVGARFLLTSTSEVYGDPLEHPQKETYWGNVNPIGVRSCYDEGKRTAETLTMDYHRGAGVEVRIARIFNTYGPRMCIDDGRVVSNFVAQALRKEPLTVYGDGKQTRSFQFVSDLVEGLMRLMEGEHVGPFNLGNPGEFTMLELAKVVQETIDPNAQIEHRPNTEDDPHKRKPDISRAKELLGWEPKVPLRKGLPMMVQDFRQRIFGDHKEQDSSKITTA

SEQ ID NO: 21695 - protein, 431 aa, Triphysaria pusilla
MASELTFRGHESHHTSVSYSPKSAKPWLGVTRPIHYLLREQRLVFIFVGIAIATLVFSVLPSSNHHQQIVDPFISSELTRIQPHRSIYQNGRLSTGFGINSVGKIPLGLKRKGLRIVVTGGAGFVGSHLVDRLIARGDSVIVVDNFFTGRKENVAHHFGNPRFELIRHDVVEPLLLEVDQIYHLACPASPVHYKHNPVKTIKTNVVGTLNMLGLAKRIGARFLLTSTSEVYGDPLQHPQVETYWGNVNPIGVRSCYDEGKRTAETLTMDYHRGANVEVRIARIFNTYGPRMCIDDGRVVSNFVAQALRKEPLTVYGDGKQTRSFQFVSDLVEGLMRLMEGEHIGPFNLGNPGEFTMLELAQVVQETIDPNAKIEFRPNTEDDPHKRKPDITKAKDLLGWEPKVALRKGLPMMVSDFRQRIFGDHKEVSSSA

SEQ ID NO: 21696 - protein, 445 aa, Amsonia hubrichtii
MGSELIFRGHESQQVTDEYSPKPHKPWLTVIRPIRYMLREQRLIFVFVGIAIASLFFAVLPSSHSPYATGDYSYGHNHIHNALSSDSFLPIQSGGHRLTYQQNRGGFGPFSSGGKIPLGLKRKGLRIVVTGGAGFVGSHLVDRLIQRGDSVIVVDNFFTGRKENVMHHFGNPRFELIRHDVVEPLLLEVDQIYHLACPASPVHYKHNPVKTIKTNVVGTLNMLGLAKRVGARFLLTSTSEVYGDPLQHPQVETYWGNVNPIGVRSCYDEGKRTAETLTMDYHRGAGVEVRIARIFNTYGPRMCIDDGRVVSNFVAQALRKEPLTVYGDGKQTRSFQYVSDLVEGLMRLMEGEHVGPFNLGNPGEFTMLELAQVVQETIDPNAKIEFRPNTEDDPHKRKPDIAKAKDLLGWEPKVPLRKGLPMMVTDFRQRIFGDHKEDGASTSTV

SEQ ID NO: 21697 - protein, 442 aa, Tabernaemontana elegans
SELIYRGHESQPVTDEYSPKPHKPWSSVVRPIHYMLREQRLVFVFVGIAIATLFFAVLPSSHSPYATGDYSYGHTHINNALSSDSLLPAESGAHRFTFQQNRGGFGPFTSGGKIPLGLKRKGLRIVVTGGAGFVGSHLVDRLIQRGDSVIVVDNFFTGRKENVMHHFGNPRFELIRHDVVEPLLLEVDQIYHLACPASPVHYKHNPVKTIKTNVVGTLNMLGLAKRVGARFLLTSTSEVYGDPLQHPQVETYWGNVNPIGVRSCYDEGKRTAETLTMDYHRGAGVEVRIARIFNTYGPRMCIDDGRVVSNFVAQALRKEPMTVYGDGKQTRSFQYVSDLVEGLIRLMEGEHVGPFNLGNPGEFTMLELAQVVQETIDPNAKIEFRPNTEDDPHKRKPDINKAKDLLGWEPKIPLRKGLPMMVTDFRQRIFGDHKDGASKSTV

SEQ ID NO: 21698 - protein, 432 aa, Triphysaria pusilla
MASELTFRGHESHHTSDSYSPKPDKPWLGVTRPIHYLLREQRLIFIFVGIAIATLVFSTLPQSNQISQIPDSFISSELTRIQPHRSMYQNGHMSTGFGINSVGKIPLGLKRKGLRIVVTGGAGFVGSHLVDRLISRGDSVIVVDNFFTGRKENVAHHFGNPRFELIRHDVVEPLLLEVDQIYHLACPASPVHYKHNPVKTIKTNVVGTLNMLGLAKRIGARFLLTSTSEVYGDPLQHPQVETYWGNVNPIGVRSCYDEGKRTAETLTMDYHRGANVEVRIARIFNTYGPRMCIDDGRVVSNFVAQALRKEPLTVYGDGKQTRSFQFVSDLVEGLMRLMEGEHIGPFNLGNPGEFTMLELAQVVQETIDPNAKIEFRPNTEDDPHKRKPDISKAKDMLGWEPKVALRKGLPMMVSDFRQRIFGDQKQEVSTSA

SEQ ID NO: 21699 - protein, 426 aa, Valeriana officinalis
GHDSQPSSAAYSPKPSKPLLTVIRPIRYMLKEQRLIFVFLGIAIATLVFTFIPAASKSSPLRESTRGRLALSDPYFSVESGYHSRAAAAIGSFHSGGKIPLGLKRKGMRIVVTGGAGFVGSHLVDRLMARGDSVIVVDNFFTGRKENVMHHFGNPRFELIRHDVVEPLLLEVDQIYHLACPASPVHYKFNPVKTIKTNVVGTLNMLGLAKRVGARFLLTSTSEVYGDPLQHPQVETYWGNVNPIGVRSCYDEGKRTAETLTMDYHRGAGVEVRIARIFNTYGPRMCIDDGRVVSNFVAQALRKEPLTVYGDGKQTRSFQYVSDLVEGLMRLMEGEHVGPFNLGNPGEFTMLDLAQVVQETIDPNAKIEFKPNTEDDPHKRKPDITKAKDLLGWEPKIALRKGLPLMVSDFRQRIFGDHKDHSSSSE

SEQ ID NO: 21700 - protein, 434 aa, Cichorium intybus
MGSELIYRGHEPQPTSDLYSPKPNKPWSAVIPPIRYMLREQRLVFVLIGIAIATFFFAFIPSSTTYSPPTTSAYTSYSVSGSAQIINPQRPVYRFQSGGKIPLGLKRKGLRIVVTGGAGFVGSHLVDRLIERGDSVIVVDNFFTGNKDNVMHHFGNPRFELIRHDVVEPLLLEVDQIYHLACPASPVHYKYNPVKTIKTNVVGTLNMLGLAKRVGARFLLTSTSEVYGDPLQHPQVETYWGNVNPIGVRSCYDEGKRTAETLTMDYHRGAGVEVRIARIFNTYGPRMCIDDGRVVSNFVAQALRKEPLTVYGDGKQTRSFQYVSDLVEGLMRLMEGEHVGPFNLGNPGEFTMLELAQVVQETIDSEAKIEFKPNTEDDPHKRKPDITKAKELLGWKPKVPLRKGLPMMVADFRQRIFGDQKSSGATAATTSTTA

SEQ ID NO: 21701 - protein, 431 aa, Triphysaria pusilla
MASELTFRGHESHHTSVSYSPKSAKPWLGVTRPIHYLLREQRLVFIFVGIAIATLVFSVLPSSNHHQQIVDPFISSELTRIQPHRSIYQNGRLSTGFGINSVGKIPLGLKRKGLRIVVTGGAGFVGSHLVDRLIARGDSVIVVDNFFTGRKENVAHHFGNPRFELIRHDVVEPLLLEVDQIYHLACPASPVHYKHNPVKTIKTNVVGTLNMLGLAKRIGARFLLTSTSEVYGDPLQHPQVETYWGNVNPIGVRSCYDEGERTAETLTMDYHRGANVEVRIARIFNTYGPRMCIDDGRVVSNFVAQALRKEPLTVYGDGKQTRSFQFVSDLVEGLMRLMEGEHIGPFNLGNPGEFTMLELAQVVQETIDPNAKIEFRPNTEDDPHKRKPDITKAKDLLGWEPKVALRKGLPMMVSDFRQRIFGDHKEVSSLA

SEQ ID NO: 21702 - protein, 427 aa, Primula obconica
MASELIFRGHEAQLESDTYSPKRVKPWSAVVNPIRYILREQRLLFVLIGIVIASLFFSLLPSSSPSYYPIAEYSRDPISDPTRITHRVMYHPFSTAGGKVPLGLKGRGVRVVVTGGAGFVGSHLVDRLMERGDSVIVVDNFFTGRKENVMHHFKNPRFEMIRHDVVEPILLEVDQIYHLACPASPVHYKFNPVKTIKTNVVGTLNMLGLAKRVGARFLLTSTSEVYGDPLQHPQVETYWGNVNPIGVRSCYDEGKRTAETLTMDYHRGANVEVRIARIFNTYGPRMCIDDGRVVSNFVAQALRKEPLTVYGDGKQTRSFQYVSDLVEGLMRLMEGEHVGPFNLGNPGEFTMLELAQVVQDTIDPNAKIEFKDNTEDDPHKRKPDISKAKDQLGWEPKVSLRDGLPLMVKDFRQRIFGDHKKEGGATV

SEQ ID NO: 21703 - protein, 442 aa, Populus trichocarpa
MGSSELIFRGHDETQPTPDAYSPKPAKPWLFVIRPVRYLLREKRLVFFLVGMAIATVFFTILPSSSPHAHKYDPLPDSFSHISHELTTPVRYKYYEPLQVGFQSANSGGKIPLGLKRKGLRIVVTGGAGFVGSHLVDRLIARGDSVIVVDNFFTGRKENVMHHFKNPRFELIRHDVVEPLLLEVDQIYHLACPASPVHYKHNPVKTIKTNVVGTLNMLGLAKRVGARFLLTSTSEVYGDPLQHPQVETYWGNVNPIGVRSCYDEGKRTAETLAMDYHRGAGVEVRIARIFNTYGPRMCIDDGRVVSNFVAQALRKEPMTVYGDGKQTRSFQFVSDLVEGLMRLMEGEHVGPFNLGNPGEFTMLELAQVVQETIDPNARIEFRPNTEDDPHKRKPDITKAKDLLGWEPKIPLRKGLPMMVSDFRQRIFGDHKEEGTATNTSTS

SEQ ID NO: 21704 - protein, 436 aa, Aquilegia formosa
KMASLVFRGHDTTLIPDSYSPKHPKPWSSLTRSIQYILREQRLIFVLVGMAIAALVFTILPSSPSHYNYSTIPDSYFTSESTRLAAAHRVVFDRRVGFVGGVGGKIPLGLKRKGLRIVVTGGAGFVGSHLVDRLIARGDSVIVVDNFFTGFKGNLIHHFGNPRFELIRHDVVEPILLEVDQIYHLACPASPVHYKFNPVKTIKTNVVGTLNMLGLAKRVGARFLLTSTSEVYGDPLQHPQVETYWGNVNPIGVRSCYDEGKRTAETLTMDYHRGAGVEVRIARIFNTYGPRMCIDDGRVVSNFVAQALRKEPLTVYGDGKQTRSFQYVSDLVEGLMRLMEGEHVGPFNLGNPGEFTMMELAQVVQETIDPNAKIEFRPNTEDDPHKRKPDISKAKELLGWEPVVPLRKGLPMMVSDFRQRIFGDHKDGSSDMSSTV

SEQ ID NO: 21705 - protein, 439 aa, Nicotiana benthamiana
MASELIYRGPESQPVPDVYTPKPDKPWLSVIRPVRYLLREQRIVFLFAGIAIASLIFALLPSSRSGSLNYANNAIYDSYLPSESTQSQVAHRMIYQNRPGFGSFNLGGKIPLGLQRKGLRIVVTGGAGFVGSHLVDRLIARGDSVIVVDNFFTGRKENVMHHFGNPRFELIRHDVVEPLLLEVDQIYHLACPASPVHYKHNPVKTIKTNVVGTLNMLGLAKRVGARFLLTSTSEVYGDPLEHPQKETYWGNVNPIGVRSCYDEGKRTAETLTMDYHRGAGVEVRIARIFNTYGPRMCIDDGRVVSNFVAQALRKMPLTVYGDGKQTRSFQFVSDLVEGLMRLMEGEHVGPFNLGNPGEFTMLELAKVVQETIDPNAQIEFRPNTEDDPHKRKPDISRAKELLGWEPKVALRKGLPMMVQDFRQRIFADHKEDTSSATIA

SEQ ID NO: 21706 - protein, 429 aa, Cirsium arvense
MGSELTYRRHEPQTISDAYSPKPNKPWLSLIRPIRYMLREQRLLFVLVGILIGAFFIAIIPSSTTTSHRQITYHDAYSVSQLAQMMNPKQTVYRTSMNSGGKVPLGLKRKGLRIVVTGGAGFVGSHLVDRLIARGDSVIVVDNFFTGNKDNVMHHFGNPRFELIRHDVVEPLLLEVDQIYHLACPASPVHYKYNPVKTIKTNVVGTLNMLGLAKRVGARFLLTSTSEVYGDPLQHPQVETYWGNVNPIGVRSCYDEGKRTAETLAMDYHRGAGVEVRIARIFNTYGPRMCIDDGRVVSNFVAQALRKEPLTVYGDGKQTRSFQFVSDLVEGLMRLMEGEHVGPFNLGNPGEFTMLELAQVVQETIDPNAKIEFKPNTEDDPHKRKPDITKAKDLLGWEPKVPLRKGLPMMVSDFRQRIFGDHKDSSSSA

SEQ ID NO: 21707 - protein, 440 aa, Coffea canephora
MGSELIYRGHESHPATDEYFPKPPKPWLSVIRPIRYMLREQRLIFVFVGIAIATLVFALLPSSSNSPYYNTGGGYNYNHGGGSSLESITSRSWNPHRMAYQNQLGGFNSGGKIPLGLKRKGLRIVVTGGAGFVGSHLVDRLMARGDSVIVVDNFFTGRKENVQHHLGNPRFELIRHDVVEPLLLEVDQIYHLACPASPVHYKHNPVKTIKTNVVGTLNMLGLAKRVGARFLLTSTSEVYGDPLQHPQVETYWGNVNPIGVRSCYDEGKRTAETLTMDYHRGADVEVRIARIFNTYGPRMFLDDGRVVSNFVAQALRKEPLTVYGDGKQTRSFQYVSDLVEGLMRLMEGEHVGPFNLGNPGEFTMLELAQVVQETIDPNAKIEFRPNTEDDPHKRKPDISKAKEFLGWEPKIPLRKGLPLMVADFRQRIFGDHKEHGTSTS

SEQ ID NO: 21708 - protein, 443 aa, Eucalyptus grandis
MGSELTYRGHGAQPVTDAYSPKPDKPWLPVARAIRYLLREQRLLFVLVGIAIATVLFTVFPGGPSARPGYGSGPYDPIPGAHVARYGGGFDRFESERALYQQRAGFGSVSGKVPLGLKRKGLRIVVTGGAGFVGSHLVDRLMARGDSVIVVDNFFTGRKENVMHHFGNPRFELIRHDVVEPLLLEVDQIYHLACPASPVHYKFNPVKTIKTNVVGTLNMLGLAKRVGARFLLTSTSEVYGDPLQHPQVETYWGNVNPIGVRSCYDEGKRTAETLTMDYHRGASVEVRIARIFNTYGPRMCIDDGRVVSNFVAQALRKEPMTVYGDGKQTRSFQYVSDLVEGLMRLMEGEHVGPFNLGNPGEFTMLELAEVVKETIDPNAKIEFKPNTEDDPHKRKPDITKAKELLGWEPKVALRKGLPLMVSDFRQRVFGDHKEGVASGSSSS

SEQ ID NO: 21709 - protein, 431 aa, Lactuca sativa
MGSELTYRRHEPQPTSDSYSPKPNKPWLAVTRLVRYMLREQRLVFVLVGIVIATSVFAILPSSTNTNTSIHSYSVSESIQMTNPRRSVYPTGFESSFSMGGKIPLGLKRKGLRIVVTGGAGFVGSHLVDRLIARGDSVIVVDNFFTGNKDNVMHHFGNPRFELIRHDVVEPLLLEVDQIYHLACPASPVHYKHNPVKTIKTNVVGTLNMLGLAKRIGARFLLTSTSEVYGDPLQHPQVETYWGNVNPIGVRSCYDEGKRTAETLTMDYHRGAGVEVRIARIFNTYGPRMCIDDGRVVSNFVAQALRKEPLTVYGDGKQTRSFQYVSDLVEGLIRLMEGEHVGPFNLGNPGEFTMLELAQVVQETIDSEAKIEFRPNTEDDPHKRKPDITKAKELLGWNPKVPLRKGLPMMVSDFRQRIFGDHKTTTTATST

SEQ ID NO: 21710 - protein, 434 aa, Tropaeolum majus
MGSELTYRGHETDLPATDGYSPKPIKPWYAETRPIRYLLREQRLVFLLVGIALAALVFTVYPFTSRSTNIQSYADYIPMSGSYVPVQTKRKSNFEYLNRVGLGSAGGKIPLGLKRKGLRVVVTGGAGFVGSHLVDRLIARGDNVIVVDNFFTGRKENVMHHFGNPNFELIRHDVVEPILLEVDQIYHLACPASPVHYKFNPVKTIKTNVVGTLNMLGLAKRVGARFLLTSTSEVYGDPLQHPQVETYWGNVNPIGVRSCYDEGKRTAETLTMDYHRGAGVEVRIARIFNTYGPRMCIDDGRVVSNFVAQALRKEPMTVYGDGKQTRSFQFVSDLVEGLMRLMEGEHVGPFNLGNPGEFTMLELAKVVQETIDPNARIEFRPNTEDDPHKRKPDITKAKNLLGWEPSVSLHKGLPLMVKDFRQRIFGDHKEGSSS

SEQ ID NO: 21711 - protein, 431 aa, Cirsium arvense
MGSELTYRGHEAQSMVDSYSPKFKKPWPAVTRVIRYMLKEQRLVFVLVGIAIATVVFAFRPSTTVSTGHITDAYSVSESVQMMNPRRSVYPIGFDSFNLGGKIPLGLKRKGLRIVVTGGAGFVGSHLVDRLIARGDSVIVVDNFFTGNKDNVMHHFGNPRFELIRHDVVEPLLLEVDQIYHLACPASPVHYKYNPVKTIKTNVVGTLNMLGLAKRVGARFLLTSTSEVYGDPLQHPQVETYWGNVNPIGVRSCYDEGKRTAETLTMDYHRGAGVEVRIARIFNTYGPRMCIDDGRVVSNFVAQALRKEPLTVYGDGKQTRSFQFVSDLVEGLMRLMEGEHVGPFNLGNPGEFTMLELAQVVQETIDPNAKIEFKPNTEDDPHKRKPDITKAKELLGWKPKVPLRKGLPMMVSDFRQRIFGDQKNIGASTTT

SEQ ID NO: 21712 - protein, 439 aa, Solanum tuberosum
  Sequence also found in Organisms: Solanum phureja
MASELIYRGPESLPVPDSYTPKPHKPWFTVIRPLRYLLREQRIVFLFAGIAIASLIFAFLPSSRSGGSNYANTGIYDSYLPSESTQSQVAHRIIYQNRVGFGSFNSGGKIPLGLQRKSLRIVVTGGAGFVGSHLVDRLIARGDSVIVVDNFFTGRKENVMHHFGNPRFELIRHDVVEPLLLEVDQIYHLACPASPVHYKHNPVKTIKTNVVGTLNMLGLAKRVGARFLLTSTSEVYGDPLEHPQKETYWGNVNPIGVRSCYDEGKRTAETLTMDYHRGAEVEVRIARIFNTYGPRMCIDDGRVVSNFVAQALRKEPLTVYGDGKQTRSFQFVSDLVEGLMRLMEGEHVGPFNLGNPGEFTMLELAKVVQETIDPNAQIVHKPNTEDDPHKRKPDISKAKELLGWEPKVALRNGLPMMVQDFRQRIFGDHKEDSGKITTA

SEQ ID NO: 21713 - protein, 415 aa, Arnica chamissonis
MGSELTYRRQETQPKPNKQSWAAVTRVVRYMLREQRLVFVLVGIAIATSVFTLFPSSNTTDAFSVSESVKLMNPQPSFYPTTFNMGGKIPLGLKRKGLRIVVTGGAGFVGSHLVDRLIARGDSVIVVDNFFTGNKDNVMHHFGNPRFELIRHDVVEPLLLEVDQIYHLACPASPVHYKFNPVKTIKTNVVGTLNMLGLAKRVGARFLLTSTSEVYGDPLQHPQVETYWGNVNPIGVRSCYDEGKRTAETLTMDYHRGAGVEVRIARIFNTYGPRMCIDDGRVVSNFVAQALRKEPLTVYGDGMQTRSFQYVSDLVEGLMRLMEGEHVGPFNLGNPGEFTMLELAKVVQDTIDPNAKIEFKPNTEDDPHKRKPDITKAKELLGWKPKVPLRKGLPMMVSDFRQRIFGDQKNPATTA

SEQ ID NO: 21714 - protein, 438 aa, Papaver somniferum
SELTYRRHESQPQSDTYLPKPPKPFLPVTRAIRYMLREQRLLFVLLGIAIATVVFVLIPSSSSSRQFTGSYDSIPAQYFPNSDSSTRLSEKFVYEQRSVNSGGKIPLGLKRKGLRIVVTGGAGFVGSHLVDRLMERGDSVIVVDNFFTGRKENVMHHFGNPRFEMIRHDVVEPLLLEVDQIYHLACPASPVHYKFNPVKTIKTNVVGTLNMLGLAKRVGARFLLTSTSEVYGDPLQHPQVETYWGNVNPIGVRSCYDEGKRTAETLAMDYHRGAGVEVRIARIFNTYGPRMCIDDGRVVSNFVAQALRKEPLTVYGDGKQTRSFQYVSDLVEGLMRLMEGEHVGPFNLGNPGEFTMLELAQVVQETIDPNAKIEFRANTEDDPHKRKPDITKAKEQLGWEPKVALRKGLPLMVSDFRQRIFGDHKEGSSSTSGVVSNS

SEQ ID NO: 21715 - protein, 440 aa, Solanum lycopersicum
MTSELIYRGPESVPVTDGYTPKPHKPWFTVIRPLRYLLREQRIVFLFAGIAIASLIFAFLPSSRSSGGSSYANTGIYDSYLPSESTESQVAHRMIYHNRVGFGSINSGGKIPLGLKRKVLRIVVTGGAGFVGSHLVDRLIARGDSVIVVDNFFTGRKENVMHHFGNPRFELIRHDVVEPLLLEVDQIYHLACPASPVHYKHNPVKTIKTNVVGTLNMLGLAKRVGARFLLTSTSEVYGDPLEHPQKETYWGNVNPIGVRSCYDEGKRTAETLTMDYHRGAEVEVRIARIFNTYGPRMCIDDGRVVSNFVAQALRKEPLTVYGDGKQTRSFQFVSDLVEGLMRLMEGEHVGPFNLGNPGEFTMLELAKVVQETIDPNAQIVHKPNTEDDPHKRKPDISKAKELLGWEPKVALRNGLPMMVQDFRQRIFGDHKEESAKITTA

SEQ ID NO: 21716 - protein, 444 aa, Vinca minor
MGSELIYRGHESQPATDSYSPKPQKPWLTVIRPIRYILREQRLIFVFVGIAIATLFFAVLPSYSRSPLYPTTGGDYNSIGNNNHIHNALSTNSLESGAQNRFGFHTNRVGFSGGKIPLGLKRKGLRIVVTGGAGFVGSHLVDRLMQRGDSVIVVDNFFTGRKENVMHHFGNSRFELIRHDVVEPLLLEVDQIYHLACPASPVHYKHNPVKTIKTNVVGTLNMLGLAKRVGARFLLTSTSEVYGDPLQHPQVETYWGNVNPIGVRSCYDEGKRTAETLTMDYHRGAGVEVRIARIFNTYGPRMCIDDGRVVSNFVAQALRKEPMTVYGDGKQTRSFQYVSDLVEGLMRLMEGEHVGPFNLGNPGEFTMLELAQVVQETIDPNAKIVFRPNTEDDPHKRKPDITKAKDMLGWEPKVPLRKGLPMMVTDFRQRIFGDHKDGTSTSTV

SEQ ID NO: 21717 - protein, 436 aa, Vinca minor
MGSELIYRGHESQPMTDSYSPKPRLAVIRPIHYILREQRLIFVFVGIAIATLFFAVLPSYRPPYPAVDYSSHIHSALSTNSYLPADESGAHTRFSLQSNRVGFSGGKIPLGLKRKGMRIVVTGGAGFVGSHLVDRLMERGDSVIVVDNFFTGRKENLMHHFGNPRFELIRHDVVEPLLLEVDQIYHLACPASPVHYKHNPVKTIKTNVVGTLNMLGLAKRVGARFLLTSTSEVYGDPLQHPQVETYWGNVNPIGVRSCYDEGKRTAETLTMDYHRGAGVEVRIARIFNTYGPRMCIDDGRVVSNFVAQALRKEPMTVYGDGKQTRSFQYVSDLVEGLMRLMEGEHVGPFNLGNPGEFTMLELAQVVQETIDPNAKIVFRPNTEDDPHKRKPDITKAKDMLGWEPKVPLRKGLPMMVTDFRQRIFGDHKDGTLASTV

SEQ ID NO: 21718 - protein, 445 aa, Arabidopsis thaliana
MASELINRRHETDQPTADAYYPKPIKPWFTVTRPMRYMLREQRLIFVLVGIAIATLVFTIFPRSTQSTPYSDPFSGYGIRPDESYVPAIQAQRKPSLEYLNRIGATGGKIPLGLKRKGLRVVVTGGAGFVGSHLVDRLMARGDTVIVVDNFFTGRKENVMHHFSNPNFEMIRHDVVEPILLEVDQIYHLACPASPVHYKFNPVKTIKTNVVGTLNMLGLAKRVGARFLLTSTSEVYGDPLQHPQVETYWGNVNPIGVRSCYDEGKRTAETLTMDYHRGANVEVRIARIFNTYGPRMCIDDGRVVSNFVAQALRKEPLTVYGDGKQTRSFQFVSDLVEGLMRLMEGEHVGPFNLGNPGEFTMLELAKVVQETIDPNANIEFRPNTEDDPHKRKPDITKAKELLGWEPKVSLRQGLPLMVKDFRQRVFGDQKEGSSAAATTTKTTSA

SEQ ID NO: 21719 - protein, 433 aa, Brassica rapa
MASELINRRHEAGQPHADAYYPRPIKPWSSTVTRPMRYMLREQRLLFVLVGIAIATLVFTIFPRSTPYSDPFSGYGIRPDDESFQAQRRPSLLMGATGGKIPLGLKRKGLRVVVTGGAGFVGSQLVDRLMVRGDTVIVVDNFFTGRKENVMHHFGSPNFELIRHDVVEPILLEVDQIYHLACPASPVHYKFNPVKTIKTNVVGTLNMLGLAKRVGARCLLTSTSEVYGDPLQHPQVETYWGNVNPIGVRSCYDEGKRTAETLTMDYHRGANVEVRIARIFNTYGPRMCIDDGRVVSNFVAQALRKEPLTVYGDGKQTRSFQFVSDLVEGLMRLMEGEHVGPFNLGNPGEFTMLELAKVVQETIDPNANIAFRPNTEDDPHKRKPDITKAKELLGWEPKVSLRQGLPLMVKDFRQRVFGDQKEGSSVTTKITAA

SEQ ID NO: 21720 - protein, 437 aa, Flaveria ramosissima
GSELIFRGHEPQTTSDSYSPKPHKPWLSVIRPIRYMLREQRLLFVLIGILIGAAVIAVVPTSTTTAADRQISYRDAYSLSQSSDLLNPRRPVFRPGFGSMNSGGKIPLGLKRKGLRIVVTGGAGFVGSHLVDRLIARGDSVIVVDNFFTGNKDNVMHHFGNPRFELIRHDVVEPLLLEVDQIYHLACPASPVHYKHNPVKTIKTNVVGTLNMLGLAKRVGARFLLTSTSEVYGDPLQHPQVETYWGNVNPIGVRSCYDEGKRTAETLAMDYHRGAGVEVRIARIFNTYGPRMCIDDGRVVSNFVAQALRKEPLTVYGDGKQTRSFQFVSDLVEGLMRLMEGEHVGPFNLGNPGEFTMLELAQVVQETIDPNAKIEFRPNTEDDPHKRKPDITKAKDLLGWEPKVPLRKGLPMMVSDFRQRIFGDHKDNIATSTSISA

SEQ ID NO: 21721 - protein, 445 aa, Eutrema halophilum
MASELINRRHEADQPAADAYYPKPIKPWFMVTRPMRYMLREQRLLFVLVGIAIATLVFTIFPRSTQSIAYSDPFSGYGIRTDESYLPAVQAQRKPSVEYLNRIGATGGKIPLGLKRKGLRVVVTGGAGFVGSHLVDRLMERGDTVIVVDNFFTGRKENVMHHFGNPNFEMIRHDVVEPILLEVDQIYHLACPASPVHYKFNPVKTIKTNVVGTLNMLGLAKRVGARFLLTSTSEVYGDPLQHPQVETYWGNVNPIGVRSCYDEGKRTAETLTMDYHRGANVEVRIARIFNTYGPRMCIDDGRVVSNFVAQALRKEPLTVYGDGKQTRSFQFVSDLVEGLMRLMEGEHVGPFNLGNPGEFTMLELAKVVQETIDPNANIEFRPNTEDDPHKRKPDITKAKELLGWEPKVSLRQGLPLMVKDFRQRVFGDQKEGSSMAATTTKTTSA

SEQ ID NO: 21722 - protein, 456 aa, Glycine max
MDHVIGGKFKLGRKIGSGSFGELYLGVNVQSGEEVAVKLESVKTKHPQLHYESKLYMLLQGGTGIPHLKWFGVEGDYNVMVIDLLGPSLEDLFNYCNRKLSLKTVLMLADQLINRVEYMHSRGFLHRDIKPDNFLMGLGRKANQVYIIDYGLAKKYRDLQTHKHIPYRENKNLTGTARYASVNTHLGVEQSRRDDLESLGYLLMYFLRGSLPWQGLRAGTKKQKYDKISEKKMLTPIEVLCKSYPLEFTSYFHYCRTLRFEDKPDYSYLKRLFRDLFIREGYQFDYVFDWTMLKYPQIGSSSRARPSGKPVINPGQSGERIERPSGGFSGAVEAFARRNGSGLVLQSEHSRHRSSDDVPSSKDVQADSERPRSSSRNGSSSKKPVLSSSRPSSSGEPSESRTSRLVLSSGRLSTTQRLQPGFESKTSLSRASATRGGRDDTLRSFELLSLGSGKRK

SEQ ID NO: 21723 - protein, 464 aa, Cajanus cajan
MDHVIGGKFKLGRKIGSGSFGELYLGVNVQSGEEVAVKLESVKTKHPQLHYESKLYMLLQGGTGIPHLKWFGVEGDYNVMVIDLLGPSLEDLFNYCNRKFTLKTVLMLADQLINRVEYMHSRGFLHRDIKPDNFLMGLGRKANQVYIIDYGLAKKYRDLQTHKHIPYRENKNLTGTARYASVNTHLGVEQSRRDDLESLGYVLMYFLRGSLPWQGLKAGNKKQKYDKISEKKMLTPIEVLCKSYPLEFTSYFHYCRSLRFEDKPDYSYLKRLFRDLFIREGYQFDYVFDWTMLKYPQIGSSSRARPSGKPVINPGQSGERIERPSGGPEIRDRFSGAVEAFARRNSSGLGLHSDHSRHNRSSDDVPSSKDVQADSDRPRSSSRNGSSSKKPVLSSSRPSSSGEPSESRASRLVSSSGRLSTTQRLQPGFESKSSLTRPSVTRGGGRDDTLRSFELLSLATGKRK

SEQ ID NO: 21724 - protein, 460 aa, Phaseolus vulgaris
MDHVIGGKFKLGRKIGSGSFGELYLGVNVQSGEEVAVKLEPVKTKHPQLHYESKLYMLLQGGTGIPHLKWFGSEGDYNVMAIDLLGPSLEDLFNYCNRKLSLKTVLMLADQLINRVEYMHSRGFLHRDIKPDNFLMGLGRKANQVYIIDYGLAKKYRDLQTHKHIPYRENKNLTGTARYASVNTHLGVEQSRRDDLESLGYVLMYFLRGSLPWQGLKAGTKKQKYDKISEKKMLTPIEVLCKSYPMEFASYFHYCRSLRFEDKPDYSYLKRLFRDLFIREGYQFDYVFDWTMLKYPQIGSSSRARPSGKPVINPGQSGERPSAVPDIRDRFSGAVEAFARRNGSGLGLHGDHSRHRSSDDVPSSSKDVQPDSERPRSSSRNGSSSKKPVLSSSRPSSSGEPSESRVSRLVSSSGRLSTTQRLQAGSESKTSLTRASGTRLGRDDALRSFELLSLGTGKRK

SEQ ID NO: 21725 - protein, 459 aa, Quercus alba
MDHVIGGKFKLGRKIGSGSFGELYLGVNIQSGEEVAVKLESVKTKHPQLHYESKLYMLLQGGTGIPHLKWFGVEGEYNVMVIDLLGPSLEDLFNYCNRKFSLKTVLMLADQLINRVEYMHSRGFLHRDIKPDNFLMGLGRKANQVYIIDYGLAKKYRDLQTHKHIPYRENKNLTGTARYASVNTHLGVEQSRRDDLESLGYVLMYFLRGSLPWQGLKAGTKKQKYDKISEKKMLTPIEVLCKSYPSEFTSYFHYCRSLRFEDKPDYSYLKRLFRDLFIREGYQFDYVFDWTILKYPQVGSSSRGRPSGKPALNPGTSAERPSVGQEIRDRFSGAVEAFARRNGTGHGLHGEHTRHRSSDDVPSSKDVQPDSERGRSSRNGSSSKRPVVSSSRPSSSGEPSENRSSRLVSSSGRLSTTQRIQPGFESKTTSFTRTAATRGGRDDALRSFELLSIGTGKRK

SEQ ID NO: 21726 - protein, 459 aa, Castanea mollissima
MDHVIGGKFKLGRKIGSGSFGELYLGVNIQSGEEVAVKLESVKTKHPQLHYESKLYMLLQGGTGIPHLKWFGVEGEYNVMVIDLLGPSLEDLFNYCNRKFSLKTVLMLADQLINRVEYMHSRGFLHRDIKPDNFLMGLGRKANQVYIIDYGLAKKYRDLQTHKHIPYRENKNLTGTARYASVNTHLGVEQSRRDDLESLGYVLMYFLRGSLPWQGLKAGTKKQKYDKISEKKMLTPIEVLCKSYPSEFTSYFHYCRSLRFEDKPDYSYLKRLFRDLFIREGYQFDYVFDWTILKYPQVGSSSRGRPSGKPALNPGTSAERPSVGQEIRDRFSGAVEAFARRNGTGHGLHGEHTRHRSSDDVPSSKDVQPDSERGRSSRNGSTSKRPVVSISRPSSSGEPSENRSSRLVSSSGRLSTTQRIQPGFESKTTSFTRTAATRGGRDDALRSFELLSIGTGKRK

SEQ ID NO: 21727 - protein, 463 aa, Cicer arietinum
MDHVIGGKFKLGRKIGGGSFGELYLGVNVQTGEEVAVKLEPVKTKHPQLHYESKLYMLLQGGTGIPHLKWFGVEGDYNAMAIDLLGPSLEDLFNYCNRKFSLKTVLMLADQLLNRVEYMHSRGFLHRDIKPDNFLMGLGRKANQVYVIDYGLAKKYRDLHTHKHIPYRENKNLTGTARYASVNTHLGVEQSRRDDLESLGYVLMYFLRGSLPWQGLRAGTKKQKYDKISEKKMLTPIEVLCKSHPLEFTSYFHYCRSLRFEDKPDYSYLKKLFRDLFIREGYQFDYVFDWTILKYPQIGSSSRTRPSSGKPVINPGQSGDRIERPSGGPEIRDRFSGAVEAFARRNGSGHGLHGDHSRHRSSDDVPSSKEVQADSERPRSSSRHGSSSKRPVLSSSRPNSSGEPSENRSSRLVLSSSRLSTTQRTQPALESKPSFTRASGTRGGRDDTLRSFELLSIGTGKRK

SEQ ID NO: 21728 - protein, 456 aa, Arachis hypogaea
MDHVIGGKFKLGRKIGSGSFGELYLGVNVQSGEEVAVKLESVKTKHPQLHYESKLYMLLQGGTGIPHLKWFGVEGDYNVMVIDLLGPSLEDLFNYCNRKFSLKTVLMLADQLLNRVEYMHSRGFLHRDIKPDNFLMGLGRKANQVYIIDYGLAKKYRDLQTHKHIPYRENKNLTGTARYASVNTHLGVEQSRRDDLESLGYVLMYFLRGSLPWQGLKAGTKKQKYDKISEKKMLTPIEVLCKSHPLEFTSYFHYCRSLRFEDKPDYSYLKRLFRDLFIREGYQFDYVFDWTILKYPQIGSSSRARLTGKPVGNPGLSGDRLVRPSGGPEIRERLSGAVEAFARRNGSGLNLHRSSDDVPSSKDVQADSERTRSSSRNGSASKRPVVLSSRPSSSGEPSENRSSRLLASSSRLSTTHRIQPGLESKTSFTRASGTRGGRDDTLRSFELLSIGTGKRK

SEQ ID NO: 21729 - protein, 456 aa, Arachis hypogaea
MDHVIGGKFKLGRKIGSGSFGELYLGVNVQSGEEVAVKLESVKTKHPQLHYESKLYMLLQGGTGIPHLKWFGVEGDYNVMVIDLLGPSLEDLFNYCNRKFSLKTVLMLADQLLNRVEYMHSRGFLHRDIKPDNFLMGLGRKANQVYIIDYGLAKKYRDLQTHKHIPYRENKNLTGTARYASVNTHLGVEQSRRDDLESLGYVLMYFLRGSLPWQGLKAGTKKQKYDKISEKKMLTPIEVLCKSHPLEFTSYFHYCRSLRFEDKPDYSYLKRLFRDLFIREGYQFDYVFDWTILKYPQIGSSSRARLTGKPVGNPGLSGDRLDRPSGGPEIRERLSGAVEAFARRNGSGLNLHRSSDDLPSSKDVQADSERTRSSSRNGSASKRPVVLSSRPSSSGEPSENRSSRLLASSSRLSTTQRIQPGLESKTSFTRASGTRGGRDDTLRSFELLSIGTGKRK

SEQ ID NO: 21730 - protein, 464 aa, Trifolium pratense
MDHIIGGKFKLGRKIGGGSFGELYLAVNVQTGEEVAIKLEPVKTKHPQLHYESKLYMLLQGGTGIPHLKWFGVEGDYNCMAIDLLGPSLEDLFNYCNRKFSLKTVLMLADQLLNRVEYMHSRGFLHRDIKPDNFLMGLGRKANQVYIIDYGLAKKYRDLHTHKHIPYRENKNLTGTARYASVNTHLGVEQSRRDDLESLGYVLMYFLRGSLPWQGLRAGNKKQKYDKISEKKMLTPIEVLCKSHPLEFTSYFHYCRSLRFEDKPDYPYLKRLFRDLFIREGYQFDYVFDWTILKYPQIGSSSRSRPSGKPVINPGQSGERIIERPSGGPETRDRFSGAVEAFARRNGSGHGMHGDHSRHRSSDDMPSSKEVQADSERPRSSSRHGSSSKRPVLSSSRPNSSGEPSESRSSRLLLSSSRLSTTQRTQPGLESKTSSFNRASGTRGGRDDTLRSFELLSLGTGKRK

SEQ ID NO: 21731 - protein, 461 aa, Malus domestica
MEHVIGGKFKLGRKIGSGSFGELYLGINVQTGEEVAVKLESVKTKHPQLHYESKLYMLLQGGTGVPHLKWFGVEGEYNVMVIDLLGPSLEDLFNYCNRKFSLKTVLMLADQLINRVEYMHSRGFLHRDIKPDNFLMGLGRKANQVYIIDYGLAKKYRDLQTHKHIPYRENKNLTGTARYASVNTHLGVEQSRRDDLESLGYVLMYFLRGSLPWQGLKAGTKKQKYDKISEKKMLTPIEVLCKSYPSEFTSYFHYCRSLRFEDKPDYSYLKRLFRDLFIREGYQFDYVFDWTILKYPQIGSSSRTRPSTKPALNPGPSAERTERPTVAQDFREKYSGAVEAFSRRNSSGYGYGDHSRHRATDDAPSSKDVQADSERARSSSRNGSSSKRPVISSSRPSSSGEPSESRSSRLVSSSGRLSTTQRVQPGYESKTSFTRTSAARGGRDDTLRSFELLAIGTGKRK

SEQ ID NO: 21732 - protein, 463 aa, Populus trichocarpa
MDHVIGGKFKLGRKIGSGSFGELYLGINVQSGEEVAVKLESVKTKHPQLHYESKLYMLLQGGTGIPHLKWFGVEVDYNVMVIDLLGPSLEDLFNYCNRKLSLKTVLMLADQLINRVEYMHSRGFLHRDIKPDNFLMGLGRKANQVYIIDYGLAKKYRDLQTHKHIPYRENKNLTGTARYASVNTHLGVEQSRRDDLESLGYVLMYFLRGSLPWQGMKAGNKKQKYDKISEKKMLVPIEVLCKNYPSEFTSYFHYCRSLRFEDKPDYSYLKRLFRDLFIREGYQFDYVFDWTILKYPQIGSSSRSRPSGKPAVYPGPSAERVERPSVGQEVRDRFSGGVEAFARRNSSGHALHSDQSRHRSSDDAPSSKDVHPDSERPRSSSRNGSTSKRAVMSSSRPSSSGEPSENRSSRLVSSSGRLSTTQRVQPGFESKSSSFTRASATSGGRGNALRSFELLSIGTGKRK

SEQ ID NO: 21733 - protein, 463 aa, Medicago truncatula
MDHVIGGKFKLGRKIGGGSFGELYLGVNIQTGEEVALKLEPAKTKHPQLHYESKLYMLLQGGTGIPHLKWFGVEGDYNAMAIDLLGPSLEDLFNYCNRKFSLKTVLMLADQLLNRVEYMHSRGFLHRDIKPDNFLMGLGRKANQVYIIDYGLAKKFRDLHTHKHIPYRENKNLTGTARYASVNTHLGVEQSRRDDLESLGFVLMYFLRGSLPWQGLKAGNKKQKYDKISEKKMLTPVEVLCKSHPLEFTSYFHYCRSLRFEDKPDYSYLKRLFRDLFIREGYQFDYVFDWTILKYPQIGSSSRARPSGKPVINPGQSGERVERPSGGPEIRDRFSGAVQAFARRNGSGHGVHGDHSRHRSSDEPSSKDVQADSERPRSSSRHGSSSKRPVLSSSRPNSSGEPSESRSSRLLLSSSRLSTTQRTQPGLESKSSSFNNRASGARGGRDDTLRSFELLSLGTGKRK

SEQ ID NO: 21734 - protein, 462 aa, Populus trichocarpa
MDHVIGGKFRLGRKIGSGSFGELYLGINVQSGEEVAVKLESVKTKHPQLHYESKLYMLLQGGTGIPHLKWFGVEGEYNVMVIDLLGPSLEDLFNYCNRKLSLKTVLMLADQLINRVEYMHSRGFLHRDIKPDNFLMGLGRKANQIYIIDYGLGKKYRDLQTHKHIPYRENKNLTGTARYASVNTHLGVEQSRRDDLESLGYVLMYFLRGSLPWQGLKAGTKKQKYDRISEKKMLTPIEVLCKNYPSEFTSYFHYCRSLRFEDKPDYSYLKRLFRDLFIREGYQFDYVFDWTILKYPQIGSSSRSRLSGKPAVNPGPSAERVEWPSGQEIRDRFSGAVEAFARKNSTGHAMHRDRSRHRSSDDVPSSKDVHPDSERPRSSSRNGSTSKRAVISSSRPSSSGEPSENRSSRLASSSGRLSTTQRIQPGLESKSSSFTRALATRGGRDDTLRSFELLSIGRGKRK

SEQ ID NO: 21735 - protein, 463 aa, Manihot esculenta
MDHVIGGKFKLGRKIGSGSFGELYLGINVQTGEEVAVKLESVKTKHPQLHYESKLYMLLQGGTGIPHLKWFGVEAEYNVMVIDLLGPSLEDLFNYCNRKFSLKTVLMLADQLINRVEYMHSRGFLHRDIKPDNFLMGLGRKANQVYIIDYGLAKKYKDLQTHKHIPYRENKNLTGTARYASVNTHLGVEQSRRDDLESLGYVLMYFLRGSLPWQGLKAGTKKQKYDKISEKKMLTPIEFLCKNYPSEFTSYFHYCRTLRFEDSPDYSYLKRLFRDLFIREGYQFDYVFDWTILKYPQIGSSSRARPSSKPAVNPGPSAERVERPSVGQEIRDRFSGAVEAFARRNGSGHALHGDHSRHRSSDDVPSSKDVHPDPERPRSSSRNGSTSKRAVVSSSRPSSSGEPSENRSSRLLSNSGRLSMTHRMQPGFESKSSSFTRATATRGGRDDTLRSFELLSIGTGKRK

SEQ ID NO: 21736 - protein, 462 aa, Citrullus lanatus
MEHVIGGKFKLGRKIGSGSFGELYLGTNVQTEEEVAVKLESVKTKHPQLHYESKLYMLLQGGTGIPHLKWFGVEGEYNVMVIDLLGPSLEDLFNYCNRKLSLKTVLMLADQLINRVEYMHSRGFLHRDIKPDNFLMGLGRKANQVYIIDYGLGKKYRDLQTHKHIPYRENKNLTGTARYASINTHLGVEQSRRDDLESLGYVLMYFLRGSLPWQGLRAGTKKQKYDKISEKKMLTPIEVLCKSYPTEFTSYFHYCRALRFEDKPDYSYLKRLFRDLFIREGYQFDYVFDWTILKYPQIGSSSRTRPSGKAAINPGPSAERVERPLVGQDLRDKFSGAVEAFARRNGTGIGLHSDHSRHRSSDDVPSSKDVQPDAERARSSSRQGSASKRPVLSTSRPSSSGEPSELRSSRLLSSSSRLSASTQRIQPGAESKSSFFRSATKGSRDDALRSFELLSIGTGKKK

SEQ ID NO: 21737 - protein, 461 aa, Prunus mume
MEHVIGGKFKLGRKIGSGSFGELYLGINVQTGEEVAVKLESVKTKHPQLHYESKLYMLLQGGTGVPHLKWFGVEGEYNVMVIDLLGPSLEDLFNYCNRKFSLKTVLMLADQLINRVEYMHSRGFLHRDIKPDNFLMGLGRKANQVYIIDYGLAKKYRDLQTHKHIPYRENKNLTGTARYASVNTHLGVEQSRRDDLESLGYVLMYFLRGSLPWQGLKAGTKKQKYDKISEKKMLTPIEVLCKSYPSEFTSYFHYCRSLRFEDKPDYSYLKRLFRDLFIREGYQFDYVFDWTILKYPQIGSSSRSRSSAKPALNPGPSAERTERPSVAQDFRDRFSGAVEAFSRRNSSGHGYGDHSRHRLTDDAPSSKDVQPDSERARSSSRNGSTSKRPVISSSRPSSSGEPSESRSSRLVSSSGRLSTAQRIQPGYDSKTSFTRTAAARGGRDDTLRSFELLSIGTGKRK

SEQ ID NO: 21738 - protein, 463 aa, Manihot esculenta
MDHVIGGKFRLGRKIGSGSFGELYLGINVQTGDEVAIKLESAKTKHPQLHYESKLYMLLQGGTGIPHLKWFGVEGDHNVMVIDLLGPSLEDLFNYCNRKFSLKTVLMLADQLINRVEYMHSRGFLHRDIKPDNFLMGLGRKANQVYIIDYGLAKKYKDLQTHKHIPYRENKNLTGTARYASVNTHLGVEQSRRDDLESLGYVLMYFLRGSLPWQGLKAGTKKQKYDKISEKKMLTPVEILCKNYPSEFTSYFHYCRSLRFDDAPDYSYLKRLFRDLFIREGYQFDYVFDWTILKYPQIGSSSRARPSSKAAINPGPSAERVERPSVGQEIRDRFSGAVEAFARRNGSGHALHGDQSRYRSIDDVPSSKDVHTDSERPRSSSRNGSTSKRAVVSSSRPSSSGEPSENRSSRLLSSSGRLSTTHRVQPGFESKSSSFSRATATRGGRDDTLRSFELLSIGTGKRK

SEQ ID NO: 21739 - protein, 462 aa, Prunus persica
MEHVIGGKFKLGRKIGSGSFGELYLGINVQTGEEVAVKLESVKTKHPQLHYESKLYMLLQGGTGVPHLKWFGVEGEYNVMVIDLLGPSLEDLFNYCNRKFSLKTVLMLADQLINRVEYMHSRGFLHRDIKPDNFLMGLGRKANQVYIIDYGLAKKYRDLQTHKHIPYRENKNLTGTARYASVNTHLGVEQSRRDDLESLGYVLMYFLRGSLPWQGLKAGTKKQKYDKISEKKMLTPIEVLCKSYPSEFTSYFHYCRSLRFEDKPDYSYLKRLFRDLFIREGYQFDYVFDWTILKYPQIGSSSRSRPSAKPALNPGPSAERTERPSAVAQDFRDRFSGAVEAFSRRNSSGHGYGDHSRHRLTDDAPSSKDVQPDSERARSSSRNGSTSKRPVISNSRPSSSGEPSENRSSRLVSSSGRLSTAQRIQPGYDSKTSFTRTAAARGGRDDTLRSFELLSIGTGKRK

SEQ ID NO: 21740 - protein, 466 aa, Eucalyptus grandis
MDHVIGGKFKLGRKIGSGSFGELYLGINVQSGEEVAIKLESVKTKHPQLHYESKIYMLLQGGTGIPHLKWFGVEGEYNVMVIDLLGPSLEDLFNYCNRKFSLKTVLMLADQLINRVEYMHSRGFLHRDIKPDNFLMGLGRKANQVYIIDYGLAKKYRDLQTHKHIPYRENKNLTGTARYASVNTHLGVEQSRRDDLESLGYVLMYFLRGSLPWQGLKAGTKKQKYDKISEKKMLTPIEVLCRSYPSEFTSYFHYCRSLRFEDKPDYSYLKRLFRDLFIREGYQFDYVFDWTILKYPQIGSSSRARPSSKPALNPGPSAERAERSERPSVGQEIRERLSGAVEAFARRNGASHGFHGDHSRHRSSDDAPSSKDVQPDSEKARSSSRNGSTSKRAVISSSRPSSSGEPSDGRSSRLVSSSGRLSTTHRVQPGFESKSSSFTRNGATRGSRDDALRSFELLSLGTSKRK

SEQ ID NO: 21741 - protein, 458 aa, Fragaria vesca
MEHVIGGKFKLGRKIGSGSFGELYLGINVQTGEEVAVKLESVKTKHPQLHYESKLYMLLQGGTGVPHLKWFGVEGEYNVMVIDLLGPSLEDLFNYCNRKFSLKTVLMLADQLINRVEYMHSRGFLHRDIKPDNFLMGLGRKANQVYIIDYGLAKKYRDLQTHKHIPYRENKNLTGTARYASVNTHLGVEQSRRDDLESLGYVLMYFLRGSLPWQGLKAGTKKQKYDKISEKKMLTPIEGLCKSYPSEFTSYFHYCRSLRFEDKPDYSYLKRLFRDLFIREGYQFDYVFDWTILKYPQIGSSSRARTSAKPALSPGPSAERTERRSERDEFRERLSGAVEAFSRRNGSGQGDNSRLKSVEDAPSSKDVHHDSERTRSSSRNGSTSKRPVISSSRPSSSGEPSESRSSRLISSSGRLSTTQRTPGYESKVSYTRTSAARGGRDDALRSFELLSIGTGKRK

SEQ ID NO: 21742 - protein, 463 aa, Cucumis sativus
MEHVIGGKFKLGRKIGSGSFGELYLGTNVQTEEEVAVKLESVKTKHPQLHYESKLYMLLQGGTGIPHLKWFGVEGEYNVMVIDLLGPSLEDLFNYCNRKLSLKTVLMLADQLINRVEYMHSRGFLHRDIKPDNFLMGLGRKANQVYIIDYGLGKKYRDLQTHKHIPYRENKNLTGTARYASINTHLGVEQSRRDDLESLGYVLMYFLRGSLPWQGLRAGTKKQKYDKISEKKMLTPIEVLCKSYPTEFTSYFHYCRALRFEDKPDYSYLKRLFRDLFIREGYQFDYVFDWTILKYPQIGSSSRTRPTGKAAITPGPSAERVERPLVGQDLRDKFSGPVEAFARRNGTGIGLHSDHSRHRSSDDVPSSKDVQPDAERARSSSRQGSASKRPILSSSRPSSSGEPSELRSSRLFSSSSRLSGSTQRIQPGVESKSSFLRSSATKGSRDDALRSFELLTIGTGKKK

SEQ ID NO: 21743 - protein, 464 aa, Vitis vinifera
MDHVIGGKFKLGRKIGSGSFGELYLGINVQTGEEVAVKLEPVKTKHPQLHYESKLYMLLQGGTGVPHLKWFGVEGEYNAMVIDLLGPSLEDLFNYCNRKFSLKTVLMLADQLINRVEYMHSRGFLHRDIKPDNFLMGLGRKANQVYIIDYGLAKKYRDFQTHKHIPYRENKNLTGTARYASVNTHLGVEQSRRDDLESLGYVLMYFLRGSLPWQGLKAGTKKQKYDKISEKKMLTPIEVLCKSYPSEFTSYFHYCRSLRFDDKPDYSYLKRLFRDLFIREGYQFDYVFDWTVLKYPQIGSSSRVRQPSGKPALNPGPSAERMERPSVGQEIRDRFSGAVEAFSRRNNSGSGYHGDQSRHRGSEDVPSSKDVQTDSERPRSSSRNGSTSKRAVVSSSRPSSSGEPTETRASRLVSGSGRLSTTQRSQPGFESKSSSFTRASAARGGREDPLRSFELLTIGSGKKK

SEQ ID NO: 21744 - protein, 461 aa, Cucumis melo
MEHIIGGKFKLGRKIGSGSFGELYLGTNVQTGEEVAVKLESAKTKHPQLHYESKLYMLLQGGTGIPHLKWFGVEGDYNVMVIDLLGPSLEDLFNYCNRKLSLKSVLMLADQLINRVEYMHSRGFLHRDIKPDNFLMGLGRKANQVYIIDYGLAKKYRDLQTHKHIPYRENKNLTGTARYASVNTHLGVEQSRRDDLESLGYVLMYFLRGSLPWQGLKAGTKKQKYDKISEKKMLTPVEVLCKSYPSEFTSYFHYCRSLRFEDKPDYSYLKRLFRDLFIREGYQFDYVFDWTILKYPQIGSSSKPRPSGKPGHAPGPSAERGEKHPVGQDIRDRYSGGAEAFGRRNASGHLHGDHSRHRSDDVPSSKDVQPDSERGRSSYRNGSISKRPVLSSSRPSSSGEPSEIRSSRLVSASSRLSAGQRVQPGFESKTTTFTRSSTTKGGRDDTLRSFELLSIGTGKRK

SEQ ID NO: 21745 - protein, 461 aa, Citrullus lanatus
MEHIIGGKFKLGRKIGSGSFGELYLGTNVQTGEEVAVKLESAKTKHPQLHYESKLYMLLQGGTGIPHLKWFGVEGDYNVMVIDLLGPSLEDLFNYCNRKLSLKSVLMLADQLINRVEYMHSRGFLHRDIKPDNFLMGLGRKANQVYIIDYGLAKKYRDLQTHKHIPYRENKNLTGTARYASVNTHLGVEQSRRDDLESLGYVLMYFLRGSLPWQGLKAGTKKQKYDKISEKKMLTPVEVLCKSYPSEFTSYFHYCRSLRFEDKPDYSYLKRLFRDLFIREGYQFDYVFDWTILKYPQIGSSSKPRPSGKPGHTPGPSAERGEKHPVGQDVRDRFSGGAEAFGRRNASGHLHGDHSRHRSDDVPSSKDVQPDSERGRSSYRNGSISKRPVLSSSRPSSSGEPSEIRSSRLVSASSRLSAGQRVQPGFESKTTTFTRSSTTKGGRDDTLRSFELLSIGTGKRK

SEQ ID NO: 21746 - protein, 460 aa, Theobroma cacao
MEHIIGGKFKLGRKIGSGSFGELYLGVNVQSGEEVAVKLESVKTKHPQLHYESKLYMLLQGGMGIPHLKWFGVEGEYNVMVIDLLGPSLEDLFNYCNRKFSLKTVLMLADQLINRVEYMHSRGFLHRDIKPDNFLMGLGRKANQVYIIDYGLAKKYRDLQTYKHIPYRENKNLTGTARYASVNTHLGVEQSRRDDLESLGYVLMYFLRGSLPWQGLKAGTKKQKYDKISEKKMLTPIEVLCKSYPSEFTSYFHYCRSLRFEDRPDYSYLKRLFRDLFIREGYQFDYVFDWTILRYPQVGSSSRARPSPKPGLNPPGVSADRTERPSVGQEIRERFSGAVGVLGRRNGLHGDQSRYRSSDDVPSSKDVQPDSEKGRSSSRNGSTSKRAVVSSSRPSSSGEPSENRSSRLVSSSGRLSTTQRVQPGFESKSSTFIRTAATRGGRDDALRSFELLTIGSGKRK

SEQ ID NO: 21747 - protein, 461 aa, Cucumis sativus
MEHIIGGKFKLGRKIGSGSFGELYLGTNVQTGEEVAVKLESAKTKHPQLHYESKLYMLLQGGTGIPHLKWFGVEGDYNVMVIDLLGPSLEDLFNYCNRKLSLKSVLMLADQLINRVEYMHSRGFLHRDIKPDNFLMGLGRKANQVYIIDYGLAKKYRDLQTHKHIPYRENKNLTGTARYASVNTHLGVEQSRRDDLESLGYVLMYFLRGSLPWQGLKAGTKKQKYDKISEKKMLTPVEVLCKSYPSEFTSYFHYCRSLRFEDKPDYSYLKRLFRDLFIREGYQFDYVFDWTILKYPQIGSSSKARPSGKPGHTPGPSAERGEKHPVGQEIRDRYPGGAEAFGRRNASGHLHGDHSRHRSDDVPSSKDVQPDSERGRSSYRNGSISKRPVLSSSRPSSSGEPSEIRSSRLVSASSRLSAGQRVQPGFESKTTTFTRSSTTKGGRDDALRSFELLSIGTGKRK

SEQ ID NO: 21748 - protein, 466 aa, Ricinus communis
MSIMDVLIGGKFKLGRKIGSGSFGELYLGINVQSGEEVAVKLESAKTKHPQLHYESKLYVLLQGGTGIPHLKWFGVEGDYNVMAIDLLGPSLEDLFNYCNRKFSLKTVLMLADQLLNRVEFMHSRGFLHRDIKPDNFLMGLGRKANQVYIIDYGLAKKYKDLQTHKHIPYRENKNLTGTARYASVNTHLGVEQSRRDDLESLGYVLMYFLRGSLPWQGLKAGTKKQKYDKISEKKMLTPIEFLCKNYPSEFTSYFHYCRSLRFEDAPDYSYLKRLFRDLFIREGYQFDYVFDWTILKYPQIGSSSRARPISKPAVNPGPSAERTERPSVGQEIRDRFSGAVEAFARRNGSGHALHGDHSRHRSSDDVPSSKDVHLDSERPRSSSRNGSTSKRAVISSSRPSSSGEPTESRSSRLLSSSGRLSTTHRVQPGFESKSSSFTRAAATRSSRDDALRSFELLSMGTGKRK

SEQ ID NO: 21749 - protein, 466 aa, Gossypium raimondii
MEHIIGGKFKLGRKIGSGSFGELYLGVNVQSGEEVAVKLESVKTKHPQLHYESKLYMLLQGGTGIPHLKWFGVEGEYNVMVIDLLGPSLEDLFNYCNRKFSLKTVLMLADQLINRVEYMHSRGFLHRDIKPDNFLMGLGRKANQVYIIDYGLAKKYRDLQTHKHIPYRENKNLTGTARYASVNTHLGVEQSRRDDLESLGYVLMYFLRGSLPWQGLKAGTKKQKYDKISEKKMLTPIEVLCKSYPSEFTSYFHYCRSLRFEDKPDYSYLKRLFRDLFIREGYQFDYVFDWTILRYPQVGSSSRARASPKPGLSPPGVSAERTERPSVGQEIRERFSGAVEAFARRNVSGHGLHGDQSRHRSSDDVPSSKDAQPDSERTRSSSRNDSASKRPVVVSGNSQPGSSGEPSENRSSRLFSSSGRMSTTQRVQPGFESKSSSFTRTAVTRAGRDDTLRSFDLLTIGSGKRK

SEQ ID NO: 21750 - protein, 465 aa, Citrus clementina
  Sequence also found in Organisms: Citrus sinensis
MDHVIGGKFKLGRKIGSGSFGELYLGVNVQTGEEVAVKLESVKTKHPQLHYESKLYMLLQGGTGVPHLKWFGVEGEYNVMVIDLLGPSLEDLFNYCNRKFSLKTVLMLADQLINRVEYMHSRGFLHRDIKPDNFLMGLGRKSNQVYIIDYGLAKKYRDLQTHKHIPYRENKNLTGTARYASVNTHLGVEQSRRDDLESLGYVLMYFLRGSLPWQGLKAGTKKQKYDKISEKKMLTPIEVLCKSYPSEFTSYFHYCRSLRFEDKPDYSYLKRLFRDLFIREGYQFDYVFDWTILKYPQTGSSSRSRPSGKPNLNPAGPSAERVERPSGQEVRDRFAGGIEAFARRNTSGHGLHGDHSRHKSSDDVPSSKDVQPDSERPRSLSRNSSSLKRAIMSGGRPSSSGDHSDNRSGRLVSGSGSGRLSTTQRAQPGYESKSSSFSRGAATRSGRDDALRSFELLTIGSGKRK

SEQ ID NO: 21751 - protein, 466 aa, Gossypium hirsutum
MEHIIGGKFKLGRKIGSGSFGELYLGVNVQSGEEVAVKLESVKTKHPQLHYESKLYMLLQGGTGIPHLKWFGVEGEYNVMVIDLLGPSLEDLFNYCNRKFSLKTVLMLADQLINRVEYMHSRGFLHRDIKPDNFLMGLGRKANQVYIIDYGLAKKYRDLQTHKHIPYRENKNLTGTARYASVNTHLGVEQSRRDDLESLGYVLMYFLRGSLPWQGLKAGTKKQKYDKISEKKMLTPIEVLCKSYPSEFTSYFHYCRSLRFEDKPDYSYLKRLFRDLFIREGYQFDYVFDWTILRYPQVGSSTRARASPKPGLSPPGVSAERTERPSVGQEIRERFSGAVEAFARRNVSGHGLHGDQSRHRSSDDVPSSKDAQPDSERTRSSSRNDSASKRPVVVSGNSQPGSSGEPSENRSSRLFSSSGRMSTTQRVQPGFESKSSSFTRTAVTRAGRDDTLRSFDLLTIGSGKRK

SEQ ID NO: 21752 - protein, 463 aa, Cicer arietinum
MDLVVGGKFKLGRKIGSGSFGELYLGVNVQTEEEVAVKLESVKTKHPQLLYESKLYMLLQGGTGIPHIKWSGVEGDYNVMAIDLLGPSLEDLFNYCSRKFSLKTVLMLADQLINRVEYMHSRGFLHRDIKPDNFLMGLGRKANQVYIIDYGLAKKYRDLQTHKHIPYRENKNLTGTARYASVNTHLGVEQSRRDDLESLGYVLMYFLRGSLPWQGLKAGTKKQKYDKISEKKMLTPIEVLCKSHPTEFTSYFHYCRSLRFEDKPDYSYLKRLFRDLFIREGYQFDYVFDWTILKYPQIGSSSRTRPSVKPVLNPGPSGERLERPSVGKEIRDRLSGAVGAFSRRNGSGHGLHKDLSKHRSLDNTPSPKDVQPDSDRARSSTRHGSASKRPIISSSRPSSSGEPSESRSSRLISGSSRLSSTQRVQPGFESKPSFTRATAGTRGSRDDTLRSFELLSISTGKRK

SEQ ID NO: 21753 - protein, 458 aa, Euphorbia peplus
MDHVIGGKFKLGRKIGSGSFGELYLGINVQSGEEVAVKLESVKTKHPQLHYESKLYMLLQGGTGIPHLKWFGVETEYNVMVIDLLGPSLEDLFNYCNRKFTLKTVLMLADQLINRVEYMHTRGFLHRDIKPDNFLMGLGRKANQVYIIDYGLAKKYKDLQTHKHIPYRENKNLTGTARYASVNTHLGVEQSRRDDLESLGYVLMYFLRGSLPWQGLKAGTKKQKYDKISEKKMLTPIEFLCKNHPSEFTSYFHYCRSLRFEDTPDYSYLKRLFRDLFIREGYQFDYVFDWTILKYPQIGSSSRARPSSKPVVNPGPPAERTERPSVGQEIRERFSGAVEAFARRNGSGHADHLRHRSSDDVASPKDVHPDSERPRSSSRNGGTSKRALVSSTRPSSSGEPSENRSSRLLSSSGRLSTAHRAQPGFESKSSSFTRATKSGRDDALRSFELLSIGTGKRK

SEQ ID NO: 21754 - protein, 461 aa, Lupinus angustifolius
MDHVIGGKFKLGRKIGAGSFGELYLGVNVQTGEEVAVKLEPAKTKHPQLHYESKLYMLLQGGTGIPHLKWFGVEGDYNVMVIDLLGPSLEDLFNYCNRKLSLKTVLMLADQLINRVEYMHSRGFLHRDIKPDNFLMGLGRKANQVYVIDYGLAKKYRDLQTHKHIPYRENKNLTGTARYASVNTHLGVEQSRRDDLESLGYVLMYFLRGSLPWQGMKGGTKKQKYDKISEKKMLTPIEILCKSYPSEFTSYFHYCRSLRFEDKPDYSYLKRLFRDLFIREGYQFDYVFDWTILKYPQIGSSSRARKWLLSANDSLILGVPEVRDRLSGALEEFARRNRPTSSGLGLHGDNSRHRSSDDVPSSKDVQADSERPRSSSRNGSTSKRPVVSSSRPSTSGEPNKSHSGRLVSSSGRLSTTQRILPGLDSKTFFTRASGSRGGRDDTLRSFELLSIGRKKEMKTVQ

SEQ ID NO: 21755 - protein, 464 aa, Panax ginseng
MDHVIGGKFKLGRKIGSGSFGELYLGVNVQTGEEVACKLESAKTKHPQLHYESKLYMLLQGGTGIPHLKWFGVEGEYNAMVIDLLGPSLEDLFNYCNRKFTLKTVLMLADQLINRVEYMHSRGFLHRDIKPDNFLMGLGRKANQVYIIDYGLAKKYRDLQTHKHIPYRENKNLTGTARYASVNTHLGVEQSRRDDLESLGYVLMYFLRGSLPWQGLKAGTKKQKYDKISEKKMLTPIEVLCKSYPSEFISYFHYCRSLRFDDKPDYSYLKRLFRDLFIREGYQFDYVFDWTILKYPQIGSSSRGRQPAGKLALNPGPSADRAEKTPVKREMRDRFSGAVEAFARRNGSGAGLHGDHSRHRSSEDVPSSKDVQADTERGRVSRTSSASKRVVIPSSRPSSSGEPSENRSNRLGSGSGRLSTTQRIQPGFESKSSFTRAVASASRGGRDDALRSFELLTIGTKKRK

SEQ ID NO: 21756 - protein, 459 aa, Chenopodium quinoa
MDHVIGGKFKLGRKIGSGSFGELYLGINVQTGEEVAVKLEPAKTKHPQLHYESKLYMLLQGGTGVPHLKWFGVEGEYNVMVIDLLGPSLEDLFNYCNRKFSLKTVLMLADQMINRVEYMHSRGFLHRDIKPDNFLMGLGRKANQVYVIDFGLAKKYRDLQTHKHIPYRENKNLTGTARYASVNTHLGVEQSRRDDLESLGYVLMYFLRGSLPWQGLKAGTKKQKYDKISEKKMLTPIEVLCKNYPSEFTSYFHYCRSLRFDDKPDYSYLKRLFRDLFIREGYQFDYVFDWTILKYPQIGSSSRSRPTAKPALNPGPSAERAERTPGQEIRDRFSGTVEAFTRRNNSSSGLQGDSRHRSSDEPSSKDVQADRERGRISRNGSTSKRAVASSSRPSSSGEPSDGRSSRLMSSGGRLSTTQRIQPGFESKTSTLARVSAARPGRDDTLRSFEFLSIGAGRRK

SEQ ID NO: 21757 - protein, 467 aa, Trifolium pratense
MMDLVIGGKFKLGRKIGSGSFGELYLGVNVQTQEEVAVKLEPVKTKHPQLLYESKLYMLLQGGTGIPHIKWSGVEGDYNVMAIDLLGPSLEDLFNYCSRKFSLKTVLMLADQLLNRVEYMHSRGFLHRDIKPDNFLMGLGRKANQVYIIDYGLAKKYRDLQTHKHIPYRENKNLTGTARYASVNTHLGVEQSRRDDLESLGYVLMYFLRGSLPWQGLKAGTKKQKYDKISEKKMLTPIEVLCKSHPTEFTSYFHYCRSLRFEDKPDYSYLKRLFRDLFIREGYQFDYVFDWTILKYPQIGSSSRTRPSVKPVLNPAPSGERERLERPSVGQEIRDRLSGAVGAFSRRNGSAHGLHKDLAKQHRSLDNMPSPKDVQPDSERARSSTRNGSASKRPMISNSRPSSSGEPSESRSSRLVSSSSRLSTTQRVQPGFESKSSFTRATAGTRGSRDDTLRSFELLSIGTGKKK

SEQ ID NO: 21758 - protein, 460 aa, Euonymus alatus
MDHVIGDKFKLGRKIGSGSFGELYLGVNVQTGEEVAVKLESVKTKHPQLHYESKLYMFLQGGTGIPHLKWFGVEGDYNVMVIDLLGPSLEDLFNYCSRKFSLKTVLMLADHLISRVEYMHSRGFLHRDIKPDNFLMGLGRKANQVYVIDFGLAKKYRDLQTHRHIPYRENKNLTGTARYASVNTHLGVEQSRRDDLESLGYVLMYFLRGSLPWQGLKAGTKKQKYDKISEKKMLTPIEVLCKSYPSEFMSYFHYCRSLRFEDKPDYSYLKRLFRDLFIREGYQFDYVFDWTILKYPQIGSSSRARPSAKPAMARGPSVERVERPSVGQEIRDPFSGAVARRNGSGHGLHGDHSRHRPSDDVLPSKDVHPNSERPRSLSRNRSASKRAVVSGSRPSSSVEPSENRSSRLLSSTGRLSTTQRVQPGIESKSLSFTRTGAARGDRDNTLRSLELLSIGTGKRK

SEQ ID NO: 21759 - protein, 465 aa, Panax ginseng
MDHVIGGKFKLGRKIGSGSFGELYLGVNVQTGEEVACKLESAKTKHPQLHYESKLYMLLQGGTGIPHLKWFGVEGEYNAMVIDLLGPSLEDLFNYCNRKFTLKTVLMLADQLINRVEYMHSRGFLHRDIKPDNFLMGLGRKANQVYIIDYGLAKKYRDLQTHKHIPYRENKNLTGTARYASVNTHLGVEQSRRDDLESLGYVLMYFLRGSLPWQGLKAGTKKQKYDKISEKKMLTPIEVLCKSYPSEFISYFHYCRSLRFDDKPDYSYLKRLFRDLFIREGYQFDYVFDWTILKYPQIGSSSRGRQPAGKLALNPGPSADRAEKTPVKREMRDRFSGAVEAFARRNGSGAGLHGDPSRHRSSEDVPSSKDVQADTERGRVSRTSSASKRVVIPSSRPSSSGEPSENRSNRLGSGSGRFSTTQRIQPGFESKSSSFTRAVASASRGGCDDALRSFELLTIGTGKRK

SEQ ID NO: 21760 - protein, 457 aa, Medicago truncatula
MDLVIGGKFKLGRKIGSGSFGEIYLGVNVQTQEEVAVKLEPVKTKHPQLLYESKLYMLLQGGTGIPHIKWSGVEGEYNVMAIDLLGPSLEDLFNYCSRKFSLKTVLMLADQLINRVEYMHSRGFLHRDIKPDNFLMGLGRKANQVYIIDYGLAKKYRDLQTHKHIPYRENKNLTGTARYASVNTHLGVEQSRRDDLESLGYVLMYFLRGSLPWQGMKAGTKKQKYDKISEKKMLTPIEVLCKSHPTEFTSYFHYCRSLRFEDKPDYSYLKRLFRDLFIREGYQFDYVFDWTILKYPQIGSSSRTRPSVKPVLNPGPSGERLERPSVGQEIRDRLSGAVGAFSRRNGSAQGLQHRSLDNMPSSKDVQPDSDRARSSTRNGSASKRPMISSSRPSSSGEPSESRSSRLISSSSRLSTTQRVQPGLESKSSFTRTAGTRGGRDDTLKSFELLSIGTGKRK

SEQ ID NO: 21761 - protein, 465 aa, Trifolium pratense
MMDLVIGGKFKLGRKIGSGSFGELYLGVNVQTQEEVAVKLEPVKTKHPQLLYESKLYMLLQGGTGIPHIKWSGVEGDYNVMAIDLLGPSLEDLFNYCSRKFSLKTVLMLADQLLNRVEYMHSRGFLHRDIKPDNFLMGLGRKANQVYIIDYGLAKKYRDLQTHKHIPYRENKNLTGTARYASVNTHLGVEQSRRDDLESLGYVLMYFLRGSLPWQGLKAGTKKQKYDKISEKKMLTPIEVLCKSHPTEFTSYFHYCRSLRFEDKPDYSYLKRLFRDLFIREGYQFDYVFDWTILKYPQIGSSSRTRPSVKPVLNPGPSGERLERPSVGQEIRDRLSGAVGAFSRRNGSAHGLHKDLAKQHRSLDNMPSPKDVQPDSERARSSTRNGSASKRPMISNSRPSSSGEPNESRSSRLVSSSSRLSTTQRVQPGFDSKSSFTRATAGTRGSRDDALRSFELLTIGTGKKK

SEQ ID NO: 21762 - protein, 466 aa, Lippia dulcis
MDHVIGGKFKLGRKIGSGSFGELYLGVNIQTGEEVAVKLESVKTKHPQLHYESKLYMLLQGGTGIPHLKWYGVEGEYNCMAIDLLGPSLEDLFNYCNRKFTLKTVLMLADQLINRVEYMHSRGFLHRDIKPDNFLMGLGRKANQVYIIDYGLAKKYRDLQTHKHIPYRENKNLTGTARYASVNTHLGVEQSRRDDLESLGYVLMYFLRGSLPWQGLRAGTKKQKYDKISEKKMLTPVEVLCKSYPSEFISYFHYCRSLRFEDKPDYSYLKRLFRDLFIREGYQFDYVFDWTILKYPQIGSSSRSARPTGKVPLNLGTSAERVEKTPVKQELRDRFSGAVGAFARRNGSSSGLHAADHSRQHRSSDDVPSSKDVQADSERGQLSRPGSASKRAVISSSRPSSSGEPGENRHSRLGSSSGRISTSHRLQPGYESKSSSFARAAAATRGVRDEALRSFELLSIGTGKRK

SEQ ID NO: 21763 - protein, 463 aa, Gossypium hirsutum
MEHVIGGKFKLGRKIGSGSFGELYLGVNVQSGEEVAVKLESIKTKHPQLLYESKLYMLLQGGTGIPHLKWFGVEGEYNVMVIDLLGPSLEDLFNYCNRKFSLKTVLMLADQLLIRVEYMHSRGFLHRDIKPDNFLMGLGRKANQVYIIDYGLAKKYRDLQTHKHIPYRENKNLTGTARYASVNTHLGVEQSRRDDLESLGYVLMYFLRGSLPWQGLKAGTKKQKYDKISEKKMLTPIEVLCKSYPSEFTSYFHYCRSLRFEDKPDYSYLKRLFRDLFIREGYQFDYVFDWTIRRYPQVGSSSRARPSPKPGLNPPGVSAERTERPSVGQEIGERVSGTIEPLTRRIGSGQGLHGDQSRYRSDDVPSSKDVQPDSEKVRSSSRNDSSSKRPVATGSRLDSSGEPNENRSSRLVSSSSRLSTTQRILPGFQSRSASYTRTSATRGGQDDTLRSFEFLTIGSGKRK

SEQ ID NO: 21764 - protein, 463 aa, Lupinus angustifolius
MDHVINGKFKLGRKIGSGSFGELYLGVNVQSGEEVAVKLEPVKTKHPQLHYESKLYMLLQGGTGIPHLKWFGVEGDYNVMVIDLLGPSLEDLFNYCSRKFSLKTVLMLADQMINRVEYMHSRGLLHRDIKPDNFLMGLGRKANQVYIIDYGLAKKYRDLQTHKHIPYRENKNLTGTARYASVNTHLGIEQSRRDDLESLGYVFMYFLRGSLPWQGLKAGTKKQKYDKISEKKMLTPIEVLCKSHPSEFTSYFHYCRSLRFEDKPDYSYLKRLFRDLFIREGYQFDYVFDWTILKYPQIGSSSIVQPSGKPVLNPGPSGERSERISVGKEIRDRLSGAVKVFSRRNSSGRGPSTDRSRHRASDDVPSSKDVQPDIERARSSSRNGSALKRPVISSSRLSSSGEPSENHSSRLVSNSGRISTTTRRIQPSFESKSSFTRTAGTQGGRHDALRSFELLSIASGKKK

SEQ ID NO: 21765 - protein, 463 aa, Gossypium raimondii
MEHVIGGKFKLGRKIGSGSFGELYLGVNVQSGEEVAVKLESIKTKHPQLLYESKLYMLLQGGTGIPHLKWFGVEGEYNVMVIDLLGPSLEDLFNYCNRKFSLKTVLMLADQLLIRVEYMHSRGFLHRDIKPDNFLMGLGRKANQVYIIDYGLAKKYRDLQTHKHIPYRENKNLTGTARYASVNTHLGVEQSRRDDLESLGYVLMYFLRGSLPWQGLKAGTKKQKYDKISEKKMLTPIEVLCKSYPSEFTSYFHYCRSLRFEDKPDYSYLKRLFRDLFIREGYQFDYVFDWTIRRYPQVGSSSRARPSPKPGLNPPGVSAERTERPSVGQEIGERVSGTIEPLTRRIGSGQGLHGDQSRYRSDDVPSSKDVQPDSEKVRSSSRNDSSSKRPVATGSRLDSSGEPNENRSGRLVSSSSRLSTTQRILPGFQSKSASYTRTSATRGGQDDSLRSFEFLTIGSGKRK

SEQ ID NO: 21766 - protein, 461 aa, Gossypium raimondii
MEHIIGGKFKLGRKIGNGSFGELYLGVNVQSGEEVAVKLEPVKTKHPQLHYESKLYMLLQGGTGIPHLKWFGVEGEYSIMVIDLLGPSLEDLFNYCNRKFSLKTVLMLADQLINRVEYMHSRGFLHRDIKPDNFLMGLGRKANQVYVIDYGLAKKYRDLQTHKHIPYRENKNLTGTARYASVNTHLGVEQSRRDDLESLGYVLMYFLRGSLPWQGLKAGNKKQKYDKISEKKMLTPIEVLCKSYPSEFTSYFHYCRSLRFEDKPDYSYLKRLFRDLFIREGYQFDYVFDWTMLRYPQAASSSRVRPSPKPGLNPQGVSAERTGRPSVGQEIRERFSGAVEAFARRNGSGHGDQSRHRSPDNVLSSKDMQPGSDRAHSSSRNGSTSKRPVVSGSRPNSSGEPSDNRSSRLVSSSGRLSTTQRVQPGFESKSSTFTRTTATRSSRNHALRSFEFLTIGSGKRK

SEQ ID NO: 21767 - protein, 454 aa, Chenopodium quinoa
MDHVIGGKFKLGRKIGSGSFGELYLGINVQTGEEVAVKLEPAKTKHPQLHYESKLYMLLQGGTGVPHLKWFGVEGEYNVMVIDLLGPSLEDLFNYCNRKFSLKTVLMLADQMINRVEYMHSRGFLHRDIKPDNFLMGLGRKANQVYVIDFGLAKKYRDLQTHKHIPYRENKNLTGTARYASVNTHLGVEQSRRDDLESLGYVLMYFLRGSLPWQGLKAGTKKQKYDKISEKKMLTPIEVLCKNYPSEFTSYFHYCRSLRFDDKPDYSYLKRLFRDLFIREGYQFDYVFDWTILKYPQIGSSSRSRPTAKPALNPGPSAERAERTPGQELRDRFSGTVEAFTRRNNSSSGLQGDSRHRSSDEPSSKDVQADRERGRISRNGSTSKRAVASSSRPSSSGEPSDGRSSRLMSSGGRLSTTHRIQPGFESKTSTLARVSAARPGRDDTLRSFEFLSIG

SEQ ID NO: 21768 - protein, 463 aa, Panax ginseng
MDHVVGGKFKLGRKIGSGSFGELYLGVNVQTGEEVAVKLESAKTKHPQLHYESKLYLLLQGGTGVPHLKWFGVEGEYSAMVIDLLGPSLEDLFNYCNQKFTLKTVLMLADQLINRVEYMHSRGFLHRDIKPDNFLMGLGRKANQVYIIDYGLAKKYRDLQTHKHIPYRENKNLTGTARYASVNTHLGVEQSRRDDLESLGYVLMYFLRGSLPWQGLKAGTKKQKYDKISEKKMLTPIEMLCKSYPSEFISYFHYCRSLRFDDKPDYSYLKRLFRDLFIREGYQFDYVFDWTILKYPQIGSSSRGRQSAGKLALNPGPSVDKAEKTPVRRETRDRFSGAVEAFARKNGSAAGLHGDHSRHRSSDNVPSSKDVQADKERGQVSRTGSASKRAVISSSRPSSSGEPSENRLNRLGSSSGRLSTTQRIQPGFESKSSSFTRAVASRGGRDDALRSFELLTIGSGKRK

SEQ ID NO: 21769 - protein, 493 aa, Lupinus angustifolius
MDHVIGGKFKLGRKIGAGSFGELYLGVNVQSGDEVAVKLEPTKTKHPQLHYESKLYMLLQGGTGIPHLKWFGVEGDYNVMVIDLLGPSLEDLFNYCNRKLSLKTVLMLADQLINRVEYMHSRGFLHRDIKPDNFLMGLGRKANQVYVIDYGLAKKYRDLQTHKHIPYRENKNLTGTARYASVNTHLGVEQSRRDDLESLGYVLMYFLRGSLPWQGMKGGTKKQKYDKISEKKMLTPIEVLCKSYPLEFTTYFHYCRSLRFEDKPDYSYLKRLFRDLFIREGYQFDYVFDWTILKYPQIGSSSRARPSGKPAINLGLSGERVERPSGVPEVRDRFSGALEQFARRNRPNSSGLGLHGENSRHRSSDDVPSSKDVQADSERTRSSSRNGSTSKRPVVSSSRPSTSGEPNESRSSRLLSSSGRLSTTQRIQAGLESKTPLTQRIQAGLESKTSLTQRIQAGLESKTSLTRASGSRGGRDDTFRSFELLSIGTGKRK

SEQ ID NO: 21770 - protein, 462 aa, Amsonia hubrichtii
MDHVIGGKFKLGRKIGSGSFGELYLGVNVQTGEEVAVKLEPLKTKHPQLHYESKLYMLLQGGTGVPHLKWFGVEGEYSAMVIDLLGPSLEDLFNYCNRKFTLKTVLMLADQLINRVEYMHSRGFLHRDIKPDNFLMGLGRKANQVYVIDYGLAKKYRDLQTHKHIPYRENKNLTGTARYASVNTHLGVEQSRRDDLESLGYVLMYFLRGSLPWQGLKAGTKKQKYDKISEKKMLTPIEVLCKSYPSEFISYFHYCRSLRFDDKPDYSYLKRLFRDLFIREGYQFDYVFDWTILKYPQIASSSRGRQPMGRLPLNGGPSVERLEKNPARQETRDRFSGAVESFTRRSGSGAGLHGDPMRHRSSDDVPSSKDVQADSERRLTRTGSSSKRAVMSSSRPSSSGEPSENRTSRLGSGTGRLSTTQRIQPGFESKSSSFTRVAATRGNRDETLRSFELLTIGSGKRK

SEQ ID NO: 21771 - protein, 459 aa, Cichorium intybus
MDHVIGGKFKLGRKIGSGSFGELYLGVNVQSGEEVAVKLESVKTKHPQLHYEAKLYMLLQGGTGVPHLKWIGVEGEYNAMVIDLLGPSLEDLFNYCNRKFTLKTVLMLADQLINRVEYMHSRGFLHRDIKPDNFLMGLGRKANQVYIIDYGLAKKYRDLQTHKHIPYRENKNLTGTARYASVNTHLGVEQSRRDDLESLGYVLMYFLRGSLPWQGLKAGTKKQKYDKISEKKMLTPIEVLCKSYPTEFISYFHYCRSLRFDDKPDYSYLKRLFRDLFIREGYQFDYVFDWTILKYPQIGSGSSSRGRTVGKLPLNPGPSADKVEKTPVRHSGAVEAFARRNVSGSGLHGEHSRHRSSEHATSSKEMHADSDRGRISRTGSTSKRAVVSSSRPSSSGEPSEGRSNRLGSGSGRISTAQRLHSQPGFESKSSSFTRAVPSSRGGRDDALRSFELLTIGKRK

SEQ ID NO: 21772 - protein, 459 aa, Cichorium intybus
MDHVIGGKFKLGRKIGSGSFGELYLGVNVQSGEEVAVKLESVKTKHPQLHYEAKLYMLLQGGTGVPHLKWIGVEGEYNAMVIDLLGPSLEDLFNYCNRKFTLKTVLMLADQLINRVEYMHSRGFLHRDIKPDNFLMGLGRKANQVYIIDYGLAKKYRDLQTHKHIPYRENKNLTGTARYASVNTHLGVEQSRRDDLESLGYVLMYFLRGSLPWQGLKAGTKKQKYDKISEKKMLTPIEVLCKSYPTEFISYFHYCRSLRFDDKPDYSYLKRLFRDLFIREGYQFDYVFDWTILKYPQIGSGSSSRGRTVGKLPLNPGPSADKVEKTPVRHSGAVEAFTRRNISGSGLHGEHSRHRSSEHATSSKEMHADSDRGRISRTGSTSKRAVVSSSRPSSSGEPSESRSNRLGSGSGRISTAQRLHSQPGFESKSSSFTRAVPSSRGGRDDALRSFELLTIGKRK

SEQ ID NO: 21773 - protein, 462 aa, Panax ginseng
MDHVVGGKFKLGRKIGSGSFGELYLGVNVQTGEEVAVKLESAKTKHPQLHYESKLYLLLQGGTGVPHLKWFGVGEEYNAMVIDLLGPSLEDLFNYCNRKFTLKTVLMLADQLINRVEYMHSRGFLHRDIKPDNFLMGLGRKANQVYIIDYGLAKKYRDLQTHKHIPYRENKNLTGTARYASVNTHLGVEQSRRDDLESLGYVLMYFLRGSLPWQGLKAGTKKQKYDKISEKKMLTPIEMLCKSYPSEFISYFHYCRSLRFDDKPDYSYLKRLFRDLFIREGYQFDYVFDWTILKYPQIGSSSRGRQSAGKLALNPGPSVDKAEKTPVRRETRDRFSGAVEAFARKNGSAAGLHGDHSRHRSSDNVPSSKDVQADKERGQVSRTGSASKRAVISSSRPSSSGEPSENRLNRLGSSSGRLSTTQRIQPGFESKSSSFTRAVARGGRDDALRSFELLTIGTGKRK

SEQ ID NO: 21774 - protein, 465 aa, Aquilegia formosa
MEHVIGAKFKVGRKIGSGSFGELYLGVNIQSGEEVAIKLENVKTKHPQLHYESKLYMLLQGGTGIPHLKWFGVEGEYNVMVIDLLGPSLEDLFNYCNRKFTLKTVLMLADQLINRVEYMHSRGFLHRDIKPDNFLMGLGRKANQVYIIDYGLAKKYRDLQTHKHIPYRENKNLTGTARYASVNTHLGVEQSRRDDLESLGYVLMYFLRGSLPWQGLKAGTKKQKYDKISEKKMLTPIEVLCKSYPSEFISYFHYCRSLRFDDKPDYSYLKRLFRDLFIREGYQFDYVFDWTILKYPQIGANSRARMPSGKIGANAGPSAERVERTSVGQDMRDRFSGAVEAFAKRNYSVSGLHGDHSKHKSSEDGPSSNNLVPDSERGRTSSSRNGSSSKRAVMSSTRPSSSCEPSENRSSRLASSSARVSTTHRVQPGFESKTSSFTRATAARGARDDPLRSFELLSIGPEKRK

SEQ ID NO: 21775 - protein, 463 aa, Catharanthus roseus
MDHVIGGKFKLGRKIGSGSFGELYLGVNVQTGEEVAVKLEPLKTKHPQLHYESKLYMLLQGGTGVPHLKWFGVEGEYSAMVIDLLGPSLEDLFNYCNRKFSLKTVLMLADQLINRVEYMHSRGFLHRDIKPDNFLMGLGRKANQVYIIDYGLAKKYRDLQTHKHIPYRENKNLTGTARYASVNTHLGVEQSRRDDLESLGYVLMYFLRGSLPWQGLKAGTKKQKYDKISEKKMLTPFEVLCKSYPSEFISYFHYCRSLRFDDKPDYSYLKRLFRDLFIREGYQFDYVFDWTILKYPQIASSSRGRQPMGRLPLNGGPALERVEKNPVRQETRDRFSGTVESFTRRSGSAGLHGDPLRHRSSDDVPSSKDVQADSERRLSRAGSSSKRAVMSSSRPSSSGEPSENRTSRLGGGSGTGRLSTTQRLQPGFESKSSSFTRVAATRGSRDETLRSFELLTIGSGKRK

SEQ ID NO: 21776 - protein, 466 aa, Actinidia deliciosa
MDHVIGGKFKLGRKIGSGSFGELYLGVNVQTGEEVAVKLESVKTKHPQLYYESKLYMLLQGGTGVPHLKWFGVEGEYNAMVIDLLGPSLEDLFNYCNRKFTLKTVLMLADQLTNRVEYMHSRGFLHRDIKPDNFLMGLGRKANQVYIIDYGLAKKYRDLQTHKHIPYRENKNLTGTARYASVNTHLGVEQSRRDDLESLGYVLMYFLRGSLPWQGLKAGTKKQKYDKISEKKMLTPIEVLCKSYPSEFISYFHYCRSLRFDDKPDYSYLKRLFRDLFIREGYQFDYVFDWTILKYPQIGSSSIPRQPAGKLALNPGASAERAPVRQEVRDKFSGAVEAFARRKGTGGGLHEHSRHSDRFRNTSSEDVPSSKDVQADSERSRGAARSGSTSKRVVISGSRPSSSGEASENRPSRLGSGSARLSTTQRVQPGFESKSSSFTRAAATRGGREDPLRSFELLTIGTGKRK

SEQ ID NO: 21777 - protein, 463 aa, Gossypium hirsutum
MEHVIGGKFKLGRKIGSGSFGELYLGVNVQSGEEVAVKLESIKTKHPQLLYESKLYMLLQGGTGIPHLKWFGVEGEYNVMVIDLLGPSLEDLFNYCNRKFSLKTVLMLADQLLIRVEYMHSRGFLHRDIKPDNFLMGLGRKANQVYVIDYGLAKKFRDLQTHKHIPYRENKNLTGTARYASVNTHLGVEQSRRDDLESLGYVLMYFLRGSLPWQGLKAGTKKQKYDKISEKKMLTPIEVLCKSYPSEFTSYFHYCRSLRFEDKPDYSYLKRLFRDLFIREGYQFDYVFDWTIRRYPQVGSSSRARPSLKPGLNPPGVSAERTERPSVGQEIGERLSGTIEPLTRRIGSGQGLHGDQSRYISDDVPSSKDVQPDSEKVHSSSRNDSSSKRPVATGSRLDSSGEPNENRSGRLVSSSSRLSTTQRILPGFQSKSASYTRTSATRGGQDDSLRSFEFLTIGSGKRK

SEQ ID NO: 21778 - protein, 461 aa, Gossypium hirsutum
MEHIIGGKFKLGRKIGNGSFGQLYLGVNVQSGEEVAVKLEPVKTKHPQLHYESKLYMLLQGGTGIPHLKWFGVEGEYSIMVIDLLGPSLEDLFNYCNRKFSLKTVLMLADQLINRAEYMHSRGFLHRDIKPDNFLMGLGRKANQVYVIDYGLAKKYRDLQTHKHIPYRENKNLTGTARYASVNTHLGVEQSRRDDLESLGYVLMYFLRGSLPWQGLKAGNKKQKYDKISEKKMLTPIEVLCKSYPSEFTSYFHYCRSLRFEDKPDYSYLKRLFRDLFIREGYQFDYVFDWTMLRYPQAASSSRVRPSPKPGLNPQGVSAERTGRPSVGQEIRERFSGAVEAFARRNGSGHGDQSRHRSPDNVLSSKDMQPGSDRAQSSSRNGSTSKRPVVSGSRPNSSGEPSDNRSSRLVSSSGRLLTTQRVQPGFESKSSTFTRTTATRSSRNHALRSFEFLTIGSGKRK

SEQ ID NO: 21779 - protein, 461 aa, Olea europaea
MDHVIGGKFKLGRKIGSGSFGELYLGTNIQSGEEVAVKLESAKTKHPQLHYESKLYMLLQGGTGIPHLKWFGVEGEYNAMVIDLLGPSLEDLFNYCNRKFTLKTVLMLADQLIARIEYMHSRGFLHRDIKPDNFLMGLGRKASQVYIIDYGLGKKYRDLQTQKHIPYRENKNLTGTARYASVNTHLGVEQSRRDDLESLGYVLMYFLRGSLPWQGLKAGTKKQKYDKISEKKMLTPVEVLCKSYPSEFISYFHYCRSLRFEDKPDYMYLKRLFQDLFIREGYQLDYVFDWTILKYPQIGSSSRARPMGKLPINPGLSAERVQKTPVKQEVRDKLSGAVEAFAKRNGSNGGLHRENSRHRSVDVPSSKDVQPDSERGRLSRTGSTSKSRLLSSSRPSSYGEASENRNSRLGSGSGRLSTTHRLQPGFESKSSSFMRAAVSRGGHDDALRSFELLRIGSGKRK

SEQ ID NO: 21780 - protein, 460 aa, Spinacia oleracea
MDHVIGGKFKLGRKIGSGSFGELYLGINVQTGEEVAVKLESAKTKHPQLHYESKLYMLLQGGTGVPHLKWYGVEGEYNVMVIDLLGPSLEDLFNYCTRKFSLKTVLMLADQMISRVEYMHSRGFLHRDIKPDNFLMGLGRKANQVYVIDFGLAKKYRDLQTHKHIPYRENKNLTGTARYASVNTHLGVEQSRRDDLESLGYVLMYFLRGSLPWQGLKAGTKKQKYDKISEKKMLTPIEVLCKNYPSEFTSYFHYCRSLRFDDKPDYSYLKRLFRDLFIREGYQFDYVFDWTILKYPQIGSSSRPRPTAKPALNPGPSAERAERTSGQDIRDRFSGAVEGFARRNNPGTGSQGDQSRHRSADDPSSKDVQADRDRGRISRNGSTSKRAIASSSRPSSSGEPSDSRSSRLMSTSGRLSTTQRVQPGLESKTSSLARVSAARPGRDDALRSFDFLSIGAGRRK

SEQ ID NO: 21781 - protein, 459 aa, Cichorium intybus
MDHVIGGKFKLGRKIGSGSFGELYLGVNVQSGEEVAVKLESVKTKHPQLHYEAKLYMLLQGGTGVPHLKWIGVEGEYNAMVIDLLGPSLEDLFNYCNRKFTLKTVLMLADQLINRVEYMHSRGFLHRDIKPDNFLMGLGRKANQVYIIDYGLAKKYRDLQTHKHIPYRENKNLTGTARYASVNTHLGVEQSRRDDLESLGYVLMYFLRGSLPWQGLKAGTKKQKYDKISEKKMLTPIEVLCKSYPTEFISYFHYCRSLRFDDKPDYSYLKRLFRDLFIREGYQFDYVFDWTILKYPQIGSGSSSRGRTVGKLPLNPGPSADKVEKTPVRHSGAVEAFTRRNISGSGLHGEHSRHRSSEHATSSKEMHADSDRGRISRTGSTSKRAVVSSSRPSSSGEPSEGRSNRLGSGSGRISTAQRLHSQPGFESKSSSFTRAVPSSRGGRDDALRSFELLTIGKRK

SEQ ID NO: 21782 - protein, 461 aa, Gossypium hirsutum
MEHIIGGKFKLGRKIGNGSFGELYLGVNVQSGEEVAVKLEPVKTKHPQLHYESKLYMLLQGGTGIPHLKWFGVEGEYSIMVIDLLGPSLEDLFNYCNRKFSLKTVLMLADQLINRVEYMHSRGFLHRDIKPDNFLMGLGRKANQVYVIDYGLAKKYRDLQTHKHVPYRENKNLTGTARYASVNTHLGVEQSRRDDLESLGYVLMYFLRGSLPWQGLKAGNKKQKYDKISEKKMLTPIEVLCKSYSSEFTSYFHYCRSLRFEDKPDYSYLKRLFRDLFIREGYQFDCVFDWTMLRYPQAASSSRVRPSPKPGLNPQGVSAERTGRPSVGQEIRERFSGAVEAFARRNGSGHGDQSRHRSPDNALSSKDTQPGSDRAHSSSRNGSTSKRPVVSGSRPNSSGEPSDNRSSRLISSSGRLSTTQRVQPGFESKSSTFTRTAATRSSRNDALRSFEFLTIGSGKRK

SEQ ID NO: 21783 - protein, 460 aa, Rosmarinus officinalis
MDHVIGGKFKLGRKIGSGSFGELYLGVNIQTGEEVAVKLESVKTKHPQLHYESKLYMLLQGGTGIPHLKWFGVEGEYNAMAIDLLGPSLEDLFNYCNRKFSLKTVLMLADQLINRVEYMHSRGFLHRDIKPDNFLMGLGRKANQVYIIDYGLAKKYRDLQTHKHIPYRENKNLTGTARYASVNTHLGVEQSRRDDLESLGYVLMYFLRGSLPWQGLKAGTKKQKYDRISEKKMLTPVEVLCKSYPSEFISYFHYCRSLRFEDKPDYSYLKRLFRDLFIREGYQFDYVFDWTILKYPQVGSSSKTRPTGKIPLNLGQPAERVEKAPVKHEIRDRLSGAMEAFGRRTGSSAGLHADSSRNRSDEVPPSKDVKIDSERGRLSRTGSSSKRAVVSSSRPSSSGEPSDNRHSRLGSGSGRISTTQRLQPGFESKSSSFTRAAARGVRDETLRSFELLTIGSGKKK

SEQ ID NO: 21784 - protein, 472 aa, Valeriana officinalis
MDHVIGGKFKLGRKIGSGSFGELYLGINVQTGEEVAVKLESAKTKHPQLHYESKLYMLLQGGTGIPHLKWFGVEGEYNAMVIDLLGPSLEDLFNYCNRKLTLKTVLMLADQLINRVEYMHSRGFLHRDIKPDNFLMGLGRKANQVYVIDYGLAKKYRDLQTHKHIPYRENKNLTGTARYASVNTHLGVEQSRRDDLESLGYVLMYFLRGSLPWQGLKAGTKKQKYDKISEKKMVTPIEVLCKSYPSEFISYFHYCRSLRFDDKPDYSYLKRLFRDLFIREGYQFDYVFDWTILKYPQIGSSSRAGRPTGKLALNPGTSAERAERTPVKRESGRDRLSGAVEAFARRNGSSSGIALHADHSTRHRTPDAVPSSKEALASDSDRGRISRTGSTSKRAIMSSSRPSSSGEPSESRLNRLGSGSGRISTTQRVQPGFESKSSSFTRAAVGGTRSGGGRDDALRSFELLTIGSGKRK

SEQ ID NO: 21785 - protein, 464 aa, Nicotiana benthamiana
MDHVVGGKFKLGRKIGSGSFGELYLGVNVQTGEEVAVKLESTKTKHPQLHYESKLYMLLQGGTGIPHLKWFGVEGEYNAMVIDLLGPSLEDLFNYCNRRFTLKTVLMLADQLINRVEYMHSRGFLHRDIKPDNFLMGLGRKANQVYIIDYGLAKKYRDLQTHKHIPYRENKNLTGTARYASVNTHLGVEQSRRDDLESLGYVLMYFLRGSLPWQGLKAGTKKQKYDKISEKKMLTPIEVLCKSYPSEFISYFHYCRSLRFDDKPDYSYLKRLFRDLFIREGYQFDYVFDWTILKYPQIGSSSRGRQTTGRLPVNPGPSAERAEKIPVRQEIKDRFSGAVEAFTRRNVSGTGLQGDHLRHHRSSDDVPSSKDVQADTERGRVTRTGSTSRRAVMGSSRPSSSGEPTDNRTGRLGSSSGRISTTQRVQPGFESKSSSFTRATATRGGRDDALRSFELLTIGTGRRK

SEQ ID NO: 21786 - protein, 462 aa, Tabernaemontana elegans
MDHVIGGKFKLGRKIGSGSFGELYLGVNVQTGEEVAVKLEPLKTKHPQLHYESKLYMLLQGGTGVPHLKWFGVEGEYSAMVIDLLGPSLEDLFNYCNRKFTLKTVLMLADQLINRVEYMHSRGFLHRDIKPDNFLMGLGRKANQVYIIDYGLAKKYRDLQTHKHIPYRENKNLTGTARYASVNTHLGVEQSRRDDLESLGYVLMYFLRGSLPWQGLKAGTKKQKYDKISEKKMLTPIEVLCKSYPSEFISYFHYCRSLRFDDKPDYSYLKRLFRDLFIREGYQFDYVFDWTILKYPQIASSSRGRQPMGRLPLNGGPSVERVEKNAVRQETRDRFSGAVDSFNRRSSSGAGLHGDPTRHRSSEDVPSSKDVQADSERRLTRTGSSSKRAVMSSSRPSSSGEPSENRTSRLGSGTGRLSTTQRIQPGFESKSSSFTRVAAPRGNRDETLRSFELLTIGSGKRK

SEQ ID NO: 21787 - protein, 464 aa, Solanum phureja
MDHVVGGKFKLGRKIGSGSFGELYLGVNVQTGEEVAVKLESTKTKHPQLHYESKLYMLLQGGTGIPHLKWFGVEGEYNAMAIDLLGPSLEDLFNYCNRRFTLKTALMLADQLINRVEYMHSRGFLHRDIKPDNFLMGLGRKANQVYIIDYGLAKKYRDLQTHKHIPYRENKNLTGTARYASVNTHLGVEQSRRDDLESLGYVLMYFLRGSLPWQGLKAGTKKQKYDKISEKKMLTPIEVLCKSYPSEFISYFHYCRSLRFDDKPDYSYLKRLFRDLFIREGYQFDYVFDWTILKYPQIGSSSRARQPIARLPVNPGPSIERPEKIPVRQEIKDRFSGAVEAFSRRNMPGTGLQGDHLRHHRSSDDVPSSKDMQADAERGRVSRTGSTSRRAVMGSSRPSSSGEPTDNRSGRLGSSSGRISTTQRVQPGFESKSSSFTRATATRGGRDDALRSFELLTIGTGRRK

SEQ ID NO: 21788 - protein, 456 aa, Panax ginseng
MDHVMGGKFKLGRKIGSGSFGELYLGINVQSGEEVAIKLESVKTKHPQLHYESKIYMLLQGGTGIPNLKWFGVEGEYNVMVIDLLGPSLEDLFNYCNRKFSLKTVLMLADQLINRVEYMHSRGFLHRDIKPDNFLMGLGRKANQVYVIDFGLAKKYRDLQTHKHIPYRENKNLTGTARYASVNTHLGVEQSRRDDLESLGYVLMYFLRGSLPWQGLKAGNKKQKYDKISEKKMLTPIEVLCKSYPSEFISYFHYCRSLRFEDKPDYSYLKRLFRDLFIREGYQFDYVFDWTILKYPQIGASSRGRNPSGNAGPSAERPGRTSVGQDIRERFSGAVEAFSRRNTSGPGRHGEHSRHRSSDEVPSSKDVQADSEKGRTSRNGSSSKRAAITNSSKPSSSGEFTEGRSSRLVSSSGRLSTTQRIQPGTESKPPTNSRNAVTKGTRDNPLRSFDFLSIRK

SEQ ID NO: 21789 - protein, 464 aa, Nicotiana benthamiana
MDHVVGGKFKLGRKIGSGSFGELYLGVNVQTGEEVAVKLESTKTKHPQLHYESKLYMLLQGGTGIPHLKWFGVEGEYNAMVIDLLGPSLEDLFNYCNRRFTLKTVLMLADQLINRVEYMHSRGFLHRDIKPDNFLMGLGRKANQVYIIDYGLAKKFRDLQTHKHIPYRENKNLTGTARYASVNTHLGVEQSRRDDLESLGYVLMYFLRGSLPWQGLKAGTKKQKYDKISEKKMLTPIEVLCKSYPSEFISYFHYCRSLRFDDKPDYSYLKRLFRDLFIREGYQFDYVFDWTILKYPQIGSSSRGRQPTGRLPVNPGPSAERAEKIPVRQEIKDRFSGAVEAFTRRNVSGTGLQGDHLRHHRSSDDVPASKDVQADAERGRVTRTVSTSRRAVMGSSRPSSSGEPTDNRTGRLGSSSGRISTTQRVQPGFESKSSSFTRATATRGGRDDALRSFELLTIGTGRRK

SEQ ID NO: 21790 - protein, 460 aa, Carica papaya
MDHVIGGKFKLGRKIGSGSFGELYLGVNVQTGEEVAVKLESVKTKHPQLHYESKLYMLLQGGTGIPHLKWFGVEGDYNVMVIDLLGPSLEDLFNYCNRKFSLKTVLMLADQLINRVEYMHSRGFLHRDIKPDNFLMGLGRKANQVYIIDYGLAKKYRDLQTHKHIPYRENKNLTGTARYASVNTHLGVEQSRRDDLESLGYVLMYFLRGSLPWQGLKAGTKKQKYDKISEKKVSTPLEVLCKSYPTEFMSYFHYCRSLRFEDKPDYSYLKRLFRDLFIREGYQFDYVFDWTVLKYPQIGSSSRARHHTGKQGLTGPAAEKQERFSVGKEIRDRFSGAVEAFSRRNVSGTSPRDYSKHRSSEDGPSSKHVHDSEKGRSSSRYGSASRKAIVSSSRPSSSGEPGDSRASSRLVSSSGGGRPSTTQRSSQPGYESKTSFSRAAASRGPREDALRSFELLSIRK

SEQ ID NO: 21791 - protein, 463 aa, Capsicum annuum
MDHVVGGKFKLGRKIGSGSFGELYLGVNVQTGEEVAVKLEPTKTKHPQLHYESKLYMLLQGGTGIPHLKWFGVEGEYNAMVIDLLGPSLEDLFNYCNRRFTLKTALMLADQLINRVEYMHSRGFLHRDIKPDNFLMGLGRKANQVYIIDYGLAKKYIDLQTHKHIPYRENKNLTGTARYASVNTHLGVEQSRRDDLESLGYVLMYFLRGSLPWQGLKAGTKKQKYDKISEKKMLTPIEVLCKSYPSEFVSYFHYCRSLRFDDKPDYSYLKRLFRDLFIREGYQFDYVFDWTILKYPQIGSSSRARQPVARLPANPGPSIERAEKIPVRQEIKDRFSGAVEAFSRRNVSGTGLGDNFRHHRSSEDVPSSKDVQADAERGRVSRTGSTSRRAVMGSSRPSSSGEPTDNRTGRLGSGSGRISTTQRVQPGFESKSSSFTRATATRGGRDDALRSFELLTIGTGRRK

SEQ ID NO: 21792 - protein, 455 aa, Panax ginseng
MDHVVGGKFKLGRKIGSGSFGELYLGINIQSGEEVAIKLETVKTKHPQLHYESKIYMLLQGGTGIPNFKWFGVEGEYNIMVIDLLGPSLEDLFNYCNRKLSLKTVLMLADQLINRVEYMHSRGFLHRDIKPDNFLMGLGRKANQVYVIDFGLAKKYRDLQTHKHIPYRENKNLTGTARYASVNTHLGVEQCRRDDLESLGYVLMYFLRGSLPWQGLKAGNKKQKYDKISEKKMLTPIEVLCKSYPSEFISYFHYCRSLRFEDKPDYSYLKRLFRDLFIREGYQFDYVFDWTILKYPQIGASSRGRNPSGNAGPSAERPGRTSGQDIRERFSGAVEAFSRRNTSGPGRHGEHSRHRSSDEVPSSKDVQADSEKGRTSRNGSSSKRAAITNSSKPSSSGEFTEGRSSRLVSSSGRLSTTQRIQPGTESKPPTNSRNAVTKGTRDNPLRSFDFLSIRK

SEQ ID NO: 21793 - protein, 461 aa, Silene vulgaris
MDHVIGGKFKLGRKIGSGSFGELYLGINVQTGEEVAVKLESAKTKHPQLHYESKLYMLLQGGTGIPHIKWYGVEGEYNVMVIDLLGPSLEDLFNYCSRKFSLKTVLMLADQMINKVEYMHSRGFLHRDIKPDNFLMGLGRKANQVYVIDFGLAKKFRDLQTHKHIPYRENKNLTGTARYASVNTHLGVEQSRRDDLESLGYVLMYFLRGSLPWQGLKAGTKKQKYDKISEKKMLTPIEVLCKNYPSEFTSYFHYCRSLRFDDKPDYSYLKRLFRDLFIREGYQFDYVFDWTILKYPQIGSSSRTRPALKPALTPGPSAERAERTSVGQEIRDRVSGAVEAFARRNSQVSGLQVDQSRHRSLGDPSSKDMQGELERGRSSRNGSTSKRAVGSTSRPSSSNGPSDGRSSRLLASSGHVSTTQRIQPGLESKTSSRTRVSATRPGRDDTLRSFDFLSIGTGRRK

SEQ ID NO: 21794 - protein, 455 aa, Nicotiana benthamiana
MDHVAGGKFKLGRKIGSGSFGELYLGVNIQNGEEVAIKLESVKTKHPQLHYESKIYMLLSGGTGIPNLKWFGVEGEYNVMVIDLLGPSLEDLFNYCNRKLSLKTVLMLADQLINRVEYMHSRGFLHRDIKPDNFLMGLGRKANQVYAIDFGLAKKYRDLQTHKHIPYRENKNLTGTARYASVNTHLGVEQSRRDDLESLGYVLMYFLRGSLPWQGLKAGTKKQKYDKISEKKMLTPIEVLCKSYPSEFISYFHYCRSLRFEDKPDYSYLKRLFRDLFIREGYQFDYVFDWTILKYPQIGASSRGRNISGSVTLNAGPSAERPGRASVGQDIRDRFSGAVGAFTRRNASGSGRHDEYSRYKTSDDIPSSKDVQFDSERGRTSRNGSSSRRAAISSSRPSSSGEPTDSRSSRLVSSSGRLSSTQRVHSGVEPKPSFSLAKGSRDDPLRSFELLSIRK

SEQ ID NO: 21795 - protein, 460 aa, Solanum phureja
MDHVVGGKFKLGRKIGSGSFGELYLGVNLQNGEEVAIKLESVKTKHPQLHYESKIYMLLSGGTGIPNLKWFGVEGEYNVMVIDLLGPSLEDLFNYCNRKLSLKTVLMLADQLINRVEYMHSRGFLHRDIKPDNFLMGLGRKANQVYAIDFGLAKKYRDLQTHKHIPYRENKNLTGTARYASVNTHLGVEQSRRDDLESLGYVLMYFLRGSLPWQGLKAGTKKQKYDKISEKKMLTPIEVLCKSYPSEFISYFHYCRSLRFEDKPDYSYLKRLFRDLFIREGYQFDYVFDWTILKYPQIGASSRGRNISGSAPLNAVPSAERPGRTSVGQDIRDRFSGAVGAFSRRNASSSGRHGDHSRNKTSDDIPSSKDVQADSERGRTSRNCSSSRRAAISSSRPSSSGEPTESRSSSRLVSSSGRLSATQRIHSGAEPKPSLFSRTSVTKGSRDDPLRSFELLSIRK

SEQ ID NO: 21796 - protein, 460 aa, Solanum lycopersicum
MDHVVGGKFKLGRKIGSGSFGELYLGVNLQNGEEVAIKLESVKTKHPQLHYESKIYMLLSGGTGIPNLKWFGVEGEYNVMVIDLLGPSLEDLFNYCNRKLSLKTVLMLADQLINRVEYMHSRGFLHRDIKPDNFLMGLGRKANQVYAIDFGLAKKYRDLQTHKHIPYRENKNLTGTARYASVNTHLGVEQSRRDDLESLGYVLMYFLRGSLPWQGLKAGTKKQKYDKISEKKMLTPIEVLCKSYPSEFISYFHYCRSLRFEDKPDYSYLKRLFRDLFIREGYQFDYVFDWTILKYPQIGASSRGRNIGGSAPLNAVPSAERPGRTSVGQDIRDRFSGAVGAFSRRNASSSGRHGEHSRHKTSDDIPSSKDVQADSDRGRTSRNCSSSRRAAISSSRPSSSGEPTESRSSSRLVSSSGRLSATQRIHSGAEPKPSLFSRTSVTKGSRDDPLRSFELLSIRK

SEQ ID NO: 21797 - protein, 465 aa, Triphysaria pusilla
MDLVIGGKFKLGRKIGSGSFGELYLGVNIQTGEEVAVKLESVKTKHPQLHYESKLYMLLQGGTGVPHLKWFGVEGEYNAMAIDLLGPSLEDLFNYCNRKFTLKTVLMLADQLINRVEYMHSRGFLHRDIKPDNFLMGLGRKANQVYIIDYGLAKKYRDLQTHKHIPYRENKNLTGTARYASVNTHLGVEQSRRDDLESLGYVLMYFLRGSLPWQGLRAGTKKQKYDKISEKKMLTPVEVLCKSYSSEFISYFHYCRSLRFDDKPDYSYLKRLFRDLFIREGYQFDYVFDWTILKYPQIGSSSRTRPMGKIPLNMGSSAQRAEKTPVRQEGRDRLTGSMDVIAKRNGSSSGLRGDPSRHRSSDIDIPSSKDVQIDSDRGRISRTGSASKRPVLSSSRPASSGEHSENRHSRLGSGSGRVSTTHRVQPGFESKSSSFTRAAAGSRGVRDEALRSFELLTIGSGKRKQ

SEQ ID NO: 21798 - protein, 459 aa, Amaranthus tuberculatus
MDRVIGGKFKLGRKIGSGSFGELYLGINVQNGEEVAVKLESTKTKHPQLHYESKLYMLLQGGTGISHLKWFGVEGEYNVMVIDLLGPSLEDLFNYCSRKFSLKTVLMLADQMINRVEYMHSRGFLHRDIKPDNFLMGLGRKANQVYVIDFGLAKKYRDLQTHKHIPYRENKNLTGTARYASVNTHLGVEQSRRDDLESLGYVLMYFLRGSLPWQGLKAGTKKQKYDKISEKKMVTPIEVLCKNHPSEFTSYFHYCRSLRFDDKPDYSYLKRLFRDLFIREGYQFDYVFDWTILKYPQIGSSSKPRPTVKPMLNPGPSAERTERISVGQEIRDRFSGAVEAFTRRNNPGSGSQGDPRHRSDDPSSKDMHADRERGRTSRNGSTSKRAIASSSRPGSSCEPSDSRTSRLHSTSGRMSTTQRIQPSFESKTSTLARGSAVRPGRDDALRSFEFLSIGTGRRK

SEQ ID NO: 21799 - protein, 458 aa, Vitis vinifera
MEHVIGGKFKMGRKIGSGSFGELYIGVNVQSGEEVAIKVEPTKTKHPQLQYESKLYMLLQGGTGIPHLKWFGVEGEYNVMVIDLLGPSLEDLFNYCNRKFTLKTVLMLADQLINRVEYMHSRGFLHRDIKPDNFLMGLGRRANQVYAIDFGLAKKYRDLQTHKHIPYRENKNLTGTARYASVNTHLGVEQSRRDDLESLGYVLMYFLRGSLPWQGLKAGTKKQKYDKISEKKMLTPIEVLCKSYPSEFTSYFHYCRSLRFEDKPDYSYLKRLFRDLFIREGYQFDYVFDWTILKYPQIGASSRGRHSTGKAGLNAGPSAERLDRTSGQEIRDRFSGAVETFPRRNAFGSGLHSDHSKNRTSDGVPSSKDVQADSERGRTSRNGSTSKRALISSSRPSSSGEPSEGRSSRLVSSSSRMSSSHRIQPGFESKSSSFTRTAATKGTRDDPLRSFELLSIRK

SEQ ID NO: 21800 - protein, 463 aa, Cichorium intybus
MDHVIGGKFKLGRKIGSGSFGELYLGVNVQTGEEVAVKLESTKTKHPQLHYESKLYMLLQGGTGVPHLKWFGVEGEYNAMAIDLLGPSLEDLFNYCNRKLTLKTVLMLADQLINRVEYMHTRGFLHRDIKPDNFLMGLGRKANQVYIIDYGLAKKYRDLQTHRHIPYRENKNLTGTARYASVNTHLGVEQSRRDDLESLGYVLMYFLRGSLPWQGLKAGTKKQKYDKISEKKMLTPIEVLCKSYPSEFIQYFHYCRSLRFEDKPDYSYLKRLFRELFIREGYQFDYIFDWTMLKYPHVGSSSRGRTTAKLPLNPGLSAERAERTPVKQEVRDRFSGAVESFTRRNGSSSGLHGDSSRHRSSENVTPSKDVHGESDRGRISRNGSTSKRAVMGSSSRPSSSGEPKRLGSGSGRISTTATSQRLHSQPGFESKSSSFTRPVVSRGGRDDALRSFELLTIGSGKRK

SEQ ID NO: 21801 - protein, 474 aa, Vaccinium corymbosum
MDHVIGGKFKLGRKIGSGSFGELYLGVNVQTGEEVAVKLESVKTKHPQLHYESKLYMLLQGGTGIPHLKWFGVEGEYSAMVIDLLGPSLEDLFNYCNRKFTLKTVLMLADQLINRVEYMHSRGFLHRDIKPDNFLMGLGRKANQVYAIDFGLAKKYRDLQTHKHIPYRENKNLTGTARYASVNTHLGVEQSRRDDLESLGYVLMYFLRGSLPWQGLKAGTKKQKYDKISEKKMLTPIEVLCKSYPSEFISYFHYCRSLRFDDKPDYSYLKRLFRDLFIREGYQFDYVFDWTILKYPQVGSSSRARQPVGKLALNPGPSAEKAERPPVRQEGRDRFSGAVEAFSRRNATGSGLHGEHSRHRDHSRNRSSDDVPSSKDVQVDSERGRTSRNGSTSKRVVASSSRPSSSGEIRLGTGSGRLSTTQRVQPGFESKSSSFTRAAGTKAGRDDPLRSFELLTIGTGKRNEITGKASIPYF

SEQ ID NO: 21802 - protein, 470 aa, Tropaeolum majus
MNHVVGGRFKLGRKIGSGSFGELFLGVNIQNGEEVAVKLESAKTRHPQLHYESKLYMLLQGGTGIPHIKWFGVEGEYNVMVIDLLGPSLEDLFNYCNRKLSLKTVLMLADQLLNRVEYMHTRGFLHRDIKPDNFLMGLGRKANQVYIIDYGLAKKYRDLQTHRHIPYRENKNLTGTARYASVNTHLGIEQSRRDDLESLGYVLMYFLRGSLPWQGIRAGTKKQKYDKISEKKMHTPVEVLCKSFPSEFTSYFHYCRSLRFEDKPDYSYLKKLFRDLFIREGYQFDYVFDWTILKYPQIGSSSRSRPNPNPKVAALNQPPGKSADRTSVGQDVRDRFTGAIEGFTRRNGSVPGVLNGDRSRQRSSDDVPSSKDMHPDSERPGSSSRNTSSSKRAVVSSGSRPSSSFEPSENRSSRLVSSSSRLSTTQRVMNQPGFESKSSSFIRAPITRTGRDDTLRSLELLTIGGGRRHT

SEQ ID NO: 21803 - protein, 456 aa, Nicotiana benthamiana
MDHVVGGKFKLGRKIGSGSFGELYLGVNIQNGEEVAIKLESVKTKHPQLHYESKIYMLLQGGTGIPNLKWFGVEGEYNVMVIDLLGPSLEDLFNYCNRKFSLKTVLMLADQLINRVEYMHSRGFLHRDIKPDNFLMGLGRKANQVYAIDFGLAKKYRDLQTHKHIPYRENKNLTGTARYASVNTHLGVEQSRRDDLESLGYVLMYFLRGSLPWQGLKAGTKKQKYDKISEKKVLTPIEVLCKSYPSEFISYFHYCRSLRFEDKADYSYLKRLFRDLFIREGYQFDYVFDWTILKYPQIGASSRGRAPGGSAGLNAGPSAERPGRTVGQDIRERFSGAVEAFSRRNASGTGRHGEHSRHKTSEDMTSSKDVQPDSERGRTSRNGSSSKRAAISSSRPSSSGDPTITDSRSSRLVSSNGRVSTTQRIHPGIEPKPSPFSRKGTHDDPLRSFEFLSIRK

SEQ ID NO: 21804 - protein, 457 aa, Solanum phureja
MDHVVGGKFKLGRKIGSGSFGELYLGVNIQNGEEVAIKLESVKTKHPQLHYESKIYMLLQGGTGIPNLKWFGVEGEYNVMVIDLLGPSLEDLFNYCNRKFTLKTVLMLADQLINRVEYMHSRGFLHRDIKPDNFLMGLGRKANQVYAIDFGLAKKYRDLQTHKHIPYRENKNLTGTARYASVNTHLGVEQSRRDDLESLGYVLMYFLRGSLPWQGLKAGTKKQKYDKISEKKMLTPIEVLCKSYPSEFISYFHYCRSLRFEDKPDYSYLKRLFRDLFIREGYQFDYVFDWTILKYPQIGASSRGRLPGGSAGLNAGPSAERPGRTSVGQDIRDRFSGAVEAFSRRNASGTGKHGEYSRHKTSEDMTSSKDVQADSERGRTSRNGSSSKRAAISSSRPSSSGDPTITDSRSSRLVSSNGRVSTTQRIHLGMEPKPSPFSRKGTRDDPLRSFEFLSIRK

SEQ ID NO: 21805 - protein, 461 aa, Arnica chamissonis
MDHVIGGKFKLGRKIGSGSFGELYLGVNLQSKEEVAVKLESVKTKHPQLHYEAKLYMLLQGGTGVPHLKWIGVEGEYNAMVIDLLGPSLEDLFNYCNRKFTLKTVLMLADQLINRVEYMHSRGFLHRDIKPDNFLMGLGRKANQVYIIDYGLAKKYRDLQTHKHIPYRENKNLTGTARYASVNTHLGVEQSRRDDLESLGYVLMYFLRGSLPWQGLKAGTKKQKYDKISEKKMLTPVEVLCKSYPTEFTSYFHYCRSLRFDDKPDYSYLKRLFRDLFIREGYQFDYVFDWTILKYPQIGSGSSSRGRTVGKLPLNPGPSAERVEKTPVKPEARDRFSGTIEAFARRSGLHGDHSRHRSSEHATPSKEMRVDSDKSRITRTGSTSKRAVISSSRPSSSGEPNESRSNRLGSGSGRISTTHRLHSQPGFESKSSSFSRAVPSSRGGRDDALRSFELLTIGKRK

SEQ ID NO: 21806 - protein, 459 aa, Nicotiana benthamiana
MDHVVGGKFKLGRKIGSGSFGELYLGVNIQNGEEVAVKLESVKTKHPQLHYESKIYMLLQGGTGIPNLKWFGVEGEYNIMVIDLLGPSLEDLFNYCNRKFTLKTVLMLADQLINRVEYMHSRGFLHRDIKPDNFLMGLGRKANQVYAIDFGLAKKYRDLQTHKHIPYRENKNLTGTARYASVNTHRDTPQSRRDDLESLGYVLMYFLRGSLPWQGLKAGTKKQKYDKISEKKMLTPIEVLCKSYPSEFISYFHYCRSLRFEDKPDYSYLKRLFRDLFIREGYQFDYVFDWTILKYPQIGASSRGRIPSGNTGLNAGPSAERPGRTSVGQDIRDRFSGAVEAFSRRNTSAAGRHGEHSRHRTSEDVPSSKDVQADSERGRTSRNGSSSRKAAISSSRPTSSGGPTDSRSSRLVSSTGRLSTTQRIQHGIEPKPSSFSRTSVTKGTHDNPLRSFEFLSIRK

SEQ ID NO: 21807 - protein, 460 aa, Citrus clementina
MDHVIGGKFKLGRKIGSGSFGELYLGVNVQTGEEIAVKLELVKTKHPQLHYESKLYMLLQGGTGIPHLKWFGVEGDYNIMVIDLLGPSLEDLFNYCNRKFSLKTVLMLADQLINRVEYMHSRGFLHRDIKPDNFLMGLGRKANQVYIIDYGLAKKYRDLQTHKHIPYRENKNLTGTARYASVNTHLGVEQSRRDDLESLGYVLMYFLRGSLPWQGLKAGTKKQKYDKISEKKVSTPIEVLCKSYPSEFVSYFHYCRSLRFEDKPDYSYLKRLFRDLFIREGFQFDYVFDWTVLKYPQIGSSSKGRHSSGKVGLTPGPSAERPERGSVGKEIRDKLSGAVEAFSRKNAAGTPHRDHPRHKSSDDGPSSKHVNPDSEKGRSSSRYGSTSRKAVIASTKPGSSGEFSECRSSRLVSSSGRLSTTQRLQSGYDSRQSSFNRTAGGRICTRDDPIRSFEMLSIRK

SEQ ID NO: 21808 - protein, 465 aa, Eschscholzia californica
MESVIGGKFKLGRKIGSGSFGELFLGVNIQSGEEVAIKLESVKTKHPQLHYESKLYMLLQGGTGIPHLKWFGVETEYSCMVIDLLGPSLEDLFNYCNRKFTLKTVLMLADQLINRVEYMHSRGFLHRDIKPDNFLMGLGRRANQVYIIDYGLAKKYRDLQTHKHIPYRENKNLTGTARYASVNTHLGVEQSRRDDLESLGYVLMYFLRGSLPWQGLKAGNKKQKYDKISEKKMLTPIEVLCKSYPSEFISYFHYCRSLRFEDKPDYSYLKRLFRDLFIREGYQFDYVFDWTVLKYPQIGGNSRRLPSGKVGTTPGPSAERTERTSGLVGQEIRDRFSGAVEAFTRRNSSGSGLHGDHSKLKNGEDSPTPKDLVPDSEKLRTSSRNGSTSRRAVASSSRPTSSGEPSESRSSRLLSGSHRVSSTQRIQPGLESRSTSLTRSTGARGTRDDPLRSFELLSIGREKRK

SEQ ID NO: 21809 - protein, 459 aa, Tabernaemontana elegans
MDHVVGGKFKLGRKIGSGSFGELYLGVNIQNGEEVAIKLEPVKTKHPQLQYESKIYMLLQGGTGIPNLKWFGVESEYNVMVIDLLGPSLEDLFNYCNRKFSLKTVLMLADQLINRVEYMHSRGFLHRDIKPDNFLMGLGRKANQVYVIDFGLAKKYRDLQTHKHIPYRENKNLTGTARYASVNTHLGLEQSRRDDLESLGYVLMYFLRGSLPWQGLKAGTKKQKYDKISEKKMLTPIEVLCKSYPSEFISYFHYCRSLRFEDKPDYSYLKRLFRDLFIREGYQFDYVFDWTILKYPQIGASSRGRNPSGSAGMSAGPSAERAGRTSVGQDIRDRFSGAVEAFSRRNASSSARHGEHTRHRSDDVPSSKDVQADSEKGRTSRNGSSSKRAAISSSRPSSSGEHTDGRSSRLVSSSGGRLSTTQRIQPGIDAKPSSFSRTSVTKGTREDPLRSFEFLSIRK

SEQ ID NO: 21810 - protein, 460 aa, Flaveria ramosissima
MDHVIGGKFKLGRKIGSGSFGELYLGVNLQSKEEVAVKLESVKTKHPQLHYEAKLYMLLQGGTGVPHLKWIGVEGEYNAMVIDLLGPSLEDLFNYCNRKFTLKTVLMLADQLINRVEYMHSRGFLHRDIKPDNFLMGLGRKANQVYIIDYGLAKKYRDLQTHKHIPYRENKNLTGTARYASVNTHLGVEQSRRDDLESLGYVLMYFLRGSLPWQGLKAGTKKQKYDKISEKKMLTPIEVLCKSYPTEFTSYFHYCRSLRFDDKPDYSYLKRLFRDLFIREGYQFDYVFDWTILKYPQIGSGSSSRGRTVGKLPMNPGPSAERVEKTPVRPEARDRFSGTVEALARRSGLHGDHSRHRSSEHATPTKEMHGDSDKARITRTGSTSKRAVVSSSRPSSSGEPNESRSNRLGSGSGRISTTRLHSQPGFESKSSSFTRAMPSSRGGRDDALRSFELLTIGKRK

SEQ ID NO: 21811 - protein, 457 aa, Panax ginseng
MDHVVGGKFKLGRKIGSGSFGELYLGINIQSGEEVAIKLETVKTKHPQLHYESKIYMLLQGGTGIPNFKWFGVEGEYNIMVIDLLGPSLEDLFNYCNRKLSLKTVLMLADQLINRVEYMHSRGFLHRDIKPDNFLMGLGRKANQVYVIDFGLAKKYRDLQTHKHIPYRENKNLTGTARYASVNTHLGVEQCRRDDLESLGYVLMYFLRGSLPWQGLKAGNKKQKYDKISEKKMLTPIEVLCKSYPSEFISYFHYCRSLRFEDKPDYSYLKRLFRDLFIREGYQFDYVFDWTILKYPQIGASSKERNPSGNAGPSAEKPGRISVGQDIREKFSGAVEAFSRRNTSGPGRHGEHSSRHRSLDEVASSKEVQADSEKGRTSRNGSSSKRAAITSSSRPSSSGEFTDGRSSRLVSSIGRLSTTQRIQPGTDSKPPTYSRNVVTKGSRDDPLRSFDFLSIRK

SEQ ID NO: 21812 - protein, 461 aa, Aristolochia fimbriata
MEHVIGGKFKLGRKIGSGSFGELYLGVNVQTGEEVAIKLESVKTKHPQLHYESKLYMLLQGGTGIPHLKWFGVEGEYNVMAIDLLGPSLEDLFNYCNRKFSLKTVLMLADQLINRVEFMHARGFLHRDIKPDNFLMGLGRRANQVYIIDYGLAKKYRDLQTHKHIPYRENKNLTGTARYASVNTHLGVEQSRRDDLESLGYVLMYFLRGSLPWQGLKAGTKKQKYDKISEKKMLTPIEVLCKSYPSEFISYFHYCRSLRFDDKPDYSYLKRLFRDLFIREGYQFDYVFDWTILKYPQIGANARSRQSGKTGVAAGPSAERPSVGQEIRDRFSGAVEAFARRNSSGLHGDHSKLKVEEASSKEVANDSERGRGSSSRNGSTSKRAVLSGSRPSSSGETGDQNIIRTSRGLSSSVGRPSTYQRGQPGYEASRSVTRTAATRGTREENPLRSFELLSIGADKRK

SEQ ID NO: 21813 - protein, 483 aa, Cirsium arvense
MDHVIGGKFKLGRKIGSGSFGELYLGVNVQSGEEVAVKLESVKTKHPQLHYEAKLYMLLQGGTGVPHLKWIGVEGEYNAMVIDLLGPSLEDLFNYCNRKFTLKTVLMLADQLINRVEYMHSRGFLHRDIKPDNFLMGLGRKANQVYIIDYGLAKKYRDLQTHKHIPYRENKNLTGTARYASVNTHLGVEQSRRDDLESLGYVLMYFLRGSLPWQGLKAGTKKQKYDKISEKKMLTPIEVLCKSYPSEFISYFHYCRSLRFDDKPDYSYLKRLFRDLFIREGYQFDYVFDWTILKYPQIGSSSRGRTAAKFPLNPGPSAERAERTTPVRQEVRDRFSGAVEALTRRNGSGSGLHNDHPRHRSSEHVTSSKDVHGDVERGRISRNGSSSKRAVVSSSRPSSSGEPSDGRTKRLGSSGEPSDGRTKRLGGSGSGSGRISTTQRLHSQPGFESKSSSFTRPVASRSGRDDALRSFELLTIGTGGKRK

SEQ ID NO: 21814 - protein, 451 aa, Olea europaea
MDHVVGGKFKLGRKIGSGSFGELYLGVNIQNGEEVAIKLESVKTKHPQLHYESKIYILLQGGTGIPNLKWFGSEGEYSVMVIDLLGPSLEDLFNYCNRKFSLKTVLMLADQLINRVEYMHSRGFLHRDIKPDNFLMGLGRKANQVYAIDFGLAKKYRDLQTHKHIPYRENKNLTGTARYASVNTHLGVEQSRRDDLESLGYVLMYFLRGSLPWQGLKAGTKKQKYDKISEKKMLTPIEVLCKSYPSEFVSYFHYCRSLRFEDKPDYSYLKRLFRDLFIREGYQFDYVFDWTILKYPQIGASSRARNPSGNAGLNAGPSGERMGRTSVGQDIRDRFSGAVEAFSRRHTSGSGHRHRTSEDVPSSKDVQPDSERGRTSRNGSSSKRAAILSRPSSSGEPTDGRSSRLVSSSGRLSTTKRIGIEPKPSSFSRGAVTKGTRNDPLRSFEFLSIRK

SEQ ID NO: 21815 - protein, 460 aa, Citrus sinensis
MDHVIGGKFKLGRKIGSGSFGELYLGVNVQTGEEIAVKLELVKTKHPQLHYESKLYMLLQGGTGIPHLKWFGVEGDYNIMVIDLLGPSLEDLFNYCNRKFSLKTVLMLADQLINRVEYMHSRGFLHRDIKPDNFLMGLGRKANQVYIIDYGLAKKYRDLQTHKHIPYRENKNLTGTARYASVNTHLGVEQSRRDDLESLGYVLMYFLRGSLPWQGLKAGTKKQKYDKISEKKVSTPIEVLCKSYPSEFVSYFHYCRSLRFEDKPDYSYLKRLFRDLFIREGFQFDYVFDWTVLKYPQIGSSSKGRHSSGKVGLTPGPSAERPERGSVGKEIRDKLSGAVEAFSRKNAAGTPHRDHPRHKSSDDGPSSKHVNPDSEKGRSFSRYGSTSRKAVIASTKPGSSGEFSECRSSRLVSSSGRLSTTQRLQSGYDSRQSSFNRTAGGRICTRDDPIRSFEMLSIRK

SEQ ID NO: 21816 - protein, 468 aa, Papaver somniferum
MESVIGGKFKLGRKIGSGSFGELYLGVNIQTGEEVAIKLESVKTKHPQLHYESKLYMLLQGGTGIPHLKWFGVETDYNCMVIDLLGPSLEDLFNYCNRKFTLKTVLMLADQLINRVEYMHSRGFLHRDIKPDNFLMGLGRRANQVYIIDYGLAKKYRDLQTHKHIPYRENKNLTGTARYASVNTHLGVEQSRRDDLESLGYVLMYFLRGSLPWQGLKAGNKKQKYDKISEKKMLTPIEVLCKSYPSEFISYFHYCRSLRFEDKPDYSYLKRLFRDLFIREGYQFDYVFDWTVLKYPQIGANSRTARVPSGRVGTNAGPSAERVERPTVGQEIRERFSGAVEAFARRNSPGPSAHADHSKNKNPEDSSTSREVLDSEKLRTSSRNGSSSRRAIASSSRPTSSGEPSESRTSRILSGSSNRLSTAQRTIQPGLESKSTSLSRTAGSRGNRDDHLRSFELLSIGTERRGSK

SEQ ID NO: 21817 - protein, 459 aa, Solanum phureja
MDHVVGGKFKLGRKIGSGSFGELYLGVNLQNGEEVAIKLESVKTRHPQLHYESKIYMLLQGGTGIPNLKWFGVEGEYNIMVIDLLGPSLEDLFNYCNRLFTLKTVLMLADQLINRVEYMHSRGFLHRDIKPDNFLMGLGRKANQVYAIDFGLAKKYRDLQTHKHIPYRENKNLTGTARYASVNTHLGVEQSRRDDLESLGYVLMYFLRGSLPWQGLKGGTKKQKYDKISEKKMLTPIEVLCKSYPSEFISYFHYCRSLRFEDKPDYSYLKRLFRDLFIREGYQFDYVFDWTILKYPQIGASSRGRNPSGNAGLNAGPSAERPGRASVGQDIRDRFTGAVEAFSRRNTSAAGRHGEHSRQRTSEDIPSSKDVQADSERGRSSRNGSSSKRAVMSSSKPTSSTEPTDSRSSRLVSSTGRLSTTQRIQQGIETKPSSFSRTSLTKGNHDNPLRSFEFLSIRK

SEQ ID NO: 21818 - protein, 460 aa, Flaveria ramosissima
MDHVIGGKFKLGRKIGSGSFGELYLGVNLQSKEEVAVKLESVKTKHPQLHYEAKLYMLLQGGTGVPHLKWIGVEGEYNAMVIDLLGPSLEDLFNYCNRKFTLKTVLMLADQLINRVEYMHSRGFLHRDIKPDNFLMGLGRKANQVYIIDYGLAKKYRDLQTHKHIPYRENKNLTGTARYASVNTHLGVEQSRRDDLESLGYVLMYFLRGSLPWQGLKAGTKKQKYDKISEKKMLTPIEVLCKSYPTEFTSYFHYCRSLRFDDKPDYSYLKRLFRDLFIREGYQFDYVFDWTILKYPQIGSGSSSRGRTVGKLPLNPGLSAERVEKTPVRPEARDRFSGTVEALTRRSGLHGDHSRHRSSEHATPTKEMHGDSDKARITRTGSTSKRAVVSSSRPSSSGEPNESRSNRLGSGSGRISTTRLHSQPGFESKSSSFTRAMPSSRGGRDDALRSFELLTIGKRK

SEQ ID NO: 21819 - protein, 451 aa, Euonymus alatus
MDHVVGSKFKLGRKIGSGSFGELYLGVNVQTGEEVAVKLEPVKTKHPQLHYESKLYMLLQGGTGIPHLKWFGVEGDYNIMVIDLLGPSLEDLFNYCNRKFSLKTVLMLADQLINRVEYMHSRGFLHRDIKPDNFLMGLGRKANQVYVIDYGLAKKYRDLQTHKHIPYRENKNLTGTARYASVNTHLGVEQSRRDDLESLGYVLMYFLRGSLPWQGLKAGTKKQKYDKISEKKVSTPIEVLCRSYPTEFYSYFHYCRSLRFEDKPDYSYLKRLFRDLFIREGYQFDYVFDWTVLKYPQIGGSSRGRNSSGKPGLNAGPSAEKPERISVGKEIRERFSGAVEAFSRRNTASPNPHGDLSKHRISENQPDTEKGRGSRYGSSSRRAVHSSSRPSSSGEPSESRSGRLLSSSGRLSTTQRVPGYESKTSSYTRGTAAKGAREDPLRSFEFLSIRK

SEQ ID NO: 21820 - protein, 467 aa, Helianthus annuus
MDHVIGGKFKLGRKIGSGSFGELYLGVNLQSKEEVAVKLESVKTKHPQLHYEAKLYMLLQGGTGVPHLKWIGVEGEYNAMVIDLLGPSLEDLFNYCNRKFTLKTVLMLADQLINRVEYMHSRGFLHRDIKPDNFLMGLGRKANQVYIIDYGLAKKYRDLQTHKHIPYRENKNLTGTARYASVNTHLGVEQSRRDDLESLGYVLMYFLRGSLPWQGLKAGTKKQKYDKISEKKMLTPIEVLCKSYPTEFISYFHYCRSLRFDDKPDYSYLKRLFRDLFIREGYQFDYVFDWTILKYPQIGSGSSSRGRTVGKLPLTPGPSAERAEKTPVRPEARDRSSGTGEALARRTGLHGDHSRHRSSEHATPSKEMASKDHLHGDSDKARITRTGSTSKRALMSSSRPSSSGEPNESRSNRLGSGSGRLSTTQRLHSQPGFESKSSSFTRAVPSSRGGRDDALRSFELLTIGKRK

SEQ ID NO: 21821 - protein, 467 aa, Vinca minor
MDHVIGGKFKLGRKIGSGSFGELYLGVNVQTGEEVAVKLEPLKTKHPQLHYESKLYMLLQGGTGVPHLKWFGVEGEYSAMVIDLLGPSLEDLFNYCNRKFSLKTVLMLADQLINRVEYMHSRGFLHRDIKPDNFLMGLGRKANQVYIIDYGLAKKYRDLQTHKHIPYRENKNLTGTARYASVNTHLGVEQSRRDDLESLGYVLMYFLRGSLPWQGLKAGNKKQKYDKISEKKMLTPIEALCKSYPSEFISYFHYCRSLRFDDKPDYSYLKRLFRDLFIREGYQFDYVFDWTILKYPQIASNSRGRQPMGRLPLNGGPSLERVEKNPVRQETRDRFSGTVETFTRRSSGAGLHGDPLRHRSSDDVPSSKEVQEDSERRLNRTGSSSKRAVMSSSRPSSSGEPSENRTSRLGSGIGRLSTTQKVQPGFESKSSSFTRVAGTRSNRDETLRSFDLLTIGSGKEMKKKVYI

SEQ ID NO: 21822 - protein, 466 aa, Daucus carota
MEQVVVGGKFKLGRKIGSGSFGELYLGVNVQSGEEVAVKLEPAKTKHPQLHYESKLYMYLHGGAGVPNLKWYGVEGEYNAMVIDLLGPSLEDLFNYCNRKLMLKTVLMLADQLITRVEYMHSRGFLHRDIKPDNFLMGLGRKANQVYVIDYGLAKKFRDLQTHKHIPYRENKNLTGTARYASVNTHLGVEQSRRDDLESLGYVLMYFLRGSLPWQGLKAGTKKQKYDRISEKKMSTPVEVLCKSYPSEFISYFHYCRSLRFDDKPDYSYMKRLFRDLFIREGYQFDYVFDWTILKYPQIGSSSKSRQPSGKLPLNPGPTIDRAEKTPVKREMRDRLSGAVEAFARRKGSSSGANLRGDHLRHRSSDNVPSSKDMQAEPVRGRVSRAASASKRAVASSSRPSSSGEPSENRLNRLGSGSGRLSTTQRIQPGFEPKPSSFTRALPSRGGRDDALRSFELLTIGSGKRK

SEQ ID NO: 21823 - protein, 456 aa, Capsicum annuum
MDHVVGGKFKLGRKIGSGSFGELYLGVNVQNGEEVAIKLESVKTKHPQLHYESKIYMLLQGGTGIPNLKWFGVEGEYNVMVIDLLGPSLEDLFNYCNRKFTLKTVLMLADQLINRVEYMHSRGFLHRDIKPDNFLMGLGRKANQVYAIDFGLAKKYRDLQTHKHIPYRENKNLTGTARYASVNTHLGVEQSRRDDLESLGYVLMYFLRGSLPWQGLKAGTKKQKYDKISEKKMLTPIEALCKSYPSEFVSYFHYCRSLRFEDKPDYSYLKRLFRDLFIREGYQFDYVFDWTILKYPQIGASSRGRIPSGNAGLNAGPSAEKTGRASVGQDIRDRFSGAVEAFSRRNASGAGRHGEHSRQKSSEDMTSSKDVQDSERGRTSRNGSSSKRAAISGSRPTSSGDPTITDSRSSRLVSSNGRVSTTQRIHSGIEPKPSPFSRKGTRDDPLRSFEFLSIRK

SEQ ID NO: 21824 - protein, 461 aa, Silene vulgaris
MDRVIGGKFKLGRKIGSGSFGELFLGINVQTGEEVAVKLESAKTKHPQLHYESKLYLLLQGGTGIPHLKWYGVDGEHNVMVIDLLGPSLEDLFNYCSRKFSLKTVLMLADQMINRVEYMHSRGFLHRDIKPDNFLMGLGRKANQVYAIDFGLAKKFRDLQTHKHIPYRENKNLTGTARYASVNTHLGVEQSRRDDLESLGYVLMYFLRGSLPWQGLKAGTKKQKYDKISEKKMLTPIEVLCKNYPSEFTSYFHYCRSLRFDDNPDYSYLKRLFRDLFIREGYQFDYVFDWTILKYPQIGSSSRPRPTTKPALNPGPSAERADRTSVGQDIRDKFSGAVEAFARRNAQGSGLQRDHSHHRSMDDPTSKDMQGDLERGRTSRNGSTSKRAVVSISRPSSSGGPSDGRSGQLLSSSGRVSTTQRIQPGVESRTSSRARISSVRPGRDDTLRSFDFLSIGAGRRS

SEQ ID NO: 21825 - protein, 454 aa, Rosmarinus officinalis
MDHVLGGKFKLGRKIGCGSFGELFLGVNIQSGEEVAIKLESVKTKHPQLHYESKIYMLLQGGTGIPNLKWFGVEGEYSIMVIDLLGPSLEDLFNYCNRKFSLKTVLMLADQLINRVEYMHSRGFLHRDIKPDNFLMGLGRKANQVYIIDFGLAKKYRDLQTHKHIPYRENKNLTGTARYASVNTHLGVEQSRRDDLESLGYVLMYFLRGSLPWQGLKAGTKKQKYDKISEKKMLTSIEVLCKSYPSEFISYFHYCRSLRFEDKPDYSYLKRLFRDLFIREGYQFDYVFDWTMLKYPQIGSSSRTRNLTGNAVAGPSGERPGRASVGQDLRDKFSGAVEAFSRRNATSTGRYGEQSRHRTSEDVPSSKDVQPDSDKGRTSRNGSSSKRAVSSSRPSSSGEAIDGRTGRLVPSGGRISTTQRIQPGAEHKPSAFSRTAKGTRDDPLRSFEFLSIRK

SEQ ID NO: 21826 - protein, 459 aa, Nicotiana benthamiana
MDHVVGGKFKLGRKIGSGSFGELYLGVNIQNGEEVAIKLESVKTRHPQLHYESKIYMLLQGGTGIPNLKWFGVEGEYNIMVIDLLGPSLEDLFNYCNRKFTLKTVLMLADQLINRVEYMHSRGFLHRDIKPDNFLMGLGRKANQVYAIDFGLAKKYRDLQTHKHIPYRENKNLTGTARYASVNTHRDTPQSRRDDLESLGYVLMYFLRGSLPWQGLKAGTKKQKYDKISEKKMLTPIEVLCKSYPSEFISYFHYCRSLRFEDKPDYSYLKRLFRDLFIREGYQFDYVFDWTILKYPQIGASSRGRIPSGNAGLNAGPSAERPGRTSVGQDIRDKFSGAVEAFSRRNTSAAGRHGEHSRHRTSEDVPSSKDVQADSERGRTSRNGSSSRRAAISSSRPTSSGEPTDSRSSRLVSSTGRLSTTQRIQQGTEPKPSAFPRTSVTKGTHDNPLRSFEFLSIRK

SEQ ID NO: 21827 - protein, 459 aa, Solanum lycopersicum
MDHVVGGKFKLGRKIGSGSFGELYLGVNLQNGEEVAIKLESVKTRHPQLHYESKIYMLLQGGTGIPNLKWFGVEGEYNIMVIDLLGPSLEDLFNYCNRLFTLKTVLMLADQLINRVEYMHSRGFLHRDIKPDNFLMGLGRKANQVYAIDFGLAKKYRDLQTHKHIPYRENKNLTGTARYASVNTHLGVEQSRRDDLESLGYVLMYFLRGSLPWQGLKGGTKKQKYDKISEKKMLTPVEVLCKSYPSEFISYFHYCRSLRFEDKPDYSYLKRLFRDLFIREGYQFDYVFDWTILKYPQIGASSRGRNPSGNAGLNAGPSAERPGRASVGQDIRDRFTGAVEAFSRRNTSAAGRHGEHSRQRTSEDIPSSKDVQADSERGRSSRNGSSSKRAVMSSSKQASSAEPTDSRSSRLVSSTGRLSTTQRIQQGIETKPSSFSRTSLTKGNHDNPLRSFEFLSIRK

SEQ ID NO: 21828 - protein, 457 aa, Panax ginseng
MDHVVGGKFKLGRKIGSGSFGELYLGINIQSGEEVAIKLETVKTKHPQLHYESKIYMLLQGGTGIPNFKWFGVEGEYNIMVIDLLGPSLEDLFNYCNRKLSLKTVLMLADQLINRVEYMHSRGFLHRDIKPDNFLMGLGRKANQVYVIDFGLAKKYRDLQTHKHIPYRENKNLTGTARYASVNTHLGVEQCRRDDLESLGYVLMYFLRGSLPWQGMKAGNKKQKYDKISEKKMLTPIEVLCKSYPSEFISYFHYCRSLRFEDKPDYSYLKRLFRDLFIREGYQFDYVFDWTILKYPQIGTSSKERNPSGNAGPSAEKPGRISVGQDIREKFSGAVEAFSRRNTSGPGRHGEHSSRHRSLDEVASSKEVQADSEKGRTSRNGSSSKRAAITSSSKPSSSGEFTDGRSSRLVSSIGRLSTTQRIQLGTDSKPPTYSRNVVTKGSRDDPLRSFDFLSIRK

SEQ ID NO: 21829 - protein, 458 aa, Theobroma cacao
MDHVIGGKFKLGRKIGSGSFGELFLGVNVQTGEEVAVKLESVKTKHPQLHYESKLYMLLQGGTGIPHLKWFGVEADYNVMVIDLLGPSLEDLFNYCNRKLSLKTVLMLADQLINRVEYMHSRGFLHRDIKPDNFLMGLGHKANQVYIIDYGLAKKYRDLQTHKHIPYRENKNLTGTARYASVNTHLGVEQSRRDDLESLGYVLMYFLRGSLPWQGLKAGTKKQKYDKISEKKVSTPIEVLCKSYPSEFVSYFHYCRSLRFEDKPDYSYLKRLFRDLFIREGYQFDYVFDWTVLKYPQLGGSSRGRHTSGRAGLAAGPAIERPERISVGREIRDRFSGAVEAFSKRNVSNTSPRRDHSRHKTAEDVTLSKHVHPDSDKRRSSSRYGSTSRRAVAASRPSSSGEPSDIQQNRLVSSGGRMSTTQRIQLAFEAKTSSRAAPVRGSRDDHPLRSFELLSIRK

SEQ ID NO: 21830 - protein, 469 aa, Papaver somniferum
MESVIGGKFKLGRKIGSGSFGELYLGVNIQTGEEVAIKLESVKTKHPQLHYESKLYMLLQGGTGIPHLKWFGVETDYNCMVIDLLGPSLEDLFNYCNRKFTMKTVLMLADQLINRVEYMHSRGFLHRDIKPDNFLMGLGRRANQVYIIDYGLAKKYRDLQTHKHIPYRENKNLTGTARYASVNTHLGVEQSRRDDLESLGYVLMYFLRGSLPWQGLKAGNKKQKYDKISEKKMLTPIEVLCKSYPSEFISYFHYCRSLRFEDKPDYSYLKRLFRDLFIREGYQFDYVFDWTVLKYPQIGANSRTARVPSGRVGTNAGPSAERVERPTVGQEIRERFSGAVEAFARRNSPGPNAHADHKNKNKNPEDSSTSREVLDSEKLRTSSRNGSSSRRAIASSSRPTSSGEPSESRTSRILSGSSNRLSTAQRTIQPGLESKSTSLSRTAGSRGNRDDHLRSFELLSIGTERRGSK

SEQ ID NO: 21831 - protein, 467 aa, Helianthus annuus
MDHVIGGKFKLGRKIGSGSFGELYLGVNLQSKEEVAVKLESVKTKHPQLHYEAKLYMLLQGGTGVPHLKWIGVEGEYNAMVIDLLGPSLEDLFNYCNREFTLKTVLMLADQLINRVEYMHSRGFLHRDIKPDNFLMGLGRKANQVYIIDYGLAKKYRDLQTHKHIPYREHKNLTGTARYASVNTHLGVEQSRRDDLESLGYVLMYFLRGSLPWQGLKAGTKKQKYDKISEKKMLTPIEVLCKSYPTEFISYFHYCRSLRFDDKPDYSYLKRLFRDLFIREGYQFDYVFDWTILKYPQIGSGSSSRGRTVGKLPLTPGPSAERAEKTPVRPEARDRFSGTVEALARRTGLHGDHSRHRSSEHATPSKEMTSKDHLHGDSDKARITRTGSTSKRALMSSSRPSSSGEPNESRSNRLGSGSGRISTTQRLRSQPGFESKSSSFTRAVPSSRGGRDDALRSFELLTIGKRK

SEQ ID NO: 21832 - protein, 457 aa, Solanum lycopersicum
MDHVVSGRFKLGRKIGSGSFGELYLGVNIQNGEEVAIKLESVKTKHPQLHYESKIYMLLQGGTGIPNLKWFGVEVEYNVMVIDLLGPSLEDLFNYCNRKFTLKTVLMLADQLINRVEYMHSRGFLHRDIKPDNFLMGLGRKANQVYAIDFGLAKKYRDLQTHKHIPYRENKNLTGTARYASVNTHLGVEQSRRDDLESLGYVLMYFLRGSLPWQGLKAGTKKQKYDKISEKKMLTPIEVLCKSYPSEFTSYFHYCRSLRFEDKPDYSYLKRLFRDLFIREGYQFDYVFDWTILKYPQIGASSRGRLPGGSAGLNAGPSAERPGRTSVGQDIRDRFSGAVEAFSRRNASGTGKHGEHSRQKTSEDMTSSKDVQADSERGRTLRNGSSSKRAAISSSRPSSSGDPTITDSRSSRLVSSNGRVSTTHRIHSGIEPKPSPFSRKGTRDDPLRSFEFLSIRK

SEQ ID NO: 21833 - protein, 451 aa, Tripterygium wilfordii
MDHVVGSKFKLGRKIGSGSFGELYLGVNVQTGEEVAVKLEPVKTKHPQLHYESKLYMLLQGGTGIPHLKWFGVEGEYSIMVIDLLGPSLEDLFNYCSRKFSLKTVLMLADQLINRVEYMHSRGFLHRDIKPDNFLMGLGRKANQVYIIDYGLAKKYRDLQTHKHIPYRENKNLTGTARYASVNTHLGVEQSRRDDLESLGYVLMYFLRGSLPWQGLKAGTKKQKYDKISEKKVSTPIEVLCKSYPTEFYSYFHYCRSLRFEDKPDYSYLKRLFRDLFIREGYQFDYVFDWTVLKYPQIGGSSRGRHSSGKPGLIAGPSAEKPERISVGKEIRDRFSGAVEAFSRRNTASPTPRGDLSKHRTSENQPDTEKGRGSRYGSSSRRAVHSSSRPSSSGEPSESRSSRLLSSSGRLSTTQRVPGYESKTSSYTRGTTAKGVREDPLRSFELLSLRK

SEQ ID NO: 21834 - protein, 459 aa, Vinca minor
MDHVVGGKFKLGRKIGSGSFGELYLGVNIQNGEEVAIKLEPAKTKHPQLQYESKIYMLLQGGTGIPNLKWFGVESEYNVMVIDLLGPSLEDLFNYCNRKLSLKSVLMLADQLINRVEYMHSRGFLHRDIKPDNFLMGLGRKANQVYVIDFGLAKKYRDLQTHKHIPYRENKNLTGTARYASVNTHLGVEQSRRDDLESLGYVLMYFLRGSLPWQGLKAGNKKQKYDKISEKKMLTPIEVLCKSYPSEFISYFHYCRSLRFEDKPDYSYLKRLFRDLFIREGYQFDYVFDWTILKYPQIGSSSRGRNPSGNAGVNAGPSAERPGRTSVGQDIRERFSGAVEAFSRKNISSSARHGDHIRHRSEDVPSSKDAQADSERGQTSRNGSSSKRAAISSSRPSSSGEHTDGRSGKLVPSSGGRLSTTQRIQSNVDTKPSTFSRKSLTKGSRDDPLRSFEFLSIRK

SEQ ID NO: 21835 - protein, 781 aa, Glycine max
MPAGIMIPARNMPSMIGRNGTVGGFGLSSGLSLGQIENHKASESQRSEEMFQPNLMEAGQLHPLDMPQNTSESDVPRIREDDFDSATKSGSENLEGASGEDQDPRPNKKKRYHRHTQHQIQEMEAFFKECPHPDDKQRKELSRELGLEPLQVKFWFQNKRTQMKTQHERHENTQLRTENEKLRADNMRFREALGNASCPNCGGPTAIGEMSFDEHHLRLENARLREEIDRISAIAAKYVGKPVVSYPLVSPSSIPPRPLELGIGGGFGGQPGGTGGDMYGGAAGDLLRSISGPTEADKPIIIELAVAAMEELIGMAQMGEPLWLTTLDGTTVLNEDEYIRSFPRGIGPKPAGFKFEASRETAVVIMNHVNLVEILMDVNQWSTVFAGIVSRAMTLEVLSTGVAGNYNGALQVMTAEVQVPSPLVPTRESYFVRYCKQHGDGTWAVVDVSLDNLRPSPSARCRRRPSGCLIQEMPNGYSKVIWVEHVEVDDRGVHNLYKQLVSSGHAFGAKRWVATLDRQCERLASAMATNIPTVDVGVITNQDGRKSMLKLAERMVISFCAGVSASTAHTWTTLSGTGADDVRVMTRKSVDDPGRPPGIVLSAATSFWLPVSPKRVFEFLRDENSRSEWDILSNGGVVQEMAHIANGRDTGNCVSLLRVNSANSSQSNMLILQESCADSTGSFVIYAPVDIVAMNVVLNGGDPDYVALLPSGFAILPDGTTAHGGGIGDTGHGGSLLTVAFQILVDSVPTAKLSLGSVATVNNLIACTVERIKAALSGEVA

SEQ ID NO: 21836 - protein, 767 aa, Cajanus cajan
MPAGIMIPARNMPSMIGRNGNVGGFGLSSGLSLGQPNLMEASHQLLPLDMPQNSESDVPRIREDDFDSATKSGSENQEGASGEDQDPRPNKKKRYHRHTQHQIQEMESFFKECPHPDDKQRKELSRELGLEPLQVKFWFQNKRTQMKTQHERHENTQLRTENEKLRADNMRFREALSNASCPNCGGPTAIGEMSFDEHHLRLENARLREEIDRISAIAAKYVGKPVVSYPLLSPNSSVPPRPLELGIGGGFGGQAGGIGGDMYGGAAGDLLRSISGPTEADKPIIIELAVAAMEELIGMAQMGEPLWLTSLDGTATVLNEDEYIRSFPRGIGPKPAGFKCEASRETAVIIMNHVNLVEILMDVNQWSTVFSGIVSRAMTLEVLSTGVAGNYNGALQVMTAELQVPSPLVPTRESYFVRYCKQHGEGTWAVVDVSLDNLRPSPSARSRRRPSGCLIQEMPNGYSKVIWVEHVEVDDRGVHNLYKQLVSSGHAFGAKRWIATLDRQCERLASAMATNIPTVDVGVITNQDGRKSMLKLAERMVISFCAGVSASTAHTWTTLSGTGADDVRVMTRKSVDDPGRPPGIVLSAATSFWLPVSPKRVFEFLRDENSRSEWDILSNGGVVQEMAHIANGRDTGNCVSLLRVNSANSSQSNMLILQESCADSTGSFVIYAPVDIVAMNVVLNGGDPDYVALLPSGFAILPDGTTAHGGGIGDTGHGGSLLTVAFQILVDSVPTAKLSLGSVATVNNLIACTVERIKAALSSEPVA

SEQ ID NO: 21837 - protein, 763 aa, Phaseolus vulgaris
MPAGIMIPARNMPSMIGRNGNVVGFGLSSGLSLGQIENHKASESQRSVEMFQPNLMEAGQLLPLDMPQNTSESDVPRIREDDFDSATKSGSENQEGASGEDQDPRPNKKKRYHRHTQHQIQEMEAFFKECPHPDDKQRKELSRELGLEPLQVKFWFQNKRTQIKTQHERHENTQLRTENDKLRADNMRFREALSNASCPNCGGPTAIGEMSFDEHHLRLENARLREEIDRISGIAAKYVGKPVVSYPLLSPSSVPPRPLELGIGGQNSRFLFSMSEADKPIIIELAVAAMEELIGMAQMGDPLWLTTLDGTTTVLNEDEYIRSFPRGIGPKPAGFKCEASRENAVVIMNHVSLVEILMDVNQWSTVFSGIVSRAMTLEVLSTGVAGNYNGALQVMTAEVQVPSPLVPTRESYFVRYCKHHGDGTWAVVDVSLDNLRPSPSARCRRRPSGCLIQEMPNGYSKVIWVEHVEVDDRGVHNLYKQLVSSGHAFGAKRWIATLDRQCERLACAMATNIPTVDVGVITNQDGRKSMLKLAERMVISFCAGVSASTAHTWTTLSGTGADDVRVMTRKSVDDPGRPPGIVLSAATSFWLPVSPKRVFEFLRDENSRSEWDILSNGGVVQEMAHIANGRETGNCVSLLRVNSANSSQSNMLILQESCADSTGSFVIYAPVDIVAMNVVLNGGDPDYVALLPSGFAILPDGTTAHGGSIGDTGNGGSLLTVAFQILVDSVPTAKLSLGSVATVNNLIACTVERIKAALSGEVA

SEQ ID NO: 21838 - protein, 773 aa, Lotus japonicus
MPAGIMIPAMNMPSMLGRNGDVGGSFGFSSSLSLSQPHLMEAHHQLHHHLDMAPQNTTSESDIAAAVRIRGEDEFDSATKSGSENQEGGASGGDQDPRPNKKKRYHRHTQHQIQEMESFFKECPHPDDKQRKELSRELGLEPLQVKFWFQNKRTQMKTQHERQENTQLRTDNDKLRADNMRLREALSNSSCPNCGGPTAIGEMSFDEHHLRLENARLREEIDRISAIAAKYVGKPVVSYPLLSPPSAPSRPLELGIGGFGGQPGVGGDMYGAGELLRSISGPTEADKPIIIELAVAAMEELIGMAQMGEPLWLTSLDGTTTVLNEDEYIRSFPRGIGPKPDGFKCEASRETSVVIMNHVNLVEILMDVNQWSTVFSGIVSRAMTLEVLSTGVAGNYNGALQVMTAELQVPSPLVPTRESYFVRYCKQHADGTWAVVDVSLDNLRPSPSARCRRRPSGCLIQEMPNGYSKVTWVEHVEVDERGVHNLYKQLVSSGHAFGAKRWISTLDRQCERLASAMATNIPTVDVGVITNQDGRKSMLKLAERMVISFCAGVSASTAHTWTTISGTGAETDDVRVMTRKSVDDPGRPPGIVLSAATSFWLPVPPKRVFEFLRDENSRSEWDILSNGGVVQEMAHIANGRDTGNCVSLLRVNSANSSQSNMLILQESCTDSTGSFVIYAPVDIVAMNVVLNGGDPDYVALLPSGFAVLPDGTTAHGGGIGETGHGGSLLTVAFQILVDSVPTAKLSLGSVATVNNLIACTVERIKAALSGEVA

SEQ ID NO: 21839 - protein, 774 aa, Medicago truncatula
MQAGLMIPASNMHSMIGRNNNNVGVFGLSSSLSLSQKMFQPNLMEAGQHHQLLPFDMTQNNNNTSESDVPRIREDELFDSATKSGNSENQEAANSGEDQEPRAKKKRYHRHTQHQIQEMEAFFKECPHPDDKQRKELSRELGLEPLQVKFWFQNKRTQMKTQQERHENTSLRTENEKLRADNMRFREALSNASCPNCGGPTAIGEMSFDEHHLRIENSRLREEIDRISAIAAKYVGKPVVSYPLLSPSSVPPRPLELGIGGFGGQPGMGGDMYGAGDLLRSISGPTEADKPMIIELAVAAMEELIGMAQMGDPLWLPTLEGGSILNEEEYVRSFPRGIGPKPAGFKCEASRESSVVIMNHVNLVEILMDVNQWSTVFSGIVSRAMTLEVLSTGVAGNYNGALQVMTAELQVPSPLVPTRESYFVRYCKQHADGTWAVVDVSLDNLRPSPSARSRRRPSGCLIQEMPNGYSKVIWVEHVEVDDRGVHNLYKQLVSSGHAFGAKRWIATLDRQCERLASAMATNIPTVDVGVITNQDGRKSMLKLAERMCISFCAGVSASTAHTWTTLSGTGADDVRVMTRKSVDDPGRPAGIVLSAATSFWLPVPPKRVFEFLRDENSRSEWDILSNGGVVQEMAHIANGRDTGNCVSLLRVNSANSSQSNMLILQESCTDTTGSFVIYAPVDIVAMNVVLNGGDPDYVALLPSGFAILPDGTTTNGGGVGETGHGGGSLLTVAFQILVDSVPTAKLSLGSVATVNNLIACTVERIKASLSGEVA

SEQ ID NO: 21840 - protein, 761 aa, Glycine max
MQAGIMMIPARNMPSMIARNNNVVGFFGSSALFTLAQPNLMDALEMGQNTSESEVPRILEDEFDSATKSGSENHEGASGEDQDPRPNKKKRYHRHTQHQIQEMEAFFKECPHPDDKQRKELSRELGLEPLQVKFWFQNKRTQMKTQHERHENTNLRTENEKLRADNMRYREALSNASCPNCGGPTAIGEMSFDEHHLRLENARLREEIDRISAIAAKYVGKPVVNYSNISPSLPPRPLELGVGGAGFGGQPGIGVDMYGAGDLLRSISGPTEADKPIIIELAVAAMEELIGMAQMGEPLWLTTLDGTSTMLNEDEYIRSFPRGIGPKPSGFKCEASRETAVVIMNHVNLVEILMDVNQWSTVFSGIVSRAMTLEVLSTGVAGNYNGALQVMTAELQLPTPLVPTRESYFVRYCKQHADGTWAVVDVSLDNLRPGPSARCRRRPSGCLIQEMPNGYSKVTWVEHVEVDDRGVHNLYKQLVSSGHAFGAKRWVATLDRQCERLASAMATNIPTVDVGVITNQDGRKSMMKLAERMVISFCAGVSASTAHTWTTLSGTGADDVRVMTRKSVDDPGRPPGIVLSAATSFWLPVPPKRVFDFLRDENSRNEWDILSNGGVVQEMAHIANGRDTGNCVSLLRVNSANSSQSNMLILQESCTNSTGSFVIYAPVDIVAMNVVLNGGDPDYVALLPSGFAILPDGTTSHNGSGGIGETGPSGSLLTVAFQILVDSVPTAKLSLGSVATVNNLIACTVERIKASLSGEPA

SEQ ID NO: 21841 - protein, 773 aa, Glycine max
MQAVIMMIPARNMPSMIARNNNNVGGFFGSSSSPFTLAQVAIIIMFQPNLMDALEMGQNTPESEIPRIREDEFDSATKSGSENHEGASGEDQDPRPNKKKRYHRHTQHQIQEMEAFFKECPHPDDKQRKELSRELGLEPLQVKFWFQNKRTQMKTQHERHENTNLRTENEKLRADNMRYREALSNASCPNCGGPTAIGEMSFDEHHLRLENARLREEIDRISAIAAKYVGKPVVNYSNISPSLPPRPLEIGVGGAGFGGQPGIGVDMYGAGDLLRSISGPTEADKPIIIELAVAAMEELIGMAQMGEPLWLTTLDGTSTMLNEDEYIRSFPRGIGPKPSGFKCEASRETAVVIMNHVNLVEILMDVNQWSTVFSGIVSRAMTLEVLSTGVAGNYNGALQVMTAELQLPTPLVPTRESYFVRYCKQHGDGTWAVVDVSLDNLRPSPSARCRRRPSGCLIQEMPNGYSKVTWVEHVEVDDRGVHNLYKQLVSSGHAFGAKRLVATLDRQCERLASAMATNIPTVDVGVITNQEGRKSMMKLAERMVISFCAGVSASTAHTWTTLSGTGADDVRVMTRKSVDDPGRPPGIVLSAATSFWLPVPPKRVFDFLRDENSRNEWDILSNGGVVQEMAHIANGRDTGNCVSLLRVNSANSSQSNMLILQESCTDSTGSFVIYAPVDIVAMNVVLNGGDPDYVALLPSGFAILPDGTTSHGSGGGVIGETSPSSGSLLTVAFQILVDSVPTAKLSLGSVATVNNLIACTVERIKASLSGEPA

SEQ ID NO: 21842 - protein, 764 aa, Manihot esculenta
MPAGVMIPARNMPSMIGTNGSVGGFGSTSGLSLGQPNMMDSQLHHLDMTQNTSESDLVRLRDEEFDSTNTKSGSDNHEGASGDDQDPRPKKKRYHRHTQHQIQEMEAFFKECPHPDDKQRKELSRELGLEPLQVKFWFQNKRTQMKTQHERHENTQLRTENEKLRADNMRYREALSNASCPNCGGPTAIGEMSFDEHHLRLENTRLREEIDRISAIAAKYVGKPVVNYPLLSSPMAPRPLELGVGNFGAQPGIGGDIYGAGDLLRSIGGHSDADKPMIIELAVAAMEELIRMAQMGEPLWMSSLDGTNAVLNEDEYIRIFPRGIGPKPSGFKCEASRETAVVIMNHINLVEYLMDVNQWSTVFSGIVSRAMTLEVLSTGVAGNYNGALQVMTAEFQLPTPLVPTRESYFVRYCKQHAEGTWAVVDVSLDNLRPSPAARCRRRPSGCLIQEMPNGYSKVTWVEHIEVDDRGVHNLYKQLVSSGHAFGAKRWVATLDRQCERLASAMATNIPTGDVGVITNQEGRKSMLKLAERMVISFFAGVSASTAHTWTTLSGTGADDVRVMTRKSVDDPGRPPGIVLSAATSFWLPVPPKRVFDFLRDENSRSEWDILSNGGVVQEMAHIANGRDTGNCVSLLRVNVSDTQSANSSQSNMLILQESCTDPTASFVIYAPVDIVAMNVVLNGGDPDYVALLPSGFAILPDGTTTHGGGIGESGSGGSLLTVAFQILVDSVPTAKLSLGSVATVNNLIACTVERIKAALSCETA

SEQ ID NO: 21843 - protein, 760 aa, Citrus clementina
MPTGVMIPARNMPSTIGRNGNVGGLGSSSGLTLSQPTNMMEGQLHPLDMTQNTSESEMARLREEEFDSTKSGSENHEGASGDDQEQRPNKKKRYHRHTQHQIQEMEAFFKECPHPDDKQRKELSRELGLEPLQVKFWFQNKRTQMKTQHERHENTQLRTENEKLRADNMRYREALSNASCPNCGGPTAIGEMSFDEHHLRLENARLREEIDRISAIAAKYVGKPVVNYPLLSPPVPSRPLELAVGNFGAQPGIGGGEMYGAADLLRSISAPTEADKPMIIELAVAAMEELIRMAQMGEPLWMTSLDGTAAVLNEDEYVRTFPRGIGPKPTGFKCEASRETAVVIMNHISLVEILMDVNQWSTVFSGIVSRAMTLEVLSTGVAGNYNGALQVMTAEFQVPSPLVPTRESYYVRYCKQHGEGTWAVVDVSLDNLRPSPAVRCRRRPSGCLIQEMPNGYSKVTWVEHVEVDDRGVHNLYKQLVSTGNAFGAKRWVATLDRQCERLASVMATNIPTGEVGVITNQDGRKSMLKLAERMVISFCAGVSASTAHTWTTLSGTGADDVRVMTRKSVDDPGRPPGIVLSAATSFWLPVPPKRVFDFLRDENTRSEWDILSNGGVVQEMAHIANGRDTGNCVSLLRVNSANSSQSNMLILQESCTDPTASFVIYAPVDIVAMNVVLNGGDPDYVALLPSGFAILPDGTSLHGANIGEAASGGSLLTVAFQILVDSVPTAKLSLGSVATVNNLIACTVERIKASLSCESA

SEQ ID NO: 21844 - protein, 760 aa, Citrus sinensis
MPTGVMIPARNMPSTIGRNGNVGGLGSSSGLTLSQPTNMMEGQLHPLDMTQNTSESEIARLREEEFDSTKSGSENHEGASGDDQEQRPNKKKRYHRHTQHQIQEMEAFFKECPHPDDKQRKELSRELGLEPLQVKFWFQNKRTQMKTQHERHENTQLRTENEKLRADNMRYREALSNASCPNCGGPTAIGEMSFDEHHLRLENARLREEIDRISAIAAKYVGKPVVNYPLLSPPVPSRPLELAVGNFGAQPGIGGGEMYGAADLLRSISAPTEADKPMIIELAVAAMEELIRMAQMGEPLWMTSLDGTAAVLNEDEYVRTFPRGIGPKPTGFKCEASRETAVVIMNHISLVEILMDVNQWSTVFSGIVSRAMTLEVLSTGVAGNYNGALQVMTAEFQVPSPLVPTRESYYVRYCKQHGEGTWAVVDVSLDNLRPSPAVRCRRRPSGCLIQEMPNGYSKVTWVEHVEVDDRGVHNLYKQLVSTGNAFGAKRWVATLDRQCERLASVMATNIPTGEVGVITNQDGRKSMLKLAERMVISFCAGVSASTAHTWTTLSGTGADDVRVMTRKSVDDPGRPPGIVLSAATSFWLPVPPKRVFDFLRDENTRSEWDILSNGGVVQEMAHIANGRDTGNCVSLLRVNSANSSQSNMLILQESCTDPTASFVIYAPVDIVAMNVVLNGGDPDYVALLPSGFAILPDGTSLHGANIGEAASGGSLLTVAFQILVDSVPTAKLSLGSVATVNNLIACTVERIKASLSCESA

SEQ ID NO: 21845 - protein, 752 aa, Theobroma cacao
MPAGVMIPARNMPSMISGNGNVGGFGTSSGLTLGQPNMMEGQLHPLEMTQNTSESEIARMRDEEFDSTTKSGSENHEGASGDDQDPRPKKKRYHRHTQHQIHEMEAFFKECPHPDDKQRKELGRELGLEPLQVKFWFQNKRTQMKTQHERQENTQLRTENEKLRADNMRFREALSTASCPNCGGPTAVGQMSFDEHHLRLENARLREEIDRISAIAAKYVGKPVVNYPLLSSPMPPRPLDFGAQPGTGEMYGAGDLLRSISAPSEADKPMIIELAVAAMEELIRMAQMGEPLWMTSLDGTTSMLNEEEYIRTFPRGIGPKPTGFKCEASRETAVVIMNHINLVEILMDVHQWSTVFSGIVSKASTLDVLSTGVAGNYNGALQVMTAEFQVPSPLVPTRESYYVRYCKQHAEGTWAVVDVSLDNLRPSPTVRCRRRPSGCLIQEMPNGYSKVTWVEHVEVDDRGVHNLYKQLVSSGHAFGAKRWIATLDRQCERLASVMATNIPTGDVGVITNQDGRKSMLKLAERMVISFCAGVSASTAHTWTTLSGTGADDVRVMTRKSVDDPGRPPGIVLSAATSFWLPVSPKRVFDFLRDENSRSEWDILSNGGVVQEMAHIANGRDTGNCVSLLRVNSANSSQSNMLILQESCADPTASFVIYAPVDIVAMNVVLNGGDPDYVALLPSGFAILPDGTTASAGGIGDAGSAGSLLTVAFQILVDSVPTAKLSLGSVATVNNLIACTVERIKASLSCENA

SEQ ID NO: 21846 - protein, 763 aa, Ricinus communis
MPAGVMNPARNMPSMIGSNGNVGGFGSSSGLTLGQPNMLMEGQLHHLDMTQNTSESDLARIRDEEFDSTNTKSGSDNHEGASGDDQDPRPNKKKRYHRHTQHQIQEMEAFFKECPHPDDKQRKELSRELGLEPLQVKFWFQNKRTQMKTQHERHENTQLRTENEKLRADNMRYREALSNASCPNCGGPTAIGEMSFDEHHLRLENARLREEIDRISAIAAKYVGKPVVNYPLLSAPMPPRPLELGVGNFGAQPGIGGEMYGAGDLLRSISAPSEADKPMIIELAVAAMEELLRMAQMGEPLWMSSHDGTNSALNEDEYIRIFPRGIGPKPAGFKCEASRETALVIMNHINLVEYLMDVNQWSTVFSGIVSRAMTLEVLSTGVAGNYNGALQVMTAEFQLPTPLVPTRESYFVRYCKQHAEGTWAVVDVSLDNLRPSPAARCRRRPSGCLIQEMPNGYSQVTWIEHVEVDDRGVHSLYKQLVSSGHAFGAKRWVATLDRQCERLASAMATNIPTGEVGVITNQEGRKSMLKLAERMVISFCAGVSASTAHTWTTLSGTGADDVRVMTRKSVDDPGRPPGIVLSAATSFWLPVPPKRVFDFLRDENSRNQWDILSNGGVVQEMAHIANGRDTGNCVSLLRVNSANSSQSNMLILQESCTDPTASFVIYAPVDIVAMNVVLNGGDPDYVALLPSGFAILPDGTTAHGGGIGGESVSAGGSLLTVAFQILVDSVPTAKLSLGSVATVNNLIACTVERIKAALSCENA

SEQ ID NO: 21847 - protein, 724 aa, Cajanus cajan
MFQSNLMEALEMGQNTSESEVPRIREDEFDSATKSGSENHEGASGEDQDPRPNKKKRYHRHTQHQIQEMEAFFKECPHPDDKQRKELSRELGLEPLQVKFWFQNKRTQMKTQHERHENTQLRTENEKLRADNMRYREALSNASCPNCGGPTAIGEMSFDEHHLRLENARLREEIDRISAIAAKYVGKPVVNYSNISPSLPPRPLELGVGAGFGGQPGIGVDIYGAGDLLRSISGPTEADKPIIIELAVAAMEELIGMAQMGEPLWLTTLDGTSTMLNEDEYIRSFPRGIGPKPSGFKCEASRETAVVIMNHVNLVEILMDVNQWSTVFSGIVSRAMTLEVLSTGVAGNYNGALQVMTSELQLPTPLVPTRESYFVRYCKQHADGTWAVVDVSLDNLRPSPSARCRRRPSGCLIQEMPNGYSKVTWIEHVEVDDRGVHNLYKQLVSSGHAFGAKRWVATLDRQCERLASAMATNIPTVDVGVITNQEGRKSMMKLAERMVISFCAGVSASTAHTWTTLSGTGADDVRVMTRKSVDDPGRPPGIVLSAATSFWLPVPPKRVFDFLRDENSRNEWDILSNGGVVQEMAHIANGRDTGNCVSLLRVNSANSSQSNMLILQESCTDTTGSFVIYAPVDIVAMNVVLNGGDPDYVALLPSGFAILPDGTTTHGSGIGESGPGGSLLTVAFQILVDSVPTAKLSLGSVATVNNLIACTVERIKASLSGEGA

SEQ ID NO: 21848 - protein, 737 aa, Cicer arietinum
MFQPNLMEAGHHHQHQLLPLDMPQNTSESDVPRIREDELFDSATKSGSENQEGGGASGEDQEPRAKKKRYHRHTQHQIQEMEAFFKECPHPDDKQRKELSRELGLEPLQVKFWFQNKRTQMKTQQERHENTQLRTENEKLRADNMRFREALSNTSCPNCGGPTAIGEMSFDEHHLRLENARLREEIDRISGIAAKYVGKPVVSYPLLSPSSVPPRPLELGMGGFGGQAGVGGDMYGGGDLLRSISGPTEADKPMIIELAVAAMEELIGMAQMGDPLWLTTLEGGLILNEEEYVRSFPRGIGPKPAGFKNEASRETSLVIMNHVNLVEILMDVNQWSTVFSGIVSRAMTLEVLSTGVAGNYNGALQVMTAELQVPSPLVPTRESYFVRYCKQHGDGTWAVVDVSLDNLRPSPSARCRRRPSGCLIQEMPNGYSKVIWVEHVEVDDRGVHNLYKQLVSSGHAFGAKRWIATLDRQCERLASAMATNIPTVDVGVITNQDGRKSMLKLAERMCISFCAGVSASTAHTWTTLSGTGADDVRVMTRKSVDDPGRPAGIVLSAATSFWLPVPPKRVFEFLRDENSRSEWDILSNGGVVQEMAHIANGRDTGNCVSLLRVNSANSSQSNMLILQESCTDTTGSFVIYAPVDIVAMNVVLNGGDPDYVALLPSGFAILPDGTTTTTTNGSAESGHGGGSLLTVAFQILVDSVPTAKLSLGSVATVNNLIACTVERIKASLSGEVA

SEQ ID NO: 21849 - protein, 729 aa, Glycine max
MFQPNLMDALEMGQNTPESEIPRIREDEFDSATKSGSENHEGASGEDQDPRPNKKKRYHRHTQHQIQEMEAFFKECPHPDDKQRKELSRELGLEPLQVKFWFQNKRTQMKTQHERHENTNLRTENEKLRADNMRYREALSNASCPNCGGPTAIGEMSFDEHHLRLENARLREEIDRISAIAAKYVGKPVVNYSNISPSLPPRPLEIGVGGAGFGGQPGIGVDMYGAGDLLRSISGPTEADKPIIIELAVAAMEELIGMAQMGEPLWLTTLDGTSTMLNEDEYIRSFPRGIGPKPSGFKCEASRETAVVIMNHVNLVEILMDVNQWSTVFSGIVSRAMTLEVLSTGVAGNYNGALQVMTAELQLPTPLVPTRESYFVRYCKQHGDGTWAVVDVSLDNLRPSPSARCRRRPSGCLIQEMPNGYSKVTWVEHVEVDDRGVHNLYKQLVSSGHAFGAKRLVATLDRQCERLASAMATNIPTVDVGVITNQEGRKSMMKLAERMVISFCAGVSASTAHTWTTLSGTGADDVRVMTRKSVDDPGRPPGIVLSAATSFWLPVPPKRVFDFLRDENSRNEWDILSNGGVVQEMAHIANGRDTGNCVSLLRVNSANSSQSNMLILQESCTDSTGSFVIYAPVDIVAMNVVLNGGDPDYVALLPSGFAILPDGTTSHGSGGGVIGETSPSSGSLLTVAFQILVDSVPTAKLSLGSVATVNNLIACTVERIKASLSGEPA

SEQ ID NO: 21850 - protein, 753 aa, Vitis vinifera
MPAGIMIPATHMPSMMGRNGNVAAYGSSSGLSLGQPNMMDGQLHPLDMTQNTSESEIARLREDDFDSKSGSENHEGASGDDQDPNQRPKKKRYHRHTQHQIQEMEAFFKECPHPDDKQRKELSRELGLEPLQVKFWFQNKRTQMKTQHERHENTQLRSENEKLRTENLRYREALSNASCPNCGGPTAIGEMSFDEHHLRLENARLREEIDRISAIAAKYVGKPVVNYPLIPQVPTRPLDLGVGNFGAQPGLGGELFGASDLLRSINGPTEADKPMIIELAVAAMEELFRMAQMGEPLWLPSLDGTTTELSEDEYIRSFPRGIGPKPPGFKCEASRETAVVIMNHISLVEILMDVNQWSTVFSGIVSRAMTLEVLSTGVAGNYNGAFQVMTAEFQVPSPLVPTRESYFVRYCKQHADGTWAVVDVSLDNLRPSPVVRCRRRPSGCLIQEMPNGYSKVTWVEHVEVDDRGVHNIYKQLVNSGLAFGAKRWVATLDRQCERLASAMATNIPTVITSQEGRKSMLKLAERMVISFCAGVSASTAHTWTTLSGSGADDVRVMTRKSVDDPGRPPGIVLSAATSFWLPVPPKRVFDFLRDENSRSEWDILSNGGVVQEMAHIANGQDTGNCVSLLRVNSANSSQSNMLILQESCTDSTASFVIYAPVDVVAMNMVLNGGDPDYVALLPSGFAILPDGTTAHGGVIGEVGSGGSLLTVAFQILVDSVPTAKLSLGSVATVNNLIACTVDRIKAAVSCENA

SEQ ID NO: 21851 - protein, 732 aa, Lupinus angustifolius
MFQPNMMEGLHHLDMTTQNTSESDIPIIRNDEFDSGTKSGSENHDGGASGEDQDPRPNKKKKRYHRHTQHQIQEMEAFFKECPHPDDKQRKELSRELGLEPLQVKFWFQNKRTQMKTQHERHENTQLRTENDKLRADNMRYREALTNASCPNCGGPTAIGEMSFDEHQLRLENARLREEIDRISAIAAKYVGKPVVNYPLLSSPSVPPRSLELGVNGAFSGQQGGIDMYGSGDLLRSINGPTDADKPIIIELAVAAMEELIGMAQMGEPLWLTTLDGSTTVLNEDEYVRSFPRGIGPKPNGFKCEASRETAVVIMNHVNLVEILMDAHQWSTVFSGIVSRAMTLEVLSTGVAGNYNGALQVMTAELQVPTPLVPTRESYFVRYCKQHPDGTWAIVDVSLDNLRPSPSSKCRRRPSGCLIQELPNGYSKVIWVEHVEVDDRGVHNLYKQLVSSGHAFGAKRWIATLDRQCQRLASSMATNMPTVDVGVITNQEGRKSMLKLAERMVISFCAGVSASTAHTWTTLSGSGTGADDVRVMTRKSVDDPGRPPGIVLSAATSFWLPVSPKRVFEFLRDENSRSEWDILSNGGVVQEMAHIANGRDTGNSVSLLRVNSANSSQSNMLILQESCTDSTGSFVIYAPVDIAAMNVVLNGGHPDYVALLPSGFAILPDGTTTHGSSIVENDHGGSLLTVAFQILVDSVPTAKLSLGSVATVNNLIACTVERIKASLTGEAA

SEQ ID NO: 21852 - protein, 761 aa, Populus trichocarpa
MPAGVMIPARNMPSMIGVNGNVGGFGSSSGLALGQPNMMEGHEFHHLDMTHNTSEGDMTRIRDEEFDSTNTKSGSENQEGASGDDQDPRPKKKRYHRHTQHQIQEMEAFFKECPHPDDKQRKELSRELGLEPLQVKFWFQNKRTQMKTQHERHENTQLRNENEKLRADNMRYREALSNASCPNCGGPTAIGEMSFDEHHLRLENTRLREEIDRISAIAARYVGKPVVNYPVLSPPMPPRPVDLGVGNFGGQPGLGGDIYEAGDLLRSISAPTEADKPMIIELAVAAMEELIRMAQMDEPLWMNSLDGIDAVLNEDEYIRIFPHGIGPKPTGFKCEASRESAVVIMNHINLVEYLMDVNQWSTLFSGIVSRALTLEVLSTGVAGNYNGALQVMTAEFQLPTPLVPTRESYYVRYCKQHADGTWAVVDVSLDSIRPGPAARCRRRPSGCLIQEMPNGYSKVTWVEHVEVDDRGVHNLYKHLVSSGHAFGAKRWVATLNRQCERLASAMATNIPAGDAGVITNQEGRKSMMKLAERMVISFCAGVSASTAHTWTTLSGTGADDVRVMTRKSVDDPGRPPGIVLSAATSFWLPVPPKRVFDFLRDENTRNEWDILSNGGVVQEMAHIANGRDTGNCVSLIRVNSANSSQSNMLILQESCTDQTASFVIYAPVDIVAMNVVLNGGDPDYVALLPSGFAIFPDGTAAHGVGMDESGSTGGSLLTVAFQILVDSVPTAKLSLGSVATVNNLIACTVERIKASLSCESA

SEQ ID NO: 21853 - protein, 753 aa, Cucumis sativus
MPAGIMTPARNMGSMIGRNGNNDVAGFSSPSGLPFSQPSIMDAHLLPLDIPQNTSESDLARIRDDDFDSATKSGSDNNHELVSGDDQDPRPKKKRYHRHTQHQIQEMEAFFKECPHPDDKQRKELSRELGLEPLQVKFWFQNKRTQMKNQHERHENTQLRTENEKLRADNMRYREALSNASCPNCGGPTAIGEMSFDEHHLRLENARLREEIDRISAIAAKYVGKPVVNYPLLSPSVPSRPLELGMANFGPQPGLGGGDIYGSASDLIRSISAPTEADKPMIIELAVAAMEELTRMAQMGEPLWMTTLDGSTHMLNEDEYLRTFPRGIGPKPSGFKCEASRESAVVIMNHINLVEILMDVNQWSTLFSGIVSRAMTLEVLSTGVAGNYNGALQVMTSEFQVPSPLVPTRESYYVRYCKQHGDGTWVVVDVSLDDLRPTPGVRCRRRPSGCLIQEMPNGYSKVTWVEHVEVDDRGVHNLYKQLVSSGQAFGAKRWVTTLDRQCERLASAMATNIPTVITNQEGRKSMLKLAERMVISFCAGVSASTTHTWTTLSGTGADDVRVMTRKSIDDPGRPHGIVLSAATSFWLPVPPKRIFDFLRDENSRSEWDILSNGGVVQEMAHIANGRDTGNCVSLLRVNSANSSQSNMLILQESCTDPTASFVIYAPVDVVAMNLVLNGGDPDYVALLPSGFAILPDGGGGEGVSGGSLLTVAFQILVDSVPTAKLSLGSVATVNNLIACTVERIKASLSCENA

SEQ ID NO: 21854 - protein, 756 aa, Citrullus lanatus
MPAGIMTPARSMASMIGRNENNAAGFASPSGFPLSQSSMMDSHLLPLDIPQNTSESDLARIRDDDFDSATKSGSDNNPDLVSGDDQDPRPKKKRYHRHTQHQIQEMEAFFKECPHPDDKQRKELSRELGLEPLQVKFWFQNKRTQMKNQHERHENTQLRTENEKLRADNMRYREALSNASCPNCGGPTAIGEMSFDEHHLRLENARLREEIDRISAIAAKYVGKPVVNYPLLSPPVPARPLELGMGNFGPQPGLGGGDLYSSASDLIRSISAPTEADKPMIIELAVAAMEELTRMAQMGEPLWMTSLDGSTHVLNEDEYLRTFPRGIGPKPSGFKCEASRESAVVIMNHINLVEILMDVNQWSTLFSGIVSRAMTLEVLSTGVAGNYNGALQVMTSEFQVPSPLVPTRESYFVRYCKQHGDGTWAVVDVSLDDLRPTPGVRCRRRPSGCLIQEMPNGYSKVTWVEHVEVDDRGVHNLYKQLVSSGQAFGAKRWVTTLDRQCERLASALATNIPTGDVGVITNQEGRKSMLKLAERMVISFCAGVSASTTHTWTTLSGTGADDVRVMTRKSIDDPGRPPGIVLSAATSFWLHVPPKRIFDFLRDENSRSEWDILSNGGVVQEMAHIANGRDTGNCVSLLRVNSANSSQSNMLILQESCTDPTASFVIYAPVDIVAMNVVLNGGDPDYVALLPSGFAILPDGAGGEGVSGGSLLTVAFQILVDSVPTAKLSLGSIATVNNLIACTVERIKASLSCENA

SEQ ID NO: 21855 - protein, 701 aa, Arachis hypogaea
FDSATKSGSENQEGGASGEDQDPRPNKKKRYHRHTQHQIQEMEAFFKECPHPDDKQRKELSRELGLEPLQVKFWFQNKRTQMKTQHERHENTQLRTENEKLRADNMRYREALSNASCPNCGGPTAIGEMSFDEHHLRLENARLREEIDRISAIAAKYVGKPVVNYPLLSSSSVPARPLELGIGGFGGQAGMGGGDMYGGGGAGDLLRPISGPTEADKPMIIELAVAAMEELIGMAQMGEPLWLTTLDGATTVLNEDEYVRSFPRGIGPKPNGFKCEASRETAVVIMNHVNLVEILMDVNQWSTVFSGIVSRAVTLEVLSTGVAGNYNGALQVMTAELQVPSPLVPTRESYFVRYCKQHADGTWAVVDVSLDNLRPSPSARCRRRPSGCLIQEMPNGYSKVIWVEHVEVDDRGVHSLYKQLVSSGHAFGAKRWIATLDRQCERLASAMATNIPTVDVGVITNQEGRKSMLKLAERMVISFCAGVSASTAHTWTTLSGTGADDVRVMTRKSVDDPGRPPGIVLSAATSFWLPVPPKRVFEFLRDENSRSEWDILSNGGVVQEMAHIANGRDTGNCVSLLRVNSANSSQSNMLILQESCTDSTGSFVIYAPVDIVAMNVVLNGGDPDYVALLPSGFAILPDGTTPDGGSEAGGHGGSLLTVAFQILVDSVPTAKLSLGSVATVNNLIACTVERIKASLSGEAPS

SEQ ID NO: 21856 - protein, 727 aa, Quercus alba
MFQPNMMDGQLHQLDMAQNTSESDLARIRDDEFDSATKSGSENHEGASGDDQDPRPNKKKRYHRHTQHQIQEMEAFFKECPHPDDKQRKELSRELGLEPLQVKFWFQNKRTQMKTQHERHENTNLRTENEKLRADNMRYREALSNASCPNCGGPTAIGEMSFDEHHLRLENSRLREEIDRISAIAAKYVGKPVVNYPLLSPPVPTRPLDLGVGSFGGQPGIGGEMYGAGDLLRTINAPTEADKPMIIELAVAAMEELIRMAQMGEPLWMTNLDGTSMINEDEYIRTFPRGIGPRPSGFKCEASRETAVVIMNHINLVEILMDVSQWSTVFSGIVSRAMTLEVLSTGVAGNYNGALQVMTAEFQVPSPLVPTRESYYVRYCKQHADGTWAVVDVSLDNLRPSPAVRCRRRPSGCLIQEMPNGYSKVTWVEHIEVDDRGVHNLYKQLVSSGNAFGAKRWVATLDRQCERLASAMATSIPTGDIGVITNQEGRKSMLKLAERMVISFCAGVSASTAHTWTTLSGTGADDVRVMTRKSIDDPGRPPGIVLSAATSFWLPVPPKRVFDFLRDENSRSEWDILSNGGVVQEMAHIANGRETGNCVSLLRVNSANSSQSNMLILQESCTDPTASFVIYAPVDIVAMNLVLNGGDPDYVALLPSGFAILPDGTMAHEGGIGEATTSGGSLLTVAFQILVDSVPTAKLSLGSVATVNNLIACTVERIKASLSCENA

SEQ ID NO: 21857 - protein, 780 aa, Cannabis sativa
MPAGIIIPARNMPSIIGRNGNIGGFGSSSGLTLSQPNMMEGSGHQLLHPLDMTAQNTTSESDLNARLGRDDDVFDSATKSGSENQDGGASGDDHDQQRPKKKRYHRHTQHQIQEMEAFFKECPHPDDKQRKELSRELGLEPLQVKFWFQNKRTQMKTQHERHENTQLRTENDKLRADNMRYREALSNASCPNCGGPTAIGEMSFDEHHLRLENARLREEIDRISAIAAKYVGKPVVSYPILSSPATPRPLELGVGNFGSQATMGGEMYGGGGSTGDLLRTMSAPNEADKPMIIELAVAAMEELIRMAQMGEPLWMTSLDGASAVLNEDEYVRTFPRGIGPKPAGFKCEASRETAVVIMNHINLVEILMDVNQWSTVFSGIVSRAMALEVLSTGVAGNFNGALQVMTAEFQVPSPLVPTRESYYVRYCKQHADGTWAVVDVSLDNLRPSPAVRCRRRPSGCLIQEMPNGYSKVTWVEHVEVDDRGVHNLYKQLVNSGHGFGAKRWVATLDRQCERLASAMATNIPTGDVGVITNQEGRKSMLKLAERMVISFCAGVSASTTHTWTTLSGTGADDVRVMTRKSVDDPGRPPGIVLSAATSFWLPVPPKRVFDFLRDEHSRSEWDILSNGGVVQEMAHIANGRETGNCVSLLRVNVCIYNLSANSSQSNMLILQESCTDQTASFVIYAPVDIVAMNVVLNGGDPDYVALLPSGFAILPDGSGGGGDGIVEPCSSGGSLLTVAFQILVDSVPTAKLSLGSVATVNNLIACTVERIKASLSCDTA

SEQ ID NO: 21858 - protein, 758 aa, Malus domestica
MQAGLIIPARNMPSMMGGNGNITGFASTSGLTLGQPNMMDASNLHPLDMAPNTSESDIPRFRDDDFDSANKSGSDNPEGGSGDDQENPRPKKKRYHRHTQHQIQEMEAFFKECPHPDDKQRKELSRELGLEPLQVKFWFQNKRTQMKTQHERHENTQLRNENEKLRTDNMRYREALGNASCPNCGGPTVLGEMSFDEHHLRLENARLREEIDSISAIAAKYVGKPLGTYPLMSSPVPSRGQLDLGVGNFGGQPGMGGEMYGAGDLLRSISAPSEVDKPMIIELALAAMEELFKMAQMGEPLWMTSFDGTTTILNEDEYIRTFPRGIGPKQNGFKTEASRESAVVIMNHINLVEILMDVNQWSTVFSGIVSRALTLEVLSSGVPGNYNGALQVMTAEFQVPSPLVPTRESYYVRYCKQHADGTWAVVDVSLDDLRPNPEPRSCQRRPSGCLIQELPNGYSKVTWVEHAEVDERGVHNLYKQLVSSGHAFGAKRWVATLDRQCERLASAMASNIPTGDVGVITNQEGRKSMLKLAERMVISFCSGVSASTTHTWTTLSGTGADDVRVMTRKSVDDPGRPPGIVLSAATSFWLPVPPKRVFEFLRDENSRSEWDILSNGGIVQEMAHIANGHDTGNCVSLLRVNSANSSQSNMLILQESCTDPTASFVIYAPVDIVAMNVVLNGSDPDYVALLPSGFAILPDGADIGDSGSGGGSLLTVAFQILVDSIPTAKLSLGSVATVNNLIACTVERIKAALSCDNE

SEQ ID NO: 21859 - protein, 755 aa, Gossypium raimondii
MLAGVMIPARNMPTMISGNGNVSGFGTSLLVQPSNMMEGQLHPLESESEIGRMRDDELDSTTKSGSENHEAASGDDQNPRPNKKKRYHRHTQHQIQEMEAFFKECPHPDDKQRKELGRELGLEPLQVKFWFQNKRTQMKTQHERHENTQLRTENEKLRADNMRYREALSTASCPNCGGPTAVGQMSFDEHHLRLENARLREEIDRISAIAAKYVGKPVVSYPLLSSPMTPRPFEFGAQPGTGDMYGAGDLLRSISSPSEADKPIIIELAVAAMEELVRMAQMGEPLWMTSLDGTTYVLNEEEYIRTFPRGIGPKPTGFKCEASRETAVVIMNHINLVEILMDVNQWSTVFSGIVSKASTLDVLSTGIAGNYNGALQVMATEFQVPSPLVPTRESYYVRYCKQHAEGTWAVVDVSLDNIRPSPTARCRRRPSGCLIQEMPNGYSKVTWVEHVEVDDSGVHSLYKQLVSTGHAFGAQRWIATLDRQCERLASVMATNVPTGDVGVITNQDGRKSMLKLAERMVMSFCAGVSASTAHTWTTLSGTGADDVRVMTRKSVDDPGRPPGIVLSAATSFWLPVSPKRVFDFLRDENSRSEWDILSNGGVVQEMAHIANGRDTGNCVSLLRVNSANSSQSNMLILQESCTDPTASFVIYAPVDIVAMNVVLNGGDPDYVALLPSGFAILPDGSTITATTSSAGGGIDTDAAGSSSGSLLTVAFQILVDSVPTAKLSLGSVATVNNLIACTVERIKASLSCENA

SEQ ID NO: 21860 - protein, 735 aa, Cicer arietinum
MFQSNLMEGGQFHPLEMIQNTSESDVIPRIREDECFESATKSCSENHEGGGASGEDQEPKPKRKRYHRHTQHQIQEMEAFFKECPHPDDKQRKELSRELGLEPLQVKFWFQNKRTQMKTQHERSENTQLRQENEKLRADNMRYREALSNASCPNCGGPTAIGEMSFDEHHLRLENARLREEIDRISAIAAKYVGKPVVNYSNIAASLPPRPLEHGVGAGFGNQQGLGMDIYGTSGDLLRSISGPTEADKPIIIELAVAAMEELTGMAQMGEPLWLTTLDGAANVLNEDEYVRSFPRGIGPKPNGFKCEASRETCVVIMNHVNLVEILMDVNQWSTVFAGIVSRAMTVEVLSTGVAGNYNGALQVMTAELQVPSPLVPTRESYFVRYCKQHTDGTWAVVDVSLDNLRPNPSSRCRRRPSGCLIQEMPNGYSKVTWVEHVEVDDRGVHNLYKQLVSTGNAFGAKRWVATLDRQCERLASSMATNIPTVDVGVITNQEGRKSMMKLAERMVMSFCGGVSASTAHTWTTLAGTGADDVRVMTRKSVDDPGRPPGIVLSAATSFWLPVPPKRVFDFLRDENSRNEWDILSNGGVVQEMAHIANGRDTGNCVSLLRVNSANSSQSNMLILQESLTDSTGSFVIYAPVDIVAMNVVLNGGDPDYVALLPSGFAILSDGNGNGIGDENGQAGVCGGSLLTVAFQILVDSVPTAKLSLGSVATVNSLIACTVERIKASLSGETA

SEQ ID NO: 21861 - protein, 726 aa, Populus trichocarpa
MFQPNMMEGQLHRLDMTQNTPEGDMARIRDDEFDSTNTKSGSENQDGASGDDQDPRPKKKRYHRHTQHQIQEMEAFFKECPHPDDKQRKELSRELGLEPLQVKFWFQNKRTQMKTQHERHENTQLRNENEKLRADNMRYREALSNASCPNCGGPTAIGEMSFDEHHLRLENARLREEIDRISAIAAKYVGKPVVNYPLISAPMPPRPLDLGVGNFGGQPGIGGEIYGAGDLLRSITAPTEADKPMIIELAVAAMEELVRMAQMDEPLWMGSLDGTNAVLDEDEYVRIFPRGIGPKPTGFKCEASRESAVVIMNHINLVEYLMDVNQWSTLFSGIVSRALTLEVLSTGVAGNYNGALQVMTAEFQLPTPLVPTRESYFVRYCKQHADGTWAVVDVSLDNLRPSPGARCRRRPSGCLIQEMLNGYSKVTWVEHVEVDDRGVHNLYKQLVSSGHAFGAKRWVATLDRQCERLASAMATNIPAGDVGVITNQEGRKSMMKLAERMVISFCAGVSASTAHTWTTLSGTGADDVRVMTRKSVDDPGRPPGIVLSAATSFWLPVPPKRVFDFLRDESTRNEWDILSNGGVVQEMAHIANGRDTGNCVSLLRVNSANSSQSNMLILQESCADQTASFVIYAPVDIVAMNVVLNGGDPDYVALLPSGFAVLPDGTGAHVGGMEEAAGGSLLTVAFQILVDSVPTAKLSLGSVATVNNLIACTVERIKASLSCESA

SEQ ID NO: 21862 - protein, 761 aa, Gossypium raimondii
MPAGVMIPARNMPSMITGNGSVSGYGTSSGLTLGQIMFQQPNNVMEGQLHPLEMTQNASESEIARMRDEEFDSTNKSGSENHELGGSGDDQDPRPNKKKRYHRHTQHQIQEMEAFFKECPHPDDKQRKELGRELGLEPLQVKFWFQNKRTQMKTQHERHENTQLRTENEKLRADNMRYREALSTASCPNCGGPTAVGQMSFDEHHLRLENSRLREEIDRISAIAAKYVGKPVVNFPLLSSPAPPRPFDFGSQPVTEEMYGVGDLLRSISAPSEADKPMIIELAVAAMEELVRMAQVGEPLWMTSLDGTTCMLNEEEYIRTFPSGIGPKPTGFKCEASKETTVVIMNHINLVEILMDVNQWSTLFSGIVSKASTLDVLSTGVAGNYNGALQVMTAEFQVLSPLVPTRESYYVRYCKQHAEGTWAVVDVSLDTIRPSPTVRCRRRPSGCLIQEMPNGYSKVTWVEHVEVDDGGVHNLYKQLVSSGHAFGARRWVSTLDRQCERLASLMASNIPTGDVGVITNQDGRKSMLKLAERMVISFCGGVSASTAHTWTTLSGTGADDVRVMTRKSVDDPGRPPGIVLSAATSFWLPVSPKRVFDFLRDEHSRSEWDILSNGGAVQEMAHIANGRDPGNCVSLLRVNSANSSQSNMLILQESCTDPTASFVIYAPVDIVAMNVVLNGGDPDYVALLPSGFAILPDGMTVTDVGMADSGGSSGSLLTVAFQILVDSVPTAKLSLGSVATVNNLIACTVERIKASLSCDNA

SEQ ID NO: 21863 - protein, 772 aa, Eucalyptus grandis
MPAGIMIPARNMSSSPMIGSNGNASGYGSSSGLTLGQPNMMESLHHHQLHHPLDMAHQTPSESELARLRDEEFEISTKSGSENQEGQSGDDMQDLQRPNKKKRYHRHTQHQIQEMEAFFKECPHPDDKQRKELSRQLGLEPLQVKFWFQNKRTQMKTQHERGENTQLRAENDKLRADNMRYREALSNATCPNCGGPTAIGEMSFDEHHLRLENARLREEIDRISAIAAKYVGKPVVNYPLLSPSAPPRPLDLGVGGFGGQSSVGGEIYGAGDLLKSIGAPTEADKPMIIELAVAAMEELIRMAQMGEPLWSESLDGNSSSVLNEDEYMKTFPRGIGPKPAGFNTEASRESAVVIMDHINLVEILMDVNQWSTVFSSIVSRAATLEVLSTGVAGNYNGALQVMTAEFQVPTPLVPTREVYFVRYCKQHGDGAWAVVDVSLDNVRPSPIVRCRRRPSGCVIQEMPNGYSKVTWVENVEVDDRGVHSLYKQLVNSGHALGAKRWVATLDRQCERLASAMATNIPNTDVGVITSQEGRKSMLKLAERMVISFCAGVSASTAHTWTTLSGTGADDVRVMTRKSIDDPGRPPGIVLSAATSFWLPVQPNRVFDFLRDENSRSEWDILSNGGVVQEMAHIANGRDTGNCVSLLRVNSANSSQSNMLILQESCTDSAGSFVIYAPVDIVAMNVVLNGGDPDYVALLPSGFAILPDGSAMQGGNDQQGVGSGGGSLLTVAFQILVDSVPTAKLSLGSVATVNNLIACTVERIRASLSCESA

SEQ ID NO: 21864 - protein, 760 aa, Gossypium hirsutum
MPAGVMVPARNMPSMISGNGNIGGFGTISGLSLGQQPNNNMMEGQLHPFEMTQNTSESEIARMRDEEFDSALKSGSENHEGVSGEDDQDPRPNKKKRYHRHTQHQIQQMEAFFKECPHPDDKQRKELGRVLGLEPLQVKFWFQNKRTQMKTQHERQENSQLRAENEKLRADNMRYREALSTASCPNCGGPTTVGQMSFDEHHLRLENARLREEIDRISAIAAKYVGKPVVSYPLLSSPMTPRPLDFGSQTGSGEMYGAGELLRSINAPAEADKPMIIELAVAAMEELVRMAQVGEPLWMTSLDGSTSVLNEEEYIRTFPRGIGPKPTGFKGEASKETCVVIMNHISLVEILMDVQQWSTVFSAIVSKASTLDVLSTGIAGNYNGALQVMTAEFQVPSPLVPTRESYYVRYCKHHAEGTWAVVDVSLDNIRPNPAMRCRRRPSGCLIQEMPNGYSKVTWIEHVEIDDRGVHNLYKQLVSSGHAFGAKRWIATLDRQCERLASLMATNIPTGDAGVITNQDGRKSMLKLAERMVISFCAGVGASTAHTWTTLSGTGADDVRVMTRKSVDDPGRPPGIVLSAATSFWLPVSPKRVFDFLRDENSRNEWDILSNGGVVQEMAHIANGRDTGNCVSLLRVNSANSSQTNMLILQESCTDPTASFVIYAPVDVVAMNVVLNGGDPDYVALLPSGFAILPDGSSGSTGSGMADAGGSSGGSLLTVAFQILVDSVPTAKLSLGSVATVNNLIACTVERIKASLSCENA

SEQ ID NO: 21865 - protein, 760 aa, Gossypium raimondii
MPAGVMVPARNMPSMISGNGNIGGFGTISGLSLGQQPNNNMMEGQLHPFEMTQNTSESEIARMRDEEFDSALKSGSENHEGVSGDDDQDTRPNKKKRYHRHTQHQIQEMEAFFKECPHPDDKQRKELGRVLGLEPLQVKFWFQNKRTQMKTQHERQENSQLRAENEKLRADNMRYREALSTASCPNCGGPTAVGQMSFDEHHLRLENARLREEIDRISAIAAKYVGKPVVSYPLLSSPMTPRPLDFGSQTGSGEMYGAGELLRSINAPAEADKPMIIELAVAAMEELVKMAQVGEPLWMTSLDGSTSVLNEEEYIRTFPRGIGPKPTGFKGEASKETCVVIMNHISLVEILMDVHQWSTVFSAIVSKASTLDVLSTGIAGNYNGALQVMTAEFQVPSPLVPTRESYYVRYCKHHAEGTWAVVDVSLDNIRPNPAMRCRRRPSGCLIQEMPNGYSKVTWIEHVEIDDRGVHNLYKQLVSSGHAFGAKRWIATLDRQCERLASLMATNIPTGDAGVITNQDGRKSMLKLAERMVISFCAGVGASTAHTWTTLSGTGADDVRVMTRKSVDDPGRPPGIVLSAATSFWLPVSPKRVFDFLRDENSRNEWDILSNGGVAQEMAHIANGRDTGNCVSLLRVNSANSSQTNMLILQESCTDPTASFVIYAPVDIVAMNVVLNGGDPDYVALLPSGFAILPDGSSGSTGSGMADAGGSSGGSLLTVAFQILVDSVPTAKLSLGSVATVNNLIACTVERIKASLSCENA

SEQ ID NO: 21866 - protein, 773 aa, Fragaria vesca
MPAGIMIPARNMPSMMGSNGNLGGYGSSSGLTLGQPANMMEAGGHFGNPLEMIATQNTSESELNARLGDDFDSATKSGSENLEGGGSGDDGQDPRPNKKKRYHRHTQHQIQEMEAFFKECPHPDDKQRKELSRELGLEPLQVKFWFQNKRTQMKTQHERHENTNLRNENEKLRADNMRYREALSNASCPNCGGPTAIGEMSFDEHHLRLENARLREEIDRISAIAAKYVGKPVGNYPHMSSPVPPHRSPLDLGVGNMGTSPHGFLLNSDMYTSGDIMRSIGAPSEADKPMIIELAVQAMEELIRMAQIGEPLWMNSIDGSTTVLNEDEYIRTFPRGIVPKQSGFKCEASRESAVVIMNHNNLVEILMDVNQWSTVFSGIVSRAMTLDVLSTGVAGNYNGALQVMTAEFQVPSPLVPTRESYFVRYCKQHVDGTWAVVDVSLDNQRGYTSTLKSCQRRPSGCLIQEMPNGYSKVTWIEHVEVDERGVHNLYKQLVNSGNAFGAKRWVATLDRQCERLASALATNIPTGDVGVITTQEGRKSMLKLAERMVISFCAGVSASTTHTWTTLSGTGADDVRVMTRKSVDDPGRPPGIVLSAATSFWLPVPPKKVFEFLRDENSRNEWDILSNGGVVQEMAHIANGRDTGNCVSLLRVNSANSSQSNMLILQESCTDSTASYVIYAPVDIVAMNVVLNGSDPDYVALLPSGFAILPDGTSGSNSGEAESGGSLLTVAFQILVDSVPTAKLSLGSVATVNNLIACTVERIKASLSLDNEA

SEQ ID NO: 21867 - protein, 734 aa, Trifolium pratense
VHGESNLLEAGQFHPLEMMQNTSESDVPRIREDECFESATKSCSENHEGGAASGDEQEPRPKRKRYHRHTQHQIQEMEAFFKECPHPDDKQRKELSRELGLEPLQVKFWFQNKRTQMKTQHERSENSQLRAENEKLRTDNMRYREALSNASCPNCGGPTAIGEMSFDEHHLRLENGRLREEIDRISAIAAKYVGKPVVNYSNISPSLPPRPEIGFVGNNQGIGGMEMYGTSGDILRSISGPTEADKPIIIELAVAAMEELIGMAQMGDPLWLSTTLDGAVTVLNEDEYVRSFPRGIGPKPNGFKCEASRETSVVIMNHVNLVEILMDVNQWSTVFAGIVSRAMTVEVLSTGVAGNYNGALQVMTAEFQVPSPLVPTRESYFVRYCKQHTDGTWAVVDVSLDNLRPSPTSRCRRRPSGCLIQEMPNGYSKVTWVEHVEVDDRGVHNLYKQLVSTGHAFGAKRWVATLDRQCERLASSMATNIPTVDVGVITSQEGRKSMMKLAERMVISFCGGVSASTAHTWTTLSGTGADDVRVMTRKSVDDPGRPPGIVLSAATSFWLPVPPKQVFDFLRDENSRNEWDILSNGGVVQEMAHIANGRDTGNCVSLLRVNSANSSQSNMLILQESLTDSTGSFVIYAPVDIVAMNVVLNGGDPDYVALLPSGFAILPDGNAIGNGENGGQAAGGGGSLLTVAFQILVDSVPTAKLSLGSVATVNSLIACTVERIKASLSGEGAA

SEQ ID NO: 21868 - protein, 691 aa, Trigonella foenum-graecum
NQEAANSGEDQEPRAKKKRYHRHTQHQIQEMEAFFKECPHPDDKQRKELSRELGLEPLQVKFWFQNKRTQMKTQQERHENTSLRTENDKLRADNMRFREALSNASCPNCGGPTAIGEMSFDEHHLRLENARLREEIDRIAGIAAKYAGKAVVSYPLLSPSSVPPRPLELGIGGFGGQPGIGGEMYGAGDLLRSISGPTEADKPMIIELAVAAMEELIGMAQMGDPLWLTTLEGGSILNEEEYVRSFPRGIGPKPAGFKCEASRETSVVIMNHVNLVEILMDVNQWSTVFSGIVSRAMTLEVLSTGVAGNYNGALQVMTAELQVPSPLVPTRESYFVRYCKQHADGTWAVVDVSLDNLRPSPSARSRRRPSGCLIQEMPNGYSKVIWVEHVEVDDRGVHNLYKQLVSSGHAFGAKRWIATLDRQCERLASAMATNIPTVDVGVITNQDGRKSMLKLAERMCISFCAGVSASTAHTWTTLSGTGADDVRVMTRKSVDDPGRPAGIVLSAATSFWLPVPPKRVFEFLRDENSRSEWDILSNGGVVQEMAHIANGRDTGNCVSLLRVNSANSSQSNMLILQESCTDTTGSFVIYAPVDIVAMNVVLNGGDPDYVALLPSGFAILPDGTTTTTTSHGGGGGGEIGHGGGSLLTVAFQILVDSVPTAKLSLGSVATVNNLIACTVERIKASLSGEVA

SEQ ID NO: 21869 - protein, 730 aa, Lupinus angustifolius
MFQPNLGQFHNALDNMAQNTSESDIPRMDEFDRSGSENQEGASGEDQEPSAKKKRRFHRHTQHQIQEMEAFFKECPHPDDKQRKELSRELGLEPLQVKFWFQNKRTQMKTQHERHENTQLRNENDKLRAENIRYREAFSNAACPNCGGQTSIGEMSFDEHHLRFENARLREEIDRISAIAAKYVGKPVVNYSNLSPSLPSRPLELGTGGGFGGQPAGIGGGDMYGGGGDFLRSISGPTESDKPIIIELAVAAMEELIGMAQMGEPLWLTTHTHDGTSIVLNEDEYLRSFPRGIGPKPTGFKSEASRETTVVIMNHVNLVEILMDVNQWSTVFSGIVSKAMTLEVLSTGVAGNCNGALQVMTAELQVPSPLVPTRESYFVRYCKQHVDGTWAVVDVSLDNLRPSPSPRCRRRPSGCLIQEMPNGYSRVTWVEHVEVVDRGVHNLYKQLVSSGNAFGAKRWVATLDRQCERLASAMATNIPTVDVGVITNQEGRKSMLKLAERMVISFCGGVSASTTHTWTTLQTGTGSDDVRVMTRKSVDDPGRPPGIVLSAATSFWLPVPPKRVFDFLRDENSRNEWDILSNGGVVQEMAHIANGRETGNCVSLLRVNSANSSQGNMSILQESCSDSTCSFVIYAPVDIVAMNVVLNGGDPDYVALLPSGFAILPDGSTTHGNGIGETGSGGSLLTVAFQILVDSVPTARLSLGSVATVNNLIACTVERIKAALSPELQD

SEQ ID NO: 21870 - protein, 721 aa, Trifolium pratense
HPLEMMQNTSESDVPRIREDECFESATKSCSENHEGGAASGDEQEPRPKRKRYHRHTQHQIQEMEAFFKECPHPDDKQRKELSRELGLEPLQVKFWFQNKRTQMKTQHERSENSQLRAENEKLRTDNMRYREALSNASCPNCGGPTAIGEMSFDEHHLRLENGRLREEIDRISAIAAKYVGKPVVNYSNISPSLPPRPEIGFVGNNQGIGGMEMYGTSGDILRSISGPTEADKPIIIELAVAAMEELIGMAQMGDPLWLSTTLDGAVTVLNEDEYVRSFPRGIGPKPNGFKCEASRETSVVIMNHVNLVEILMDVNQWSTVFAGIVSRAMTVEVLSTGVAGNYNGALQVMTAEFQVPSPLVPTRESYFVRYCKQHTDGTWAVVDVSLDNLRPSPTSRCRRRPSGCLIQEMPNGYSKVTWVEHVEVDDRGVHNLYKQLVSTGHAFGAKRWVATLDRQCERLASSMATNIPTVDVGVITSQEGRKSMMKLAERMVISFCGGVSASTAHTWTTLSGTGADDVRVMTRKSVDDPGRPPGIVLSAATSFWLPVPPKQVFDFLRDENSRNEWDILSNGGVVQEMAHIANGRDTGNCVSLLRVNSANSSQSNMLILQESLTDSTGSFVIYAPVDIVAMNVVLNGGDPDYVALLPSGFAILPDGNAIGNGENGGQAAGGGGSLLTVAFQILVDSVPTAKLSLGSVATVNSLIACTVERIKASLSGEGAA

SEQ ID NO: 21871 - protein, 734 aa, Medicago truncatula
MFQSNLLEAGQFHPLEMMQNTSESDVPRIREDEFESGTKSCSENHEGGAASGEEQGPRPKRKRYHRHTQHQIQEMESFFKECPHPDDKQRKELSRELGLEPLQVKFWFQNKRTQMKTQHERSENSQLRADNEKLRADNMRYREALSNASCPNCGGPTAIGEMSFDEHHLRLENARLREEIDRISTMAAKYVGKPVVNYSNISPSLPPRTEIGFGNPQGIGTMDMYGASGDILRSISGPTEADKPIIIELAVAAMEELIGMAQMGDPLWLRTTPEGAATVLNEDEYVRSFPRGIGPKPNGFKCEASRESSVVIMNHVNLVEILMDVNQWSTVFAGIVSRAVTVEVLSTGVAGNYNGALQVMTAEFQVPSPLVPTRESYFVRYCKQHPDGTWAVVDVSLDNLRPSPSSRCRRRPSGCLIQEMPNGYSKVTWVEHVEVDERGVHNLYKQLVNTGDAFGAKRWVATLDRQCERLASSMATNIPTVDVGVITNQEGRKSMLKLAERMVISFCGGVSASTAHTWTTLSGTGADDVRVMTRKSVDDPGRPPGIVLSAATSFWLPVPPTQVFEFLRNENSRTEWDILSNGGVVQEMAHIANGRDTGNCVSLLRVNSPNSSQSNMLILQESVTDATGSFVIYAPVDMVAMNVVLNGGDPDYVALLPSGFAILSDGNGNGVGGETGGGVGAGAGGGGSLLTVAFQILVDSTPTAKLSLGSVATVNSLIACTVERIKASLSGESA

SEQ ID NO: 21872 - protein, 227 aa, Glycine max
MASSSPSSLSLDTAKDLSHSFSEVHVIIGPMFAGKTTALLRRIKSELNAANNVALLKSSKDTRYAIDSVVTHDGIKFPCWALPDLLSFREKYGEDAYQKLDVIGIDEAQFFVDLYEFCCKAADEDGKTVIVAGLDGDYLRRSFGSVLHIIPLAESVTKLTARCELCGKRAFFTLRKTEQRETELIGGADVYMPVCRLHYINSQVAERSVLESENEKTDSLLEAATDV

SEQ ID NO: 21873 - protein, 227 aa, Glycine max
MASSSPSSLSLDTAKDLSHSFSEVHVIIGPMFAGKTTALLRRIKSELNAANNVALLKSSKDTRYAIDSVVTHDGIKFPCWALPDLLSFREKYGEDAYQKLDVIGIDEAQFFVDLYEFCCKAADEDGKTVIVAGLDGEYLRRSFGSVLHIIPLAESVTKLTARCELCGKRAFFTLRKTEQRETELIGGADVYMPVCRLHYINSQVAERSVLESENEKTDSLLEAATDV

SEQ ID NO: 21874 - protein, 224 aa, Phaseolus vulgaris
MASSFSLSPDSKALSHSSGEVHVIVGPMFAGKTTALLRRIKSELNAARNVVMLKSSKDTRYATDSVVTHDGIKFPCWALPNLLSFREKYGHDAYQKLDVIGIDEAQFFEDLYEFCCKAADEDGKTVIVAGLDGDYLRRSFGSVLHIIPLADSVTKLTARCELCGKRAFFTLRKTEHQETELIGGADVYMPVCRLHYMNSQVAERIVLQSQAVKTDSLLEPTADV

SEQ ID NO: 21875 - protein, 205 aa, Vigna unguiculata
MAYSSSSLSLSPDTKDLSHPSGEVHVIVGPMFAGKTTALLRRIKSELNAVRNVVMLKSSKDTRYAIDSVVTHDGVKFPCWALPNLLSFREEYGHDAYQKLDVIGIDEAQFFEDLYEFCCKAADEDGKTVIVAGLDGDYLRRSFGSVLHIIPLADSVTKLTARCEVCGKRAFFTLRKTEDQETELIGGADVYMPVCRMHYMNSQVA

SEQ ID NO: 21876 - protein, 221 aa, Cajanus cajan
MASSSVSFDAAKDTFGEVHVIVGPMFAGKTTALLRRIKSELNAKRSVTLLKSSKDTRYAIDSVVTHDGVKFPCWALPDLLSFRDKYGHDAYQKLDVIGIDEAQFFDDLYEFCCKAADEDGKTVIVAGLDGDYLRRSFGSVLHIIPLADSVTKLTARCELCGKRAFFTLRKTEQRETELIGGADLYMPVCRLHYMNNQVAEKCVVQSQNVKSDSLLEAIADV

SEQ ID NO: 21877 - protein, 277 aa, Glycine max
MFSGSQFDATTAFSGGGFMSSQPSTLNDSSPAPSKSRETQGLVPVTVKQISEASQSGDEKSNFVINGVDLNNVTLLGMVFEKVERNTDVNFVLDDGTGRIKCRRWVNEAFDTKEMEAVMNGMYVRVYGHLKSFQGVKQLVTFSARPVTNFDEIPFHFIDCIHNHLRSKIKMEGITSSNPSSGSSLNTPGKSAPNGSQAPSSNPVSAQHSVDGLKGIDKLIMDYLEQHSDMSDGRGIHVDELSRELKLPMEKIKLSLKTLADDGEIYSTIDDDHYKKA

SEQ ID NO: 21878 - protein, 331 aa, Glycine max
MSTTVQRTPRSSRHSLFFQDLASPVSARRGKFSSPGQAAAVSSLWRENFGSSDLPPPPVFTLEDRSDFSPESGILDYQISPEAKSDTRTPIQTSNKEFSTPLKSKSEASTSYALRGVQQNQQGSPGLSWWSPTTAKSVGEQDEKGRSSPVEGVVQPGALITLPPPLEVARPEVQRNSLPAGNLNEEEWVTVYGFSPGDTNMVLREFEKCGEILKHVPGPRDANWVHILYQNRSDAHKALNKNGMQINGVLIVGVKLLDPMQRQALNERLKNQGFMPLPLASARNSEVSTLKAPSRPYYLQNGNSTARQTGGTIASPTKSLVSKIMDLMFGV

SEQ ID NO: 21879 - protein, 331 aa, Vigna unguiculata
MSTTVQRTPRSGRQSLFFQDLASPVSTRRGKVSSPGQAAAVSALWRENFGSSDLPPPPVFTLEDRSDFSPESGILDYQVSPEIKSDTRTPIQTSNREFSTPGKSKSEASTSYALRGVQQNQQTSPGLSWWSPATAKSVGEQDEKGKSSPVEGVVQPGALITLPPPLEVARPEVQRNSLPAGNLNEEEWVTVYGFSPGDTNMVLREFEKCGEILKHVPGPRDANWLHILYQNRSDAHKALNKNGMQINGVLIVGVKLLDPMQRQALNERVNNQGFMPLPLPSARNSEVSTLKAPTRPYYQQNGNSTARQTGGTIASPTKSLVSKIMDLMFGV

SEQ ID NO: 21880 - protein, 329 aa, Cajanus cajan
MSTTVQRTPRSGRQSLFFQDLASPVSACRGKFSSPGQAAAVSALWRENTSDLPPPPVFTLEDRSDFSPESGILDYQMSPEPKSDNKTPIQTSNREFSTPVKSKSEASTSYALRGLQQNQQGSPGLSWWSPTTAKSGGDRDEKGRSSPVEGVVQPGALITLPPPLEVARPEVQRNSLPAGNLNEEEWVTVYGFSPGDTNMVLREFEKCGEILKHVPGPRDANWMHILYQNRSDAQKALNKNGIQINGVLIVGVKLLDPMQRQALNERLNNQGFMPLPLPSTRNSEVSTLKAPSRPYYLQNGNSTARQTGGAIASPTKSLVSKIMDLMFGV

SEQ ID NO: 21881 - protein, 330 aa, Phaseolus vulgaris
MSTTVQRTPRSGRQSLFFQDLASPVSTRRGKTSSPGQAAAVSALWRENFGSSDLPPPPVFTLEDRSDFSPESGILDYQVSPEIKSDIRTPVQTYNREFSTPGKSKSEASTSYALRGVQQNQQASPGLSWWSPATAKSGGEQDEKGRSSPVEGVVQPGALITLPPPLEVARPEVQRNSLPTGNLNEEEWVTVYGFSPGDTNMVLREFEKCGAILKHVPGPRDANWMHILYQNRSDAHKALSKNGMQINGVLIVGVKLLDPMQRQALNERLNNQGFMPLPLPSARNSGVNTLKAPVRPYYPQNGNSARQTGGTIASPTKSLVSKIMDLMFGV

SEQ ID NO: 21882 - protein, 331 aa, Cicer arietinum
MSTTVQRTPRSGRQSLFFQDLASPVSSRRGKFPSPGQSGATSSLWRENFGNSDLPPPPVFTLEDRSDFSPESGILDYQISPETKSDNKTPTQTPNREFSTPAKGKSEASTSYALRGVQQNQQSSPGLNWWSPATAKSGGEQEEKGRSSPVEGVVQPGALITLPPPLEVARPEVQRNSLPAGNLNEEEWVTLYGFSPCDTNLVLREFEKCGEILKHVPGPRDANWMHILYQNRSGAQKALNKNGMQINGVLIVGVKPLDPMQRQALNERLNNQGFMPLPLPSGRNSEASTSKALSRPYYPQNGSSTTRQTGGTIASPTKSLASKIMDLMFGV

SEQ ID NO: 21883 - protein, 331 aa, Arachis hypogaea
MSTTVHKTPKSGRQTLFFQDLASPVSARRGKFSSPGQAAAVSALWRENFGGSDLPPPPVFTLEDRSDFSPESGLPDYQISPESKSNIRTPVQASNREFSTPLKSKSEASTSYVLRGVQQSQQSSPGLSWWSPTTAKSAGEQDEKGRSSPVEGVVQPGALITLPPQLEVARPEVQRNSLPAGNLNEEEWVTVYGFSPGDTNLVLREFEKCGEILKHVPGPRDANWMHILYQNRSDSQKALNKNGVQLNGVLIVGVKPLDPMQRQALDERLNHQGFMPLPLPSARNSESSTLKASSRPYYLQNGNSSARQTGGAIASPTKSLVSKIMDLMFGV

SEQ ID NO: 21884 - protein, 332 aa, Trifolium pratense
MNNTVQRTPRSGRQSLFFQDLASPISSRRGKFSSPGQSGASSSLWRENFGGNSDLPPPPVFTLEDRSDFSPESGILDYQISPETKSDNKTPVQTLNREFSTPAKGKSEASTSYALRGVQQNQQGSPGLNWWSPATAKSGGEQEEKGRSSPVEGVVQPGALITLPPPLEVARPEVQRNSLPAGNLNDEEWVTVYGFSPYDTNLVLREFEKCGEILKHVPGPRDANWMHILYQNRSAAQKALNKNGMQLNGVLIIGVKPVDPMQRQALTERLNNQGFMPLPLPSARNSEVSTSKAPSRPYYLQNGNATTRQTGGTIASPTKSLASKIMDLMFGV

SEQ ID NO: 21885 - protein, 329 aa, Trifolium pratense
MNNTVQRTPRSGRQSLFFQDLASPISSRRGKLSSPGASSSLWRENFGGNSDLPPPPVFTLEDRSDFSPESGILDYQISPETKSDNKTPVQTLNREFSTPAKGKSEASTSYALRGVQQNQQGSPGLNWWSPATAKSGGEQEEKGRSSPVEGVVQPGALITLPPPLEVARPEVQRNSLPAGNLNDEEWVTVYGFSPYDTNLVLREFEKCGEILKHVPGPRDANWMHILYQNRSAAQKALNKNGMQLNGVLIIGVKPVDPMQRQALTERLNNQGFMPLPLPSARNSEVSTSKAPSRPYYLQNGNATTRQTGGTIASPTKSLASKIMDLMFGV

SEQ ID NO: 21886 - protein, 332 aa, Trifolium pratense
MNNTVQRTPRSGRQSLFFQDLASPISSRRGKFSSPGQSGASSSLWRENFGGNSDLPPPPVFTLEDRSDFSPESGILDYQVSPETKSDNKTPVQTLNREFSTPAKGKSEASTSYALRGVQQNQQGSPGLNWWSPATAKSGGEQEEKGRSSPVEGVVQPSALITLPPPLEVARPEVQRSSLPAGNLNEEEWVTVYGFSPYDTNLVLREFEKCGEILKHVPGPRDANWMHILYQNRSAAQKALNKNGMQINGVLIIGVKPVDPIQRQSLTERLNNQGFMPIPLPSARNPEVSTSKAPTRPYYLQNGNATTRQTGGTIASPTKSLASQIMDLMFGV

SEQ ID NO: 21887 - protein, 337 aa, Trifolium pratense
MSYNNMNTTVQRTPRSGRQSLFFQDLASPISSRRGKFSSPGQSGASSSLWRENFGGNSDLPPPPVFTLEDRSDFSPESGILDYQISPETKSDNKTPVQTLNREFSTPAKGKSEASTSYALRGVQQNQQGSPGLNWWSPATAKSGGEQEEKGRSSPVEGVVQPGALITLPPPLEVARPEVQRNSLPAGNLNDEEWVTVYGFSPYDTNLVLREFEKCGEILKHVPGPRDANWMHILYQNRSAAQKALNKNGMQINGVLIIGVKPLDPIQRQSLTERLNNQGFMPIPLPSARNPEVSTSKAPTRPYYLQNGNATTRQTGGTIASPTKSLASQIMDLMFGV

SEQ ID NO: 21888 - protein, 330 aa, Medicago truncatula
MSTTAQRTPRSGRQSLFFQDLASPVNARRGKFSSPGQSGASSSLWRENFGNSDLPPPPFFTLEDRSDFSPESGILDYQMSPETKSDHKTPIQTPNREFSTPAKGKSEASTSYALRGVQQNQQGSLSLNWWSSPAKSGGEQEEKGRGSPVEGVVQPGALITLPPPPEVARPEVQRNSLPAGNLNEEEWVTVYGFSPNDTNLVLREFEKCGEILKHVPGPRDANWMHILYQNRSAAQNALNKNGIQINGVLIIGVKPLDPMQRQALTERLNNQGFMPLPLPTARNSEVSTSRAPSRPYYLQNGNATTRQTGGTIASPTKSFASKIMDLMFAV

SEQ ID NO: 21889 - protein, 337 aa, Trifolium pratense
MSYNNMNTTVQRTPRSGRQSLFFQDLASPISSRRGKFSSPGQSGASSSLWRENFGGNSDLPPPPVFTLEDRSDFSPESGILDYQVSPETKSDNKTPVQTLNREFSTPAKGKSEASTSYALRGVQQNQQGSPGLNWWSPATAKSGGEQEEKGRSSPVEGVVQPSALITLPPPLEVARPEVQRSSLPAGNLNEEEWVTVYGFSPYDTNLVLREFEKCGEILKHVPGPRDANWMHILYQNRSAAQKALNKNGMQINGVLIIGVKPLDPIQRQSLTERLNNQGFMPIPLPSARNPEVSTSKAPTRPYYLQNGNATTRQTGGTIASPTKSLASQIMDLMFGV

SEQ ID NO: 21890 - protein, 331 aa, Lupinus angustifolius
MSTTVQKTPRSGRQSLFFKDLASPVSTRRGKFSSPGQAAPASTPWRENFGGSDLPPPPFYTLEDRSDFSPESGIPDYQVSPETKSDPRSPIQSSNTEFSTPLKSKSEASTSYALRGVQQNHQDSPGLNWWSPVPAKSGSEQDDKGTSSPVEGVIQPGALITLPPPLEVARPEVQRNSFPAGNLNEEEWVTVYGFSPYDTNLVLREFEKCGEILKHVPGPRDANWIHILYQNRSDAQKALNKNGMQINGVLIVGVKPLDPMQRQSLNERQNNQEFMPLPLSSARISETNTLRASSRPYYLQNGNSAVRQAGGTIASPTKSLVSKVMDLMFGV

SEQ ID NO: 21891 - protein, 330 aa, Quercus alba
MSTTVQRTPRSGRQSLFFQDLASPVSARRGKFSSPGQAAAVSALWRENFAGSDLPPPPVFTLEDRSDFSPESGIPDYPLSPEAKSDPRTPVQSSGRDISTPGKNKSEASTSYALMGAQQNQQGSAGLNWWSPAKSGSEQEDKGKSSPVEGVVQPGALITLPPPREVARPEVQRNCLPTGDLNEEEWVTVYGFSPSDTNLVLREFEKCGVILKHVPGPREANWMHILYQNRFDAQKALSKNGMQINGVLIVGVKPLDPMQRQALSERVNNQGFMTLPPQPSTKSSELNTLKAPSRPYYLQNGSTNTRQSGGAIASPTKSLVSKIMDLMFGV

SEQ ID NO: 21892 - protein, 330 aa, Castanea mollissima
MSTTVQRTPRSGRQSLFFQDLASPVSAQRGKFSSPGRAAAVSALWRENFAGSDLPPPPVFTLEDRSDFSPESGIPDYPLSPEAKSDPRTPVQSSGRDISTPGKNKSEASTSYALMGAQQNQQSSAGLNWWSPAKSGSEQEDKGKSSPVEGVVQPGALITLPPPREVARPEVQRNCLPTGDLNEEEWVTVYGFSPSDTNLVLREFEKCGVILKHVPGPREANWMHILYQNRFDAQKALSKNGMQINGVLIVGVKPLDPMQRQALSERVNNQGFMTLPPQPSTKSSELNTLKAPSRPYYLQNGSTNTRQSGGAIASPTKSLVSKVMDLMFGV

SEQ ID NO: 21893 - protein, 504 aa, Glycine max
MQVTDVILLGLCLLFLRWWWRRWSTTGGGPKNLPPGPPGWPIVGNLFQVILQRRHFIYVIRDLHKKYGPIFTMQMGQRTLIIVSSAELIHEALIQRGPLFASRPKDSPIRLIFSVGKCAINSAEYGPLWRTLRKNFVTEMITPLRIKQCSWIRKWAMEAHMRRIQQEAREQGFVQVMSNCRLTICSILICICFGAKIEEKRIKSIESILKDVMLITLPKLPDFLPVFTPLFRRQVKEAEELRRRQVELLAPLIRSRKAYVEGNNSDMASPVGAAYVDSLFGLEVPGRGRLGEEELVTLVSEIISAGTDTSATALEWALLHLVMDQEIQERLYREIVGCVGKDGVVTESHVEKMPYLSAVVKETFRRHPPSHFVLSHAATEETKLGGYTVPKEASVEFYTAWLTEDPSMWEDPNEFRPERFMSGDGVDVDVTGTKGVRMMPFGVGRRICPAWTMGILHINMLLAKMVHAFHWLPNPNSPPDPTETFAFTVVMNNPLKPLIVPRSI

SEQ ID NO: 21894 - protein, 506 aa, Phaseolus vulgaris
MHLNDLLLLAFAFLFLCWWWRRCTTTGGGPKNLPPGPPGWPIVGNLFQVILQRRHFIYVIRDLRKKYGPIFTMQMGQRTLIIVTSADLIHEALIQRGPLFASRPQDSPIRLIFSMGKCAINSAEYGPLWRTLRKNLVTEMITPLRIKQCGWIRKWAMEAHMSRIQKEAREQGFVEVMSNCRLTICSILICLCFGAKIEERRIKSIESILKDVMLITLPKLPDFLPVFTPLFRRQVKEARELRKRQVELLAPLIRSRKAYVEGSFSGSEMASPVGAAYVDSLFELEVPGRGRLGEEELVTLVSEIISAGTDTSATAVEWALFHLVTDQEIQERLYKEIVECVGKEGVVKESDVERMPYLSAVVKETFRRHPPSHFVLSHAATEDTKLGGYTVPKNASVEFYTAWLSEDPNMWEDPNEFRPERFLSGDGVDVDVTGTKGVRMMPFGIGRRICPAWTLGILHINLLLAKMVQAFHWLPNPNSPPDPAETFAFTVVMKNPLKAVIVPRSI

SEQ ID NO: 21895 - protein, 508 aa, Cajanus cajan
MQLITDLILLALAFLFLRCWWRYCSTTGAGPKNLPPGPPGWPVVGNLFQVILQRRHFIYVVRDLRKKYGPIFSMQMGQRTLIIVTSADLIHEALIQRGPQFASRPKDSPIRLLFSMGKCAINSAEYGPLWRTLRRNFVSEMISPLRIKQCGWIRKWAMEAHMRRIQKEARELGLVEVMSNCRLTICSILICLCFGAKIEENRIKSIESILKDVMLITLPKLPDFLPVFTPLFRRQVKEAKDLRKRQVELLAPLIRNRKAYVQGKFEGAHMASPVGAAYVDSLFGLEVPGRGRLGEEELVTLVSEVISAGTDTSATALEWALLHLVMDQEIQERLYREIVECVGKDGVVTESDVEKMPYLSAVVKETFRRHPPSHFVLSHAATEETKLGGYTIPKEASVEFYTAWLTEDPNMWKDPNEFRPERFLTGDGVDVDVTGTKGVKMMPFGIGRRICPAWSLGILHINLLLAKMVHAFHWLPIPNNPPDPTETFAFTVVMKNPLKAVIVPRSIY

SEQ ID NO: 21896 - protein, 508 aa, Cicer arietinum
MELVDIIMLFFALAFLRWWWRRWSKTGGGAKNLPPGPPGWPIVGNLFQVILQRRPFIYVVRDLREKYGPIFTMQMGQRTLIIVTSSNLIHEALIQRGPQFASRPKDSPIRLIFSMGKCAINSAEYGPLWRSLRRNLVTEMISPLRVKQCSWIRKWAMEAHMKRIQQEAHKNGFVEIMSNCRLTICSILICLCFGAKITEERIRKIESVLKDVMLITLPKLPDFLPVLTPLFRGHVKEARKLRKIQVELLAPLIRKRKAYVESDGKCGDPEMVSPVGAAYVDSLFALEVPGRGKLGEEELVTLVSEIMSAGTDTSATAVEWALLHLVMDQEIQERLYREIVDCVGKCGVILESDVEKMHYLGAIVKETFRRHPPSHFVLSHAATEETELGGYTVPADASVEFYTAWLTEDPNMWEDPNEFRPERFLNGDGVDVDVTGTKEVKMMPFGVGRRICPAWTLGILHINMLLAKMVLAFRWLPVPNSPPDPTETFAFTVVMKNPLKAVIVPRSI

SEQ ID NO: 21897 - protein, 512 aa, Lupinus angustifolius
MELIDILLLFFTFLFLLWWWRFCSATTHKGSKNLPPGPPGWPIVGNLFQVILQRRHFIYVIRDLRKIYGPIFTMQMGQRTLIIVTSADLIHEALIQRGPLFASRPKDSPIRLIFSMGKCAINSAEYGPLWRSLRRNFVTEMISPLRIKQCSWIRKWAMEGHMRRIEEEARDKGFVEVMSNCRLTICSILICLCFGAKITEDRIKSIESILKDVMLVTLPKLPDFLPVLTPLFQKQVREAKKLRKKQVELVAPLIRSRKEYVESNGKLENDEMVSPVGAAYVDSLFELEVPSRGRLGEEELVTLVSEIISAGTDTSATAVEWALLHLVMEQKIQERLYSEIVECVGKNGEVLERHVEKMAYLGAVIKETFRRHPPSHFVLSHAATSETELGGYRIPKDASVEFYTAWLSENPEMWEDPNEFRPERFLNGDGVDVDITGTKGVKMMPFGVGRRICPAWTLGVLHINMLLAKMVLAFKWLPIPNSPPDPTETFAFTVVMKNPLKALIVPRSIYPS

SEQ ID NO: 21898 - protein, 508 aa, Lotus japonicus
MELLDILMLLLAIVFLCWWWRYWSTTGGGAKNLPPGPPGWPIVGNLFQVVFQRRHFIYVVRDLRKKYGPIFTMQMGQRRLIIVTSSDLIHEALIQRGPQFASRPKDSPIRLIFSMGKCAINSAEYGPLWRSLRRNFVTEMISPLRIKQCSWIRKWATEAHMRRIQQEARDLGFVEVMSNCRLTICSILICLCFGAKITEERIRSIESVMKDVMLMTLPKLPDFLPILTPLFRRQVEEAKKLRKTQVELLAPLIRKRKSYVESDGKLRDPEMVSAVGAAYVDSLFALEVPDRGRLGEEELVTLVSEVISAGTDTSATAVEWALLHLVMDQGIQEKLYKEIVGCVGKGGDVKEADVEKMPYLSAIVKETFRRHPPSHFVLSHAATEETELGGYTVPKDASVEFYTAWLSEDPDMWEDPDEFRPERFLIGDGVDADITGTKAVRMMPFGAGRRICPAWTLGVLHINMLLAKMVLAFQWLPVPGAPPDPSETFAFTVVMKNPLKAVIIPRSI

SEQ ID NO: 21899 - protein, 508 aa, Trifolium pratense
MELIDFIMLFFALAFFRWWWHRWSKIGGGAKNLPPGPPGWPIVGNLFQVILQRRPFMYIVRDLRLKYGPIFTMQMGQRTLIIVTSADLIHEALIQRGPQFASRPKDSPIRLIFSMGKCAINSAEYGPLWRSLRRNLVSEMISPLRVKQCSWIRKWAMEAHMRRIQREAQENGFVEVMSNCRLTICSILICLCFGAKITEERIRDIESVLKEVMLITLPKLPDFLPVLTPLFRGHVKEARKLRKKQVELIAPLIRNRKAYVDSDGKCGDPEMVSPIGAGYVDSLFGLEVPGRGRLGEEELVTLVSEIISAGTDTSATAIEWALLHLVMDQDIQERLYREIVGCVGKCGVVMDSDVEKMPYLGAIVKETFRRHPPSHFVLSHAATEETKLGGYTVPADASVEFYTAWLSENPDMWKDPDEFRPERFLNGDGVDVDITGTKEVKMMPFGAGRRICPAWTLGTLHINMLLAKMVLAFRWLPVPNSPPDPTETFAFTVVMKNPLKAVIVPRSI

SEQ ID NO: 21900 - protein, 508 aa, Trifolium pratense
MELIDFIMLFFALAFFRWWWHRWSKTGGGAKNLPPGPPGWPIVGNLFQVILQRRPFMYIVRDLRLKYGPIFTMQMGQRTLIIVTSADLIHEALIQRGPQFASRPKDSPIRLIFSMGKCAINSAEYGPLWRSLRRNLVSEMISPLRVKQCSWIRKWAMEAHMRRIQNEAHENGFVEVMSNCRLTICSILICLCFGAKITEERIRDIESVLKEVMLITLPKLPDFLPVLTPLFRGHVKEARKLRKKQVELIAPLIRNRKAYVDSNGKCGDPEMVSPIGAGYVDSLFGLEVPGRGKLGEEELVTLVSEIISAGTDTSATAIEWALLHLVMDQEIQERLYSEIVGCVGKCGVVMDSDVEKMPYLGAIVKETFRRHPPSHFVLSHAATEETKLGGYTVPADASVEFYTAWLTENPDMWKDPDEFRPERFLNGDGVEVDITGTKEVKMMPFGAGRRICPAWTLGTLHINMMLAKMVLAYRWLPVPNSPPDPTETFAFTVVMKNPLKAVIVPRSI

SEQ ID NO: 21901 - protein, 508 aa, Trifolium pratense
MELIDFIMLFFALAFFRWWWHRWSKIGGGAKNLPPGPPGWPIVGNLFQVILQRRPFMYIVRDLRLKYGPIFTMQMGQRMLIIVTSADLIHEALIQRGPQFASRPKDSPIRLIFSMGKCAINSAEYGPLWRSLRRNLVSEMISPLRVKQCSWIRKWAMEAHMRRIQREAHENGFVEVMSNCRLTICSILICLCFGAKITEERIRDIESVLKEVMLITLPKLPDFLPVLTPLFRGHVKEARKLRKKQVELIAPLIRNRKAYVDSDGKCGDPEMVSPIGAGYVDSLFGLEVPGRGRLGEEELVTLVSEIISAGTDTSATAIEWALLHLVMDQEIQERLYREIVGCVGKCGVVMDSDVENMPYLGAIVKETFRRHPPSHFVLSHAATEETKLGGYTVPADASVEFYTAWLSENPDMWKDPDEFRPERFLNGDGVDVDITGTKEVKMMPFGAGRRICPAWTLGTLHINMLLAKMVLAFRWLPVPNSPPDPTETFAFTVVMKNPLKAVIVPRSI

SEQ ID NO: 21902 - protein, 151 aa, Glycine max
MGSDSEAEKEKKKMLALAPIAKPLAGKKLCKRTLKLVRRAAEHKCLKRGVKEVVKSIRRGHKGLCVIAGNISPIDVITHLPILCEDSDIPYIYVPSKEDLAGAGATKRPTCCVLVQTKPAKGEIEQGEQEKLKSDYDQVVSEVTELTTSLF

SEQ ID NO: 21903 - protein, 157 aa, Cyamopsis tetragonoloba
MGSDSEAEKSVQKEKERKKMLALAPIAKPLAGKKLCKRTLKLVRRAAEHKCLKRGVKEVVKSIRRGHKGLCVIAGNISPIDVITHVPILCEESDIPYIYVPSKEDLATAGATKRPTCCVLVMTKPAKGELEQGAQEKLKSDYDQVASEVNELTASLF

SEQ ID NO: 21904 - protein, 157 aa, Glycyrrhiza uralensis
MGSDSEGEKSVQKEKERKKMLALAPIAKPLAGKKLCKRTLKLVRRAAEHKCLKRGVKEVVKSIRRGHKGLCVIAGNISPIDVITHVPILCEESDIPYVYVTSKEDLATAGATKRPTCCVLVMTKPAKGEIEQGEQEKLKSDYDQVVSDVTELTSTLF

SEQ ID NO: 21905 - protein, 151 aa, Glycine max
MGSDSEAEKEKKKMLALAPIAKPLAGKKLCKRTLKLVRRAAEHKCLKRGVKEVVKSIRRGHKGLCVIAGNISPIDVITHLPILCEDSDIPYIYVPSKEDLAGAGATKRPTCCVLVQTKPVKGEIERGEQEKLKSDYDQVVSEVTELTTSLF

SEQ ID NO: 21906 - protein, 158 aa, Phaseolus vulgaris
MGGSDSEVEKSAQKEKEKKKMQALAPIAKPLAGKKLCKRTLKLVRRAAEHKCLKRGVKEVVKSIRRGQKGFCVIAGNISPIDVITHVPVLCEESDIPYVYVPSKEDLAGAGATKRPTCCVLVQTKPTKGELEQGEQEKLKSDYDQVVSEVTELTASLF

SEQ ID NO: 21907 - protein, 156 aa, Cajanus cajan
MGSDSEAEKSAQKEKEKKILALSPIAKPLAGKKLCKRTLKLVRRASQHKCLKRGVKEVVKSIRRGQKGLCVIAGNISPIDVITHVPILCEEADIPYIYVPSKEELAGAGATKRPTCCVLVTTKPAKGEIEQGEQEKLKSDYDQVVSEVSEVTASLF

SEQ ID NO: 21908 - protein, 156 aa, Cajanus cajan
MGSDSEAEKSAQKEKEKKILALSPIAKPLAGKKLCKRTLKLVRRASQHKCLKRGVKEVVKSIRRGQKGLCVIAGNISPIDVITHVPILCEEADIPYIYVPSKEELAGAGATKRPTCCVLVMTKPAKGEIEQGEQEKLKSDYDQVVSEVSEVTASLF

SEQ ID NO: 21909 - protein, 155 aa, Vigna unguiculata
MGSDSEAERSAVKEKKKTQSLAPIAKPLAGKKLCKRTLKLVRRAAEHKCLKRGVKEVVKSIRRGHKGFCVIAGNISPIDVITHVPVLCEESDIPYIYVNSKEDLAGAGATKRPTCCVLVQTKPAKGELEQAEQEKLKSDYDQVVAEVKELAASLF

SEQ ID NO: 21910 - protein, 157 aa, Lotus japonicus
MGSDSEGEKSVQKEKERKKLLAVAPIAKPLAGKKLCKRTLKLVRRAAEHKCLKRGVKEVVKSIRRGHKGLCVIAGNISPIDVITHVPVLCEESDVPYVYVTSKEDLASAGATKRPTCCVLVLTKPAKGEMEKGEQEKLKSDYDQVVSDVTEITASLF

SEQ ID NO: 21911 - protein, 157 aa, Arachis hypogaea
MGSDSEAEKSAHKEKERKKMLALAPIAKPLAGKKLCKRTLKLVRKAAEHKCLKRGVKEVVKSIRRGHKGVCVIAGNISPIDVITHVPILCEEADIPYVYVPSKEDLASAGATKRPTCCVLVMTKPAKGELEKGEQEKLKSDYDQVVTEINEIAASLF

SEQ ID NO: 21912 - protein, 157 aa, Arachis hypogaea
MGSDSEAEKSAHKEKERKKMLALAPIAKPLAGKKLCKRTLKLVRKAAEHKCLKRGVKEVVKSIRRGHKGVCVIAGNISPIDVITHVPILCEEADIPYVYVPSKEDLASAGATKRPTCCVLVMTKPAKGELEKGEQEKLKSDYDQVVTEINEIAATLF

SEQ ID NO: 21913 - protein, 157 aa, Amsonia hubrichtii
MGSDSEAEKSAQKEKEKKKLLALAPIAKPLAGKKLCKRTLKLVRRAAENKCLKRGVKEVVKSIRRGNKGLCVIAGNISPIDVITHVPILCEDADIPYVYVPSKEDLANAGATKRPTCCVLVLTKPTKGVLGQEEQEKLKADYDQVVSEVKELATSVF

SEQ ID NO: 21914 - protein, 157 aa, Rosmarinus officinalis
MGSDSEAEKSAQKEKEKKKLLALAPIAKPLAGKKPCKRTFKLVRRAAENKCLKRGVKEVVKSIRRGNKGLCVIAGNITPIDVITHVPILCEDADIPYIYVPSKEDLASAGATKRPTCCVLVLTKPTKGELGQEEQEKLKSDYDQVVSDVKELATSVF

SEQ ID NO: 21915 - protein, 157 aa, Acacia harpophylla
MGSDTEAEKSVQKEKEKKKMLGLSPITKPLAGKKLCKRTLKLVRRASEHKCLKRGVKEVVKSVRRGHKGLCVIAGNISPIDVITHLPILCEESEIPYIYVPSKEDLASAGVTKRPTCCVLVMTKPAKGELDKGEQEKLKSDYDQVVSEINEVNASLF

SEQ ID NO: 21916 - protein, 155 aa, Actinidia deliciosa
MGSDSEAEKSAQKEKKKVLALAPIAKPLAGKKLNKRIFKLVRRAAGHKCLKRGVKEVVKSIRRGNKGLCIIAGNISPIDVITHVPILCEESDIPYIYVPSKEDLANAGATKRPTCCVLVLTKPAKGELAQEEQEKLKSDYDQVVSDVSELASSLF

SEQ ID NO: 21917 - protein, 157 aa, Capsicum annuum
MGSDSEVEKSVQKEKERKKLLALAPIAKPLAGKKLSKRTFKLVRRAAEHKCLKRGVKEVVKSIRRGQKGLCVIAGNISPIDVITHVPILCEEADIPYIYVPSKEDLANAGATKRPTCCVLVSTKPTKGELRQEDQEKLKEDYDQVVSEIREITASLF

SEQ ID NO: 21918 - protein, 159 aa, Cucumis melo
MGSDSEAEKSRQKDKEKEKKKLLALAPIAKPLAGKKLCKRTLKLVRKAAEYKCLKRGVKEVVKSIRRGQKGLCVIAGNISPIDVITHVPILCEESDIRYVYVPSKEDLANAGSTKRPTCCVLVQTKPNKGELGSTEQEKLKADFDQVVAEVSELTSTLF

SEQ ID NO: 21919 - protein, 159 aa, Citrullus lanatus
MGSDSEAEKSHQKDKEKEKKKRLALAPIAKPLAGKKLCKRTLKLVRKAAEYKCLKRGVKEVVKSIRRGQKGLCVIAGNISPIDVITHVPILCEESDIRYVYVPSKEDLANAGSTKRPTCCVLVQTKPNKGELGSTEQEKLKADFDQVVAEVSELTSTLF

SEQ ID NO: 21920 - protein, 157 aa, Cannabis sativa
MGSDSEVEKSHQKEKEKKKMQALAPIAKPLAGKKLCKRTLKLVRRAAEHKCLKRGVKEVVKSIRRGQKGVCVIAGNISPIDVITHVPILCEEAEIPYVYVPSKEDLANAGATKRPTCCVLVMTKPAKGELSPEELEKLKSDYDQVKTEVSELASTLF

SEQ ID NO: 21921 - protein, 158 aa, Lupinus angustifolius
MGGSDSEVEKTAQKEREKKKVLALAPIAKPLAGKKLSKRTLKLVRKAAEHKCLKRGVKEVVKSIRRGHKGLCVIAGNISPIDVITHVPILCEESEIPYVYVHSKEELATAGATKRPTCCVLVTTKPAKGELDQGEQEKLKSDYDQVAAEISEITASLF

SEQ ID NO: 21922 - protein, 157 aa, Coffea canephora
MGSDSEAEKTAQKEKDKKKLAGLAPIAKPLAGKKLCKRTLKLVRRAAEHKCLKRGVKEVVKSIRRGNKGLCVIAGNISPIDVITHVPILCEESDIPYIYVPSKEDLANAGTTKRPTCCVLVLTKPTKGELGQEEQEKLKAEYDQVTSDVTELANSMF

SEQ ID NO: 21923 - protein, 157 aa, Euonymus alatus
MGSDSEAEKSLKQEKEKKKVLALAPIAKPLAGKKLCKRTLKLVRKAAEQKCVKRGVKEVVKSIRRGNKGLCVIAGNISPIDVITHVPILCEEADIPYIYVPSKEDLANAGATKRPTCCVLVQTKPTKLELGQEVQEKLKADYDQVVSDVNELAASLF

SEQ ID NO: 21924 - protein, 157 aa, Humulus lupulus
MGSDSEVEKSHQKEREKKKMQALAPIAKPLAGKKLCKRTLKLVRRAAEHKCLKRGVKEVVKSIRRGQKGVCVIAGNISPIDVITHVPILCEEAEIPYVYVPSKEDLANAGATKRPTCCVLVMTKPAKGELSSEELEKLKSEYDQVKAEVSELAATLF

SEQ ID NO: 21925 - protein, 157 aa, Ipomoea batatas
MGSDSETEKSAQKEREKKKVLALAPIAKPLAGKKLSKRTFKLVRRAAELKCLKRGVKEVVKSIRRGHKGFCVIAGNISPIDVITHVPILCEESDIPYVYVASKEDLANAGATKRPTCCVLVLTKPAKGELSPEDQEKLKGDYDQAVAEVRELTSSMF

SEQ ID NO: 21926 - protein, 157 aa, Rosmarinus officinalis
MGSDSEVEKSAQKEREKKKLLALAPIAKPLAGKKLCKRTLKLVRRAAEHKCLKRGVKEVVKSIRRGNKGICVIAGNISPIDVITHVPILCEEADIPYVYVPSKEDLANAGATKRPTCCVLVSTKPAKGEIGQEEQEKLKGEYDQVASDISELANTMF

SEQ ID NO: 21927 - protein, 154 aa, Amorphophallus konjac
MGSDSETEKSVKDKKKLTALAPIAKPLAGKKLCKRTFKLVRRAAEHKCLKRGVKEVVKSIRRGHKGLCVIAGNISPIDVITHVPILCEESDVPYIYVPSKEDLATAGATKRPTCCVLVLTKPTKGDMGQEEQEKLKSDYAQVEAEVKELAAFLY

SEQ ID NO: 21928 - protein, 157 aa, Theobroma cacao
MGSDSEVEKTQQKEKERKKMLAVAPIAKPLAGKKLSKKTLKLVRRAAEHKCLKRGVKEVVKSIRRGHKGLCVIAGNISPIDVITHVPILCEEADIPYVYVPSKEDLATAGATKRPTCCVLVLTKPTKGELGPEDQEKIKADYSQIVADVTELTTTLF

SEQ ID NO: 21929 - protein, 157 aa, Manihot esculenta
MGSDSEAERSQKQEKDKKKILALSPIAKPLAGKKLCKRTLKLVRQAAEHKCLKRGVKEVVKSIRRGHKGLCVIAGNISPIDVITHVPILCEESDIPYVYVPSKEDLANAGATKRPTCCVLVLTKPPKGELVQEEQEKLKEDFSQVAADVSELNSSLF

SEQ ID NO: 21930 - protein, 158 aa, Cucumis sativus
MGSDSEAEKSRLKDKEKEKKLLALAPIAKPLAGKKLCKRTLKLVRKAAEYKCLKRGVKEVVKSIRRGQKGLCVIAGNISPIDVITHVPILCEESEIRYVYVPSKEDLANAGSTKRPTCCVLVQTKPNKGELGSTEQEKLKADFDQVVAEVSELTSTLF

SEQ ID NO: 21931 - protein, 157 aa, Euonymus alatus
MGSDSEAEKSLKQEKEKKKVLALAPIAKPLAGKKLCKRTLKLVRKATEQKCVKRGVKEVVKSIRRGNKGLCVIAGNISPIDVITHVPILCEEADIPYIYVPSKEDLANAGATKRPTCCVLVQTKPTKGVLGQEVQEKLKADYDQVVSDVNELAASLF

SEQ ID NO: 21932 - protein, 157 aa, Sarracenia psittacina
MGSDSEAEKTAQKEKEKKKMLALAPIAKPLAGKKLCKRTLKLVRRAAEQKCLKRGVKEVVKTIRRGNKGFCVIAGNISPIDVITHLPILCEEADIPYVYVPSKEDLANAGATKRPTCCVLVLTKPTKGEISQEEQEKLKADYDAVVTDASELASSMF

SEQ ID NO: 21933 - protein, 157 aa, Tripterygium wilfordii
MGSDSEAEKSQKQEKERKKVIALAPIAKPLAGKKLCKRTLKLVRKAAEQKCVKRGVKEVVKSIRRGNKGLCVIAGNISPIDVITHVPILCEESEIPYIYVPSKEDLANAGATKRPTCCVLVLTKPTKGQLGQEEQEKLKADYDQVVSDVSELTSSLF

SEQ ID NO: 21934 - protein, 158 aa, Gossypium hirsutum
MGSDSEAEKSQQRKEKEKKKMLAVAPIAKPLAGKRLCKKTFKLVRKAAEHKCLKRGVKEVVKSIRRGHKGLCVIAGNISPIDVITHVPILYEEADIPYVYVPSKEDLATAGATKRPTCCVLVLTKPTKGELDPSEQEKIKADYSQVVADISELTSSLF

SEQ ID NO: 21935 - protein, 157 aa, Manihot esculenta
MGSDSETERSQKQEKDKKKILALSPIAKHLAGKKLCKRTLKLVRRAAEHKCLKRGVKEVVKSIRRGHKGLCVIAGNISPIDVITHVPILCEEADIPYIYVPSKEDLANAGATKRPTCCVLVLTKPTKGELAQEEQEKLKAELSQVAADVSELTSSLF

SEQ ID NO: 21936 - protein, 157 aa, Ricinus communis
MGSDSEAERSHKHEKEKKKIIALSPIAKPLAGKKLCKRTLKLVRKAAEHKCLKRGVKEVVKSIRRGHKGLCVIAGNISPIDVITHVPILCEEADIPYVYVPSKEDLANAGVTKRPTCCVLVLTKPPKGEIPQEEQEKLKADFSQVAADVSELASSLF

SEQ ID NO: 21937 - protein, 156 aa, Castanea mollissima
GSDSEAEKTQQKEKERKKLLALAPIAKPLAGKKLCKRTLKLVRRAAEHKCLKRGVKEVVKSIRRGHKGLCVIAGNISPIDVITHVPVLCEEADIPYIYVTSKEDLANAGATKRPTCCVLVLTKPTKGELGAEEQEKLNEDYKQVAAEVSELASTIF

SEQ ID NO: 21938 - protein, 157 aa, Sarracenia psittacina
MGSDSEAEKTAQKEKEKKKMLALAPIAKPLAGKKLCKRTLKLVRRAAEQKCLKRGVKEVVKTIRRGNKGFCVIAGNISPIDVITHLPILCEEADIPYVYVPSKEDLANAGATKRPTCCVLVLTRPTKGEISQEEQEKLKADYDAVVTDASELASSMF

SEQ ID NO: 21939 - protein, 158 aa, Eucalyptus grandis
MGSDTEAERAQKEKEKERKKVAALAPIAKPLAGKKLCKRTLKLVRRAAEQKCLKRGVKEVVKSIRRGHKGLCVIAGNISPIDVITHVPILCEENDISYIYVPSKEDLANAGATKRPTCCVLVLTKPTKGELGPEEQEKIKADYDQVVTEVSELTSTLF

SEQ ID NO: 21940 - protein, 157 aa, Vinca minor
GSDSEAEKSAQKEKESKKKISALAPIAKPLAGKKLCKRTMKLVRKATENKCLKRGVKEVVKSIRRGNKGLCVIAGNISPIDVITHVPVLCEDADIPYIYVPSKEDLANAGATKRPTCCVLVLTKPTKGELGQEEQEKLKADYDQVVSEVKELATSVI

SEQ ID NO: 21941 - protein, 157 aa, Catharanthus roseus
MGSDSETEKSAHKEKDKKKLSALAPIAKPLAGKKLSKRTFKLVRRAAENKCLKRGVKEVVKSIRRGNKGLCVIAGNISPIDVITHVPVLCEDSDIPYIYVTSKEDLASAGTTKRPTCCVLVLTKPTKGELSQEEQEKLKADYDQVVSEVKELATSVF

SEQ ID NO: 21942 - protein, 154 aa, Cocos nucifera
MGSDSETEKSIKEKKKMMAVATIAKPLAGKKLSKRTLKLVRRASEAKCLKRGVKEVVKSIRRGHKGLCVIAGNISPIDVITHVPILCEEADIPYIYVPSKEDLATAGVTKRPTCCVLVLTKPTKGELAQEVQEKLQADFDQVVAEVKELTSSLF

SEQ ID NO: 21943 - protein, 155 aa, Panax ginseng
MGSDSEAEKSAHKEKKKVLALAPIAKPLAGKKLSKRALKLVRRAAEQKCLKRGVKEVVKSIRRGNKGLCIIAGNISPIDVITHVPILCEEAEIPYIYVNSKEDLANAGATKRPTCCVLVLTKPTKGELSQEEQEKLKSDYDQVVSDVSELASSMF

SEQ ID NO: 21944 - protein, 157 aa, Prunus persica
  Sequence also found in Organisms: Prunus mume
MGSDSEVEKTAQKERERKKMQALAPIAKPLAGKKLCKRTLKLVRRAAENKCLKRGVKEVVKSIRRGQKGLCVIAGNISPIDVITHVPILCEEAEIPYLYVPSKEDLANAGATKRPTCCLLVMTKPSKGELGQEEQDKLKADYDQVVGDVSELQSSLF

SEQ ID NO: 21945 - protein, 154 aa, Vaccinium corymbosum
DSEAEKSAQKVKEKKLLLALAPIAKPLAGKKLSKRIFKLVRRAAGHKCLKRGVKEVVKSIRRGNKGLCVIAGNISPIDVITHVPILCEESDIPYIYVTSKEDLANAGATKRPTCCVLVLTKPAKGELAQEEQEKLKAEYDQVASDVTELASSMF

SEQ ID NO: 21946 - protein, 156 aa, Citrus clementina
  Sequence also found in Organisms: Citrus sinensis
MGSDSEAERTPHKDEKKKIVSLAPIAKPLAGKKLSKRTLKLVRRAAEHKCLKRGVKEVVKSIRRGHKGLCVIAGNISPIDVITHVPILCEESDIPYIYVASKEDLANAGATKRPTCCVLVLTKPTKGELGQEEQDKLKADYTLVVEDVKELASSLF

SEQ ID NO: 21947 - protein, 154 aa, Eucalyptus grandis
MGSDSEAERSQKEKKKMQALAPIAKPLAGKKLGKRALKLVRRAAEDKCLKRGVKEVVKSIRRGHKGVCVIAGNISPIDVITHVPILCEESDIPYIYVPSKEDLANAGATKRPTCCVLVLTKPTKGDLSAEKQDKLKAEYDQVVNDISELTSSLF

SEQ ID NO: 21948 - protein, 154 aa, Elaeis guineensis
MGSDSETEKCIKEKKKMMAVAPIAKPLAGKKLSKRTFKLVRRASEAKCLKRGVKEVVKSIRRGHKGLCVIAGNISPIDVITHVPILCEEADIPYIYVSSKEDLATAGVTKRPTCCVLVLTKPTKGELAQEVQEKLQGDYDQVAAEVKELTSSLF

SEQ ID NO: 21949 - protein, 157 aa, Petunia hybrida
MGSDSEVEKSAQKEREKKKVLALAPIAKPLAGKKLHKRIFKLVRRAAEKKCMKRGVKEVVKSIRRGQKGVCIIAGNISPIDVITHVPILCEEAEIPYIYVNSKEDLANAGATKRPTCCVLVQTKPAKGELSQEDQEKLKEDYDQVVTEVQEMASSMF

SEQ ID NO: 21950 - protein, 154 aa, Platanus occidentalis
MGSDSETEKSQKERKKMLALAPIAKPLAGKKLCKRTLKLVRKASESKCLKRGVKEVAKSIRRGNKGFCVIAGNISPIDVITHVPILCEEADIPYVYVPSKEDLATAGATKRPTCCVLVLTKPTKGELGQEEQENLKADYAQVVSDVAELTSSLF

SEQ ID NO: 21951 - protein, 155 aa, Populus trichocarpa
MGSDSETERSNIKEKKKITSLAPIAKPLAGKKLCKRTLKLVRKASESKCLKRGVKEVVKSIRRGHKGLCIIAGNISPIDVITHVPILCEESDIPYVYVTSKEDLASAGATKRPTCCVLVLTKPTKGEIGKEDQEKLKADYDQVVSDVSELTSSLF

SEQ ID NO: 21952 - protein, 155 aa, Solanum tuberosum
  Sequence also found in Organisms: Solanum phureja
MGSDSEVEKSGQKEKKKVFALAPIAKPLAGKKLNKRIFKLVRRAAEKKCLKRGVKEVVKSIRRGQKGVCVIAGNISPIDVITHVPILCEEAEIPYIYVSSKEDLANAGATKRPTCCVLVQTKPAKGELSQDDQEKLKTDYDQVVSEVGEMASSMF

SEQ ID NO: 21953 - protein, 155 aa, Chenopodium quinoa
MGSDSEAEKSAHKEKKKAIALAPIAKPLAGKKLCKRTYKLIRRAAEHKCLKRGVKEVVKSIRRGHKGICVIAGNISPIDVITHVPILCEESEIPYVYVPSKEDLASAGATKRPTCCVLVLNKPAKGELSQEDQEKLKSESEQVSSEIRELTSSMF

SEQ ID NO: 21954 - protein, 159 aa, Cicer arietinum
MGSDSEGEKSVQKEREKKKMLALSPIAKPLAGKKLSKKTLKLVRRAAENKCIKRGVKEVVKSIRRGQKGVCVIAGNISPIDVIAHVPVLCEEAEIPYVYVLSKEDLATATAGVTKRPTCCVLVMTKPSKGELEQGVQEKLKSEFDQVASEITELTTSLF

SEQ ID NO: 21955 - protein, 159 aa, Heritiera littoralis
MGSDSEAEKTQQEEKERKKMLAVAPIAKPLAGKKLCKRTFKLVRKAAEHKCLKRGVKEVVKSIRRGHKGLCVIAGNISPIDVITHVPILCEEADIPYVYVPSKEDLATAGDTKRPTCCVLVLTKPTKGELGPEEQEKIKADYSQIVADISELTSSPFFN

SEQ ID NO: 21956 - protein, 155 aa, Spinacia oleracea
MGSDSETEKSAHKEKKKAIALAPIAKPLAGKKLCKRTYKLIRRAAEQKCLKRGVKEVVKSIRRGHKGICVIAGNISPIDVITHVPILCEESEIPYVYVPSKEDLASAGATKRPTCCVLVLNKPAKGELSQEEQEKLKSESEQVSSEIRELTSSMF

SEQ ID NO: 21957 - protein, 157 aa, Antirrhinum majus
MGSDSEIEKSAQKERDKKKILALAPIAKPLAGKKLSKRTLKLVRRAAENKCLKRGVKEVVKSIRRGNKGVCVIAGNISPIDVITHVPILCEESNIPYVYVTSKEDLANAGATKRPTCCVLVMTKPAKGELAQEQQEKLKAEYDQVASDISELANSMF

SEQ ID NO: 21958 - protein, 157 aa, Gossypium hirsutum
  Sequence also found in Organisms: Gossypium raimondii
MGSDSEVEKTQQKEKERKKMLAIAPIAKPLAGKKLSKKTLKLVRKASEHKCLKRGVKEVVKSIRRGHKGLCVIAGNISPIDVITHVPILCEEAEIPYVYVSSKEDLATAGATKRPTCCVLVLTKPTKGELAIEEQEKMKADYSQIVSDVSELTSSLF

SEQ ID NO: 21959 - protein, 157 aa, Vitis vinifera
MGSDSEAERSAHKEKEKKKLSALAPIAKPLAGKKLCKRTLKLIRRAAEHKCLKRGVKEVVKGIRRGDKGFCVIAGNITPIDVITHVPILCEEADIPYVYVPSKEDLANAGSTKRPTCCVLVLTKPTKGELGQEEQEKLKAEYTQVVSDVSGLTSTLF

SEQ ID NO: 21960 - protein, 157 aa, Mimulus guttatus
MGSDSETERSAQKQREKKKLAALAPIAKPLAGKKLCKRTLKLVRLAAEHKCLKRGVKEVVKSIRRGNKGICVIAGNISPIDVITHVPILCEEVNIPYVYVPSKEDLANAGATKRPTCCVLVLTKPAKGELGQEEQEKLKGEHDLVATEITELANSMF

SEQ ID NO: 21961 - protein, 155 aa, Chenopodium quinoa
MGSDSETEKSAHKEKKKAIALAPIAKPLAGKKLCKRTYKLIRRAAEHKCLKRGVKEVVKSIRRGHKGICVIAGNISPIDVITHVPILCEESEIPYVYVPSKEDLASAGATKRPTCCVLVLNKPAKGELSQEDQEKLKSESEQVSSEIRELTSSMF

SEQ ID NO: 21962 - protein, 156 aa, Silene vulgaris
MGSDSETEKSHQKEKKKTPVTLAPIAKPLAGKKLCKRTFKLVRRAAEHKCLKRGVKEVVKSIRRGSKGVCVIAGNISPIDVITHVPILCEENDIPYIYVPTKEDLASAGATKRPTCCVLVLQKPTKGELSQEDQEKLKADYDQVASEARELASSMF

SEQ ID NO: 21963 - protein, 155 aa, Nicotiana tabacum
MGSDSEVEKSAQKEKKKLLALAPIAKPLAGKKLNKRIFKLVRRAAEKKCLKRGVKEVVKSIRRGQKGVCVIAGNISPIDVITHVPILCEEAEIPYVYVSSKEDLANAGATKRPTCCVLVQTKPAKGGLSQDDQEKLKADYDQVVSEVGEMASSMF

SEQ ID NO: 21964 - protein, 150 aa, Lupinus angustifolius
MGGSDSEVEKKKVLALAPIAKPLAGKKLSKHTLKLVRKAAQHKCLKRGVKEVVKSIRRGHKGLCVIAGNISPIDVITHVPILCEESEIPYVYVQSKEDLATAGATKRPTCCVLVMTKPTKGDLDQGEQEKLKSDYDQVAAEITEITASLF

SEQ ID NO: 21965 - protein, 157 aa, Solanum phureja
MGGSDSEVEKTAQKEERKKLMAIAPIAKPLAGKKLSKRTFKLVRRATEHKCLKRGVKEVVKSIRRGHKGLCVIAGNISPIDVITHVPLLCEEADIPYIYVPSKEDLASAGATKRPTCCVLVLTKPTKGELGQEDQEKLKEEYDQVVSEIHETTSSLF

SEQ ID NO: 21966 - protein, 156 aa, Eutrema halophilum
MGSDSEAEKVHLKEKKKVVALAPIAKPLAGKKLCKRTLKLVRTAAENKCVKRGVKEVVKSIRRGHKGVCVIAGNISPIDVITHVPILCEESNIPYVYVPSKEDLATAGATKRPTCCVLILTKPAKGELSPKIQEKLKTDYDQVVEDVKELASSTVY

SEQ ID NO: 21967 - protein, 155 aa, Aquilegia formosa
MESDSEAEKSAHKERKKIQALAPIAKPLAGKKLSKKTLKLVRKAAESKCLKRGVKEVVKSIRRGNKGLCVIAGNISPIDVITHVPILCEEADIPYVYVTSKEDLATAGATKRPTCCVLVLTKPTKGELAQEEQEKLKADYTQVVSDVSELTSTLF

SEQ ID NO: 21968 - protein, 157 aa, Gossypium hirsutum
MGSDSEAEKTQQKEKERKKMFAISPIAKPLAGKKLSKKTLKFVRKAAEHKCLKRGVKEVVKSIRRGHKGLCVIAGNISPIDVITHVPILCEEADIPYVYVPSKEDLATAGSTKRPTCCVLVLTKPTKGELSPEEQEKLKADYSHIVEDVSELTSSMF

SEQ ID NO: 21969 - protein, 154 aa, Fagopyrum esculentum
MGSDSETEKSGKDKKKVIALAPIAKPLAGKKLCKKTFKLVRKAAEHKCLKRGVKEVVKSIRRGNKGFCVIAGNISPIDVITHLPILCEEAEIPYIYVPSKEDLANAGATKRPTCCVLVMTKPTKGELAQDEQEKLKADYDQVVSDVREVAASLF

SEQ ID NO: 21970 - protein, 156 aa, Actinidia deliciosa
MGSDGEADKTAQKEREKKLLALAPIAKPLAGKKLCKRTFKLVRRAAEHKCLKRGVKEVVKSIPRGNKGLCVIAGNISPIDVITHLPILCEEADIPYIYVPAKEDLANAGATKRPTCCVLVQTKPTKGELAHEEQENLKADYDQVVSDLSDLAASMF

SEQ ID NO: 21971 - protein, 155 aa, Chenopodium quinoa
MGSDSETEKSAHKEKKKAIALAPIAKPLAGKKLCKRTYKLIRRAAENKCLKRGVKEVVKSIRRGHKGICVIAGNISPIDVITHVPILCEESEIPYVYVPSKEDLASAGATKRPTCCVLVLNKPAKGELCQEDQEKLKSESEQVSSEIRELTSSMF

SEQ ID NO: 21972 - protein, 155 aa, Nicotiana tabacum
MGSDSEVEKSAQKEKRKLLALAPIAKPLAGKKLNKRIFKLVRRAAEKKCLKRGVKEVVKSIRRGQKGVCVIAGNISPIDVITHVPILCEEAEIPYVYVSSKEDLANAGATKRPTCCVLVQTKPAKGELSQEDQEKLKADYDQVVSEIGEMASSMF

SEQ ID NO: 21973 - protein, 155 aa, Solanum lycopersicum
MGSDSEVEKSGQKEKKKVFALAPIAKPLAGKKLNKRIFKLVRRAAEKKCLKRGVKEVVKSIRRGQKGVCIIAGNISPIDVITHVPILCEDAEIPYIYVSSKEDLANAGATKRPTCCVLVQTKPAKGELSQEDQEKLKTDYDQVVSEVGEMASSMF

SEQ ID NO: 21974 - protein, 157 aa, Trigonella foenum-graecum
MGSDSEGEKSVQREKERKKMLALAPIAKPLAGKKLSKKTLKLVKRAAENKCIKRGVKEVVKSIRRGQKGVCIIAGNISPIDVITHVPILCENNQIPYVYVPSKEDLATAGATKRPTCCVLVMTKPSKGQLSQEVQEKLKSEYDQVAAECTELQSTLF

SEQ ID NO: 21975 - protein, 154 aa, Valeriana officinalis
MGSDSEADKSAQKEKKSFALAPIAKPLAGKKLSKRALKLVRRAAEKKCLKRGVKEVVKSIRRGNKGLCILAGNISPIDVITHLPILCEEAGIPYIYVNSKEDLANAGATRRPTCCVLVQTKPSKGEIAQEDQEKLKEDYDQVVSDVNELATSMF

SEQ ID NO: 21976 - protein, 158 aa, Plantago ovata
MGGSDSEIDKSAQKEREKKKILALAPIAKPLAGKKLCKKTLKLVRRAAENKCLKRGVKEVVKSIRRGNKGICVIAGNISPIDVITHVPILCEESDVPYVYVTSKEDLANAGATKRPTCCVLVQTKPTKGEIDQEKLEKLKGEYDQVASDISELANSMF

SEQ ID NO: 21977 - protein, 157 aa, Solanum tuberosum
MGGSDSEVEKTAQKEERKKLMAIAPIAKPLAGKKLSKRTFKLVRRATEHKCLKRGVKEVVKSIRRGHKGLCVIAGNIYPIDVITHVPLLCEEADIPYIYVPSKEDLASAGATKRPTCCVLVLTKPTKGELGQEDQEKLKEEYDQVVSEIHETTSSLF

SEQ ID NO: 21978 - protein, 158 aa, Fragaria vesca
MGSDSEMEKSHQKERERKKTQALAPIAKPLAGKKLGKRTLKLVRKAAEHKCLKRGVKEVVKSIRRGQKGLCVIAGNISPIDVITHVPVLCEEAEIPYVYVSSKEDLANAGATKRPTCCVLVITKPTKGELAHEEQEKLKAEYDQVAGEVSELYSSTLF

SEQ ID NO: 21979 - protein, 154 aa, Musa acuminata
MGSDSEVEKSVKERKKMMAVAPIAKPLAGKKLCKRTLKLVRRAAEAKCLKRGVKEVVKSVRRGQKGLCVIAGNISPIDVITHVPILLEEADIPYIYVPSKEDLAVAGVTKRPTCCVLVMTKPTKGELAQEVQEKLQGDFNQVAADVKEMASSLF

SEQ ID NO: 21980 - protein, 157 aa, Gossypium hirsutum
MGSDGEAEKTQQKEKERKKMLAISPIAKPLAGKKLSKKTLKFVRKAAEHKCLKRGVKEVVKSIRRGHKGLCVIAGNISPIDVITHVPILCEEADIPYVYVPSKVDLATAGSTKRPTCCVLVLTKPTKGELSPEEQLKLKADYSHIVEDVSELTSSLF

SEQ ID NO: 21981 - protein, 157 aa, Euphorbia peplus
MGSDSEAERSHKQDKEKKKVIALSPIAKPLAGKKLCKKTLKLVRRAAEHKCLKRGVKEVVKSIRRGHKGMCVIAGNISPIDVITHVPVLCEEAEIPYIYVPSKEDLANAGATKRPTCCVLVLTKPPKGELAQEDQEKIKAEFSQVTAEVAELTSAQF

SEQ ID NO: 21982 - protein, 154 aa, Fagopyrum esculentum
MGSDSETEKSGKDKKKVTALAPIAKPLAGKKLCKKTFKLVRKAAEHKCLKRGVKEVVKSIRRGNKGFCVIAGNISPIDVITHLPILCEEAEIPYIYVPSKEDLANAGATKRPTCCVLVMTKPTKGELAQDEQEKLKADYDQVVSDVGEVAASMF

SEQ ID NO: 21983 - protein, 156 aa, Linum usitatissimum
MGSDSETEKSQKKEKKTTPVTLAPIAKPLAGKKLCKRTFKLVRRAADNKCLKRGVKEVVKSIRRGNKGICIIAGNISPIDVITHVPILCEEAEVPYFYVPSKEDLATAGNTKRPTCCVLVQMKPAKGELAKEEQEKLKSDYDQVVADVSELSSSLF

SEQ ID NO: 21984 - protein, 156 aa, Linum usitatissimum
MGSDSEMEKSQKKEKKTTPVTLAPIAKPLAGKKLCKRTFKLVRRAADNKCLKRGVKEVVKSIRRGNKGICIIAGNISPIDVITHVPILCEEAEVPYFYVPSKEDLATAGNTKRPTCCVLVQMKPAKGELAKEEQEKLKSDYDQVVADVSELSSSLF

SEQ ID NO: 21985 - protein, 157 aa, Linum usitatissimum
MGSDGEGEKSQKREEKTKKAITLAPIAKPLAGKKLSKKTFKLVKRAAEHKCLKRGVKEVVKSIRRGHKGICIIAGNISPIDVITHVPILCEEAEIPYFYVSSKEDLATAGNTKRPTCCVLVQTKPPKGEIPKEEQEKLQSDYDQVVADVSELTTSLF

SEQ ID NO: 21986 - protein, 154 aa, Zingiber officinale
MGSDSENEKSLKDRKKLMAVAPIAKPLAGKKLCKRSLKLVRRAAEAKCLKRGVKEVVKSVRRGQKGLCIIAGNISPIDVITHVPILLEEADIPYIYVPSKEDLAVAGVTKRPTCCVLVTTKPTKGELTQDVQEKLQSDYNQVVADVKELTASLF

SEQ ID NO: 21987 - protein, 157 aa, Triphysaria pusilla
MGSDSETEKSSHKEREKKKISALAPIAKPLAGKKLSKRTLKLVRRAAEHKCLKRGVKEVVKSIRRGNKGLCVIAGNISPIDVITHVPILCEESDIPYIYVQSKEDLANAGATKRPTCCVLVLQKPTKGELGQEDQEKLKGEYEQVASDISEVVNSSI

SEQ ID NO: 21988 - protein, 160 aa, Cleome spinosa
MGSDSEAERSQMKEKEKEKKKKVLALAPIAKPLAGKKLYKRTLKVVRTAAENKCLKRGVKEVVKSIRRGNKGLCVIAGNISPIDVITHVPILCEDADIPYIYVPSKEDLATAGATKRPTCCVLVLTKPGKGELSQEVQEKLKTEYEQVVGDVKELASSVV

SEQ ID NO: 21989 - protein, 158 aa, Carthamus tinctorius
MGGSDSEGDRSAHKEKEKKKLLALAPIAKPLAGKKLSKRTLKLVRKAAEHKCLKRGVKEVVKSIRRGNKGVCVIAGNITPIDVITHVPILCEEADIPYVYVSSKEDLANAGATKRPTCCVLVLTKPTKGELGEEEQQKLKAEYDQVASEVTELAATLF

SEQ ID NO: 21990 - protein, 157 aa, Malus domestica
MGSDSEVEKSAQKEREKKKLQALAPVAKPLAGKKLCKRTLKLVRKAAEHKCLKRGVKEVVKSIRRGQKGFCVIAGNISPIDVITHVPILCEEAEIPYVYVPSKEDLANAGATKRPTCCVLVTTKPNKGALSQEDEDKIKENYDEVVGEVKELHANLF

SEQ ID NO: 21991 - protein, 154 aa, Persea americana
MGSDSETEKSLKEKKKLMALAPIAKPLAGKKLCKKTLKLVRKASESKCLKRGVKEVVKSIRRGHKGLCVIAGNISPIDVITHVPILCEEAEIPYIYVPSKEDLATAGATKRPTCCVLVLPKPIKGELGQEEQEKLEEDYSKVASDLKELASSLF

SEQ ID NO: 21992 - protein, 155 aa, Fagus grandifolia
MGSDSEAEKSQQKERKKVVALAPIAKPLAGKKLCKRTLKLVRKAAEHKCLKRGVKEVVKSIRRGHKGICVIAGNISPIDVITHVPILCEEADIPYVYVTSKEDLANAGATKRPTCCVLVLTKPTKGELAPEEQDKLQAEYKQVAVDVSELASSLI

SEQ ID NO: 21993 - protein, 156 aa, Cedrus atlantica
MGSDVETEKTPKDKEKRKMLMLSPIARPLAGKKLCKRTLKLVRRASEAKCLKRGVKEVVKSIRRGKKGLCVIAGNISPIDVITHVPILCEEADIPYIYVPSKEDLAGAGATKRPTCCVLVLTSPTKGSLSEEEDKKLKEDYNEVVKEVRELATSFF

SEQ ID NO: 21994 - protein, 157 aa, Centaurea maculosa
GGSDSEGDRSAHKEKEKKKLQALAPIAKPLAGKKLSKRTLKLVRKAAEHKCLKRGVKEVVKSIRRGNKGVCVIAGNITPIDVITHVPILCEEADIPYVYVSSKEDLANAGATKRPTCCVLVLTKPTKGELAEEEQQKLKAEYDQVASEVTELAATLF

SEQ ID NO: 21995 - protein, 157 aa, Gossypium raimondii
MGSDGEAEKTQQKEKERKKMLAISPIAKPLAGKKLSKKTLKFVRKAAEHKCLKRGVKEVVKSIRRGHKGLCVIAGNISPIDVITHVPILCEEADIPYVYVPSKVDLATAGSTKRPTCCVLVLTKPTKGELSPEEQLKLKADYSHIVEDVSELTSSMF

SEQ ID NO: 21996 - protein, 157 aa, Mimulus guttatus
MGSDSETDKTAQKVREKKQMSALAPIAKPLAGKKLSKRTLKLVRRAAEQKCLKRGVKEVVKSIRRGNKGICVIAGNISPIDVITHVPILCEEANIPYVYVTSKEDLANAGATKRPTCCVLVLTKPVKGELGQEEQEKLKGDYDQVASDLSELANSMF

SEQ ID NO: 21997 - protein, 155 aa, Nicotiana benthamiana
MGSDSEVEKSAQKEKKKLLALAPIAKPFAGKKLNKRIFKLVRRAAEKKCLKWGVKEVVKSIRRGQKGVCVIAGNISPIDVITHVPILCEEAEIPYVYVSSKEDLANVGATKRPTCCVLVQTKPAKGELSQEDQEKLKADYDQVVSEIGEMASSMF

SEQ ID NO: 21998 - protein, 157 aa, Orobanche aegyptiaca
MGSDSETEKTAQKEREKKNRLALAPIAKPLAGKKLSKRTLKLVRRAAEHKCLKRGVKEVVKSIRRGNKGICVIAGNISPIDVITHVPILCEESEIPYIYVQSKEDLANAGATKRPTCCVLVLPKPTKGELGQEEQDKLKGEYDQVALDISGIANSMF

SEQ ID NO: 21999 - protein, 157 aa, Euphorbia esula
MGSDSEAERSQKQEKEKKKVIALSPIAKPLAGKKLCKKTLKLVRRAAEHKCLKRGVKEVVKSIRRNNKGLCVIAGNISPIDVITHVPVLCEDNGIPYIYVPSKEDLANAGATKRPTCCVLVLTKPTKGELAQEEQDKLKAQLSEVSADVAELTSALF

SEQ ID NO: 22000 - protein, 157 aa, Helianthus annuus
GGSDSEGDRSAHKEKEKKKLLALAPIAKPLAGKKLSKRTLKLVRKAAEHKCLKRGVKEVVKSIRRGNKGVCVIAGNISPIDVITHVPVLCEEADIPYVYVSSKEDLANAGATKRPTCCVLVLTKPAKGELGEEEGQKLKTEYDQVASEVSELTAGMF

SEQ ID NO: 22001 - protein, 469 aa, Glycine max
MGTSNLLLFFSLVSLCAMAASKVVLIGNNITLSFDDIEANFAPTVKGSGEYGILYLAEPLDACTELTNKVEQLPNASSPFALVVRGGCSFEEKVRRAQKAGFKAVIVYDNEDGGILVAMAGNSAGIKIHAVFVSKASGEILSKYAGLTNVEIWLIPTFENSAWSIMAISFISLLAMSAVLATCFFVRRHRIRRERPRAPLVREFHGMSSRLVKAMPSLIFTAVLEDNCTSRTCAICLEDYCVGEKLRILPCCHKFHAACVDSWLTSWRTFCPVCKRDARSGLTDPPPSESTPLLSSTPASMASSVLSSARSSLASSSAIQIARTASMASSALPSARSSLASSSAIQIARAASQTPSVSRNHSIASTPYVQPSLRSSYHQSPSLSISRSSVDLRNASQRSLASHLNSPRSMGYPSLSSLNSRYMSPHIPSPSNASVSYMGSSSHQQHPLRYSESAASFSPFASTHSLPEC

SEQ ID NO: 22002 - protein, 443 aa, Cajanus cajan
MGTSNLLLFFSLLSLCAMAASKVVLIGSNITLSFDDIEANFAPTIKGSGEYGVLYLAEPLDACTELTNKVEQLPNTSSPFALVVRGGCSFEEKVRRAQMAGFKAVIVYDNEDGGVLVAMAGNSAGIRIHAVFVSKASGEILKKYAGLTNVEIWLIPTFENSAWSIMAISFISLLAMSAVLATCFFVRRHRIRRERPRASLVREFHGMSSRLVKAMPSLIFTAVLEDNCTSRTCAICLEDYCVGEKLRILPCCHKFHAACVDSWLTSWRTFCPVCKRDARTGLTDPPPSESTPLLSSSPASMASSLASSVRSSLASSSAIQIVRTASQTPSVSRNHSISSTPYVQPSLRSSYHQSPSLSISRSSVDLRNASQRSLASHLNSPRSTGYPSLSSLNSRYMSPHIPSPSNASVSYLGSSSHQQHPLRYSESAASFSPFASTHSLPEC

SEQ ID NO: 22003 - protein, 445 aa, Vigna unguiculata
MGTLNLLLFFSLVSLCAMAAAKVVLIGNNITLSFDDIEANFAPTVKGSGEYGVLYLAEPLDACTDLTNKVERHPNVSSPFALVVRGGCSFEEKVRRAQKAGFQAVIVYDNEEDGVLVAMAGNSAGIRIHAVFVSKASGEILKKYAGWPNVEIWLIPTFENSAWSIMAISFISLLAMSAVLATCFFVRRHRIRRERPRASLVREFHGMSSRLVKAMPSLIFTAVLEDNCTSRTCAICLEDYCVGEKIRILPCCHKFHAACVDSWLTSWRTFCPVCKRDARTGLTDPPPSESTPLLSSSPASMASSVLSSVRSSLASSSAIQIARTASQTTSVSRNHSIASTPYVHPSPSLRSSYHQSPSLSMSRSSVDLRNASQRSLASHFNSPHSMGYPSLPSLNSRYMTPYIPSPSNASVSYLGSSSHQQHPLRYSESAASFSPFASTHSLPEC

SEQ ID NO: 22004 - protein, 535 aa, Glycine max
MGEIKENVPLPKTKPSTEQDVTDELDLRMKKYLRGEGANLEGLKDKKLKGQLAAKEDLYGKSAKAAAKAEKWLMPSEGGYLEAEGLEKTWRIKQEAIAHEVDISSSRKQYDIILPELGPYTLDFTSSGRYMAVSGRKGHLGIVDMINLSIIREFQVRETVRDVAFLHNELFFAAAQKKYPYIYNREGTELHCLKEHGPVLRLQFLENHFLLASINKFGQLRYQDVTMGSMVGNFRTGLGRTNVMQVNPFNGVVSLGHSGGTVTMWKPTSASPLVKMLCHHGPVSALAFHSNGLLMATAGKDKKIKLWDLRKFEVLQTLPGHANTLDFSQKGLLACGNGSLIQILRDVSGTQNYSKYMTHSMVKGYQIGKLVFRPYEDVLGIGHSMGWSSILTPGAGEPNFDSWVANPFETSKQRREKEIRSLLDKLPPETIMLDPSKIGTVKPRRERPTKQEREAEIEAGVEAAKGMKLKKKTKGRNKPGKRVQKKQEAVSRVKRPYLEQKIQEEESISRKKQKTSEDVELPKSLQRFARKKASS

SEQ ID NO: 22005 - protein, 535 aa, Cajanus cajan
MGESQENDALPENKPPTEQEISDELDLRIKKYLRGEGANLEVLKDKKLKGQLAVKEELYGKSAKAAAKAEKWLMPSEGGYLEAEGIEKTWRFKQEAISREVDISSSRNQYDIVLPELGPYTLDFTSSGRYLAVGGRKGHLGIVDMISLRLIREFQVRETVRDVAFLHNELFFAAAQKKYSYIYNREGTELHCLKEHGPVLRLQFLENHFLLASINKLGQLRYQDVTMGTMVGNFRTGLGRTNVMQVNPFNGVVSLGHSGGTVTMWKPTSSSPLVKMLCHHGPVSALAFHSNGHLMATAGKDKKIKLWDLRKFEVLQTLPGHANTLDFSQKGLLACGNNSSIQVLRDVSGTQNYSRYMTHSMVKGYQIGKLVFRPYEDVLGIGHSMGWSSILIPGAGEPNFDSWVANPFETNKQRREKEIRSLLDKLPPETIMLDPSKIGTVKPKKEKTAKQDKEAEIEAALEAAKGIKLKNKSKGRNKPGKRMQKKQEAIARVKRPYLEQKIQEEENISRKKQKNSEGVELPKSLQRFARKKASS

SEQ ID NO: 22006 - protein, 520 aa, Phaseolus vulgaris
DNIALQDVSDELELRMKKYLRGESANLEVLKDKKLKGQLAAKEQLYGKSAQAAAKAEKWLMPSEGGYLEAEGLEKTWRIKQETIAHEVDISGSRKQYDIILPELGPYTLDFTSSGRYMAVGGRKGHIGIVDMINLSLIRELQVRETVRDVVFLHNELFFAAAQKRYPYIYNREGTELHCLKEHGPVLRLQFLKNHFLLATINKFGQLRYQDVTMGSMVGNFRTGVGRTNVMQVNPFNGVVSLGHSAGTVTMWKPTSSAPLVKMLCHHGPVSALAFHSNGHLMATAGKDKKVKLWDLRKYEVLQTLPGHANTLDFSQKGLLSCGNGSLIQVLRDVSGTQNYSRYMTHSMVKGYQVEKLVFRPYEDVLGIGHSMGWSSILIPGAGEPNFDSWVANPFETSKQRREKEIRTLLDKLPPETIMLDPSKIGTVKPKGKRPTKKEKEAEIEAAVEATKGKKLKKKTKGRNKPGKMIQKKQDAIARVKRPYMEQKIQEEENVSRKKQKTSVELPKSLQRFARKKASS

SEQ ID NO: 22007 - protein, 536 aa, Cicer arietinum
MEETHDNDTLPNNNPSTVQDITDELELRSKKYLRGEGANLKGLKDKKLRTQLSAREQLYGQSAKAAAKTEKWLMPSDGGYLEAEGIEKTWRIKQETIGREVDILSSRNQYDITLPDLGPYTLDFTSSGRYMAVGGRKGHLAIVDMMNLSLIREIQVRETVRDVVFLHNELFFAAAQKKYPYIYNRDGTELHCLKEHGAVLRLQFLENHFLLASTNKFGLLLYQDVTMGTIAGKYRTGLGRTNVMQVNPYNGVVSLGHSAGTVTMWKPTSSSPLVKMLCHQGPVSALAFHSNGHLMATAGKDKKIKLWDLRKFEAFQTLPGHANTLEFSQKGLLACGNGSYIQVLRDVSGAQNYSKYMTHSMVKGYQIGKLAFRPYEDVLGIGHSMGWSSILIPGAGEPNFDSWVANPFETPKQRREKEIHSLLDKLPPETIMLDPSKIGTVKQTRKEKLTVQEREAEIEAAVEAVKGKKLKKKTKGRSKAGKIMPKKQDAIATAKRPYLEQKIQEEKDISRKKQKTNEGVELPKSLQRFARKKPSS

SEQ ID NO: 22008 - protein, 536 aa, Lupinus angustifolius
MDENHENDALTTPKPSTEHDIADELNLKMKKYLRGKVNDLGALKDKKLRTQLTIREELYGKSAKAAAKAEKWLMPSEGGYLEPEGIEKTWRIKQDAIAREVDIRSSRNQYDIVLPDLGPYTLDFTSSGRYMAIGGRKGHLGIVDMINLSLVRELQVRETVRDVVFLHNELFFAAAQKKYLYIYNREGTELHCLKEHGAVLRLQFLENHFLLASVNKFGQLHYQDVTMGAMVGNFRTGLGRTNVMQVNPFNGVVGLGHSSGTVTMWKPTSSAPLVKMLCHRGPVSALAFHSNGQLMATAGQDKKVKIWDLRKFEVLQTLPGHASSLDFSQKGLLACSNGSFIQVLSDASGTHNYSKYMTHSMVKGYQIGKLAFRPYEDVLGIGHSQGWSSILIPGAGEPNFDSWVANPFETSKQRREKEIRSLLDKLPPETIMLDPSKIGTVQTTKKEKKTKQERESEMEAAVEDVKGRKMKNKTKGRNKPGRVAHKKQEALAKVKRPYIEQKVQEEENVSNKKQKTSEGVELPKSLQRFARKKASS

SEQ ID NO: 22009 - protein, 536 aa, Lupinus angustifolius
MDESHENDALTNQKPSTEQDIADELNLKMKKYLRGKVNDLEGLKDKKLKTQLTIREELYGKSAKAAAKAEKWLMPSEGGYLEPEGIEKTWRIKQDAIAREVNIISARNQYDIVLPDLGPYTLDFTSSGRYMAIGGRKGHLGIVDLINLSLIRELQVRETVRDVVFLHNELFFAAAQKKYTYIYSREGTELHCLKEHGAVLRLQFLENHFLLASVNKYGQLHYQDVTMGAMVGNFRTGLGRTNVMQVNPFNGVVGLGHSNGTITMWKPTSSAPLVKMLSHRGPVLALAFHSNGQLMATAGLDKKVKIWDLRKFEVLQTLPGHASSLDFSQKGLLAWSNSSFVQVLRDASGTHNYSKYMTHSMVKGYQIGKVAFRPYEDVLGIGHSQGWSSILIPGAGEPNFDSWVANPFETSKQRREKEIRSLLDKLPPETIMLDPSKIGTVQTTKKEKKTKQERESEMEAAVEDVKGKKLKNKTKGRNKPGRVAHKKQEALAKVKRPYIEQKVQEEENTSTKKQKTSEGVELPKSLQRFARKKASS

SEQ ID NO: 22010 - protein, 536 aa, Medicago truncatula
MEETHNNDALSNNKPSTEQDIADELELRSKKYLRGEAANLKGLKDKKLKSQLIAKEKLYGQSAKAAAQAEKWIMPSEGGYIEAEGIEKTYRIKQETIAKEVDISSSRNQYDITLPELGPYTIDFTSSGRYMAIGGRKGHLAIMDMMNLSLIRELQVRETVRDVVFLHNELFFAAAQRKYPYIYNRDGTELHCLKEHGSVLRLQFLENHFLLASTNKFGMLLYQDVTMGTIAGKYRTGLGRTNVMELNPYNGVVSLGHSAGTVTMWKPTSSSPLVKMLCHQGPVSALAFHSNGHLMATAGVDKKIKLWDLRKFEAFQTLPGHANTLEFSQKGLLACGNGSYIQVLRDVSGAQNYSRYMTHSMVKGYQIGKLAFRPYEDVLGIGHSMGLSSILIPGAGEPNFDSWVANPFETPKQRREKEIRSLLDKLPPETIMLDPSKIGTVKYSKTEKPTAQEIEAEMEAAVEAVKGKKLKKKTKGRSKAGKIMPKKQDAIANAKRPYLEQKIQEEKNLAKKKQKTNEGGELPKSLQRFVHKKPSS

SEQ ID NO: 22011 - protein, 536 aa, Arachis hypogaea
MDEAQDNHAIITKKKPSANQDISDELDLKIKKYLRGEAASFEDLKDRKLKRQLSVREELYGNAAKAAAKAEKWLMPNEGGYLEAEGIEKTWRIKQEAIAKEVGLVNLRNQYDIVLPDLGPYTLDFTSSGRYMAVGGRKGHLGIVDMINLNLIKEIQVAETVRDVVFLHNELFFAAAQKKFVYMYNRDGTEIRCLREHGAALKLQFLKNHFLLASVNKFGQLHYQDITMGEIVGNFRTGLGRTNVMQVNPFNAVVGLGHAGGTVTMWKPTSSAPLVKMLCHHGPVSALAFHPNGHLMATAGKDKRIKLWDLRKFEPLQTLTGHANTLDFSQKGLLACGVGSFVQVLNDVSGTQNYSKYMTHSMAKGYQIGRLAFRPYEDVLAIGHSMGWSSILIPGAGEPNFDTWVANPFETSKQRREKEVRSLLDKLPPETIMLDPSKIGTVKSTYREKPTKQEREAEVEAAVEAAKGTKLKNKTKGRNKPGKKIQKKQDAIARVKRPYLEEKINEEQKISHKKQKTSENIDLPKSLQRFARKKSS

SEQ ID NO: 22012 - protein, 311 aa, Solanum phureja
MNDLMTKSFTSYIDLKKAAMKDVEASPDLEMGMTQLDQNLTAFLEEAEKVKLEMNSIKEILRRLQDTNEESKSLHKPEALKSMRDSINSDIVAVLKKARAIRSQLEEMDRSNAINRRLSGCKEGTLVDRTRSAVTNGLRKKLKELMMEFQGLRQRMMTEYKETVGRRYFTVTGEHPDEEVIDKIISSGNGQGGEEFLSRAIQEHGRGKVLETVVEIQDRHDAAKEIERSLLELHQIFLDMAVMVEAQGEKMDDIEHHVVNAAHYVNDGAKNLKTAKKYQKSSRKCMFIGVIVLLILILVVIIPIATSFTKS

SEQ ID NO: 22013 - protein, 311 aa, Nicotiana benthamiana
MNDLMTKSFTSYIDLKKAAMKDVEAGPDLEMGVTQMDQNLTAFLEEAEKVKLEMNSIKDILRRLQDINEESKSLHKPEALKSMRNRINSDILAVLKKARAIRSQLEEMDRSNAINRRLSGCKEGTPVDRTRSAVTNGLRKKLKELMMDFQGLRQRMMTEYKETVGRRYFTVTGEHPDEEVIEKIISSGNGQGGEEFLSRAIQEHGRGKVLETVVEIQDRHDAAKEIEKSLLELHQIFLDMAVMVEAQGEKMDDIEHHVMNAAQYVNDGTKKLKTAKDYQKSSGKWMCVAIIILLILILVVIIPIATSFIKS

SEQ ID NO: 22014 - protein, 311 aa, Capsicum annuum
MNDLMTKSFTSYVDLKKAAMKDAESGPDLEMGMTQMDQNLTAFLEEAEKVKVEMNSIKDILRRLQDTNEESKSLTKPEALKSMRNLINSDILAVLKKARAIRSQLEEMDRSNAINRRLSGCKEGTPVDRTRFAVTNGLRKKLKELMMDFQGLRQRMMSEYKETVGRRYFTVTGEQPDEEVIDKIISSGNGQGGEEFLSRAIQEHGRGKVLETVVEIQDRHDAAKEIEKSLLELHQIFLDMAVMVEAQGEKMDDIEHHVVNAAQYVNDGTKNLKTAKEYQKSSRTWMCIGIIILLILILVVIIPIATSFTKS

SEQ ID NO: 22015 - protein, 306 aa, Nicotiana benthamiana
MNDLMTKSFTSYVDLKKAAMKDVEAGPDLEMGMTQMDQNLTAFLEEAEKVKLEMNSIKDILGRLQETNEESKSLHKPEALKSMRNRINSDIVAVLKKARAIRSQLEEMDRSNAINRRLSGCKEGTPVDRTRSAVTNGLRKKLKELMMDFQGLRQRMMTEYKETVGRRYFTVTGEHPDEEVIEKIISSGEEFLSRAIQEHGRGKVLETVVEIQDRYDAAKEIETSLLELHQIFLDMAVMVEAQGEKMDDIEHHVMNAAQYVNDGTKNLKTAKDYQKSSRKWMCIAIIILLILILVVIIPIATSFSKS

SEQ ID NO: 22016 - protein, 311 aa, Tabernaemontana elegans
MNDLMTKSFTSYVDLKKEAMKDLEAGRDLEMGMTQMDHNLSAFLEEAENVKKEMNFIKDVLGRLQEANEESKTLHKPEALKSLRNRINADILAVLKKAKAIKSQLEEMDRSNALSRRLSGCKEGTPVDRTRSAVTNGLRKKLKELMMDFQGLRQRMMTEYKETVGRRYFTVTGENPDEEVIEKIISSGNGHGGEELLSRAIQEHGRGKVLETVVEIQDRYDAAKEIEKSLLELHQIFLDMAVMVEAQGEQMDDIEQHVLNAAQYVSDGTKNLKTAKNYQKSSRRWMCIGVILLLVLILVVIIPIATSFSKS

SEQ ID NO: 22017 - protein, 307 aa, Antirrhinum majus
MNDLMTKSFTSYVDLKKEAMKDLELGPDIEMGITQVDHNLTAFLEEAEQVKLEMNSIKEVLIRLDESNEEGKTLHKSEALKSHRARMNDDVLSVLKRARAIKIRLEEMDRSNEVSRRLSGCKTGTLVDRTRSAVTNGLRKKLKELMMEFQSLRQKMMTEYKETVGRRYYTVTGENPDEEVIDKIISNGGEEFLSRAIQEHGRGRVLETVVEIQDRHDAAKEIEKSLLELHQIFLDMAVMVEAQGEKMDDIEHHVMNAAQYVSDGTKNLKTAKDYQKSSRRCMCIGIILLLVLILVVIIPIATSFSKS

SEQ ID NO: 22018 - protein, 311 aa, Vitis vinifera
MNDLMTKSFISYVDLKKEAMKDLEAGPEYDLQMSGTQMDRNLGLFLEEAEKVKQEMGLIREILGRLHEANEESKSLHKPEALKSLRNRINADIIGVQKKARAIKSQLEEMDRANAANMRLSGYKEGTPVYRTRAAVTNGLRKKLKELMMDFQGLRQRMMTEYKETVGRRYFTVTGEYPDEEVIEKIISNGEGGEEFLGRAIQEHGRGKVLETVVEIQDRHDAAKEIEKSLLELHQVFLDMAIMVEAQGEQMDDIEHHVMNAAQYVKDGTKNLKTAKDYQRSSRKCMCLGVILLLILILIVVIPIATSFSNS

SEQ ID NO: 22019 - protein, 311 aa, Mimulus guttatus
MNDLMTKSFTSYVDLKKEAMKDLESGPDLEMGITKPDQNLTLFLEGAEQVKTEMNSIREILARLHESNEEGKTLHKPEALKSLRARQNGDVFSVLKKARAIKARLEDMDRSNAANRRLSGCKSGTPVDRTRTAVTNGLRKKLKELMMDFQGLRQRMMSEYKETVGRRYFTVTGENPDDEVIEKIISGGDGNGGEEFLSRAIQEHGRGKVIETVVEIQDRHDAAKEIEKSLLELHQIFMDMAVMVEAQGEQMDDIEHHVMNAAQYVGDGTKSLKVAKEHQKSSRRCLCIGIILLLVLIIIVIIPIATSFGKS

SEQ ID NO: 22020 - protein, 442 aa, Solanum phureja
MEAINAVRLTPLSVLSDRRNEAKKIPSHPISFPFKNLCSVENLSRNVQGGLVLVSSVLNTGLAKALTYEETLEQSATSPGAEFDATAVVETVTTFASENPIIIAGGFAALALPIVLFQVLGKPPKSWGVESAKTAYAKLADDAGAQLLDIRAPAELREVGSPDIRGLKKKPVTVVYKSEDKTGFLKKLSLKFKEPENTTLFILDKFDGNSELVAELVTENGFKAAYAIKDGAEGPRGWLNSSLPWILPKKTLGLDLSNLSDALDGVLGEGSDAVTVGLGVAAAAGLGILAFSEVEIILQLLGSAALVQLVSKKLLFAEDRKKTLQQVDEFLSTKVAPKELVDEIKQIGKALLPDSVSSNALPAPVEASPAAATSTVEETESVAKEDIAPPKVEATSPPTPEVNAVPNAEVKTDALPESSRPLSPYPNYPDLKPPTSPMPSQP

SEQ ID NO: 22021 - protein, 441 aa, Nicotiana benthamiana
MEAINAVRVTPLSVLSDRRNESKKIPSHPISFPFKNLCSVESLSRNVQGGLVLLSSALTTGLAKALTYEEALEQSTTSPAADFDATAVVETVTTFASDNPLVIAGGVVALALPLVLFQVLEKPKSWGVESAKTAYAKLGDDQSAQLLDIRAPAELREVGSPDIRGLKKKAVTVAYNGEDKPGFLKKLALKLRDPENTTLFILDKFDGNSELVAELVTANGFKAAYAIKGGAEGPRGWLNSGLPWNAPKKTLSLDLSNLSDALDGILGEGSDAVTVGLGAAAAAGLGLLAFSEVETILQLLGSAALIQLIGKKLLFAEDRKLTLQQVDEFLSTKIAPKELVDEIKQIGKALLPETVSSDALPAPAEASPAAATGTVEKTESVPQGDIAPPKVEASSQTTPEVNSIANAEVKADALPKSSRPLSPYPNYPDFKPPTSPMPSQP

SEQ ID NO: 22022 - protein, 441 aa, Nicotiana benthamiana
MEAINAVRLTPLSVLSDRRNEPKKIPSHPISFPFKNLCSVESLSRNVQGGLVLLSSALTTGLAKALTYEEALEQSTTSPAADFDATAVVETVTTFASDNPLVIAGGVVALALPLVLFQVLEKPKSWGVESAKTAYAELGDDESAQLLDIRAPAELREVGSPDIRGLKKKSVTVAYKGEDKPGFLKKLALKFKDPENTTLFVLDKFDGNSELVAELVTSNGFKAAYAIKDGAEGPRGWLNSGLPWNAPKKTLSLDLSNLSDALDGILGEGSDAVTIGLGAAAAAGLGLLAFSEVETILQLLGSAALIQLIGKKLLFAEDRKLTLQQVDEFLSTKIAPKELVDEIKQIGKALLPETVSSNALLAPAKEGPAVVTDTVEKTESVPQEDISPPKVEASSQPTPEVNSVANAEVKADALPNSSRPLSPYPNYPDFKPPTSPMPAQP

SEQ ID NO: 22023 - protein, 168 aa, Solanum phureja
MASPTLITPSTSTPKSLITPIRSKLISSVTTTTTALRRREFLSLSAGILSPSLLLPATSAFAATDEEYVKEASEVIQKVRSTLNMDKGDPNIADSVAELREASNYWVAKYRREKALLGRASFRDIYSALNAVSGHYVSFGPTTPIPAKRKVRILEEMDTAEKALQRGR

SEQ ID NO: 22024 - protein, 167 aa, Solanum tuberosum
ASPTLITPSTSTPKSLITPIRSKLISSVTSTTTTLRRREFLSLSAGILSPSLLLPATSAFAATDEEYVKEASEVIQKVRSTLNMDKGDPNIADSVAELREASNYWVAKYRREKALLGRASFRDIYSALNAVSGHYVSFGPTTPIPAKRKVRILEEMDTAEKALQRGR

SEQ ID NO: 22025 - protein, 175 aa, Nicotiana benthamiana
MSSPTLITPSTSTPKPLTPIRSKLSSTTTTANAATVSASLPSTRRREFLSLAAGILSPALLLPATSAFAASDEEYVREASEVIKKVRSTLSMEKGDPNIADSVTDLREASNYWVAKYRREKALLGRASFRDIYSALNAVSGHYVSFGPTTPIPAKRKQRILEEMDTAEKALQRGR

SEQ ID NO: 22026 - protein, 171 aa, Nicotiana benthamiana
MASPTLITPSTSNPKPLTPIRSKLSSTTTATVSASISSTRRREFLSLAARILAPALLLPATSAFAASDDEYVREASEVIKKVRSTLSMEKSDPNIADSVTELREASNYWVAKYRREKDLLGRASFRDIYSALNAVSGHYVSFGPTTPIPAKRKQRILEEMDTAEKALQRGR

SEQ ID NO: 22027 - protein, 159 aa, Solanum melongena
MASPTLITPSTSTPKPRITPIRSKLISNAVSLPSTTTVRRRELLSLAAGILSPSFLLPATSALAASDEEYVREASEVIQKVRSTLNMDKGDPNIADSVAELREASNYWVAKYRREKALLGRASFRDIYSALNAVSGHYVSFGPTTPIPAKRKMRILEEM

SEQ ID NO: 22028 - protein, 174 aa, Solanum phureja
MAVFSRNVFVMAILFSSLLSFTEARDHLVGGKTDSWKIPSSESDSLNRWAEKSRFLVGDSLVWKYDGAKDSVLEVSKRDYVTCNTSSPIAMHNDGNTKIVLEHSGAYYFISGVKGNCEQGQKLVVVTLSKRRYADAPVPSPVEFDGPAIAPTSNTVSLKASLVVAFGVLVGFWL

SEQ ID NO: 22029 - protein, 174 aa, Solanum tuberosum
MAGFSRNVFVMAILFSSLLSFTEARDHLVGGKTDSWKIPSSESDSLNRWAEKSRFLVGDSLVWKYDGAKDSVLEVSKRDYVTCNTSSPIAMHNDGNTKIVLEHSGAYYFISGVKGNCEQGQKLVVVTLSKRRYADAPVPSPVEFDGPAIAPTSNAVSLKASLVVAFGVLVGFWL

SEQ ID NO: 22030 - protein, 180 aa, Solanum melongena
MAFFSRNVLSSSVVAVLFFLLLSFTEARDHLVGGKTDSWKIPSSESDSLNRWAEKSRFLVGDSLVWKYDGKKDSVLEVSKRDYVTCNTSSPISVHNDGDTKIVLEHSGAHYFISGAKGHCEQGQKLIVVTLSEKNTRRFANAPAPSPVELEGLAPAPSSNAVSLKASLVVAFGVMVGFWV

SEQ ID NO: 22031 - protein, 418 aa, Solanum tuberosum
MVFSPLTSSGCSSYCNLGLSWKSSSLFVELGFLSNGSKGVSAKPAKLNASKVFRACASSSSSDPLLVKAARREQVSRPPAWMMRQAGRYMAVYRKLAEKHPSFRERSETTDLIVEISLQPWEAFHPDGVIIFSDILTPLPAFGVQFDIEDVRGPVIQSPIRSEEGLKSLHSIDLEKLQFVGDSLRILRKEVGEQAAILGFVGAPWTIATYIVEGGTTRTYTKIKDMCHTAPHVLRALLSHLSKAIAEYIVYQVESGAHCIQIFDSWGGQLPPHMWDCWSKPYIDEIVGIIKRKCPQTPLVLYINGNGGLLERMKTTGVDVIGLDWTVDMADGRRRLGTDIGIQGNVDPATLFCPLPALTDEIKRVVKSAGTSGHILNLGHGVLVGTPEEAVAHFFDVAKSFDFDKVEDHVSEADKVVA

SEQ ID NO: 22032 - protein, 418 aa, Solanum phureja
MVFSPLTSSGCSSYCNLGLSWKSSSLFVELGFLSNGSKGVSAKPAKLNASKVFRACASSSSSDPLLVKAARRERVSRPPAWMMRQAGRYMAVYRKLAEKHPSFRERSETTDLIVEISLQPWEAFHPDGVIIFSDILTPLPAFGVQFDIEDVRGPVIQSPIRSEEGLKSLHSIDLEKLQFVGDSLRILRKEVGEQAAILGFVGAPWTIATYIVGGGTTRTYTKIKDMCHTAPHVLRALLSHLSKAIAEYIVYQVESGAHCIQIFDSWGGQLPPHMWDCWSKPYIDEIVGIIKRKCPQTPLVLYINGNGGLLERMKTTGVDVIGLDWTVDMADGRKRLGTDIGIQGNVDPATLFCPLPALTDEIKRVVKSAGTSGHILNLGHGVLVGTPEEAVAHFFDVAKSFDFDKVEDHVSEADKVVA

SEQ ID NO: 22033 - protein, 361 aa, Capsicum annuum
MYCFSDPLLVKAARRERVSRPPAWMMRQAGRYMAVYRKLAEKHPSFRERSETTDLIVEISLQPWEAFHPDGVIIFSDILTPLPAFGVQFDIEDVRGPVIQSPIRSEEGLKSLHSIDLEKLQFVGDSLRILRKEVGDQAAILGFVGAPWTIATYIVEGGTTRTYTKIKDMCHTAPHVLRALLSHLSKAIAEYIVYQVESGAHCIQIFDSWGGQLPPHMWDCWSKPYIDEIVSTIKRKCPQTPLVLYINGNGGLLERMKTTGVDVIGLDWTVDMADGRKRLGTDIGIQGNVDPATLFCPLPALTDEIRRVVKSAGTRGHILNLGHGVLVGTPEDAVAHFFDVAKSFDFDKVEDHVSEADKVVA

SEQ ID NO: 22034 - protein, 664 aa, Solanum phureja
MEGVDYLADERKKAGFDVDEMKIVWAGSRHDFELTDRISKLVANDPGFSKEGRTMLPRKELFKNTLRKAAYAWKRIIELRLSQEEATMLRRYVDEPAFTDLHWGMFIPALKGQGTDKQQEKWLPLAYKMQIIGCYAQTELGHGSNVQGLETTATFDPQTDEFVIHSPTLTSSKWWPGGLGKVSTHAVVYARLITDGKDYGVNGFIVQLRSLEDHKPLPGVTVGDIGMKFGNGAYNSMDNGVLSFDHVRIPRDQMLMRVSQVTKEGKYVQSDIPRQLLYGTMVYVRQSIVSDASLAMSRAVCIATRYSAVRRQFGSQNGGQETQVIDYKTQQNRLFPLLASAYAFRFVGEWLKWLYTDVTQRLAANDFSTLPEAHACTAGLKSLTTSATADGIEECRKLCGGHGYLCSSGLPELFAVYVPACTYEGDNVVLQLQVARFLMKTVSQLGTGKKPVGTVSYMGRIEQLMQCRSDVKQAEDWLKPSAVLEAFEARSARMSVACAKNLSKFENQEEGFAELAADLVEAAVAHCQLIVVSKYIEKLQQNIPGKGVKQQLEVLCGIYSLFLLHKHQGDFLGTGYITSKQGSLANDQLRALYSQLRPNAISLVDAFNYTDHYLDSILGRYDGNVYPKLYEAAWKDPLNKSDIADGFHEYIRPLLKQQLRTAKL

SEQ ID NO: 22035 - protein, 664 aa, Capsicum annuum
MEGVDYLADERKKAEFDVDEMKIIWAGSRHHFQLSDRISKLVANDPGFSKEGRTMLPRKELFKSTLRKAAYGWKRIIELRLTEEEATVLRRYVDEPAFTDLHWGMFIPAIKGQGTDEQQKKWLPLAQKMQLIGCYAQTELGHGSNVQGLETTATFDPQTDEFVIHSPTLTSSKWWPGGLGKVSTHAVVYARLITDGKDYGINGFIVQLRSLEDHKPLPGVTVGDIGMKFGNGAYNSMDNGVLRFDHVRIPRDQMLMRVSQVTKEGKYVQSDVPRQLLYGTMVYVRQTIVADASLAMSRAVCIATRYSAVRRQFGSQNGGQETQVIDYKTQQNRLFPLLASAYAFRFVGEWLKWLYTDVTQRLQANDFSTLPEAHACTAGLKSLTTSATADGIEECRKLCGGHGYLCSSGLPELFAVYVPACTYEGDNVVLQLQVARFLMKTVSQLGTGTKPVGTTSYMGRIEYLMQCRSDVKQAMDWMKPSAIVEAYEARAARMSVACAKRLSKFDNQEEGFAELAADLVEAAVAHCQLIVVSKFVEKLQQDIPGKGVKQQLEVLCGIYSLYLLHKHQGDFLGTGYITSKQASLANDQLRALYSKLRPNAISLVDAFNYTDHYLGSILGRYDGNVYPKLYEAAWKDPLNDSDVADGFHEYVRPLLKQQLRTARL

SEQ ID NO: 22036 - protein, 664 aa, Nicotiana benthamiana
MEGVDYLADERRKAEFDVNEMKVVWAGSRHNFELSDRISKLVANDPGFSKEGRTMLPRKELFKNTLRKAAYAWKRIIELRLSEEEAAKLRHFVDEPAFTDLHWGMFIPAIKGQGTDEQQKKWLPLAYKMQIIGCYAQTELGHGSNVQGLETTATFDPQTDEFVVHSPTLTSSKWWPGGLGKVSTHAVVYARLITNGKDYGINGFIVQLRSLEDHKPLPGVTVGDIGMKFGNGAYNTMDNGVLRFDHVRIPRDQMLMRVSQVTREGKYVQSDVPRQLLYGTMVYVRQTIVADASSALSRAVCIATRYSAVRRQFGSQNGGQEIQVIDYKTQQSRLFPLLASAYAFRFVGEWLKWLYTDVTQRLQANDFSTLPEAHACTAGLKSVTTTATADGIEECRKLCGGHGYLCSSGLPELFAVYVPACTYEGDNIVLLLQVARFLMKTVSQLGSGKKPVGTISYMGKIEHLMQCRSDVKQAKDWLKPSVVLEAFEARAARMSVACAQNLSKFDNPEEGFAELAADLAEAAVAHCQLIVVSKFIEKLQQDIPGKGVKQQLEVLCGIYSLFLLHKHQADFLGTGYITSKQASLANDQLRALYSKLRPNAISLVDAFNYTDHFLDSILGRYDGNVYPKLYEAAWKDPLNQSDIADGFHEYIRPLLKQQLRAARL

SEQ ID NO: 22037 - protein, 664 aa, Nicotiana benthamiana
MEGVDYLADERRKAEFDVNEMKIVWAGSRHNFELSDRISKLVANDPGFSKEGRTMLPRKELFKNTLRKAAYAWKRIIELRLSEEEAAKLRHFVDEPSFTDLHWGMFIPSIKGQGTDEQQKKWLPLAYKMQIIGCYAQTELGHGSNVQGLETTATFDPQTDEFVIHSPTLTSSKWWPGGLGKVSTHAVVYARLITNGKDYGINGFIVQLRSLEDHKPLPGVTVGDIGMKFGNGAYNTMDNGVLRFDHVRIPRDQMLMRVSQVTREGKYVQSDVPRQLLYGTMVYVRQTIVADASSALSRAVCIATRYSAVRRQFGSQNGGQEIQVIGYKTQQSRLFPLLASAYAFRFVGDWLKWLHTDVTQRLQANDFSTLPEAHACTAGLKSLTTTSTADGIEECRKLCGGHGYLCSSGLPELFAVYVPACTYEGDNTVLLLQVARFLMKTVSQLGSGKKPVGTISYMGKIEHLMQCRSDVKQAQDWLKPSVVLEAFEARAARMSVACAQNLSKFDNPEEGFAELAADLAEAAVAHCQLIVVSKFIEKLQQDIPGKGVKQQLEVLCGIYSLFLLHKHQADFLGTGYITSKQASLANDQLRALYSKLRPNAISLVDAFNYTDHFLDSILGRYDGNVYPKLYEAAWKDPLNQSDIADGFHEYIRPVLKQQLRTARL

SEQ ID NO: 22038 - protein, 664 aa, Olea europaea
MEGVDYLVDERKKAQFDVDAMKIVWAGSRHAFEVSDRISKLVAGDPAFRKDDRTMLPRKELFKNTLRKAAYAWKRIIELRLSEEEASKLRFYVDEPAFTDLHWGMFVPAIKGQGTDEQQQKWLPLAYKMQIIGCYAQTELGHGSNVQGLETTATFDPKTDEFIIHSPTLTSSKWWPGGLGKVSTHAVVYARLITDGKDQGVHGFIVQLRNLEDHNPLPGITLGDIGTKFGNGAYNTMDNGVLRFDHVRIPRDQMLMRVSQVTREGKYMQSDVPRQLVYGTMVYVRQTIVADASCALSRAVCIATRYSAVRRQFGSQNGGPETQVIDYKTQQSRLFPLLASAYAFRFVGEWLNWLYTDVTQKLQANDFSTLPEVHACTAGLKSLTTSATADGIEECRKLCGGHGYLCSSGLPELFAVYVPACTYEGDNIVLLLQVARFLMKTVSQLGTGKKPVGTIAYMGRVEYLMQCRSDAQNAVDWLKPSIVLEAFEARAARMSVACAQNLSKFANPEEGFAELAADLVEAAVAHCQLIVVSKFIEKLQQDIPGKGVKKQLEVLCGIYYLSLLHKYQGDFIATSCISPKQASLANDQLRALYSQVRPNAIALVDAFNYTDHYLGSILGCYDGNVYPKLYEAAWKDPLNESDIPDGYHEYIRPLLKQQLRAARL

SEQ ID NO: 22039 - protein, 664 aa, Amsonia hubrichtii
MAGLDYLADERKKAQFDVDEMKIVWAGSRHTFELSDRIAKLVANDPAFAKDERTMLPRKELFKNTLRKAAYAWRRINELRLSEEEASKLRFYVDEPAFTDLHWGMFVPVIKGQGTDEQQRKWLPLAYKMQIIGCYAQTELGHGSNVQGLETTATFDPQTDEFIIHSPTLTSSKWWPGGLGKVSTHAVVFARLITDGQDHGVHGFIVQLRSLEDHKPLQGITVGDIGMKFGNGAYNTMDNGVLRFDHVRIPRNQMLMRVSQVTREGKYKQSDVPRQLVYGTMVYVRQTIVQDASSALSRAVCIATRYSAVRRQFGSQNGGPETQVIDYKTQQSRLFPLLASAYAFRFAGEWLNWLYTDVTQRLQANDFSTLPEVHACTAGLKSLTTSATADGIEECRKLCGGHGYLCTSGLPELFAVYVPACTYEGDNTVLLLQVARFLMKTVSQLGSRKQPGGTIAYMGRIEHLMQCRCNVQNAEDWLNPNAVLEAFEARAARMSVSCAKKLSKFANQEEGFAELSADLVEAAVAHCQLIVVSKFIEKLQQDIPGKGVKQQLKALCGIYYLSLLHKYQGDFLAASCITPKQASLANDLLRALYSQVRPNAIALVDAFNYTDHFLGSILGRYDGNVYPKLYEAAWKDPLNDSVVPDGYHEYIRPLLKEQLRTAKL

SEQ ID NO: 22040 - protein, 664 aa, Tabernaemontana elegans
MAAVDYLADERKKAQFDVGEMKIVWAGSRHTFEVSDRMSKLVANDPAFSKDDRTMLPRKELFKNTLRKTAYAWKRINELHLSEEEASKLRFFVDEPAFTDLHWGMFLPFVKAQGTDEQLRKWLPLAYKMQIIGCYAQTELGHGSNVQGLETTATFDPQTDEFIIHSPNLTSSKWWPGGLGKVSTHAVVFAHLITDGQDYGVHGFIVQLRSLEDHRPLPGITVGDIGVKFGNGAYNTMDNGVLRFDHVRIPRSQMLMRFSQVTREGKYMQSDVPRQLVYGTMVYVRQTIVQDASSALSRAVCIATRYSAVRRQFGSANGGPETQVIDYKTQQSRLFPLLASAYAFRFVGEWLKWLYTDVTQRLQANDFSTLQEAHACTAGLKSLTTSATADGIEECRKLCGGHGYLCTSGLPELFAVYVPACTYEGDNTVLLLQVARILMKTVSQLGSGKQPVGTIAYMGRIEHLMQCRCNVQTAEDWLNPSVVLEAFEARAARMSVSCAKKLSKFANQEEGFAELSADLVEAAVAHCQLIVVSKFIEKLQQDIPGKGVKQQLKALCGIYYLFLLHKHHGDFLATGCITPKQASLANDLLRALYSQVRPNAIALVDAFNYTDHYLGSILGCYDGNVYPKLYEAAWKNPLNDSDIPDGYHEYIRPLLKQQLRAAKL

SEQ ID NO: 22041 - protein, 664 aa, Rosmarinus officinalis
MAGVDYLADERKKAQFDVDAMKIVWAGSRHAFEVSDRVSKLVANDPAFAKDERTILPRKELFKNTLRKAAYAWKRINELHLSEEEASKLRFYVDEPAFTDLHWGMFVPFIKGQGTDEQQRKWLSLAYKMQIIGCYAQTELGHGSNVQGLETTATFYPQTDEFVIHSPTLTSSKWWPGGLGKVSTHAVVFARLITDGQDYGVHGFIVQLRSLEDHKPLLGITVGDIGMKFGNGAYNTMDNGVLRFDHVRIPRNQMLMRFSQVTRDGKYKQSDVPRQLVYGTMVFVRQTIVQDASSALSRAVCIATRYSAVRRQFGSQNGGPETQVIDYKTQQSRLFPLLASAYAFRFVGEWLKWLYMDVTQRLQANDFSTLPEAHACTAGLKSLTTAATADGIEECRKLCGGHGYLCTSGLPELFAVYVPACTYEGDNIVMLLQVARFLMKTVSQLGSGKQLVGTIAYMGRIEHLMQCRCNVQNAEDWLNPSTVLEAFEARAARMSVSCAKKLSKFASQEEGFAELSADLVETAVAHCQLIVVSKFIEKLQQDILGKGVKQQLKAVCGIYYLHLLHKHQGDFLATSCITPKQASLANDLLRTLYSQVRPNAVSLVDAFNYTDHFLGSILGRYDGNVYPKLYEAAWKDPLNDSDIPDGFHEYIRPLLKQLRRAAKL

SEQ ID NO: 22042 - protein, 664 aa, Valeriana officinalis
MEGVDYLADERRKGQFDVDEMKIVWAGSRHTFEVSDRIAKLVANDPAFRKDNRTMMDRKELFKNTLRKAAYAWKRILELRLSEEEAAMLRNYVDEPAFTDLHWGMFVPAIKGQGTDEQQQKWLPLAYKMQIIGCYAQTELGHGSNVQGLETTATFDPKTDEFIIHSPTLTSSKWWPGGLGKIATHGVVYARLITDGKDHGVHGFIVQLRSLEDHLPLPGITVGDIGMKFGNGAYNTMDNGVLRFDNVRIPRSQMLMRVSQVTREGKYKQSDVPRQLVYGTMVYVRKTIVLDASIALSRAVCIATRYSAVRRQFGSQNGGLETQVIDYKTQQNRLFPLLASAYAFRFVGEWLNWLYTDVTQRLQANDFTTLPEAHACTAGLKSLTTTATADAIEECRKLCGGHGYLCSSGLPELFAVYVPACTYEGDNVVLLLQVARFLVKTVSQLGSGKKPSGTTAYMARMEQLMQSHSDVQKAEDWLKPNAILEAFEARAARMSVACARNLSKFANVEEGFAELSADLVEAAVAHCQLIVVSKFIDKMKEEIPGKGVKQQLEVLCNVYALFLLHKYQGDFLATGSITPKQGALANDQLRSLYSQVRPNAISLVDTFNYTDHYLGSILGCYDGNVYPKLYDAAWKDPLNDSVVPDGFHQYVRPILKQQLRTSKL

SEQ ID NO: 22043 - protein, 668 aa, Vinca minor
MAEIDYLSDERKKAEFDVDEMKIVWAGSSHNFQLSDRISKLVANDPGFAKDGRTMLPRKELFKNTLRKATYAWKRINELRLSEEEASKLRFYVDEPAFTDLHWGMFVPFIKGQGTDEQQKKWLSLAHKMQIIGCYAQTELGHGSNVQGLETTATFDPQTDEFVIHSPTLTSSKWWPGGLGKVSTHAVVFARLITGGKDYGVHGFIVQLRSLEDHNPLPGVTVGDIGMKFGNGAYNTMDNGVLSFDHVRIPRDQLLMRFSQVTRDGKYKQSDVPRQLVYGTMVYVRQSIVQDASSALSRAVCIATRYSAVRRQFGSQNGGPEIQVIDYKTQQSRLFPLLASAYAFRFVGEWLNWLYTDVTKRLQANDFSTLPEAHACTAGLKSLTTSFTADAIEECRKLCGGHGYLCSSGLPELFAVYVPACTYEGDNTVMLLQVARFLMKTVSQTVAQLGSGKQLVGTIAYMGRLEHLMQCHCNVQNAEDWLNPSAVMEAFEARAVRMSVSCAKRLSQFTNQEEGFAEISADLVEAAVAHCQLIVVSKFIEKLQQDIPGKGVKEQLKALCGVYYLFLLHKHHGDFLATNCITPKQASLANDLLRSLYSQIRPNAIALVDSFNYTDHYLGSILGRYDGNVYPKLYEAAWKDPLNDSVVTDGYHEYIRPLLKQQLRTAKL

SEQ ID NO: 22044 - protein, 664 aa, Lippia dulcis
MEGVDHLADERKKAAFDVEGMKIVWAGSRHTFEVCDRISKLVANDPAFRKDDRTMLARKELFKNTLRKAACAWKRIIDLHLSEEEASKLRFFVDEPAYTDLHWGMFVPAIKGQGTDEQQKKWLPLAYKMQIIGCYAQTELGHGSNVQGLETTATFDPHTDEFVIHSPTLTSSKWWPGGLGKVSTHAVVYARLIIDGKDNGVHGFIVQLRSLEDHRPLPGITVGDIGMKFGNGAYNTMDNGVLRFDHVRIPRNQMLMRVLQVTREGNCKQSDVPRQLVYGTMVYVRQQIVADASCALSKAVCIATRYSAVRRQFGSQNGGPETQVIDYKTQQSRLFPLLASAYAFRFVGEWLQWLYKDVTQKLHANDFSTLPEAHACTAGLKSLTTTATADGIEECRKLCGGHGYLCSSGLPELFAVYVPACTYEGDNTVLLLQVARFLVKTVSQLGTGKKPVGTIAYMGKIEHLIECHCDVQRAGDWLKPSQVLEAFEARAARMSVSCAQNLSKFANPEEGFAELSADLVEAAVAHCQLIVVSKFIAKLEQEIPGEGVRQQLEALCGIYYLSLLHKHQGDFLATSYLTPKQAALANNQLRALYSKVRPNAIALVDSFNYTDHFLGSILGRYDGNVYPKLYEAAWKDPLNESVIPDGYHEYVRPLLKQQLHTARL

SEQ ID NO: 22045 - protein, 664 aa, Rosmarinus officinalis
MAGVDYLADERKMAEFDVNSMKIVWAGSRHAFEVSDRISKLVANDPAFQKDNRPMLPRKELFKNTLRKAAYAWKRIIELRLSEEEASKLRFFVDEPAYTDLHWGMFVPALKGQCTDEQQSKWLPLAYKMQIIGCYAQTELGHGSNVQGLETTSTFDPQTDEFVIHSPTLTSSKWWPGGLGKVSTHAVVYARLITDGKDHGVHGFIVQLRSMEDHKPLPGITVGDIGMKFGNGAYNTMDNGVLRFDHVRIPRDQMMMRVSQVTREGKFKQSDVPRQLVYGTMVYVRQQIVADASCALSKAVCIATRYSAVRRQFGSQNGGPETQVIDYKTQQNRLFPLLASAYAFRFVGEWLKWLYTDVTQRLQANDFSTLPEVHACTAGLKSLTTTATADGIEECRKLCGGHGYLCTSGLPELFAVYVPACTYEGDNVVLLLQVARFLMKTVSQIGSGKQPVGTIAYMGRVEHLLKSRCSVQRAEDWLNPSQVLEAFEARAARMSVSCGQNLSKFSNPEEGFAELSADLVEAAVAHCQLIVVSKFLEKLLQDIPGEGVKQQLQAVCGIYYLSLLHKHQGDFLATGYITPKQAALANDQLRALYAKVRPNAIALVDSFNYTDHFLGSILGCYDGNVYPKLYEAAKNDPLNDTVVPDGYHEYLKPLLKQQLHSAKL

SEQ ID NO: 22046 - protein, 664 aa, Triphysaria pusilla
MEGVDYLADERKKAEFDVEAMKVVWAGSPHNLEVFDRISKLVADDPAFRKDDRTMLPRKELFRNTLRKAAYAWKRIVELRLSEEEASMLRFYVDEPAYTDLHWGMFIPAIKGQGTDEQQKKWLPLAYKMQIIGCYAQTELGHGSNVQGLETTSTFDPHTDEFVIHSPTLTSSKWWPGGLGKVSTHAIVYARLLINGKDHGVHGFIVQLRSLEDHTPLPGITVGDIGMKFGNGAYNTMDNGVLRFDHFRIPRNQMLMRVSEVTREGKYKQSDVPRQLVYGTMVYVRQRIVADASCYLSRAVCIATRYSAVRRQFGRQNGGPETQVIDYKTQQNRLFPLLASAYAFRFVGEWLEWLYMDVTKRLQASDFSTLPEAHACTAGLKSLTTSVTADGIEECRKLCGGHGYLCSSGLPELFAVYVPACTYEGDNVVLLLQVARFLIKTVSQLGTGKQPVGTIAYMGRIENLMQCRSSAQRAEDWSNTSQVLEAFEARAARMSASVALNLSKFTNPEEGFAELSADLVEAAVAHCQLIVVSKFIEKLEQDIPGEGVKQQLEALCGIYSLSLLHKHQGDFLATSYVTPKQAALANDQLRSLYTKVRPNAIALVDAFNYSDHFLNSILGRYDGNVYPKLYEAAWKDPLNESVVPDGYLEYVRPLLKQQLHTARL

SEQ ID NO: 22047 - protein, 664 aa, Rosmarinus officinalis
MAGVDYLADERKMAEFDVNSMKIVWAGSRHAFEVSDRISKLVANDPAFRKDDRPMLPRKELFKNTLRKAAYAWKRIIELRLSEEEASKLRFFVDEPAYTDLHWGMFVPALKGQCTDEQQSKWLPLAYKMQIIGCYAQTELGHGSNVQGLETTATFDPQTDEFVIHSPTLTSSKWWPGGLGKVSTHAVVYARLITDGKDHGVHGFIVQLRSMEDHKPLPGITVGDIGMKFGNGAYNTMDNGVLRFDHVRIPRDQMMMRVSQVTREGKFKQSDVPRQLVYGTMVYVRQQIVADASCALSKAVCIATRYSAVRRQFGSQNGGPETQVIDYKTQQNRLFPLLASAYAFRFVGEWLKWLYTDVTQRLQSNDFSTLPEVHACTAGLKSLTTTATADGIEECRKLCGGHGYLCTSGLPELFAVYVPACTYEGDNVVLLLQVARFLMKTVSQIGSGKQPVGTIAYMGRVEQLLESRCSVQRAEDWLNPSQVLEAFEARAARMSVSCGQNLNKFSNPEEGFAELSADLVEVAVAHCQLIVVSKFLEKLQQDIPGEGVKQQLQALCGIYYLSLLHKHQGDFLATSYITPKQAALASDQLRALYAKVRPNAIAMVDSFNYTDHFLGSILGCYDGNVYPKLYEAAKKDPLNDTVVPDGYHEYLKPLLKQQLRSAKL

SEQ ID NO: 22048 - protein, 661 aa, Mimulus guttatus
MDYLADERKKAVFDVDSMKIVWAGSRQAFEVSDRISKLVAADPGFRKDDRPMLPRKELFRNTLRKAAYAWKRIIDLRLSEEEASRLRFYVDEIAYTDLHWGMFVPALKGQGTDEQQAKWLPLAYKMQIIGCYAQTELGHGSNVQGLETTATFDADKDEFVIHSPTLTSSKWWPGGLGKVSTHAVVYARLITDGKDHGVHGFIVQLRSLEDHTPLPGITVGDIGMKFGNGGYNTMDNGVLRFDHVRIPRNQMLMKVSQVTREGKYKQSDVPRQLVYGTMVFVRQQIVKDASCALSRAVCIATRYSAVRRQFGSQNGGSETQVIDYKTQQSRLFPLLASAYAFRFVGEWLEWLYKDVIQRLQANDFSTLPEAHACTAGLKSITTSITADGIEECRKLCGGHGYLCSSGLPELFAAYVPACTYEGDNTVLLLQVARFLMKTVSQLGSGKQPVGTTAYMGRLEHLMQSRCTAQRAEDWLKPSQVLEAFEARAAKMSVSCAQNLSKFSNPEEGFAELSADLVEAAVAHCQLIVVSKFIEKLQQDIPGEGVKQQLEALCGIYYLSLLHKHQGDFLATSYLTPKQAVLANDQLRALYAKVRPNAIALVDAFNYTDHYLGSILGRYDGNVYPKLYEAAWKEPLNESVVPDGYKEYIRPLLKQQLHSARL

SEQ ID NO: 22049 - protein, 664 aa, Panax ginseng
MEGVDHLADERRKAQFDVESMKIVWAGSLHAFDVSDRMSKLVANDPAFRKDERTMLARKELFKNTLRKAAHAWKRVNELKLTYEEATKLRFFVDEPCYTDLHWGMFVPAIKGQGTEEQQEKWLPLAHKMQIIGCYAQTELGHGSNVQGLETTAIFDPQTDEFVIHSPTLTSSKWWPGGLGKVSTHAVVYARLITDGQDHGVHGFIVQLRSLEDHSPLPGITVGDIGMKFGNGAYNTMDNGVLRFDHVRIPRNQMLMRVLQVSREGKCTHSDVPRQLIYGTMVYVRQTIVADASLALSRAVTIATRYSCVRRQFGSQNGGPETQVIDYKTQQNRLFPLLASAYAFRFVGEWLHWLYMDVTERLQADDFSTLPEAHACTAGLKSLTTTATSDAIEECRKLCGGHGYLCSSGLPELFAVYAPACTYEGDNMVLLLQVARFLVKTASQLGTGKQPVGTTSYMGRAEHLIQCHSNVETAEDWLKPSAVLEAFEARAFRMVVACAQNLSQFANPEEGFAELSADLAEVAVAHCQLIVVSKFIDKLKQDIPGKGVKQMLEVLCNVYSLFLLHKYQGDFLATGSITTKQASLANTQLRNLYSQVRPNAVALVDSFNYTDHFLGSILGRYDGNVYPKLYEAAWKDPLNDSVVPDGYHEYVRPLHKQQLHMARL

SEQ ID NO: 22050 - protein, 662 aa, Plantago ovata
MDYLAGERNKAEFDVETMKIVWAGSREAFQVSDRISKLVADDPVFRKDNRTMLARKELFKNTLRKVAHAYKRIHELRLSEQEASQFRFYMDEPAYTDLHWGMFVPAIKGQGTDEQQQKWLPLAYKMQIIGCYAQTELGHGSNVQGLETTATFDPHTDEFVIHSPTLTSSKWWPGGLGKVSTHAVVYARLILHGEDYGVNGFIVQLRSLEDHTPLPGVTVGDIGMKFGNGAYNTMDNGVLRFDHVRIPRNQMLMKVSQVTRDGKYKPSDVPRQLVYGTMVYVRQTIVADASRALSRAVCIATRYSAVRRQFGSVNGGPETQVIDYKTQQSRLFPLLASAYAFRIVGEWLTWLYTDVTQRLKANDFSTLPEAHACTAGLKSLTTSCTADGIEECRKLCGGHGYLCSSGLPELFAVYVPACTYEGDNTVLLLQVARFLMKTVSQLGSGKQPVGTISYMGNIEHLMQTRCDVQTAEDWLKPGLVLEAFEARAARMSINCAKNLSKFANPEEGFAELSADLVEAAAAHCQLIIVSKFLDKLQQNIPGKGVKQQLETLCGIYYLHLLHKHQGDFLATSYLTPKQSALANDQLRALYTKVRPNAIALVDAFSYTDHFLGSILGRYDGNVYPKLYEAAWKDPLNETVVPDGYHEYLKPLLKQQLLHSSRM

SEQ ID NO: 22051 - protein, 664 aa, Panax ginseng
MEGVDHLADERRKAQFDVESMKIVWAGSLHAFDVSDRMSKLVANDPAFRKDERTMLARKELFKNTLRKAAHAWKRVNELKLTYEEATKLRFFVDEPCYTDLHWGMFVPAIKGQGTEEQQEKWLPLAHKMQIIGCYAQTELGHGSNVQGLETTAIFDPQTDEFVIHSPTLTSSKWWPGGLGKVSTHAVVYARLITDGQDHGVHGFIVQLRSLEDHSPLPGITVGDIGMKFGNGAYNTMDNGVLRFDHVRIPRNQMLMRVLQVSREGKCTHSDVPRQLIYGTMVYVRQTIVADASLALSRAVTIATRYSCVRRQFGSQNGGPETQVIDYKTQQNRLFPLLASAYAFRFVGEWLHWLYMDVTERLQANDFSTLPEAHACTAGLKSLTTTATSDAIEECRKLCGGHGYLCSSGLPELFAVYAPACTYEGDNMVLLLQVARFLVKTVSLLGTGKQPVGTTSYMGRAEHLMQCHSNVETAEDWLKPSAVLEAFEARAFRMVVACAQNLSQFANPEEGFAELSADLAEVAVAHCQLIVVSKFIDKLKQDIPGKGVKQMLEVLCNVYSLFLLHKYQGDFLATGSITTKQASLATTQLRNLYSQVRPNAVALVDSFNYTDHFLGSILGRYDGNVYPKLYEAAWKDPLNDSVVPDGYHEYVRPLHKQQLHMSRL

SEQ ID NO: 22052 - protein, 664 aa, Panax ginseng
MEGVDHLADERRKAQFDVESMKIVWAGSQHAFDVSDRMSKLVANDPAFQKDERTMLARKELFKNTLRKAAHAWKRVNELKLTYEEATKLRFFVDEPCYTDLHWGMFVPAIKGQGTEEQQEKWLPLAHKMQIIGCYAQTELGHGSNVQGLETTAIFDPQTDEFVIHSPTLTSSKWWPGGLGKVSTHAVVYARLITDGQDHGVHGFIVQLRSLEDHSPLPGITVGDIGMKFGNGAYNTMDNGVLRFDHVRIPRNQMLMRVLQVSREGKCSHSDVPRQLIYGTMVYVRQTIVADASLALSRAVTIATRYSCVRRQFGSQNGGPETQVIDYKTQQNRLFPLLASAYAFRFVGEWLHWLYMDVTERLQANDFSTLPEAHACTAGLKSLTTTATSDAIEECRKLCGGHGYLCSSGLPELFAVYAPACTYEGDNMVLLLQVARFLVKTVSLLGTGKQPVGTTSYMGRAEHLMQCHSNVETAEDWLKPSAVLEAFEARAFRMVVACAQNLSQFANPEEGFAELSADLAEVAVAHCQLIVVSKFIDKLKQDIPGKGVKQMLEVLCNVYSLFLLHKYQGDFLATGSITTKQASLATTQLRNLYSQVRPNAVALVDSFNYTDHFLGSILGRYDGNVYPKLYEAAWKDPLNDSVVPDGYHEYVRPLHKQQLHMSRL

SEQ ID NO: 22053 - protein, 666 aa, Cyclamen graecum
MEGAGVDHLADERRKANFDVQSMKIVWAGSKRTLEVSDRISKLVAADPVFRKDNRTTLGRKELFNDTLRKAAYAWKRIAELRLSEEEAGMMRKYVDQAAFTDLHWGMFIPAIKGQGTEDQQKKWLPLANKMQIIGCYAQTELGHGSNVQGLETTATFDPKMDEFIIHSPTLTSSKWWPGGLGKVSTHAVVFARLILEGQDYGVNGFIVQLRSLEDHLPLPGITVGDIGTKFGNGAYNTMDNGVLRFDRVRIPRDQMLMRVVQVTREGKYVKSNAPRQLLYGTMVFVRQTIVADASVALSRAVTIATRYSAVRRQFGSQNGGPETQVIDYKTQQNRLFPLLASAYAFRFVGEWLKWLYTDVTQRLQVNDFSTLPEAHACTAGLKSLTTTATADGIEECRKLCGGHGYLCSSGLPELFAVYIPACTYEGDNVVLLLQVARHLMKTVRELGSGKQPLGTAAYMGRIEQLMQCHCNVQKAEDWLMPEAVLKAFEARAARMSVACAKNLSTYENPEEGFDELAADLVEAAVAHCQLIVVSKFIEKLQQEIPGKGVKQQLEVLCYVYALHLVHKYQGDFLSTGSITPKQASFANDQLRSLYSEVRPNAIALVDSFNYTDHYLSSILGCYDGNVYPKLYEEAWKDPLNDSVVPEGYHQYIRPLLKQQLRTAKL

SEQ ID NO: 22054 - protein, 664 aa, Ocimum basilicum
MAEVDYLADERKKAEFDVDSMKIVWAGSRHDFEVSDRMAKLVANDPEFRKDNRAMLPRKELFKNTLRKAAYAWKRINELRLTEEEASKLRFFVDEPAYTDLHWGMFVPAIKGQGTDEQQRKWLPLAYKMQIIGCYAQTELGHGSNVQGLETTATFDAQTDEFVIHSPTLTSSKWWPGGLGKVSTHAVVYARLITDGKDYGVHGFIVQLRSIEDHSPLPGIIVGDIGMKFGNGAYNTMDNGVLRFNHVRIPRDQMLMKVSQVTKEGKFKQSDVPRQLVYGTMVYVRQQIVADASRALAKAVCIATRYSAVRRQFGSQNGGPEIQVIDYRTQQSRLFPLLASAYAFKFVGEWLTWLYKDVTKRLQNSDFSTLPEAHACTAGLKSLTTSVTADGIEECRKLCGGHGYLHSSGLPELFAVYVPACTYEGDNIVLLLQVARFLMKTVSQIGSGKKPVGTISYMGRVEHLLKSRCNVQRAEDWLNPGQVVEAFEARAARMSVSRAQKLSTFSDPEGGFAELSAELVEAAVAHCQLIVVSKFLDKLQQDIPGEGVKQQLQALCGIYYLSLLHKHQGDFLATNYITPKQAELANDQLRALYAKVRPNAVALVDSFNYTDHFLGSILGCYDGNVYPKLYEAAWKEPLNETVVPDGYQEYIRPLLKKQLHGAKL

SEQ ID NO: 22055 - protein, 664 aa, Trifolium pratense
MEGVDHLAFERKKAQFDVNDMKIVWAGSRQEFELSDRISRLVASDPVFQKDNRTALDRKELFKNTLRKAAHAWKRIIELRLNEQEASKLRSFVDQPGFTDLHWGMFVPAIKGQGTDEQQEKWLPLANNMQIIGCYAQTELGHGSNVQGLETTATFDPKTDEFIIHSPTLTSSKWWPGGLGKISTHAIVYARLITDGQDHGVHGFIVQLRSLDDHLPLPGITVGDIGMKFGNAAYNSMDNGVLRFDHVRIPRNQMLMRVSQVTREGKFVHSGVPRQLIYGTMVYVRQAIVADASIALSRAVCIATRYSAVRRQFGSQKGGPETQVIDYKTQQARLFPLLASAYAFRFVSEWLKWLYTDVTQKLQANDFSTLPEAHACTAGLKSLTTSATADGIEECRKLCGGHGYLCSSGLPELFAVYVPACTYEGDNTVLLLQVARYLIKTITQLGSGNKPVGTTAYFARVEQLMQYQSDVKRAEDWLKPNVVIEAFEARAARMSAAVAQNLSKFTDPEEGFQELSADLVEAAAAHCQLIVVSKFIEKLQQDIPGNGVKQQLEVLCSVYALFLLHNHLGDFLSTGCITQKQGSLANEQLRSLYSQVRPNAIALVDAFNYTDHLLGSVLGRYDGNVYPKLYEEAWKDPLNDSVVPDGFKDHVQPILRQQIRNARL

SEQ ID NO: 22056 - protein, 662 aa, Flaveria ramosissima
EGVDYLSDERNKAEFDVESMKIAWAGSRQAFELSDRMAKLVANDPAFEKFTRPMLGRKELLKNTLRKAAHGWKLIVDLRLTEEEAKWLRLYIDEPAYTDLHWGMFIPAIEGQGTEEQKKKWLPLAQKMQIIGCYAQTELGHGSNVQGLETTATFDPQTDEFIIHSPTLTSSKWWPGGLGKVSTHAVVYARLIVGGEFHGVHGFIVQLRSLDDHSPLSGVTVGDIGLKFGNGAYNTMDNGVLRFDHVRIPRDQMLMRVTQVTKEGKIVQSDVPRQLIYGTMVYVRQTIVADASKALSRAVCIATRYSAVRRQFGSRNGGPETQVIDYKTQQSRLFPLLASAYAFRFVGEWLKWLYMDVKQRLAANDFSTLPEAHACTAGLKSLTTTATADGIEECRKLCGGHGYLVSSGLPELFAVYIPACTYEGDNVVLLLQVARFLVKTVSELGYKKPVGTTAYMGRVASLMQNNCAVQTAEGWLNPGAIMEAFESRAARMAVRCGRQLAKFENPEEGFAELSADLVEASVAHCQLIIVSKFIEKLQQDIPGKGVKQTLEVLCYVYALFLLHKHQGDFLATGYLTPKQASLANDQLRTLYSKVRPNAIALVDSFNYTDHYLGSILGRYDGNVYPKLYEAAWKDPLNDSDVVDGFHEYVQPLLKQKLRTSKL

SEQ ID NO: 22057 - protein, 664 aa, Gossypium raimondii
MEALDYHAEERRKAEFDLEEMKIVWAGSRQNYEISDRMARLVASDPVFRKDNRTMLSRKDLFKDTLRKAAHAWKRIIELRLSEEEAHMLRSYVDQPAFTDLHWGMFIPAIKGQGTEEQHEKWLPMAYKMQIIGCYAQTELGHGSNVQGLETTATFDPQTDEFVIHSPTLTSSKWWPGGLGKVSTHAVVYARLITGAQDHGVHGFIVQLRSLDDHSPLPGITVGDIGMKFGSGAYNSMDNGLLRFDHVRIPRNQMLMRVSQVTREGKFVQSDVPRQLVYGTMVYVRQTIVSDASCALARAVCIATRYSAVRRQFGSQNGGPETQVIDYKTQQSRLFPLLASAYAFRFVGEWLKWLYTDVTQRLQANDFSTLPEAHACTAGLKSMTTSVTADAIEECRKLCGGHGYLSNSGLPELFAVYIPTCTYEGDNVVLLLQVARFLMKTVSQLGSGKKPVGTTAYMGRAEHLMQCRCEVERAEDWLKPSVILEAFEARAFRMSIACAKNLSKFSNPEDGFSELSPDLLEAAIAHCQLIVVSKYIEKLQQDIPGKGVKRQLEILCNVYALHLLHKHLGDFVTTSCITPKQGALANEQLRLLYSQVRPNAITLVDAFNYTDHYLGSVLGCYNGNVYQRLYEEAWKDPLNDTVVPDGYLEYVRPILKQHIRTARL

SEQ ID NO: 22058 - protein, 664 aa, Gossypium hirsutum
MEALDYHAEERRKAEFDLEEMKIVWAGSRQNYEISDRMARLVASDPVFRKDNRTMLSRKDLFKDTLRKAAHAWKRIIELRLSEEEAHMLRSYVDQPAFTDLHWGMFIPAIKGQGTEEQHEKWLPMAYKMQIIGCYAQTELGHGSNVQGLETTATFDPQTDEFVIHSPTLTSSKWWPGGLGKVSTHAVVYARLITGAQDHGVHGFIVQLRSLDDHSPLPGITVGDIGMKFGSGAYNSMDNGLLRFDHVRIPRNQMLMRVSQVTREGKFVQSDVPRQLVYGTMVYVRQTIVSDASCALARAVCIATRYSAVRRQFGSQNGGPETQVIDYKTQQSRLFPLLASAYAFRFVGEWLKWLYADVTQRLQANDFSTLPEAHACTAGLKSMTTSVTADAIEECRKLCGGHGYLSNSGLPELFAVYIPTCTYEGDNVVLLLQVARFLMKTVSQLGSGKKPVGTTAYMGRAEHLMQCRCEVERAEDWLKPSVILEAFEARAFRMSIACAKNLSKFSNPEDGFSELSPDLLEAAIAHCQLIVVSKYIEKLQQDIPGKGVKRQLEILCNVYALHLLHKHLGDFVTTSCITPKQGALANEQLRLLYSQVRPNAITLVDAFNYTDHYLGSVLGCYNGNVYQRLYEEAWKDPLNDTVVPDGYLEYVRPILKQHIRTARL

SEQ ID NO: 22059 - protein, 664 aa, Malus domestica
MEGVDHLAQERSKAQFDVDQMKVIWAGSRHTLEVSDRIARLVASDPVFRKDNRTLLSRKDLFKNTLQKAAHAWKRITELRLSEEEAYWLRHYVDQPAYTDLHWGMFVPAIKGSGTEEQQKKWLPLAYKMQIIGCYAQTELGHGSNVQGLETTATFDPKTDEFVINSPTLTSSKWWPGGLGKASTHAVVYARLITDGQDHGVHGFIVQLRSLDDHLPLPGIIVGDIGMKFGSGAYNSMDNGVLRLDHVRIPREQMLMRVSQVTREGKYVQSNVPRQLLYGTMVYVRQTIVADASSALSRAVCIATRYSAVRRQFGSQDGGLETQVIDYKTQQSRLFPLLASAYAFRFVGEWLKWLYTDVTEKLQANDFSTLPEAHACTAGLKSLTTSATADGIEECRKLCGGHGYLSNSGLPELFAVYVPACTYEGDNIVLLLQVARFLMKTVAQLPSGKKPVGTTTYMGRAQHLIQCRSSAQKAEDWLNPSVILEVFEARAIRMSIACAQDLSKFSNQEEGFAELSSNLAEAAVAHCQLIVVSKFIDKVQQDIPGKGVKKQLEILCNIYALYTIHKHLGDFLSTGSLTAKQASLANDQLRSLYSQLRPNAIALVDAFNFTDHYLGSILGRYDGNVYPNLYEEAWKDPLNESVVPDGYREYVQPLLKNQLRNARL

SEQ ID NO: 22060 - protein, 664 aa, Momordica charantia
MEGVDHLSHERRNAQFDVDEMKIIWAGSRHAFEVSDRMSRLVANDPVFRKDNRVQLGRKELFKNTLRKAAYAWKRIIELKLSEEEAGRLRFFVDEPAYTDLHWGMFVPFLKGQGSDEQLQKWMPLAYKMQIIGCYAQTELGHGSNVQGLETTATFDQRTDEFIIHSPTLTSSKWWPGGLGKVSTHAVVFARLITDGQDYGVHGFLVQIRSLDDHSILPGITIGDIGMKFGNAAYNTMDNGVMQFDHVRIPRNQMLMRFSQVTREGKYVQSDVPRQLVYGTMVFVRKTIVVDASNALSRAVCIATRYSAVRRQFGSQNGDVETQVIDYKTQQSRLFPLLASAYAFRFVGEWLQWLYTDVTQRLAANDFSTLPEAHACTAGLKSITTAATADGIEECRKLCGGHGYLCSSGLPELFAVYVPACTYEGDNIVLLLQVARILMKTVAQLASGKKPVGTISYMGRAQHLLECSSNVQKAEDWLKPSVVLEAFEARATRMSVSCAKKLSKFTNQEEGFQELSPSLVEAAVAHCQLIVVSKFIEKLQGDIPGKGVKDQLQKLCGIYALYTLHKHLGDFLSTSTITPKQASLADDLLRSLYSQVRPNAIALVDAFNYTDHYLGSILGRYDGNVYPNLYEAAWKDPLNDSATPDGYHEYIKPLLKQQLRNARL

SEQ ID NO: 22061 - protein, 664 aa, Flaveria ramosissima
MEGVDYLSDERNKAELGIGESMKIAWAGSRQAFELSDRMAKLVANDPAFEKFTRPMLGRKELLKNTLRKAAHGWKLIVDLRLTEEEAKWLRLYIDEPAYTDLHWGMFIPAIEGQGTEEQKKKWLPLAQKMQIIGCYAQTELGHGSNVQGLETTATFDPQTDEFIIHSPTLTSSKWWPGGLGKVSTHAVVYARLIVGGGFHGVHGFIVQLRSLDDHSPLPGVTVGDIGLKFGNGAYNTMDNGVLRFDHVRIPRDQMLMRVTQVTKEGKIVQSNVPRQLIYGTMVYVRQTIVADASKALSRAVCIATRYSAVRRQFGSRNGGPETQVIDYKTQQSRLFPLLASAYAFRFVGEWLKWLYMDVKQRLAANDFSTLPEAHACTAGLKSLTTTATADGIEECRKLCGGHGYLVSSGLPELFAVYIPACTYEGDNVVLLLQVARFLVKTVSELGYKIPVGTTAYMGRVASLMQNNCAVQTAEGWLNPGAIMEAFESRAARMAVRCGRQLAKFDNPEEGFAELSADLVEASVAHCQLIIVSKFIEKLQQDIPGKGVKQTLEVLCYVYALFLLHKHQGDFLATGYLTPKQASLANDQLRTLYSKVRPNAIALVDSFNYTDHYLGSILGRYDGNVYPKLYEAAWKDPLNDSDVVDGFHEYVQPILKQKLRTSKL

SEQ ID NO: 22062 - protein, 663 aa, Flaveria ramosissima
MEGVDYLSDERNKAEFDVESMKIAWAGSREAFELSDRMAKLVANDPAFEKFTRPMLGRKELLKNTLRKAAHGWKLIVDLRLTEEEAKWLRLYIDEPAYTDLHWGMFIPALEGQGTEEQKKKWLPLAQKMQIIGCYAQTELGHGSNVQGLETTATFDPQKDEFIIHSPTLTSSKWWPGGLGKISTHAVVYARLIVGGEFHGVHGFIVQLRSLDDHSPLPGVTVGDIGLKFGNGAYNTMDNGVLRFDHVRIPRDQMLMRVTQVTKEGKIMQSDVPRQLIYGTMVYVRQTIVADASKALSRAVCIATRYSAVRRQFGSRNGGPETQVIDYKTQQSRLFPLLASAYAFRFVGEWLKWLYMDVKQRLAVNDFSTLPEAHACTAGLKSLTTTATADGIEECRKLCGGHGYLVSSGLPELFAVYIPACTYEGDNVVLLLQVARFLVKTVSELGHKKPVGTTAYMGRVASLMQNNCAVQTAEGWLNPGAIMEAFESRAARMAVQCGRQLAKFENPEEGFAELSADLVEASVAHCQLIIVSKFIEKLQQDIPGKGVKPTLEVLCYVYALFLLHKHQGDFLATGYLTPKQASLANDQLRTLYSKVRPNAIALVDSFNYTDHYLGSILGRYDGNVYPKLYEAAWKDPLNDSDVVDGFHEYVQPILKQKLRTSKL

SEQ ID NO: 22063 - protein, 663 aa, Centaurea maculosa
MEGVDYLIDERKKAQFDVEAMKVAWAGSREAFELSDRMGKLVANDPAFEKFTRPMLSRKELFKNTLRKAAHGWKLIVDLRLTEEEAKWLRLYIDEPAYTDLHWGMFIPAIEGQGTEEQKKKWLPLARKMQIIGCYAQTELGHGSNVQGLETTATFDPQADEFVIHSPTLTSSKWWPGGLGKASTHALVYARLIVGGEFHGVHGFIVQLRSLEDHLPLPGITVGDIGLKFGNGAYNTMDNGVLRFDHVRIPRDQMLMRVAQVTKEGKFRQSDVPRQLLYGTMVYVRQTIVSDASKALSRAVCIATRYSAVRRQFGSRNGGPETQVIDYKTQQSRLFPLLASAYAFRFVGEWLKWLYTDVKQRLEANDFSTLPEAHACTAGLKSLTTTATADGIEECRKLCGGHGYLVSSGLPELFAVYIPACTYEGDNVVLLLQVARFLVKTVSELGYKQPVGTTAYMGRVAALMQNNCTVRTVEDWLNPGAIVEAFEARAARMSVACGRQLAKFENPEEGFAELASDLVEAALAHCQLIVVTKFVEKLQQDIPGKGVKQSLEILCYVYALFLLHKHQGEFLATGYLTPKQAVLANEQLRTLYSKVRPNAIALVDSFNYTDHYLGSILGRYDGNVYPKLYEAAWQDPLNDSDVADGFHQYVQPILKQKLHSAKL

SEQ ID NO: 22064 - protein, 663 aa, Cichorium intybus
MEGVDYLSDEREKAQFDVKAMKVAWAGSRETLEVSDRMAKLVANDPAFEKFTRPMLGRKELFKDTLKKAAYAWKLIIDLRLSEEEAKWLRLYIDEPAFTDLHWGMFIPAIEGQGTEEQKQKWLPLAQKMQIIGCYAQTELGHGSNVQGLETTATFDPQTDEFVLHSPTLTSSKWWPGGLGKVSTHAVVYARLIVGGQFHGVHGFIVQLRSLEDHSPLRGITVGDIGLKFGNGAYNTMDNGVLRFSHVRIPRNQMLMRVLQVTKDGKIMQSDVPRQLIYGTMVYVRQTIVADASKALSRAVCIATRYSAVRRQFGSRDGGPETQVIDYKTQQSRLFPLLASAYAFRFVGEWLKWLYMDVKQRLAANDFSTLPEAHACTAGLKSLTTTATADGIEECRKLCGGHGYLVSSGLPELFAVYIPACTYEGDNVVLLLQVARFLVKTVSELGHKKPVGTTAYMGRAAALMQSNCGIQSAGEWLNPDAIVEAFEARAARMAVSCAQRLAKFENPEEGFAELAADLVEASVAHCQLIVVSKFIEKLQQDIPGKGVRESLEVLCYVYALFLLHKHQGDFLATGYLTPKQSALANDQLRTLYSKVRPNAIALVDSFSYTDHYLGSILGRYDGNVYPKLYEAAWKDPLNDSDVADGFHQYVQPILKQMLHSAKL

SEQ ID NO: 22065 - protein, 663 aa, Cichorium intybus
MEGVDYLSDERKKAQFDVKAMKVAWAGSRETLEVSDRMAKLVANDPAFEKFTRPMLGRKELFKDTLKKAAYAWKLIIDLRLSEEEAKWLRLYIDEPAFTDLHWGMFIPAIEGQGTEEQKQKWLPLAQKMQIIGCYAQTELGHGSNVQGLETTATFDPQTDEFVLHSPTLTSSKWWPGGLGKVSTHAVVYARLIVGGQFHGVHGFIVQLRSLEDHSPLRGITVGDIGLKFGNGAYNTMDNGVLRFSHVRIPRNQMLMRVLQVTKDGKIMQSDVPRQLIYGTMVYVRQTIVADASKALSRAVCIATRYSAVRRQFGSRDGGPETQVIDYKTQQSRLFPLLASAYAFRFVGEWLKWLYMDVKERLAANDFSTLPEAHACTAGLKSLTTTATADGIEECRKLCGGHGYLVSSGLPELFAVYIPACTYEGDNVVLLLQVARFLVKTVSELGHKKPVGTTAYMGRAAALMQSNCGIQSAGEWLNPDAIVEAFEARAARMAVSCAQRLAKFENPEEGFAELAADLVEASVAHCQLIVVSKFIEKLQQDIPGKGVRESLEVLCYVYALFLLHKHQGDFLATGYLTPKQSALANDQLRTLYSKVRPNAIALVDSFSYTDHYLGSILGRYDGNVYPKLYEAAWKDPLNDSDVADGFHQYVQPILKQKLHSAKL

SEQ ID NO: 22066 - protein, 663 aa, Cichorium intybus
MEGVDYLSDERKKAQFDVKAMKVAWAGSRETLEVSDRMAKLVANDPAFEKFTRPMLGRKELFKDTLKKAAYAWKLIIDLRLSEEEAKWLRLYIDEPAFTDLHWGMFIPAIEGQGTEEQKQKWLPLAQKMQIIGCYAQTELGHGSNVQGLETTATFDPQTDEFVLHSPTLTSSKWWPGGLGKVSTHAVVYARLIVGGQFHGVHGFIVQLRSLEDHSPLRGITVGDIGLKFGNGAYNTMDNGVLRFSHVRIPRNQMLMRVLQVTKDGKIMQSDVPRQLIYGTMVYVRQTIVADASKALSRAVCIATRYSCVRRQFGSRDGGPETQVIDYKTQQSRLFPLLASAYAFRFVGEWLKWLYMDVKQRLAANDFSTLPEAHACTAGLKSLTTTATADGIEECRKLCGGHGYLVSSGLPELFAVYIPACTYEGDNVVLLLQVARFLVKTVSELGHKKPVGTTAYMGRAAALMQNNCGIQSAGEWLNPDAIVEAFEARAARMAVSCAQRLAKFENPEEGFAELAADLVEASVAHCQLIVVSKFIEKLQQDIPGKGVRESLEVLCYVYALFLLHKHQGDFLATGYLTPKQSALANDQLRTLYSKVRPNAIALVDSFSYTDHYLGSILGRYDGNVYPKLYEAAWKDPLNDSDVADGFHQYVQPILKQKLHSAKL

SEQ ID NO: 22067 - protein, 663 aa, Cirsium arvense
MEGVDYLIDERKKAQFDVEAMKVAWAGSRETLEVSNRMAKLVADDPVFEKFTRPMLGRKELFKNTLRKAAHGWKLIVDLRLTEEEAKWLRLYIDEPAYTDLHWGMFIPAIEGQGTEEQKKKWLPLAQKMKIIGCYAQTELGHGSNVQGLETTATFDPQADEFVIHSPTLTSSKWWPGGLGKASTHALVYARLIVGGEFHGVHGFIVQLRSLEDHSPLPGITVGDIGLKFGNGAYNTMDNGVLRFDHVRIPRNQMMMRVSQVTKEGKYMQSDVPRQLIYGTMVYVRQTIVADASKALSRAVCIATRYSAVRRQFGSRNGGPETQVIDYKTQQSRLFPLLASAYAFRFVGEWLKWLYTDVKQRLEANDFSTLPEAHACTAGLKSLTTTATADGIEECRKLCGGHGYLVSSGLPELFAVYIPACTYEGDNVVLLLQVARFLVKTVSELGYKKPVGTTAYMGRVATLMQNNCAVKTAEDWLNPGAIVEAFEARAARMAVAVGQQLAKFENPEEGFAELASDLVEASVAHCQLIVVSKFIEKLQQDIPGKGVKQSLEILCYVYALFLLHKHQGDFLAIGYLTPKQALLANDQLRTLYSKVRPNAIALVDSFNYTDHYLGSILGRYDGNVYPKLYEAAWQDPLNDSDVADGFHQYVQPILKQKLHSAKL

SEQ ID NO: 22068 - protein, 663 aa, Echinacea purpurea
MEGVDYLSYERKKAQFDVEAMKVAWAGSREAFQLSDRMAKLVANDPAFEKFTRPMMGRKELLKNTLRKAAHGWKLIVDLRLTEEEAKWLRLYIDEPAYTDLHWGMFIPAIEGQGTEEQKKKWLPLAQKMQIIGCYAQTELGHGSNVQGLETTATFDPQTDEFVIHSPTLTSSKWWPGGLGKVSTHAVVYARLIVGGEFHGVHGFIVQLRSLDDHSPLPGITVGDIGMKFGNGAYNTMDNGVLRFDHVHTPRNQMLMRVTQVTKEGKVMQSNVPRQLIYGTMVYVRQTIVADASKALSRAVCIATRYSAVRRQFGSRNGGPETQVIDYKTQQSRLFPLLASAYAFRFVGEWLKWLYTDVKERLAANDFSTLPEAHACTAGLKSLTTSVTADGIEECRKLCGGHGYLVSSGLPELFAVYIPACTYEGDNVVLLLQVARFLVKTVSELGYKKPVGTTAYMGRVASLMQNSCAVQTAEDWLNHGAIIEAFESRAARMAVRCGRHLAKFENPEEGFAELSADLVEAAVAHCQLIVVSKFNEKLQQDIPGQGVKEMLEVLCYVYALFLLHKHQGDFLATGYLTPKQASLANDQLRTLYSKVRPNAIVLVDSFNYTDHYLGSILGRYDGNVYPKLYEAAWKDPLNDSDVVDGFHDYVQPILKQKIRTAKL

SEQ ID NO: 22069 - protein, 649 aa, Solanum lycopersicum
MEGIDYLAEERKKAEFNVDEMKIVWAGSRRAFEVSDYISKLVADDPGFSKEERTMLSRKELFKDTLRKSAYSWKHIIDLQLSEEEAEKLRYFVDEPAFIDSHLGVFIPAIKGQGNKEQLKKWLPLAYKMQIIGCYAQTELGHGSNVQGLETTATFDPQTDEFVIHSPTLTSSKWWPGGLGKVSTHAIVYARLITDGKDHGINGFIVQLRSLEDHKPLPGITVGDIGTKFGNGAYNTMDNGVLRFDHLHIPRDQMLMRVAQVTKDGKYVQSDVPRQLLYVSMVHVRQALVTYASGALSRAVCIATRYSAVRRQFGSQNGGQEIQVIDYKTQQSRLFPLLASAYAFRFVGEWLKWFCTDVTQRLKANDFSTLPELHATTAGIKSLTTTATADGIEECRKLCGGHGYLCSSGLPELYAVSVPACTFEGDNVVLLLQVARFLLKTLSQLSSGKKPTGTIAYMGKIEQLMQCHSDVEQAKDWLKPSAILEAFEARAARMSVSCAQSLSKFDYPEEGFQELATDLVEAAVAHCQLIVVSKFIEKLQQDIPGEGVKQQLVVLCSIYALFLLHKHQGDFLATGYITSKQGLFANEQLRALYTQVCLIGFVICVCCSFVYPKLYEAAWKDPLNESDIPDGFHEYIRPLLEQQLQTARL

SEQ ID NO: 22070 - protein, 631 aa, Catharanthus roseus
VSDRISKLVANDPAFAKDERTMMPRKELFKNTLRKAAYAWKKINELRLSEEEASKLRFYVDEPAFTDLHWGMFVPFIKGQGTDEQQQKWLSLAYKMQIIGCYAQTELGHGSNVQGLETTATFDPQTDEFVIHSPTLTSSKWWPGGLGKVSTHAVVFARLITDGKEYGVHGFIVQLRSLEDHQPLPGVTVGDIGMKFGNGAYNTMDNGVLRFDHVRIPRDHMLMRFSQVTRDGKYKQSDVPRQLVYGTMVYVRQTIVQDASSALSRAVCIATRYSAVRRQFGSQNGGPETQVIDYKTQQSRLFPLLASAYAFRFAGEWLKWLYTDVTQRLQANDFSTLPEAHACTAGLKSLTTSATADAIEECRKLCGGHGYLCTSGLPELFAVYVPACTYEGDNIVMLLQVARFLMKTVSQLAFGKQLTGTIAYMGRLEHLMECRCSVQKAEDWLNPSAVLEVFEARAARMSVSGAQRLSNFTNPEEGFAELSADLVEAAVAHCQLIVVSKFIEKLQQDIPGQGVKEQLKALCGIYYLYLLHKHQGDFLATSCITPKQASLANDLLRTLYSQVRPNAVALVDAFNYTDHYLGSILGCYDGNVYAKLYDAAWKDPLNESVVPDGYQEFIRPLLKRQLGNAKL

SEQ ID NO: 22071 - protein, 210 aa, Solanum tuberosum
MAISVASLASSFASLSFSSQISQKPYAVSLAHSKQFSFSLTSKIPRLVVSASVAEAPETEELETRENLLKLVKSRLPGGFAAQPIFGTGRRKSASARVVLQEGSGKIIINYRDAKEYLQGNPLWIQYVKTPLATLGYEASYDIFVKVEGGGLSGQAQAISLGIARALLKVSESHRKPLRVEGLLTRDARVVERKKVGLKKARKRPQFSKR

SEQ ID NO: 22072 - protein, 210 aa, Solanum phureja
MAISVASLASSFASLSFSSQISQKPYAVSLAHSKQFSFSLTSKIPRLVVSASVAEAPETKELETRENLLKLVKSRLPGGFAAQPIFGTGRRKSASARVVLQEGSGKIIINYRDAKEYLQGNPLWIQYVKTPLATLGYEASYDIFVKVEGGGLSGQAQAISLGIARALLKVSESHRKPLRVEGLLTRDARVVERKKVGLKKARKRPQFSKR

SEQ ID NO: 22073 - protein, 210 aa, Nicotiana benthamiana
MAISLTSLTSSFASLSFSSQISQKPYAVSLAHLKPFPLSLNSKIPTLVVSASVAEAPAAPELETREELLKLVKSRLPGGFAAQPIFGTGRRKSASARVVLQEGSGKIIINYRDAKEYLQGNPLWIQYVKTPLATLGYEASYDIFVKVEGGGLSGQAQAISLGIARALLKVSESHRKPLREEGLLTRDARVVERKKVGLKKARKRPQFSKR

SEQ ID NO: 22074 - protein, 210 aa, Nicotiana benthamiana
MAISLTSLTSSFASLSFSSQISKKPYAISLAHSKQFPLSLTSKIPTLVVSASVAEAPAAPELETREELLKLVKSRLPGGFAAQPIFGTGRRKSASARVVIQEGSGKIIINYRDAKEYLQGNPLWIQYVKTPLATLGYEASYDIFVKVEGGGLSGQAQAISLGIARALLKVSESHRKPLREEGLLTRDARVVERKKVGLKKARKRPQFSKR

SEQ ID NO: 22075 - protein, 210 aa, Nicotiana tabacum
MAISLASLTSSFASLSFSSQISQKPYAISFANSKPFPLSLTSKIPTLVVSASVAEAPAPPELETREELLKLVKSRLPGGFAAQPIFGTGRRKSASARVVLQEGSGKIIINYRDAKEYLQGNPLWIQYVKTPLATLGYEASYDIFVKVEGGGLSGQAQAISLGIARALLKISESHRKPLREEGLLTRDARVVERKKVGLKKARKRPQFSKR

SEQ ID NO: 22076 - protein, 210 aa, Solanum melongena
MAISVASLTSSFSSLSFSSQISQKPYALSLTHSKKISFSLTPKVPTLVVSASVAEAPAPEDFETREDLLKLVKSRLPGGFAAQPIFGTGRRKSAIARVVLQEGSGKIIINYRDAKEYLQGNPLWIQYVKTPLATLGYEASYDIFVKVEGGGLSGQAQAISLGIARALLKVSENHRKPLREEGPLTRDSRVVERKKAGLKKARKRPQFSKR

SEQ ID NO: 22077 - protein, 211 aa, Capsicum annuum
MAVSVASLTSSFASLSFTSQISQKPYALSLSHSKQFPFSLTSKTPKLIVSASVAEAPSATEELETREDLLKLVKSRLPGGFAAQPFFGTGRRKSASARVVVQEGSGMIVINYRDAKEYLQGNPLWIQYVKTPMATLGYEASYDIFVKVEGGGLSGQAQAISLGIARALLKVSESHRKPLRDEGLLTRDARVVERKKAGLKKARKRPQFSKR

SEQ ID NO: 22078 - protein, 207 aa, Petunia hybrida
MAISLTSLTSSFASLSFSSQISQKPYIYCSKPLSLSVSSKLPKISATVAAEEAAAVVESESREELLKLVKSRLPGGFAAQPIFGTGRRKSASARVVLQEGSGKIIINYRDAKDYLQGNPLWIQYVKTPLATLGYEASYDIFVKVEGGGLSGQAQAISLGIARALLKVSESHRKPLREEGLLTRDARVVERKKVGLKKARKRPQFSKR

SEQ ID NO: 22079 - protein, 320 aa, Solanum tuberosum
MESCIYHQLKSQPVWLLLLLSLGFLKVLCFSVIFLKWVYVNFLRPAKNLKKYGSWALVTGPTDGIGKGFAFELARKGLNLVLVGRNPDKLKDVSESINAKYGQTQIKTVVVDFSGDLDEGVKKIKETIEGLDIGVLINNVGVSYPYARFFHEVDDKLLADLIKVNVEGTTKVTQAVLPGMIQRKRGAIVNIGSGAAIVIPSDPLYAVYAATKAYIDQFSRCLYVEYKKSGIDVQCQVPLYVATKMASIKRSSFFVPSTDGYARSALRWIGHEPRCTPYWPHSLLWGLLYSSPESMVDAWRLKFCIGIRRRGQLKDSRKNE

SEQ ID NO: 22080 - protein, 320 aa, Solanum phureja
MESCIYHQLKSQPVWLLLLLSLGFLKVLCFSVIFLKWVYVNFLRPAKNLKKYGSWALVTGPTDGIGKGFAFELARKGLNLVLVGRNPDKLKDVSESINAKYGQTQIKTVVVDFSGDLDEGVKKIKETIEGLDIGVLINNVGVSYPYARFFHEVDDKLLADLIKVNVEGTTKVTQAVLPGMIQRKRGAIVNIGSGAAIVIPADPLYAVYAATKAYIDQFSRCLYVEYKKSGIDVQCQVPLYVATKMASIKRSSFFVPSTDGYARAALRWIGHEPRCTPYWPHSLLWGLLYSSPESMVDAWRLKFCIGIRRRGQLKDSRKNE

SEQ ID NO: 22081 - protein, 320 aa, Solanum melongena
MESCIYHQLKSQPLWLLLLLSLGSLKVLCYSLIFLKWVYVNFLRPAKNLKKYGSWALVTGPTDGIGKGFAFQLARKGLNLVLVGRSPDKLKDVSESIKAKYGQTQIKTVVVDFTGDLDEGVKKIKETIEGLDVGVLINNVGISYPYARFFHEVDDKLFADLIKVNVEGTTKVTQAVLPGMIQRKRGAIVNIGSGSAIVIPSDPLYSVYAATKAYIDQFSRCLYVEYKKNGIDVQCQVPLYVATKMASIKRSSFFVPSTDGYAQAALRWIGYEPRCTPYWPHSLLWGLLYSLPESIVDAWRLKFCSGIRRRGQLKDSRKNE

SEQ ID NO: 22082 - protein, 320 aa, Nicotiana tabacum
METCIYHQLKSQPFWLLFLPSLGSLKILCFSIIFLKWVYVNFLRPGKNLKKYGSWALVTGPTDGIGKGFAFQLARKGLNLVLVGRNPDKLKDVSDSIKAKYGQIQIKSVVVDFSGDLDEGVEKIKETIEGLDVGVLINNVGVSYPYARFFHEVDDKLLADLIKVNVEGTTKVTQAVLPGMLKRKKGAIVNIGSGAAIVIPSAPLYAVYAATKAYVDQFSRCLYVEYKKSGIDVQCQVPLYVATKMASIKRSSFFVPSTDGYARAGLRWIGYEPRCTPYWPHSLLWGLIYSLPESIVDAWRLKFCMGIRKRGQMKDSRKKE

SEQ ID NO: 22083 - protein, 320 aa, Nicotiana benthamiana
METCIYHQLKSQPIWLLFLLSLGSLKFLCFLLVFLKWVYVNFLRPGKNLKKYGSWALVTGPTDGIGKGFAFQLAKKGLNLVLVGRNPDKLKDVSDSIKAKYGQVQIKSVVVDFSDDLDEGVKKIKETIEGLDVGVLINNVGVSYPYARFFHEVDDKLLADLIKVNVEGTTKVTHAVLPGMLKRKKGAIVNIGSGAAIVIPSDPLYAVYAATKAYVDQFSRCLYVEYKKSGIDVQCQVPLYVATKMASIKRSSFFVPSTDGYARAGLRWIGYEPRCTPYWPHSLLWGLIYSLPESIVDAWRLKFCMGIRKRGQMKDSRKKE

SEQ ID NO: 22084 - protein, 320 aa, Capsicum annuum
MESCIYHQLKSQPIWLVLLLSLGILKVLSFSVILLRWVYVNFLRPAKNLKKYGSWALVTAPTDGIGKAFAFQLARKGLNLILVGRNPDKLKDVCDSIKVKYGKVEIKTVVVDFSGDLDEGVKKIKEIIEGLDIGVLINNVGVSYPYARFFHEVDDKLLADLIKVNVEGTTKVTQAVLPGMVQRKRGAIVNIGSGAANVIPADPLYAVYAATKAYIDQFSRCLYVEYNKSGIDVQCQVPLYVATKMASIRRSSFFVPSTDGYARAALRWIGHDPRCTPYWPHSLLWGLLYSLPESAVDAWRLKFNMGIRKRGQLKDNRKKE

SEQ ID NO: 22085 - protein, 320 aa, Ipomoea nil
MEACVYEQLKSQPPWLLVLLALGFLKLLALSVTVLKWVHVNFLRPGKNLKKYGSWALVTGPTDGIGKGFAFQLARKGLNLVLVGRNPEKLKDVSDSIKAKYGQTQIKSVVVDFSGDLDDGVRRIREAIEGIDVGVLINNVGVSYPYARFFHEVDDKLLADLIKVNVEGTTKVTQAVLPGMIQRKKGAIVNIGSGAAIVIPSDPLYSVYAATKAYIDQFSRCLYVEYKKSGIDVQCQVPLYVATKMASIRRSSFFVPSTDGYARAALRWIGYEPRCTPYWPHSLLWGLLYSLPESAVDAWRLKFCLGIRKRGQLKDSRKTE

SEQ ID NO: 22086 - protein, 320 aa, Petunia hybrida
METCIYHQLKTQPLWLLFLLSLGSLKLLSFAFIVLKWVYVNFLRPGKNLKKYGSWALVTGPTDGIGKAFAFQLAKKGLNLILVGRNPDKLNDVSASIMAKFAKTQIKNVVVDFSGDLDEGVVKIKEAIEGLDVGVLINNVGVSYPYARFFHEVDEKLLADLIKVNVEGTSKVTQAVLPGMVKRKKGAIVNIGSGAAIVIPSDPLYAVYAATKAYIDQFSRCLYVEYKKSGIDVQCQVPLYVATKMASIKRSSFFVPSTDGYARAGLRWIGYEPRCTPYWPHSLLWGLLSSLPESIIDAWRLKFCIGIRKRGQLKDSRKKE

SEQ ID NO: 22087 - protein, 323 aa, Tabernaemontana elegans
MESCLFHQVQELKSQPLWLLLLLAVGSLKLLLSLLSVLKWVYVNFLRPPKNLKKYGSWALVTGPTDGIGKGFAFQLARKGLNLVLVGRNPDKLKDVSDSIKEKNGQTQIKTVVVDFSGDLDEGVQKIKDTIEGLDVGILINNVGVSYPYARFFHEVDEKLLADLIKVNVEGTTKVTQAVLPGMIKRKKGAIVNIGSGAAIVIPSDPLYAVYAATKAYIDQFSRCLYVEYKKSGIDVQCQVPLYVATKMASIRRSSFFVPSTDGYARAGLRWIGYEPRCTPYWPHSVLWALAYSLPESIVDAWRLGFCLKIRKRGQVKDSRKKE

SEQ ID NO: 22088 - protein, 324 aa, Amsonia hubrichtii
MESSCLLHQVQQLKSQPLWLLLLLALGSLKVLLLLLSVLKWVYVNFLRPPKNLKKYGSWALVTGPTDGIGKSFAFQLARKGLHLVLVGRNPDKLKDVSDSIKTKYGQTQIKTVVVDFSGDLNEGVQRIKDTIEGLDVGVLINNVGVSYPYARFFHEVDEKLLADLIKVNVEGTTKVTQAVLPGMLQRKRGAIVNIGSGAAIVIPSDPLYAVYAATKAYIDQFSRCLYVEYKKSGIDVQCQVPLYVATKMASIRKSSFLVPSTDGYARAGLRWVGYEPRCTPYWPHSVLWALVHSLPEWIVDSWRLGFCLKIRKRGQLKDSRKKE

SEQ ID NO: 22089 - protein, 323 aa, Vinca minor
MESCPFHQVLELKSQPLWILLLLGLGSLKSLILLVSLLKWVYVNFLRPAKNLKKYGSWAVVTGPTDGIGKAFAFQLARKGLNLVLVGRNPDKLKDVSESIKDKYGQTQIKTVVVDFSGELNEGIQRIKETIEGLEVGILINNVGVSYPYARFFHEVDEKLLADLIKVNVEGTTKVTQAVLPGMVQRKRGAIVNIGSGAAIVIPSDPLYAVYAATKAYIDQFSRCLYVEYKKSGIDVQCQVPLYVATKMASIKRSSFFVPSTDGYARAGLRWIGYEPRCTPYWPHSVMWALASSLPESIIDTWRLGFCLKIRKRGQLKDARKQE

SEQ ID NO: 22090 - protein, 321 aa, Actinidia deliciosa
MELCSVMEPLKSQPLWLLLLLGLGSLSLLKCSFAFLKWVYVHFLRPAKNLKKYGSWALVTGPTDGIGKGFAFQLARKGLNLVLVGRNPEKLKDVSDSIRAKFRQTQIKTVVVDFSGDLNEGVNRIRETIEGLDVGILINNVGVSYPYARFFHEVDDKLLGDLIKVNVEGTTKVTQAVLPGMIKRKKGAIVNIGSGAAIVIPSDPLYAVYAATKAYIDQFSRCLYVEYKKSGIDVQCQVPLYVATKMASIRRSSFFVPSTDCYARAGLRWVGYEPRCTPYWPHSLLWALACLLPESIIDAWRLRFCLAIRKKGQLKDSRKKE

SEQ ID NO: 22091 - protein, 320 aa, Manihot esculenta
MELYFLDKLKGQPSWILVLFTVGSLSVLKCFFAFLNWVYVNFLRPAKNLKKYGSWALVTGPTDGIGKGFAFQLARKGLNLVLVGRNPDKLKDVSDSIQSKYGKVQIKNVVVDFSGDIDEGVKKIQETIEGLDVGVLINNVGVSYPYARFFHEVDDDLLKNLIKVNVEGTTKVTQAVLPGMLKRKKGAIVNIGSGAAIVIPSDPLYAVYAATKAYIDQFSRCLYVEYKKSGIDVQCQVPLYVATKMASIRRSSFFVPSTDGYARAGLRWIGYEPRCTPYWPHSLLWGLLCALPESIVDGWRLRYCLGIRKKGQLKDSRKKE

SEQ ID NO: 22092 - protein, 320 aa, Olea europaea
MAECILEQLKSQPTWLLPLLVLGFLSLFKCSFTILNWVYVNFLRPGKNLKKYGSWALVTGPTDGIGKAFAFQLARKGLNLVLVGRNPDKLREVSDSIKSKHGSTQIKTVVVDFSCDLNDGVGRIKETIEGLDIGILINNAGISYPYARFFHELDEKLLNDLIKVNVESTTKVTQAVLPGMLERKKGAIVNIGSGAAMVIPSDPLYAVYAATKAYIDQFSRCLYVEYKKSGIDVQCQVPLYVATKMASIKRSSFFVPSTDGYARAALRWIGYEPRCTPYWPHSLLWGLLYSLPESVVDAWRLKFCLGIRKRGQLKDSRKKE

SEQ ID NO: 22093 - protein, 320 aa, Gossypium hirsutum
MEACFFDTLKAQSFWVIFLFTLGSLSLLKFSFVFLKWVWINFLRPGKNLKKYGSWGLVTGPTDGIGKGFAFQLARKGLNLVLVGRNPDKLKDVSDSILAKYAKIRIKTVVVDFTGDLDEGVKKIKETIEGLDVGVLINNVGISYPYARFFHEVDEELLMNLIKVNVEGTTKVTQAVLPGMVKRKRGAIVNIGSGAAIVIPSDPLYAVYAATKAYIDQFSRCLYVEYKNSGIDVQCQVPLYVATKMASIKRSSFFVPSTDGYARAAMRWIGYEPRCTPYWPHSILWGLAYSLPESVVDAWRLRFCLGIRKRGQLKDSRKKE

SEQ ID NO: 22094 - protein, 320 aa, Gossypium raimondii
MEACFFDTLKAQPFWVIFLFTLGSLSLLKFSFVFLKWVWINFLRPGKNLKKYGSWGLVTGPTDGIGKGFAFQLARKGLNLVLVGRNPDKLKDVSDSILAKYAKIQIKTVVVDFTGDLDEGVKKIKETIEGLDVGVLINNVGISYPYARFFHEVDEELLMNLIKVNVEGTTKVTQAVLPGMVKRKKGAIVNIGSGAAIVIPSDPLYAVYAATKAYIDQFSRCLYVEYKNIGIDVQCQVPLYVATKMASIKRSSFFVPSTDGYARAAMRWIGYEPRCTPYWPHSILWGLAYSLPESVVDAWRLRFCLGIRKRGQLKDSRKKE

SEQ ID NO: 22095 - protein, 320 aa, Hevea brasiliensis
MELCFVDKLKEQPYWLLVLFTMGSLSVLKFFFAFLKWVYVNFLRPAKNLKKYGSWALVTGPTDGIGKGFAFQLARKGINLVLVGRNPDKLKDVSDSIQSKYGKVQIKTVVVDFSGDINEGVKKIQETIEGLDVGVLINNVGVSYPYARFFHEVDEELLKNLIKVNVEGTTKVTQAVLPGMLKRKKGAIVNMGSGAAVVIPSDPLYAVYAATKAYIDQFSRCLYVEYKKSGIDVQCQVPLYVATKMASIRRSSFFIPSTDGYARAGLRWIGHEPRCTPYWPHSLLWGLLYALPESIIDAWRLRFCLGIRKKGQQKDSRKKE

SEQ ID NO: 22096 - protein, 320 aa, Tropaeolum majus
MEVCLLETLKSQPIWVIALFSLGSLSVLKFSLSILKWVYVSFLRPGKNLKKYGSWALVTGPTDGIGKSFAFQLARKGINLVLVGRNPDKLKDVSDSIVAKYGKTLIKTVVVDFSGDLDEGVNKIKETIEGLDIGVLINNVGISYPYARFFHEVDEKLLKNLIKVNVEGTTKVTQAVLPGMLERKKGAIVNIGSGAAIVIPSDPLYAVYAATKAYIDQFSRCLYVEYKKSGIDVQCQVPLYVATKMASIRRSSFFVPSTDSYAKAGLRWIGYEPRCTPYWPHSLLWGLASLLPESAIDAWRLPFCMKIRKRGQLKDARKDE

SEQ ID NO: 22097 - protein, 320 aa, Olea europaea
MAECILEQLKSQPTWLLPLLTLGVLSLFKCLFSILKWVYVNFLRPGKNLKKYGSWALVTGATDGIGKAFAFQLARKGLNLILVGRNPDKLREVSDSIKSKHGSTQIKTVVVDFSGDLNDGVGRIKETIEGLDVGVLINNAGISYPYARFFHEVDENLLNDLIKVNVEGTTKVTHAVLPGMLNRKKGAIVNIGSGAATVIPSDPLYDVYAASKAYIDQFSRCLYVEYKKSGIDVQCQVPLYVATKMASIKRSSFFVPSTDGYARAALRWIGYEPRCTPYWPHSLLWGLLYSLPESIVDAWRLKFCLGIRKRGQLKDSRKKE

SEQ ID NO: 22098 - protein, 320 aa, Manihot esculenta
MEHCFVDKLKDQPSWLLVLFTIGSLSLLKFFFAFLKWVYVNFLRPAKNLKKYGSWALVTGPTDGIGKGFAFQLARKGMNLVLVGRNPDKLKDVSDSIQSKYGKVQIKSVVVDFSGDIDEGIRKIQETIEGLDVGVLINNVGVSYPYARFFHEVDEELLKNLIKVNVEGTTKVTKAVLPGMLKRKKGAIVNIGSGAAIVIPSDPLYAVYAATKAYIDQFSRCLYVEYKKSGIDVQCQVPLYVATKMASIRRSSFFVPSTDGYARAGLRWIGYEPRCTPYWPHSLLWGLLYALPESIIDAWRLHFCLGIRKRGQQKDSRKKE

SEQ ID NO: 22099 - protein, 320 aa, Prunus mume
MGFCLLEHLKTQPFWLVVLFTLGSLSVLRFSLAFLQWVYVNFLRPAKNLKKYGSWALVTGPTDGIGKAFAFQLARKGLNLVLVGRNPEKLKDVSDSILAKYGKTQIKTVVVDFTGDLDNGVKRIRETIEGLDVGLLVNNAGISYPYARFFHEVDEELLKNLIKVNVEGTTKVTQAVLPGMLQRKRGAIVNIGSGAAIVIPSDPLYAVYAATKAYIDQFSRCLYVEYKKSGIDVQCQVPLYVATKMASIRRSSFFVPSTDGYARAALRWIGYEPRCTPYWPHTLLWAVASSLPESVVDAWRLRFCLAIRKRGQLKDSQKQE

SEQ ID NO: 22100 - protein, 320 aa, Gossypium hirsutum
MEACFFDTLKAQPFWVIVLFTLGSLSLLKFSFVFLKWVWINFLRPGKNLKKYGSWGLVTGPTDGIGKGFAFQLARKGLNLVLVGRNPDKLKDVSDSILAKYAKIQIKTVVVDFTGDLDEGVKKIKETIEGLDVGVLINNVGISYPYARYFHEVDEELLMNLIKVNVEGTTKVTQAVLPGMVKRKKGAIVNIGSGAAIVIPSDPLYAVYAATKAYIDQFSRCLYVEYKNIGIDVQCQVPLYVATKMASIKRSSFFVPSTDGYARAAMQWIGYEPRCTPYWPHSILWGLAYSLPESVVDAWRLRFCLGIRKRGQLKDSRKKE

SEQ ID NO: 22101 - protein, 320 aa, Gossypium raimondii
MEACFFDTLKAQPFWVIFLFTLGSLSLLKFSFVFLKWVWINFLRPGKNLKKYGSWGLVTGPTDGIGKGFAFQLARKGLNLVLVGRNPDKLKDVSDSILAKYAKIQIKTVVVDFTGDLDEGVKKIKETVEGLDVGVLINNVGISYPYARYFHEVDEELLVNLIKVNVEGTTKVTQAVLPGMVKRKKGAIVNIGSGAAIVIPSDPLYAVYAATKAYIDQFSRCLYVEYKNSGIDVQCQVPLYVATKMASIKRSSFFVPSTDGYARAAMRWIGYEPRCTPYWPHSILWGLAYSLPESVVDAWRLRFCLGIRKRGQMKDSRKKE

SEQ ID NO: 22102 - protein, 320 aa, Theobroma cacao
MATCFFDTLKAQPFWVLVLFTLGSLSLLKSSFVFLKWVWVNFLRPGKNLKKYGSWGLVTGPTDGIGKGFAFQLARKGLNLVLVGRNPDKLKDVSDSILAKYGKIQIKTVVVDFTGDFDEGVKKIKEAIEGLDVGILINNVGISYPYARFFHEVDEELLRNLIKVNVEGTTKVTQAVLPGMVKRKRGAIVNIGSGAAIVIPSDPLYAVYAATKAYIDQFSKCLYVEYKNSGIDVQCQVPLYVATKMASIKRSSFFVPSTDGYARAAMRWIGYEPRCTPYWPHSILWSLASSLPESVVDAWRFHFCLGIRKRGQLKDSRKKE

SEQ ID NO: 22103 - protein, 320 aa, Gossypium hirsutum
MEACFFDTFKAQPFWVIFLFTLGSLSLLKFSFVFLKWVWINFLRPGKNLKKYGSWGLVTGPTDGIGKGFAFQLARKGLNLVLVGRNPDKLKDVSDSILAKYAKIQIRTVVVDFTGDLDEGVKKIKETIEGLDVGVLINNVGISYPYARYFHEVDEELLVNLIKVNVEGTTKVTQAVLPGMVKRKKGAIVNIGSGAAIVIPSDPLYAVYAATKAYIDQFSRCLYVEYKNSGIDVQCQVPLYVATKMASIKRSSFFVPSTDGYARAAMRWIGYEPRCTPYWPHSILWGLAYSLPESVVDAWRLRFCLGIRKRGQMKDSRKKE

SEQ ID NO: 22104 - protein, 320 aa, Prunus persica
MGFCLLEHLKTQPFWLVVLFTLGSLSVLRFSLAFLQWVYVNFLRPAKNLKKYGSWALVTGPTDGIGKAFAFQLARKGLNLVLMGRNPEKLKDVSDSILAKYGKTQIKTVVVDFTGDLDDGVKRIRETIEGLDVGLLVNNVGISYPYARFFHEVDEELLKNLIKVNVEGTTKVTQAVLPGMLQRKRGAIVNIGSGAAIVIPSDPLYAVYAATKAYIDQFSRCLYVEYKQSGIDVQCQVPLYVATKMASIRRSSFFVPSTDGYARAALRWIGYEPRCTPYWPHTLLWALASSLPESVVDAWRLRFCLAIRKRGQLKDSQKQE

SEQ ID NO: 22105 - protein, 321 aa, Cucurbita pepo
MELSCVEQLKSQPLWVCLLFAFGSLSALKFLVIVLKWVYVNFLRPPKNLKKYGSWALVTGPTDGIGKGFAFQLARKGLNLILVGRNPEKLKDVSDSIVAKYGSIQIKNVVVDFSGDLSEGMKRISEAIEGLDVGVLINNVGVSYPYGRFFHEVDEELLNNLIKVNVEGTTKVTQAVLPGMLKRKRGAIVNIGSGAAIVIPSDPLYAVYAATKAYIDQFSRCLYVEYKKSGIDVQCQVPLYVATKMASIRRSSFFVPLTNGYAAAALRWIGYEPRCTPYWPHQLIWGLVYLLPESVVDAWRLKFCLGIRKRGQLKDSRKKEE

SEQ ID NO: 22106 - protein, 320 aa, Cucumis melo
MQLGCIEQLKSQPIWVLFLLALGSLSALKFILIILKWIYVNFLRPSKNLKKYGSWALVTGPTDGIGKSFAFQLARKGLNLVLVGRNPEKLKDVSDSIVAKYGSIQIKSVVVDFSGDLSEGIKRITEAIEGLDVGVLINNVGVSYPYGRFFHEVDEELLNNLIKVNVEGTTKVTHAVLPGMLKRKRGAIVNIGSGAAIVIPSDPLYTVYAATKAYIDQFSRCLYVEYKKSGIDVQCQVPLYVATKMASIRRSSFFVPSTNGYAAAALRWIGYEPRCTPYWPHQLLWGLVSLLPESVVDGWRLNFCLGIRKRGQLKDSRKKE

SEQ ID NO: 22107 - protein, 320 aa, Vaccinium corymbosum
MELCSMEQLKSQPYWLLLLLTLGSISLLKLTLSFLDWVFVNFLRPPKNLKKYGSWALVTGPTDGIGKGFAFQLARKGLNLILVGRNPSKLAEVSDSIRAKYGQTQIKTVVVDFSGDLNEGVDRIREEIEGLDVGVLVNNVGVSYPYARFFHEVDEKLLKDLIQINVEGTTKVTKVVLDGMVKRKRGAIVNIGSGAAVVIPSDPLYAVYAATKAYIDQFSRCLYVEYKNSGIDVQCQVPLYVATKMASIKRSSFFVPSTDGYARAAMRWIGYEPRCTPYWPHSLLWGLANSLPESIIDAWRLRFCLAIRKRGQLKDSRKKE

SEQ ID NO: 22108 - protein, 320 aa, Orobanche aegyptiaca
MADCIFHQLKSQPTWLILLTSLGSLSLLRLSFSILKWIYVNFLRPGKNLKKYGSWALITGPTDGIGKAFAFQLAGKGLNLILVGRNPDKLKEVSESIKSKYGSTRITNVVVDFSGDLDDGVSRIKDAIEGLDVGVLINNVGLSYPYARFFHEVDDKLLSDLIRVNVEGTTKVTRVVLPGMVRRKKGAIVNIGSGAAIVIPSDPLYSVYAATKAYVDQFSRCLYVEYKKSGIDVQCQVPLYVATKMASIKRSSFFVPSTDGYARAALRWIGYEPRCTPYWPHTLLWALANSLPESVVDAWRLKFCLGIRKRGQLKDSRKNE

SEQ ID NO: 22109 - protein, 320 aa, Sarracenia psittacina
MELCFMEQLKAQPLWVLLLLGLGSLSVLRFSLAFFNWVYVNFLRPSKNLKKYGSWALVTGPTDGIGKGFAFQLARKGLNLVLVGRNPDKLKEVSDSIGAKFGQIKIKTVVVDFSGDLTDGVHRIGEAIDDLDIGILVNNVGISYPYARFFHEVDEKLLADLIKINVEGTTKVTQAVLPGMLKRKRGAIVNIGSGAAIVIPSDPLYAVYAATKAYIDQFSRCLYVEYKKSGIDVQCQVPLYVATKMASIRRSSFFVPSTDGYARAAIRWIGYEPRCTPYWPHTLLWALANSLPESAIDAWRLRFCLAIRKKGQFKDSRKKE

SEQ ID NO: 22110 - protein, 320 aa, Gossypium hirsutum
MEACFFDTLKAQPFWVIFLFTLGSLSLFKFSFVFLKWVWINFLRPGKNLKKYGSWGLITGPTDGIGKGFAFQLARKGLNLVLVGRNPDKLKDVSDSILAKYAKIQIKTVVVDFTGDLDEGVKKIKETIEGLDVGVLINNVGISYPYARFFHEVDEELLMNLIKVNVEGTTKVTQAVLPGMVKRKKGAIVNIGSGAAIVIPSDPLYAVYAATKAYIDQFSRCLYVEYKNRGIDVQCQVPLYVATKMASIKRSSFFVPSTDGYARAAMQWIGYEPHCTPYWPHSILWGLAYSLPESVVDAWRLRFCLGIRKRGQMKDSRKKE

SEQ ID NO: 22111 - protein, 321 aa, Malus domestica
MGSCLLEHLKAQPFWVLVLFTLGSFSLLKLSLSFLQWVYVNFLRPAKNLKKYGSWALVTGPTDGIGKAFAFQLARKGLNLILVGRNPDKLKDVSDAVLAKYGKTQIKTVVVDFTGDLDDGVRRIRETIEGLDVGLLINNVGISYPYARFFHEVDSELLRNLIKVNVEGTTKVTQAVLPGMVQRKRGAIVNIGSGAAIVIPSDPLYAVYAATKAYIDQFSRCLYVEYKKSGIDVQCQVPLYVATKMASIRRSSFFVPSTDGYARAALRWIGYEPRCTPYWPHTLLWGLACSLPESVVDAWRLRFCLRIRKRGQQKDSSLKQA

SEQ ID NO: 22112 - protein, 321 aa, Cannabis sativa
MELGFVENLKAQPLWVLLLFSVGSLSVLKFLIAFIKWVFVNFLRPAKNLKKYGSWAVVTGPTDGIGKGFAFQLARKGLNLVLVGRNPDKLKEVSDSIQAKFGNKTQIKTVVVDFSGDLDEGVQRIRETIEGLDVGILINNVGVSYPYARFFHEVDEQLLKNLIKVNVEGTTKVTQAVLPGMVQRKRGAIVNIGSGAAIVIPSDPLYAVYAATKAYIDQFSRCLYVEYRNIGIDVQCQVPLYVATKMASIKRSSFFVPSTDGYARAAMRWIGYEPRCTPYWPHSLLWALANALPECIIDAWRLRFCLAIRKRGQLKDSRKTD

SEQ ID NO: 22113 - protein, 350 aa, Nicotiana benthamiana
METCIYHQLKSQPTWLLFLLSLGSLKLLCFSLIILKWVYVNFLRPGKNLKKYGSWALVTGPTDGIGKGFAFQLAKKGLNLVLVGRNPTLHISTEIGKGFAFQLAKKGLNLVLVGRNPDKLKDVSDSIKAKYGQIQIKSVVVDFSGDLDEGVKKIKETIEGLDVGVLINNVGVSYPYARFFHEVDDKLLADLVKVNVEGTTKVTHAVLPGMLKRKKGAIVNIGSGAAIVIPSDPLYAVYAATKAYVDQFSRCLYVEYKKSGIDVQCQVPLYVATKMASIKRSSFIVPSTDGYARAGLRWIGYEPRCTPYWPHSLLWGLIYSLPESIVDAWRLKFCMGIRKRGQMKDSRKKE

SEQ ID NO: 22114 - protein, 320 aa, Rosmarinus officinalis
MTDCIFEQLKSQPTWLLLLISLGTFSLLKLSLSILKWAYVNFLRPGKNLKKYGSWAVITGPTDGIGKSFAFQLARKGLNLVLVGRSPTKLEEVSGAIKSKSGSTQIKTVVVDFSGDLDDGVSRIKEAIEGLDVGLLINNVGVSYPYARFFHEVDEKLLNDLIKVNVVGTTKVTQAVLPGMVERKKGAIVNIGSGAAIVIPSDPLYSVYAATKAYIDQFSRCLYVEYKKSGIDVQCQVPLYVATKMASIRRSSFFVPSADGYARAALRWIGYEPRCTPYWPHTLLWAVANSLPESAIDAWRLKFCLAIRKRGQLKDSRKKE

SEQ ID NO: 22115 - protein, 320 aa, Gossypium hirsutum
MEACFFDTLKAQPFWVIFLFTLGSLSLFKFSFVFLKWVWINFLRPGKNLKKYGSWGLITGPTDGIGKGFAFQLARKGLNLVLVGRNPDKLKDVSDSILAKNAKIQIKTVVVDFTGDLDEGVKKIKETIEGLDVGVLINNVGISYPYARFFHEVDEELLMNLIKVNVEGTTKVTQAVLPGMVKRKKGAIVNIGSGAAIVIPSDPLYAVYAATKAYIDQFSRCLYVEYKNRGIDVQCQVPLYVATKMASIKRSSFFVPSTDGYARAAMQWIGYEPHCTPYWPHSILWGLAYSLPESVVDAWRLRFCLGIRKRGQMKDSRKKE

SEQ ID NO: 22116 - protein, 320 aa, Panax ginseng
MELCSIDQLKSQPLWVLLLTGLGSLYVFRFLFSILRWVYVNFLRPPKNLKKYGSWALVTGPTDGIGKAFAFQLARKGLNLVLVGRNPEKLNAVSKAIRAKFGQTQISTVVVDFSGDLSEGIQRIRATIEGLDIGVLINNVGISYPYARFFHEVDAKLLADLIQVNVEGTTKVTQAVLPGMLKRKRGAIVNIGSGAAIIIPSDPLYSVYAAAKAYVDQFSRCLYVEYKNSGIDVQCQVPLYVATKMASIKRSSFFVPSTDGYAQAALRWIGYEPRCTPYWPHSILWALLYLLPESAVDAWRLRFCLAIRKRGQLKDSRKKE

SEQ ID NO: 22117 - protein, 320 aa, Panax ginseng
MELCSIDQLKSQPLWVLLLTGLGSLYVFRFLFSILRWVYVNFLRPPKNLKKYGSWALVTGPTDGIGKAFAFQLARKGLNLVLVGRNPEKLNAVSEAIRAKFGQTQISTVVVDFSGDLSEGIQRIRATIEGLDIGVLINNVGISYPYARFFHEVDAKLLADLIQVNVEGTTKVTQAVLPGMLKRKRGAIVNIGSGAAIIIPSDPLYSVYAAAKAYVDQFSRCLYVEYKNSGIDVQCQVPLYVATKMASIKRSSFFVPSTDGYAQAALRWIGYEPRCTPYWPHSILWALLYLLPESVVDAWRLRFCLAIRKRGQLKDTRKKE

SEQ ID NO: 22118 - protein, 320 aa, Mimulus guttatus
MAECIYHQLKSQPTWILILLSLGSISLLKLSFSIIIWVYVNFIRPGKNLKKYGSWALITGPTDGIGKAFAFQLARKGLNLVLVGRNPDKLKEVSESIKSKSGSTQIKNVVVDFSGDLDDGVSRIKEAIEGLDVGLLINNVGVSYPYARFFHEVDEKLLSDLIKVNIEGTTKVTQAVLPAMVKRKKGAIVNIGSGAAIVIPSDPLYSVYAATKAYVDQFSRCLYVEYKNSGIDVQCQVPLYVATKMASIKRSSFFVPSTDGYARAALRWIGYEPRCTPYWPHSILWALANSLPESAIDAWRLKFCLAIRKRGQLKDSKKIE

SEQ ID NO: 22119 - protein, 319 aa, Trifolium pratense
DCCIMSKLKTQPFWFILLFSLGLFTILRFTLILLNWVYVNFLRQPKNLKKYGSWALVTGPTDGIGKSFAFELARKGLNLILVGRNPDKLKDVSDSVKSKFGKTEVKTVVVDFAGDLDEGVNRIRETIEGLDIGVLINNVGISYPYARFFHEVDEELLKNLIHVNVVGTTKVTQAVLPGMLKRKKGAIVNIGSGAAIVIPSDPLYAVYAATKAYIDQFSRCLYVEYKKSGIDVQCQVPLYVATKMASIKRSSFFVPSTDGYAKAGVKWIGYEPRCTPYWPHTLLWAVACSLPESIVDAWRLRFCIGIRKRGQLKDSRKQE

SEQ ID NO: 22120 - protein, 321 aa, Euphorbia peplus
MELCFLNHLKDQPIWLLAFFSLGSLSITKFIFISLNWVYVNFLRPGKNLKKYGSWALVTGPTDGIGKGFAFQLAKKGLNLILVARNPDKLKEVSDSILAKYGKTQIKSVIVDFSGDLDDGVKRIKESIEGLDVGVLINNVGVSYPYARFFHEVDEDLLRNLIKVNVEGTTKVTQAVLPGMLSRKKGAIVNIGSGAAIVIPSDPLYAVYAATKAYIDQFSRCLYVEYKKSGIDVQCQVPLYVATKMASIKRSSFFVPSTDGYARAGLHWIGYEPRCTPYWPHSLLWGLLTILPESAIDKWRLGFCLNIRKKGQQKDSRTKKE

SEQ ID NO: 22121 - protein, 320 aa, Tripterygium wilfordii
MGPCFFDTLKAQPSWVLLLFSLGSFSILKFSLAVLKWVYVSFLRPAKNLKKYGSWALVTGPTDGIGKSFAFELGRKGLNLVLVGRNPGKLKDVSDSIKAKYGKTEIKNVVVDFSGDLDEGVKRIGEAIGGLDIGVLINNVGISYPYARFFHEVDEELLKNLIKVNVEGTTKVTQTILPGMLKRKKGAIVNIGSGAAIVIPSDPLYAVYAATKAYIDQFSRSLYVEYKDRGIDVQCQVPLYVATKMASIRRSSFFVPSTDGYARAAMRWIGYDPRCTPYWPHSLLWGLAHSLPEFVIDAWRLRFCLGIRKRGQLKDSRKTE

SEQ ID NO: 22122 - protein, 320 aa, Ricinus communis
MELCFVDKLKSQPLWFLVLFSLGSLSLLRCFFTILNWVYVNFLRPAKNLKKYGSWALVTGPTDGIGKGFAFQLARKGLNLVLVARNPDKLKDVSDSILSKYGKVQIKTVVVDFSGDIDEGVKRIKDTVEGLDVGVLINNVGVSYPYARFFHEVDEELLKNLIKVNVEGTTKVTHAVLPGMLKRKKGAIINIGSGAAIVIPSDPLYAVYAATKAYIDQFSRCLYVEYKKSGIDVQCQVPLYVATKMASIRRSSFFVPSTDDYARAGLRWVGYEPRCTPYWPHSLIWGLISIVPEFAVDAWRYKFNLGIRKRGQQKDARKKE

SEQ ID NO: 22123 - protein, 320 aa, Cucumis sativus
MQLSCVEHLKSQPIWVFFLLALGSLSALKFILIILNWIYVNFLRPSKNLKKYGSWALVTGPTDGIGKSFAFQLARKGLNLVLVGRNPEKLKDVSDSIVAKYGSIQIKSVVVDFSGDLSEGIKRITEAIEGLDVGVLINNVGVSYPYGRFFHEVDEELLNNLIKVNVEGTTKVTHAVLPGMLKRKRGAIVNIGSGAAIVIPSDPLYTVYAATKSYIDQFSRCLYVEYKKSGIDVQCQVPLYVATKMASIRRSSFFVPSTNGYAAAGLRWIGYEPRCTPYWPHQLLWGLVSLLPESVVDGWRLNFCLGIRKRGQLKDSRKKE

SEQ ID NO: 22124 - protein, 320 aa, Panax ginseng
MELCSIDQLKSQPLWVLLLTGLGSLYVFRFLFSILRWVYVNFLRPPKNLKKYGSWALVTGPTDGIGKAFAFQLARKGLNLVLVGRNPEKLNAVSKAIRAKFGQTQISTVVVDFSGDLSEGIQRIRATIEGLDIGVLINNVGISYPYARFFHEVDAKLLADLIQVNVEGTTKVTQAVLPGMLKRKRGAIVNIGSGAAIIIPSDPLYSVYAAAKAYVDQFSRCLYVEYKNSGIDVQCQVPLYVATKMASIKRSSFFVPSTDGYAQAALRWIGYEPRCTPYWPHSILWALLYLLPESAVDAWRLRFCLAIRKKGQLKDTRKKE

SEQ ID NO: 22125 - protein, 320 aa, Populus trichocarpa
MSLCFVDELKSQPSWLLVLFTLGSLSFLKFLFASLKWVYVSFLRPAKNLKKYGSWALVTGPTDGIGKGFAFQLARKGLNLILVGRNPDKLKDVSTSIQSKYSNVQIKNVVVDFSGDIDEGVQKIKETVEGLDVGILINNVGVSYPYARFFHEVDEELLKHLIRVNVEGTTKVTQAVLPGMLKRKKGAIVNIGSGAAIVIPSDPLYAVYAATKAYIDQFSRCLYVEYKKSGIDVQCQVPLYVATKMASIKRSSFWVPSSDSYARAGLRAIGYEPRCTPYWPHSLLWGLIQLLPESAVDSWRLGFCLRIRKRGQLKDSRKNE

SEQ ID NO: 22126 - protein, 321 aa, Trifolium pratense
MDSCCIISKLKTQPFWFLVFFSLGLFTILRFTLILLNWVYVNFLRQPKNLKKYGSWALVTGPTDGIGKSFAFELARKGLNLILVGRNPDKLKDVSDSVKAKFGKTEVKTVVVDFAGDLDEGVNRIRETIEGLDIGVLINNVGISYPYARFFHEVDEELLKNLIQVNVVGTTKVTQAVLPGMIRRKKGAIVNIGSGAAIVIPSDPLYAVYAATKAYIDQFSRCLYVEYKNKGIDVQCQVPLYVATKMASIRRSSFFVPSTDGYAKAGVKWIGYEPRCTPYWPHTLLWAVACSLPESIVDAWRLRFCIGIRKRGQLKESRKQE

SEQ ID NO: 22127 - protein, 320 aa, Gossypium hirsutum
MEACFFDTLKAQPFWVIVLFTLGSLSLLKFSFVFLKWVWINFLRPGKNLKKYGSWGLVTGPTDGIGKGFAFQLARKGLNLVLVGRNPDKLKDVSDSILAKYAKIQIKTVVVDFTGDLDEGVKKIKETIEGLDVGVLINNVGISYPYARYFHEVDEELLMNLIKVNVEGTTKVTQAVLPGMVKRKKGAIVNIGSGAAIVIPSDPLYAVYAATKAYIDQFSRCLYVEYKNIGIDVQCQVPLYVATKMASIKRSSFFVPSTDGYARAAMQWIGYEPRCTPYWPHSILWGLAYSLPESVVDAWRLRFVLAFERGGNFKDSRKKG

SEQ ID NO: 22128 - protein, 320 aa, Panax ginseng
MELCSIDQLKSQSLWVLLLTGLGSLYVFRFLFSILRWVYVNFLRPPKNLKKYGSWALVTGPTDGIGKAFAFQLARKGLNLVLVGRNPEKLNAVSEAIRAKFGQTQISTVVVDFSGDLSEGIQRIRATIEGLDIGVLINNVGISYPYARFFHEVDAKLLADLIQVNVEGTTKVTQAVLPGMLKRKRGAIVNIGSGAAIIIPSDPLYSVYAAAKAYVDQFSRCLYVEYKNSGIDVQCQVPLYVATKMASIKRSSFFVPSTDGYAQAALRWIGYEPRCTPYWPHSILWALLYLLPESAVDAWRLRFCLAIQKKGQLKDTRKKE

SEQ ID NO: 22129 - protein, 321 aa, Fagus grandifolia
METCFLNKLKTQPLWVLVLFTLGSLSALRLSLTFLNWVYVNFLRPPRNLKKHYGSWALVTGPTDGIGKGFAFQLARAGLNLVLVGRNPEKLKDVSDLIQTKYGKTQIKNVVVDFAGDLSEGINRISDAIEGLDVGVLINNVGISYPYARFFHEVDEELLKNLIQVNIEGTTKVTQAVLPGMLKRKRGAIVNIGSGAAIVIPSDPLYAVYAATKAYIDQFSRCLYVEYKKSGIDVQCQVPLYVATKMASIKRSSFFVPSTDGYARAALRHIGFEPRCTPYWPHTLLWALAYSLPESGVDAWRLRFCLGIRKRGQLKDSRKKE

SEQ ID NO: 22130 - protein, 313 aa, Castanea mollissima
LKTQPFWVLVLFTLGSLSALKLSLTFLNWVYVNFLRPPKNLKKHYGSWALVTGPTDGIGKGFAFQLARAGLNLVLVGRNPEKLKDVSDSIQAKYSKTQIKNVVVDFSGDLSEGIKRISETIEGLDVGVLVNNVGVSYPYARFFHEVDEELLKNLIQINVVGTTKVTQAVLPGMLKRKRGAIVNIGSGAAIVIPSDPLYAVYAATKAYIDQFSRCLYVEYKKSGIDVQCQVPLYVATKMASIKRSSFLVPSTDGYARAALRHIGYEPRCTPYWPHTLLWALAYSLPEFVVDAWRLRFCLGIRKRGQLKDSRKKE

SEQ ID NO: 22131 - protein, 320 aa, Rosmarinus officinalis
MTDCIFEQLKSQPTWLLLLISLGTFSLLKLSLSILKWAYVNFLRPGKNLKKYGSWAVITGPTDGIGKSFAFQLARKGLNLVLVGRSPTKLEEVSGAIKSKSGSTQIKTVVVDFSGDLDDGVSRIKEAIEGLDVGLLINNVGVSYPYARFFHEVDEKLLNDLIKVNVVGTTKVTQAVLPGMVERKKGAIVNIGSGAAIVIPSDPLYSVYAATKAYIDQFSRCLYVEYKKSGIDVQCQVPLYIATKMASIRRSSFFVPSADGYAHAALRRIGYEPRCTPYWPHTLLWAVANSLPESAIDAWRLKFCLAIRKRGQLKDSRKEE

SEQ ID NO: 22132 - protein, 320 aa, Citrus clementina
MESCFLNTLKTQPLWLLALFTIGSLSVLKLAFVILNWVYVNFLRPAKNLRKYGSWALVTGPTDGIGKSFAFQLAKTGLNLVLVGRNPDKLKDVSDSIQAKYAKTQIKSVVVDFSGDLDEGVERIKEAIEGLDVGVLINNVGISYPYARFFHEVDQVLLKNLIKVNVEGTTKVTQAVLPGMLKRKKGAIVNIGSGAAIVIPSDPLYSVYAATKAYIDQFSRSLYVEYRKSGIDVQCQVPLYVATKMASIKRSSFFVPSTDVYARAAVRWIGYEPCCTPYWPHSFIWGVLSILPEKLIDAGRLQFSIGIRKRGQLKDARKKE

SEQ ID NO: 22133 - protein, 320 aa, Euonymus alatus
MEPCLFNTLKSQPSWVLLLFTLGSFSILKFSLAVFNWVYVSFLRPGKNLKKYGSWALVTGPTDGIGKSFAFELGRKGLNLVLVGRNPDKLKDVSDSIKAKYAKIEIKNVVVDFSGDLDEGVKRIGEAIDGLDVGVLINNVGISYPYARFFHEVDEQLLRNLIKVNVEGTTKVTQAVLPGMLKRKKGAIVNIGSGAAIVIPSDPLYAIYAATKAYIDQFSRCLYVEYKDRGIDVQCQVPLYVATKMASIRRSSFFVPSTDGYARAAMRWIGYDPRCTPYWPHSLLWCLAQSLPEFVIDAWRLRFCLGIRKRGQLKDSRKEE

SEQ ID NO: 22134 - protein, 320 aa, Euonymus alatus
MEPCFFDTLKAQPSWVLLLFSLGSFSILKLSLAVVKWVYVSFLRPAKDLKKYGSWALVTGPTDGIGKSFAFELGRKGLNLVLVGRNQDKLKDVSDSIKAKYAQIEIKNVVVDFSGDLDEGVKRIVEAIDGLDVGVLINNVGISYPYARFLHEVDEELLRSLIKVNVEGTTKVTQAILPGMLRRKKGAIVNIGSGAAIVIPSDPLYAVYAATKAYIDQFSRCLYVEYKDRGIDVQCQVPLYVATKMASIRRSSFFVPSTDGYARAAMRWIGYDPRCTPYWPHSLLWGLAHSLPEFVIDAWRLRFCLGIRKRGQLKDSRKTE

SEQ ID NO: 22135 - protein, 320 aa, Panax ginseng
MELCSIDQLKSQSLWVLLLTGLGSLYVFRFLFSILRWVYVNFLRPPKNLKKYGSWALVTGPTDGIGKAFAFQLARKGLNLVLVGRNPEKLNAVSKAIRAKFGQTQISTVVVDFSGDLSEGIQRIRATIEGLDIGVLINNVGISYPYARFFHEVDAKLLADLIQVNVEGTTKVTQAVLPGMLKRKRGAIVNIGSGAAIIIPSDPLYSVYAAAKAYVDQFSRCLYVEYKNSGIDVQCQVPLYVATKMASIKRSSFFVPSTDGYAQAALRWIGYEPRCTPYWPHSILWALLYLLPESAVDAWRLRFCLAIQKKGQLKDTRKKE

SEQ ID NO: 22136 - protein, 320 aa, Citrus sinensis
MESCFLNTLKTQPLWLLALFTIGSLSVLRLAFVILNWVYVNFLRPAKNLRKYGSWALVTGPTDGIGKSFAFQLAKTGLNLVLVGRNPDKLKDVSDSIQAKYAKTQIKSVVVDFSGDLDEGVERIKEAIEGLDVGVLINNVGISYPYARFFHEVDQVLLKNLIKVNVEGTTKVTQAVLPGMLKRKKGAIVNIGSGAAIVIPSDPLYSVYAATKAYIDQFSRSLYVEYRKSGIDVQCQVPLYVATKMASIKRSSFFVPSTDVYARAAMRWIGYEPCCTPYWPHSFIWGVLSILPEKLIDAGRLQFSIGIRKRGQLKDARKKE

SEQ ID NO: 22137 - protein, 320 aa, Populus trichocarpa
MGLRFIDQLKDQPFWLLLLFTLGSLSLLKFLSATLKWVYVSFLRPAKNLKKYGSWALVTGPTDGIGKGFAFQLARKGLNLVLVGRNPDKLKDVSSSIQSRYSNVQIKNVVVDFSGDIDEGVQKIKETIEGLDVGVLINNVGVSYPCARFFHEVDEGLLKNLIKVNVEGTTKVTQAVLHGMLKKKKGAIVNIGSGAAIVIPSDPLYAVYAATKAYIDQFSRCLYVEYKKSGIDVQCQVPLYVATKMASIRRSSFWVPSSDGYARAGLRAIGYEPRCTPYWPHSLLWGLIQLLPESIVDFWRLSFCLAIRKKGHLKDSRKME

SEQ ID NO: 22138 - protein, 320 aa, Tripterygium wilfordii
MEPCFFNTIKSQPSWVLFPFTLGCFSILKFSLAVLRWVYVSFLRPGKNLKKYGSWALVTGPTDGIGKSFAFELGRKGLNLVLVGRNPDKLKDVSDSIKAKYGKIETKNVVVDFSGDLDEGVKRIGEAIDGLDVGVLINNVGISYPYARFFHEVDEQLLRNLIKVNVEGTTKVTQALLPGMLKRKKGAIVNIGSGAAIVIPSDPLYAVYAATKAYIDQFSRSLYVEYKDRGIDVQCQVPLYVATKMASIKRSSFFVPSTDGYARAAMRWIGYDPRCTPYWPHSLLWGLAHSLPEFVIDAWRLRFCLGIRKRGQLKDSRKKE

SEQ ID NO: 22139 - protein, 320 aa, Vicia sativa
MVCCIISKLKSEPLWFLLLFSLGLFTILRFTLTFLNWVYVNFLRQPKNLKKYGSWALVTGPTDGIGKSFAFELARKGLNLILVGRNPDKLKDVSDSIQAKFGKTEVKTVVVDFTGDLDEGVNRIRETIEGLEVGVLVNNVGISYPYARFFHELDEELLKNLIKVNVVGTTKVTHAVLPGMLKRKKGAIVNIGSGAAIVIPSDPLYAVYAATKAYIDQFSRCLYVEYKKSGIDVQCQVPLYVATKMASIKRSSFFVPSTDGYARAGVKWIGYEPRCTPYWPHTLLWAVACSLPEYVVDTWRLGFCMGIRKRGQLKDSRKQE

SEQ ID NO: 22140 - protein, 321 aa, Citrullus lanatus
MELTNCVQQLKSQPLWVCFLFALGSLSALKFLAIILKWIYVNFLRPPKNLKKYGSWALVTGPTDGIGKSFAFQLARKGLNLVLVGRNPEKLKDVSDAIVAKYGSVQIKSVVVDFSGDLSEGIKRITEAIEGLDVGVLINNVGVSYPYGRFFHEVDEELLNNLIKVNVEGTTKVTHAVLPGMLKRKRGAIVNIGSGAAIVIPSDPLYTVYAATKAYIDQFSRCLYVEYKKSGIDVQCQVPLYVATKMASIRRSSFFVPSTNGYAAAALRWIGYEPRCTPYWPHQLIWGLVYLLPESVVDAWRLKFCLGIRKRGQLKDSRKKE

SEQ ID NO: 22141 - protein, 321 aa, Quercus alba
MHTCVLDKLKTQPFWVPVLVTLGSLSALKLSLTFLNWVYVNFLRPPKNLKKHYGSWALVTGPTDGIGKGFAFQLARAGLNLVLVGRNPEKLTDVSDSIRAKYGKTQIKNVVVDFSGDLSEGIKRISEAIEGVDVGVLVNNVGVSYPYARFFHEVDEELLKNLIQINVVGTTKVTQAVLPGMLKRKRGAIVNIGSGAAIVIPSDPLYAVYAATKAYIDQFSRCLYVEYKKSGIDVQCQVPLYVATKMASIKRSSFLVPSTDGYARAALRHIGYEPRCTPYWPHTLLWALAYSLPEFVVDAWRLRFCLGIRKRGQLKDSRKKE

SEQ ID NO: 22142 - protein, 320 aa, Phaseolus vulgaris
MECCIISRLRVQPIWFVLLFLVGFLTILKLAFVLVKWVYVNFLRPPKNLRKYGSWAVVTGPTDGIGKSFAFELARKGLNLVLVGRNPDKLKDVSDSIAAKFGKTEVRTVVVDFSGDLDEGVAKIGEAVEGLDVGVLVNNVGVSYPYARFFHEVDEGLLNNLIQVNVVGTTKVTQAVLPGMLKRKRGAIVNIGSGAAIVIPSDPLYAVYAATKAYIDQFSRCLYVEYKKSGIDVQCQVPLYVATKMASIRKSSFFVPSTDGYARAGVRWIGYEPRCTPYWPHTLLWAVACSLPEFVVDAWRLWFCLGIRKRGQRKDSTKKE

SEQ ID NO: 22143 - protein, 320 aa, Eucalyptus grandis
MELCFLDKLKNQPSWVIFLFALGSISILKFSLAVLKWVYVSFLRPAKNLKKYGSWALITGPTDGIGKGFAFQIARKGINLVLVGRNPDKLKDVSDAILAKYGKVQIKTVVVDFAGDIDAGVRRISETIEGLDVGVLINNVGVSYPYARFFHELDDELLKNLIKVNVEGTTKVTHAVLAGMIKRKKGAIVNIGSGAAIVIPSDPLYSVYAATKAYIDQFSRCLYVEYKKSGIDVQCQVPLYVATKMASIKRSSFFVPSPEGYARAALGSIGYEPRCTPYWPHSLLWGVASLLPESAIDSWRLGFCLGIRKRGQLKDSRKNE

SEQ ID NO: 22144 - protein, 320 aa, Petroselinum crispum
MSSCPMDQLKSQPLWVLALLSLSSLYILKFLFCVLKWVYVYFIRPAKNLKKYGSWALVTGPTDGIGKAFAFQLARKGLNLVLVGRNPDKLNDVSTAIRAKFGGIEIKTVVVDFSGDLLEGVKRIEEVIEGLDVGVLINNVGISYPYARFFHEVDEKLLADMIKINVEGTTRVTQAVLPGMLKRKRGAIVNIGSGAAIVIPSDPLYSLYAAAKAYVDQFSRCLYVEYKKSGIDVQCQVPLYVATKMASIRRSSFFVPSTDGYARAALPWIGYEPRCTPYWPHSILWALANSLPDAVIDAWRLNFCLAIRKKGQSKDSRKKE

SEQ ID NO: 22145 - protein, 320 aa, Platanus occidentalis
MEHCFMEQLKAQPTWVRVLLVLGFLFVSKFAFAILKWVYVNFLRPGKNLKKYGSWALVTGPTDGIGKGFAFQLARKGLNLILVGRNPDKLKEVSNAIQAKFGKTQIKNVVVDFSGDLSEGIQRIQEAIEGLDVGVLINNVGISYPYARFFHEVDAELLNDLIKINVEGTTKVTQAVLTGMLQRKKGAIVNIGSGAAIVIPSEPLYAVYAATKAYIDQFSRCLYVEYKKSGIDVQCQVPLYVATKMASIRRSSFLVPSTDGYARAAMRWIGYEPRCTPYWPHSLLWGLASLLPEYIIDTWRLGYCLKIRKKGQLKDSRKKE

SEQ ID NO: 22146 - protein, 320 aa, Vigna unguiculata
MECCIISRLRVQPLWFALLFLVGLFTILKLAFVVVRWVYVNFLRPPKNLRKYGSWALVTGPTDGIGKSFAFELARKGLNLVLVGRNPDKLKDVSDSIVAKFGKTEVKTVVVDFSGDLDEGVAKIGEAIEGLDVGVLVNNVGVSYPYARFFHEVDEGLLNNLIKVNVVGTTKVTQAVLPGMLKRKRGAIVNIGSGAAIVIPSDPLYAVYAATKAYIDQFSRCLYVEYKKSGIDVQCQVPLYVATKMASIRKSSFFVPSTDGYAKAGVRWIGYEPRCTPYWPHTLLWAVACSLPEFVVDAWRLWFCLGIRKRGQRKESTKKE

SEQ ID NO: 22147 - protein, 315 aa, Triphysaria pusilla
YHQLKSQPTWLLLLISIGSFSLLKLSLSILKWVYLNFLRPGKNLKKYGSWALITGPTDGIGKAFAFQLARKGLNLILVGRNPDKLNEVSESIKSKYGSTQIKNVVVDFSGDLDDGVLKVKDAIEGLDVGILINNVGMSYPYARFFHEVDDKLLSDLIRVNVEGTTKVTRAVLPGMVERRKGAIVNIGSGAAIVIPSDPLYSVYAATKAYIDQFSRCLYVEYKNIGIDVQCQVPLYVATKMASIKRSSFFVPSTDGYARAALRWIGYEPRCTPYWPHTILWALANALPESIVDAWRLRFCLKIRKRGQFKDTRKKD

SEQ ID NO: 22148 - protein, 299 aa, Vinca minor
LGSLKSLFLLVSLLKWVYVNFLRPAKNLKKYGSWALVTGPTDGIGKAFAFQLARIGLNLVLVGRNPDKLKDVSDSIKAKYGQTQIKTVVVDFSGELNEGIERIKEIIDGLEVGILINNVGVSYPYARFFHEVDEKLLADLIKVNVEGTTKVTQAVLPGMVQRKRGAIVNIGSGAAIVIPSDPLYAVYAASKAYIDQFSRCLYVEYKNSGIDVQCQVPLYVATKMASIKRSSFFVPSTDGYARAGLRWIGYEPRCTPYWPHSVMWALASSLPESIVDTWRLGFCLKIRKRGQLKDARKQE

SEQ ID NO: 22149 - protein, 320 aa, Cicer arietinum
MDCCIISKLKTQPFWFIILFALGLLTILRFTLTFLNWLYVNFLRPSKDLKKYGSWALVTGPTDGIGKSFAFQLASKGLNLILVGRNPDKLKDVSDSIQAKFGNTQVKTIVVDFAGDLDEGVQRIRETIEGLDIGVLINNVGISYPYAKFFHEVDEELLKNLIKVNVVGTTKVTQAVLPGMLKRKKGAIVNIGSGAAIVIPSDPLYAVYAATKAYIDQFSRSLYVEYKKSGIDVQCQVPLYVATKMASIKKSSFFVPSTDGYAKAGVRWIGYEPRCTPYWPHTLLWAVAYSLPEFIVDAWRLQFCIGIRKRGLLKDSRKKD

SEQ ID NO: 22150 - protein, 320 aa, Spinacia oleracea
MAECIYHQLKAQPTWLILLLTIGSFTILRTLLGVLKWVYVSFLRPAKNLKKYGSWAVVTGPTDGIGKGFAFQLARKGLNLILVGRNPDKLKDVSDSIKLKFANTQIKSVVVDFSGDLDDGVKRVKEAIEGLDVGVLINNVGVSYPYARFFHEVDEQLLQNLIKVNVEGTSKITHAVLPNMVKRRKGAIVNIGSGAAIVIPSDPLYSVYAATKAYIDQFSRCLYVEYKNMGIDVQCQVPLYVATKMASIKRSSFFVPSTDGYAKAGIRHIGYEPRCTPYWPHSFLWGIASCVPESLIDAWRLRFCLAIRKRGQLKDSRKKE

SEQ ID NO: 22151 - protein, 320 aa, Aquilegia formosa
MELCFFDQVKAQPLWVQILLVVGTISILKFSFAVLNWVYVTFLRPGKNLKKYGSWALVTGPTDGIGKSFAFQLARKGLNLVLVGRNPDKLKEVSDGIQAKFGKVQIKSVVVDFSGDLTEGIRKIEEAIEGLDIGVLINNVGISYPYARFFHEVDEQLLKNLIQINVEGTTKVTQAVLPGMVKRKKGAIVNIGSGAAIVIPSDPLYAVYAATKAYIDQFSRCLYVEYKKSGIDVQCQVPLYVATKMASIKRSSFLVPSTDGYARAAMRWIGYEPRCTPYWPHSLLWALVHMLPEYAVDAWRLQFCLAVRKKGQLKDSRKKE

SEQ ID NO: 22152 - protein, 320 aa, Ocimum basilicum
MADCILEQLKSQPTWLLLLFSLGSISLLKLSLSILNWVYVNFLRPAKNLKRYGSWALITGPTDGIGKAFAFQLAKKGLNLVLVGRSPAKLEEVSAAIKSKSGSAQIKTVVVDFSGDLDDGVSRIKAAIAGLDVGLLINNVGVSYPYARFFHEVDEKLLNDLIKVNVVGTTKVTQAVLPGMLERKKGAIVNIGSGAAIVIPSDPLYSVYAASKAYIDQLSRCLYVEYKKSGIDVQCQVPLYVATKMASIRRSSFFVPSADEYARAALRWVGYEPRCTPYWPHTVLWALISCLPESAVDAWRLKFCIGIRKRGMLKDSRKKE

SEQ ID NO: 22153 - protein, 320 aa, Medicago truncatula
MDCCIISKLKTQPFWFLILFSLGLFTILRFTLLLLNWFYVNFLRQPKNLKNYGSWALVTGPTDGIGKSFAFELARKGLNLILVGRNPEKLKDVSDSIKAKFGKTEVKTVVVDFTGDLDDGVKRIVETIDGLDVGVLINNVGISYPYARFFHEVDQELLKNLIKVNVVGTTKVTQAVLPGMLKRKKGAIVNIGSGAAIVIPSDPLYAVYAATKAYIDQFSRCLYVEYKKSGIDVQCQVPLYVATKMASIRRSSFFVPSTDGYAKAGVKWIGYEPRCTPYWPHTLLWAVARSLPESIVDTWRLGFCMGIRKRGQLKDSKKQE

SEQ ID NO: 22154 - protein, 298 aa, Solanum tuberosum
MMNTVTLYSGSSTFWHKPISRINQNFKIRASISTSDNMVAPAIIVGGGRVGRALQDLGNGDDVLVKRGEPVPIDFVGPILVCTRNDDLEAVLEATPKSRWSDLVFFQNGMLEPWFQSKGLGDADQVLAYFAVSKLGEPPTDGKTDTNPEGLTAAYGKWASAVAARLQNGGLSCKVLDKEPFQKQMLEKLIWICAFMLVGARHPGATVGAVEKEYRSEVSKLIAELAAAAAAEKSLVFEDAMEDRLCAYSRAVAHFPTAVKEFKWRNGWFYSLSEKAIAQGKPDPCPLHTAWLKELKIV

SEQ ID NO: 22155 - protein, 298 aa, Solanum phureja
MMNTVTLYSGSSTFWHKPISRINQNFKIRASISTSDNMVAPAIIVGGGRVGRALQDLGNGDDVLVKRGEPVPIDFVGPILVCTRNDDLEAVLEATPKSRWSDLVFFQNGMLEPWFQSKGLGDADQVLAYFAVSKLGEPPTDGKTDTNPEGLTAAYGKWASAVAARLQNGGLSCKVLDKEPFQKQMLEKLIWICAFMLVGARHPGATVGAVEKEYRSEVSKLIAELAAAAAAEKSLVFEDAMEDRLCAYSRAVAHFPTAVKEFKWRNGWFYSLSEKAIAQGKPDPCPLHTSWLKELKIV

SEQ ID NO: 22156 - protein, 306 aa, Nicotiana benthamiana
MVTAVTLSSSTIWHHYTKPISRINLNFRIRASLSTSANMATSTTTKVAPAIIVGGGRVGRALQDLGNGDDVLVKRGEPVPVDFAGPILVCTRNDDLEAVLEATPKSRWSDLVFFQNGMLEPWFQSKGLSDADQVLAYFAVSKLGEPPTDGKTDTNPEGLTAAYGKWASAVAARLQTGGLSCKVLEKEPFQKQMLEKLIWICAFMLVGARHPGATVGAVEKEYRSEVSQLIAELAAAAAAEKGLVFEDAMEDRLCAYSRAVAHFPTAVKEFKWRNGWFYSLSEKAIAEGKPDPCPLHTAWLKELKIV

SEQ ID NO: 22157 - protein, 306 aa, Nicotiana benthamiana
MLNAVTLSSSTIWHHYTNPISRINLSFRIRASLSTSANMATGTTTKVTPAIIVGGGRVGRAIQDLGNGDDVLVKRGEPVPVDFAGPILVCTRNDDLEAVLEATPKSRWSDLVFFQNGMLEPWFQSKGLGDADQVLAYFAVSKLGEPPTDGKTDTNPEGLTAAYGKWASAVAARLQAGGLSCKVLEKEPFQKQMLEKLIWICAFMLVGARHPGATVGAVEEEYRSEVSQLIAELAAAAAAEKGLVFEEAMEDRLCAYSRAVAHFPTAVKEFKWRNGWFYSLSEKAIAEGKPDPCPLHTAWLKELKIV

SEQ ID NO: 22158 - protein, 287 aa, Nicotiana tabacum
CNMKAAMVNAVTLSSSTFWHHYTKPISRINLNFKIGASLSTSANMATGTTTKVAPAIIVGGGRVGRALQDLGNGDDVLVKRGEPVPVDFVGPILVCTRNDDLEAVLEATPKSRWSDLVFFQNGMLEPWFQSKGLGDADQVLAYFTVSKLGEPPTDGKTDTNPEGLTAAYGKWASAVAARLHAGGLSCKVLDKEPFQKQMLEKLIWICAFMLVGARHPGATVGAVEKEYRSEASKLIAELASAAAAEKGLVFEEAMEDRLCAYSRAVAHFPTAVKEFKWRNGWFYSLS

SEQ ID NO: 22159 - protein, 307 aa, Amsonia hubrichtii
MATTALALSSSTLCQHCTKPTSVNWLRSFKIGASLSTSTTMASTATKVIPAIIVGGGRVGRALQDMGSGDDVLVKRGESVPIDFPGPILVCTRNDDLEAVLESTPKSRWSDLVFFQNGMLEPWFRSKGLGDADQVLAYFAVSKLGEPPVDGITDTNPEGLTAAYGKWASAVATRLGAGGLSCKVLEKEAFEKQMLEKLIWICAFMLVGARHPGTTVGGVEKEYRAEVSSLISELAAAAAAEKGLVFEESMEDRLCAYSRAVAHFPTAVKEFKWRNGWFYSLSEKAIGEGKPDPCTLHTAWLKELKIV

SEQ ID NO: 22160 - protein, 306 aa, Sesamum indicum
MAATLSLSSSSFLHHCAKPTSRICLSFKAKASLSTSSSSMATTAEKVAPAIIVGGGRVGKALQDMGSGDDVLVKRGEPVPLDFPGPILVCTRNDDLDAVLESTPNSRWSDLVFFQNGMLEPWFESKGLGDADQVLAYFAVSKLGEPPIDGITDTNPEGLTAAYGKWASAVAGRLRAGGLSCKVLEKDAFQKQMLEKLIWICAFMLVGARHPGATVGVVEKEYRSEVSALIAELAGAAAAEKGIVFEGAMEERLCAYSRAVAHFPTAVKEFKWRNGWFYSLSQKAIAQGKDDPCPLHTAWLKELKIV

SEQ ID NO: 22161 - protein, 305 aa, Vinca minor
MATTTLSLSSSTLWQHCTKPTSVNKLRTFKVSAMASAAATTTATKVIPAIIVGGGRVGRALQDMGNGNDVLIKRGESVPLDFAGPILVCTRNDDLDAVLDSTPKSRWTDLVFFQNGMLEPWFQSKGLGDADQVLAYFAVSKLGEPPIDGITDTNPEGLTAAYGKWASAVATRLQAGGLSCKVLENEAFKKQMLEKLIWICAFMLVGARHPGTTVGGVEKEYRSEVSSLISELAAAAAAEMGLVFEDAMEDRLCAYSRAVAHFPTAVKEFKWRNGWFYSLSEKAIAEGKPDPCPLHTAWLKELKIV

SEQ ID NO: 22162 - protein, 1301 aa, Secale cereale
HSSSAAKDVLAGDSGNPTSTAGRRRRRPFTPPPAPAHSPSPGGFALSDRPATGTPAPWTTSSLLARISTSKQTDRAGDSDQIQPVRVAEFPQVVRNAQANLLQKNFAGKSMLVGGIDKETSLAWMICGNELFVWSYLAAVAKDCLVLEIPTSLMGNKDGKPLSGNQWTVCIMRWHSSGPSTRNSGDMLHRRSSTGVILCNRRTQAIAYWPDIYGESSKSPVLSLFGHSDTSASDGISGCYRFNSLIAASVPGAAHECIVIASEPTGALWLFQCSPLGIHRREVHRDTLGDNGTDHSQKNNGGRSLVWLPSNESSEAAERKFFLLTSQGIQCWGISLLHGINVKILGSQEIVGSDGELGIKKDIAGQKNIWLLDMQIDERGKEFNILVATFCKDRVSGSNYTQYSLLTMLYKSNQKFPSGNNVVKCERFLEKKAPAQVIIPKARVEDEEFLFSMRLKTGGKPSGSVIILSGDGKATVAIYWRGSTRLYQFDLPWDAGKVFDASIIPSPDDRDEGAWVVLTEKAGIWAIPEKAVLVGGVEPPERSLSRKGSCNEAVAEEKRRSQAFSASIVPRRVSSEAWSAGDRQRPALTGVSQQAVVDEEAEMLLNRLFHDFILSGAVHEALQKLRVAGAFEKEGEMNVFVRVSKSIVNTLSKHWTTTREAEFLASTIVSSLAEKRQKHEKFLQFLVLSKCHEELSSKQRAAMLSVMEHGEKLSGMIHLRELQNALSQQSSSTRLSPQSKTSTAGALWNLIQLVGEKARRNTVLLMDRDNAEVFYSRVSDIEDLFYCLSHQLRYIITGEEHPSVQMQRALELSNACVTLVQAALHYRAEYKDWYPFPEGLITWNSQPVVRSGIWNLASSVMELLREPGSADMPMKSNLWSQLEGLADMLLEGYIGVLTAKFERGEDHGVLAQEYCERRDELLGSLYDLAKQIIEAKYQESSEGNDNPDLKESIFREVTSSILATAKRHEGYQTLWQICYDISDTVLLRNLMHDSVGPHGGFSFYVFKQLINSRHYAKLLRLGEEFQEELANFLKDRSDLLWLHEICLNQFSTASETLHTCALFSSPGEDADLTSTRKSLSFVERRRLLYLSKIAATAGKDVDYEVKVAQIDADIRILNLQEEIVQQDPEYAQGKHTSKLLPPSELIEMCMKGGRELSLKAFEVFAWTGSSFRSSNKGLLEACWTNAADQDDWVELSQASVSEGWSDEVIQESLEGTVLFNASRLCYSSDAVVFDGTFEEVLPVRKEDVHARGLEAKCFSVEEVLMQHDAFPDAGKLMMTAVVMGKELSYAAPADEPVDMDS

SEQ ID NO: 22163 - protein, 1293 aa, Brachypodium distachyon
MFSPAIRKPLHLHRRDKGGATPSPPPAPVHSPSPGGAALSDRPATGTPAPWTSSSLLARISTSKQIDRAGDSDQIQPVRVAEFPQVVRNAQDNLIQKNFSGKTMLAGGIDKETSLAWMICGNELFIWSYLASVAKDCRVLELPSSLMGTKDARPLCGNQWMLCIIRCCSSDPSTGNNGDMLHGRSSIGVILCNRRTQAIAYWPDIYDSSKSPALSLFGYSGASASDGTSGCHTFNSLIATSIPGRIQECIVIASEPTGTLWLFQCSPVEIHRREVHQDTSEDNGTDHSQKNNGGRSLAWLPCNVSSEADEQKFFLLTGHGIQCWSISLLHDINVKKIGSQEIVGSDGELGIKKDIAGQKNIWLLDMQIDEHGKEFNILSATFCKDRVSGSNYTQYSLLTMLYKSNQKFSSQENVAKCERFLEKKAPSQVIIPKARVEDEEFLFSMRLKTGGKPSGSVIILSGDGTATVAIYWRGSTRLYQFDLPWDAGKVLDASIIPSADDRDEGAWVVLTEKAGVWAVPEKAVLVGGVEPPERSLSRKGSCNEAIAEEKRRSQAFSASVVPRRVSSEAWTAGERQRPSLTGIAQQVVVDEEAEMLLNRLFHDFILSGAAHEALQKLRASGAFEKEGEMNVFVRISKSIVNTLSKHWTTTREAEFLASTIVSSLAEKQQKHEKFLQFLVLSKCHEELSSKQRAAMLSVMEHGEKLCGVIQLRELQNVLSQQRSSTHLSPQSKTQTTGALWNLIQLVGEKARRNTVLLMDRDNAEVFYSRVSDIEDLFYCLSHQLQYIITGEEHPSVQMQRALELSNACVTLGQAALHYREEHKDWYPSPEGLITWNSQPVVRSGIWTLASSVMELLREPGAAGMSMKSNLCSQLEGLTDMLLEGYIGLLTAKFERGEDHGVLAQEYCERRDKLLGALYDLAKQIVEAKYQESREGDDNLDLKESIFREVTSPILATAKRHEGYQTLWQICYDISDTVLLRNLMHDSVGPRGGFGFYVFEQLTNSRQYAKLLRLGEEFQEMLASFLKDRTDLLWLHEICLNQFSAASETLRTCALLSTPRENADLTSNRKPLSFVERRRLLYLSKIAATAGKDEDYEVIVAGIDADIRILKLQEEIIQHDPEYAQGKYTNKLLRPSELIEMCLKRGRDLSLKAFEVFAWTSSSFRSSNRGLLEDCWMNAANQDDWLKLSQSSTSQGWSDEVTQESLHGTVLFNASRLCYGPDAVVLGGSFEEVLPLRKEDVHARGLEGKCFSVEEVLMQHDVFPDAGRLMMTAVVLGKELSFDVPADEPVEMDS

SEQ ID NO: 22164 - protein, 1292 aa, Setaria italica
MFSPAIRKPHLLHRRDREEASPSPPPAAPTHSPSPRGFAIPDRPATGTPAPWTSSSLLARISASKRTEKAGDSDQIQPVHVAEFPQVVRNAQAGLLQKNFSGKNMFAGGIDKETSLAWMICGNELFIWNYSASVAKDCLVLDVPSSLIGYKDVKPLPGIQWTVCIMRWHSSGASTRNSGEILYRKSSTGVILCNKRTQAVAYWPDIYAEFNRSLVLSSPFDELSASDGASDRFRFNSIIAAAVPGGTHECIAIASEPTGALWLFKCSPEGIRQEKVLRDTLGDGGADHSQKSNGGRSLAWLPSNVSSEGSDRKFFLLTNNEVQCWSVSLLHDINIKKLGSQEIVGTDGDASIKKDIAGQKNIWLLDMQIDEHGKEFSILVATFCKDRVSGSNYTQYSLLTMLYKPNQKFSSEDNVVKVERFLEKKAPSQVIIPKARVEDEEFLFSMRLRTGGKPSGSVIILSGDGTATVAIYWRGSTRLYQFDLPWDSGKVLDASVIPSPEDGDEGAWVVLTEKAGVWAIPEKAVLVGGVEPPERSLSRKGSCNEAVAEEKRRTQVFSASVAPRRVSSEAWSAGERQRPPLTGIAQQAVVDEESEMLLSRLFHDFIISGAVNEALQKLRDAGAFDKEGEMNIFVRMSKSIVNTLAKHWTTTREAEFLASTIVSSLVEKQQKHEKFLQFLVLSKCHEELTSKQRAAMLTIMEHGEKLSGMIQLRELHNALIQQRSSTHLSPQLKTQATGALWNLIQLVGEKARRNTVLLMDRDNAEVFYSRVSDIEDLFYCLSHQLQYIISREEHPSVQMQRALELANACSTLVHAALHYRKEHKEWYPSPEGLITWNSHLVVRSGIWSLASFVMELLGEFGAADMTMKSNLWSQLEGLTDILLEAYIGLLTAKFERGDEHGVLVQEYCERRDELLRSLYNLAKQIVEAKYQESRDGKDNLDLKESIFREVISPILATAKRHEGYQTLWQICSDLNDSVLLRSLMHDSVGPHGGFSFFVFKELVNSRQYSKLLRLGEEFQEELASFLKDRNDLLWLHEICLNQFSSASETLHTYALRGSPDEDASVTTSRKPLSFAERRRLLYLSKIAATAGKDIDYEAKVARIEADMWILKLQEEIVQHDPEYAQVKYTTTLLDPSELIEMCLKRDQELSLKAFEVFASTSSSFRSSNRGLLEACWTNATNQDDWLKLSQASTSEGWSDEVIQESLQGTVLFKASRLCYSPDSVVYDGTFEDVLPVKKEDVHLRGLESKCLSVEEVLMQHKDFPDAGKLMMTAVIMGKEVSYTAAEPVEMES

SEQ ID NO: 22165 - protein, 1290 aa, Oryza sativa
MFSPAIKKPHLLHRRDKEEASPSPPPAPAHTPAPRGFAVHDRPATGTPAPWTSSSLLARISTSTRTDRTGDSGQIQPVHVSEFPQIVRNAQANLLQKSFSGKNMLAGGIDKETSLAWMLCGNELFIWSYLASVAKDCLVLEVPSSLMGNKEEKSLCGNQWAVCIVRWGSSGASTRSSGDILHRRSSTGFILCNKRTQAIAYWSDIYAESSKSPVLDLIGYGDTSSGDGTSGNCRINSLIAVAVPGGINECIVIASQPTGTLWMFWCSPAAVRRREIHKGTLGVYNADHSQKNSGGRSLAWLPSKASSKAAERTFFLLTSHELQFWSISFGHDINCKKIGSQEIVGSDGDMGIKKDIAGQKNIWLLDMQIDDHGKEIIILVATFCKDRVSGSNYTQYSLLTMLYRPNQKFSSEDNVIKTERFLEKKAPSQVIIPKARVEDEEFLFSMRLKTGGKPSGSVIILSGDGTATIAIYWRGSTRLYQFDLPWDAGKVLDASVIPSSEDRDEGAWVVLTEKAGVWAIPEKAVLVGGVEPPERSLSRKGSCNEAVAEEKRRNQAFNASVVPRRASSEAWSAGERQRPALTGIAQQAVVDEESEMLLNRLFHDFVLSGTVHEALQKLRAASAFDKEGEMNIFVRISKSIVNTLSKHWTTTREAEFLASTIVSSLTEKQQKHKKFLQFLVLSKCHEELSSKQRTAMLTVMEHGEKLSGMIQLRELQNALSHQRSSINLSPQSKNQTTGALWNLIQLVGEQSRRNTVLLMDRDNAEVFYSRVSDIEDLFNCISHQLQYIITGEENPSVQMQRALELSNACMTLVQAALRYREEHKDWYPSPEGLITWNSQPVVRSGIWRVASFVMELLREPGAADMSMKSNLWSQLERLTDILLDAYIGLLTAKFERGDEHGVLIQEYCDRRDELLGSLYDLAKQIVDVKYQETTEVTDNLELKESIFREVTSPILATAKRHEGYQTLWQICYDLSDTGLLRSLMHDSVGPHGGFSFFVFKQLVKRRQHAKLLRLGEEFPEELANFLKERDDLLWLHEICLNRFSSASKTLHTLVSPEEDANLTSNRKSLSFVERRRFLYLSKIAAAAGKDVDYEVKVAHIDADIRILNLQEEIVQHDPEYAPDKYTTKPFRPLELIEMCLKGDRELSLKAFEVFAWTRASFRSSNKGLLEACWMNAADQDDWVSLQEESSGGWSDEVIQESLQGTVLFNASRLCYSPDAVVYDGSFEDVLPVKKEDLHLRGLEGRCLSVEEVLMQHKDFPDAGKLMMTAVIMGKELPYTVSTAEPVDMDS

SEQ ID NO: 22166 - protein, 1293 aa, Sorghum bicolor
MFSPAIRRPHLLNRRDREEGSPSPPPAAPAHSPSPHGFAVPDRPATGTPVPWNSSSLLARISTSKRTDRTGDSDQIQPVRVAEFPQVVRNAQASLLQKNFSGKNMLAGGIDKETSLAWMICGNELFIWSYLASVAKDCIALDIPSSLIGYNDVKPLLGIQWTVCIMRWHSGGASTRNSGEMLHRKSSTGVILCNKRTQAVAYWPDIYAEFNRSLVLSSSGDGEVSACDAASDCLRFNSLIAAAVPGCIHECIAIASDPAGALWLFQCSPEGIHQRKVHADTLGDGGADHSQKSNGGRSLIWLPNNVSSEGSDRKFFLLTNNEVQCWSISFLNDINVKKLGSHGIVGTDGDVGIKKDIAGQKNIWLLDMQIDERGKEFSILVATLCKDRVSGSNYTQYSLLTMLYKPNQKLSSEDNVAKVERFLEKKAPSQVIIPKARVEDDEFLFSMRLKTGGKPSGSVIILSGDGTATVAMYWRGSTRLYQFDLPWDAGKVLDASVIPSAEDRDEGAWVVLTEKAGVWAIPEKAVLVGGVEPPERSLSRKGSCNETIAEEKRRSQGFSASVVPRRVSSEAWSAGERQRPALTGIAQQSVVDEESEMLLNRLFHDFIISSAVSEALQKLRAAGAFEKEGEMNIFVRTSKSIVNTLAKHWTTTREAEFLASTIVSSLVEKQQKHEKFLQFLVLSKCHEELASKQRAAMLTVMEHGEKLSGMAHLRELQNALIQQRSSTHLSPQSKTQGTGALWNLIQLVGEKARRNTVLLMDRDNAEVFYSRVSDIDDLFYCLSHELQYIISREEHPSVQMQRALELANACIALVQAASHYRKDHKEWYPSPEGLITWNSQPVVRSGIWSLASLIMELLGDSGAADMSMKSSLWSQLEGLTDILLEAYIGLLTAQFERGQEHGVLVQEYCERRDELLRSLYNLAKQIVEVKYQESKDGTDNLDLKESIFRKVISPILATAKRHEGYQTLWQICYDLDDSDLLRSLMHDSVGPHGGFSFFVFKELVNRGDYSKLLRLGEEFQEELASFLKERSDLLWLHEICLNQFSSASETLHTYALRGSPDGDASFTTSRKPLSFVERSRLLYLSKIAATAGKDIGYEVKVARIEADMRILKLQEEIVQHDPEYAQVKYTNALLGPSELIEMCLRRDRELSFKAFEVFALTSSSFRSSNRGLLEACWMNATHQDDWVKLSEASTLEGWSDELIEESLQATVLFKASRLCYSPDAVVYDGTFEDVLPVKKEDVHLRGLESKCLSVEEVLMQHKDFPDAGKLMMTAVILGKELTFTATEPVEMDS

SEQ ID NO: 22167 - protein, 1293 aa, Panicum virgatum
MFSPAIRKPHLLHRRDREEASPSPPPAAPAHSPSPRGFAISDRPATGTPAPWTSSSLLARISTSKRTDRAGESEQIQPVHVAEFPQIVRNAQASLRQKIFSGKNMFAGGIDKETSLAWMICGNELFIWNYSASSAKDCLVLDVPSSLIGYKDVKSLPGIQWTVCIMRWHSSGASARNSGDILYRKHSTGVILCNKRTQAVAYWPDIYAEFNKSLVLSSPGYGEVSASDGASDCFRFNSIIAAAVPGGTHECIAIASEPTGALWLFQCSPEGIRRQKIHGDTLGDGGADHSQKSNGGRSLAWLPNYVSSEGSDRKFFLLTNNEVQCWSISLLHDIDIKKLGSQEIVGTDGDVSIKKDIAGQKNVWLLDMQIDEHGKEFSILVATFCKDRVSGSNYTQYSLLTMLYKPNQKFSSEDNAVKVERFLEKKAPSQVIIPKARVEDEEFLFSLRLKTGGKPSGSVIILSGDGTATVAIYWRGSTRLYQFDLPWDAGKVLDASVIPSADDRDEGAWVVLTEKAGVWAIPEKAVLVGGVEPPERSLSRKGSCNEAVAEEKRRTQVFNAGVVPRRVSSEAWSAGERQRPALTGIAQQAVVDEESEMLLNRLFHDFIISGAVNEALQKLRAAGAFDKEGEMNIFVRMSKSIVNTLAKHWTTTREAEFLGSTIVSSLVEKQQKHEKFLQFLLLSKCHEELASKQRAAMLTIMEHGEKLSGMIQLRDLHNTLIQQRSSTQLSPQLKTQTTGALWNLIQLVGEKARRNAVLLMDRDNAEVFYSRISEIEDLFYCLSHQLQYIISREENPSVQLQHALEIANACITLVHAALHYRKEHKEWYPSPEGLITWNSHPVVRSGIWSLASFVMELLGESGAADMSMKFNLWSQLEGLTDILLEAYIGLLTAKFERGDEHGVLVQEYCERRDELLGSLYNVAKQIVEAKYQESRDGTDNLDLKESIFREVISPILGTAKRHEGYQTLWQICSDLNDSVLLRSLMHDSVGPHGGFSFFVFKELVNRRHYSKLLRLGEEFQEELASFLKERSDLLWLHEICLNQFSSASETLHTYALHGSPDEDASVTTSRKPLSFGERRRLLYLSKIAATADKDIDYEAKVARIEADLRILKLQEEIVQHDPEYGQVKYTTTLIDPSELIEMCLKRDQELSLKAFEVFASTSSSFRSSNRGLLEACWMNATNQDDWVKLSEASLSEGWSDEVIQESLQGTVLFKASRLCYSPDSVVYDGTFEDVLPVKKEDVHLRGLESKCLSVEEVLMQHKDFPDAGKLMMTAVIMGKKLSYTAAEPVEMDS

SEQ ID NO: 22168 - protein, 1077 aa, Triticum aestivum
FGHSDTSASDAISGCYRFNSLIAASVPGAAHECIAIASEPTGALWLFQCSPLRIHRREVHRDTLGDNGTDHSQKNNGGRSLVWLPSNESSEAAERKFFLLTSQGIQCWGISLLHGINVKILGSQEIVGSDGELGIKKDIAGQKNIWLLDMQIDERGKEFNILVATFCKDRVSGSNYTQYSLLTMLYKSNQKFPSENNVVKRERFLEKKAPAQVIIPKARVEDEEFLFSMRLKTGGKPSGSVIILSGDGKATVAIYWRGSTRLYQFDLPWDAGKVFDASIIPSAEDRDEGAWVVLTEKAGIWAIPEKAVLVGGVEPPERSLSRKGSCNEAVAEEKRRSQAFSASIVPRRVSSEAWSAGDRQRPALTGVAQQAVVDEEAEMLLNRLFHDFILSGAVHEALQKLRVAGAFEKEGEMNVFVRVSRSIVNTLSKHWTTTREAEFLASTIVSSLAEKRQKHEKFLQFLVLSKCHEELSSKQRAAMLSVMEHGEKLSGMIHLRELQNALSQQSSSTRLSPQSKTPTAGALWNLIQLVGEKARRNTVLLMDRDNAEVFYSRVSDIEDLFYCLSHQLRYIITGEEHPSVQMQCALELSNACVTLVQAALHYRAEYKDWYPSPEGLITWNSQPVVRSGIWNLASSVMELLREPGSAGMPMKSNLWSQLEGLTDMLLEGYIGVLTAKFERGEDHGVLAQEYCERRDELLGSLYDLAKQIIEAKYQESSEGNDNPDLKESIFREVTSPILATAKRHEGYQTLWQICYDISDTVLLRNLMHDSIGPHGGFSFYVFKQLINSRHYAKLLRLGEEFQEELANFLKDRSDLLWLHEICLNQFSTASETLHTCALLSSPGEDADLTSTRKSLSFVERRCLLYLSKIAATAGKDVDYEVKVAQIDADIRILNLQEEIVQHDPEYAQGKHASKLLPPSELIEMCMKRGRELSLKAFEVFAWTGSSFRSSNKGLLEACWTNAADQDDWVKLSQASVSEGWSDEVIQESLQGTVLFNASRLCYSSDAVVFDGTFEEVLPVRKEDVQARGLEAKCFSVEEVLMQHDAFPDAGRLMMTAVVMGKELSYAAPADEPVDMDS

SEQ ID NO: 22169 - protein, 218 aa, Pseudoroegneria spicata
MVKLTMIARITDGLPLAEGLDDGRDLKDADFYKQQAKLLFKNLSKGQHESSRLSIETGPYYFHYIIESRVCYLTMCDRSYPKKLAFQYLEDLKNEFERVNGSQIETAARPYAFIKFDTFIQKTRKLYLDTRTQRNLAKLNDELYEVHQIMTRNVQEVLGVGEKLDQVSQMSSRLTSDTRMYADKAKDLNRQALIRKYAPVAIVIGIVLMLFWVKNKIW

SEQ ID NO: 22170 - protein, 218 aa, Secale cereale
MVKLTMIARITDGLPLAEGLDDGRDLKDADFYKQQAKLLFKNLSKGQHESSRLSIETGPYYFHYIIESRVCYLTMCDRSYPKKLAFQYLEDLKNEFERVNGSQIETAARPYAFIKFDTFIQKTRKLYLDTRTQRNLAKLNDELYEVHQIMTRNVQEVLGVGEKLDQVSQMSSRLTSDTRMYADKAKDLNRQALIRKYAPVAIVIGIVLMLFWIKNKIW

SEQ ID NO: 22171 - protein, 218 aa, Triticum aestivum
MVKLTMIARITDGLPLAEGLDDGRDLKDADFYKQQAKLLFKNLSKGQHESSRLSIETGPYYFHYIIESRVCYLTMCDRSYPKKLAFQYLEDLKNEFERVNGNQIETAARPYAFIKFDTFIQKTRKLYLDTRTQRNLAKLNDELYEVHQIMTRNVQEVLGVGEKLDQVSQMSSRLTSDTRMYADKAKDLNRQALIRKYAPVAIVMGIVLMLFWVKNKIW

SEQ ID NO: 22172 - protein, 218 aa, Triticum aestivum
MVKLTMIARITDGLPLAEGLDDGRDLKDADFYKQQAKLLFKNLSKGQHESSRLSIETGPYYFHYIIESRVCYLTMCDRSYPKKLAFQYLEDLKNEFERVNGSQIETAARPYAFIKFDTFIQKTRRLYLDTRTQRNLAKLNDELYEVHQIMTRNVQEVLGVGEKLDQVSQLSSRLTSDTRMYADKAKDLNRQALIRKYAPVAIVMGIVLMLFWIKNKIW

SEQ ID NO: 22173 - protein, 218 aa, Brachypodium distachyon
MVKLTMIARVTDGLPLVEGLDDGRDLKDADFYKQQAKLLFKNLSKGQHESSRLSIETGPYFFHYIIEGRVCYLTMCDRSYPKKLAFQYLEDLKNEFERVNGNQIETAARPYAFIKFDTFIQKTRKLYLDTRTQRNLTKLNDELYEVHQIMTRNVQEVLGVGEKLDQVSQMSSRLTSDTRMYADKAKDLNRQALIRKYAPVAIVIGIVLMLFWVKNKIW

SEQ ID NO: 22174 - protein, 226 aa, Hordeum vulgare
MVKLTMIARITDGLPLAEGLDDGRDLKDADFYKQQAKLLFKNLSKGQHESSRLSIETGPYYFHYIIESRVCYLTMCDRSYPKKLAFQYLEDLKSEFERVNGSQIETAARPYAFIKFDTFIQKTRKLYLDTRTQRNLAKLNDELYEVHQIMTRNVQEVLGVGEKLDRDSFLPFAEVSQMSSRLTSDTRMYADKAKDLNRQALIRKYAPVAIVIGIVLMLFWVKNKIW

SEQ ID NO: 22175 - protein, 218 aa, Festuca arundinacea
MVKLTMIARITDGLPLAEGLDDGRDLRDADFYKQQAKLLFKNLSKGHHDSSRLSIETGPYLFHYIIESRVCYLTMCDRSYPKKLAFQYLEDLKNEFERVNGSQIETAARPYAFIKFDTFIQKTRKLYLDTRTQRNLAKLNDELYEVHQIMTRNVQEVLGVGEKLDQVSEMSSRLISDTRMYADKAKDLNRQALIRKYAPIAIVIGIVVMLFWVKNKIW

SEQ ID NO: 22176 - protein, 218 aa, Avena sativa
MVKLTMIARVTDGLPLAEGLDDGRDLKDADFYKQQAKLLFKNLSKGHHDSSRLSIETGPYLFHYIIEGRVCYLTMCDRSYPKKLAFQYLEDLKNEFERVNGSQIETAARPYAFIKFDTFIQKTRKLYLDTRTQRNLAKLNDELYEVHQIMTRNVQEVLGVGEKLDQVSQMSSRLTSDTRIYADKAKDLNRQALIRKYAPVAVVIGIVVMLFWVKNKIW

SEQ ID NO: 22177 - protein, 218 aa, Zea mays
MVKLTMIARVTDGLPLAEGLDDGRDLKDSDFYKQQAKLLFKNLSKGHHEASRMSIETGPYYFHYIIEGRVCYLTMCDRSYPKKLAFQYLEDLKNEFERVNGNQIETAARPYAFIKFDTFIQKTRKLYLDTRTQRNLAKLNDELYEVHQIMTRNVQEVLGVGEKLDQVSEMSSRLTSDTRIYADKAKDLNRQALIRKYAPVAIVIGVVLMLFWLKNKIW

SEQ ID NO: 22178 - protein, 218 aa, Sorghum bicolor
MVKLTMIARVTDGLPLAEGLDDGRDLKDADFYKQQAKLLFKNLSKGHHEASRMSIETGPYYFHYIIEGRVCYLTMCDRSYPKKLAFQYLEDLKNEFERVNGNQIETAARPYAFIKFDTFIQKTKKLYLDTRTQRNLAKLNDELYEVHQIMTRNVQEVLGVGEKLDQVSEMSSRLTSDTRIYADKAKDLNRQALIRKYAPVAIVIGVVLMLFWLKNKIW

SEQ ID NO: 22179 - protein, 218 aa, Avena sativa
MVKLTMIARVTDGLPLAEGLDDGRDLKDADFYKQQAKLLFKNLSKGHHDSSRLSIETGPYLFHYIIEGRVCYLTMCDRSYPKKLAFQYLEDLKNEFERVNGSQIETAARPYAFIKFDTFIQKTRKLYLDTRTQRNLAKLNDELYEVHQIMTRNVQEVLGVGEKLDQVSEMSSRLTSDTRIYADKAKDLNRQAFIRKYAPVAIVIGVVIILFWAKNKIW

SEQ ID NO: 22180 - protein, 218 aa, Saccharum officinarum
MVKLTMIARVTDGLPLAEGLDDGRDQKDADFYKQQAKLLFKNLSKGHHEASRMSIETGPYYFHYIIEGRVCYLTMCDRSYPKKLAFQYLEDLKNEFERVNGNQIETAARPYAFIKFDTFIQKTKKLYLDTRTQRNLAKLNDELYEVHQIMTRNVQEVLGVGEKLDQVSEMSSRLTSDTRIYADKAKDLNRQALIRKYAPVAIVIGVVLMLFWLKNKIW

SEQ ID NO: 22181 - protein, 218 aa, Oryza sativa
MVKLTMIARVTDGLPLAEGLDDGRDQKDADFYKQQAKLLFKNLSKGQHEASRMSIETGPYYFHYIIEGRVCYLTMCDRSYPKKLAFQYLEDLRNEFERVNGSQIETAARPYAFIKFDTFIQKTKKLYLDTRTQRNLAKLNDELYEVHQIMTRNVQEVLGVGEKLDQVTEMSTRLTSDTRIYADKAKDLNRQALIRKYAPVAIVIGVVLMLFWLKNKIW

SEQ ID NO: 22182 - protein, 218 aa, Oryza sativa
MVKLTMVARVTDGLPLAEGLDDGRDQKDADFYKQQAKLLFKNLSKGQHEASRMSIETGPYFFHYIIEGRVCYLTMCDRSYPKKLAFQYLEDLKNEFERVNGSQIETAARPYAFIKFDTFIQKTKKLYLDTRTQRNLAKLNDELYEVHQIMTRNVQEVLGVGEKLDQVTEMSTRLTSDTRMYADKAKDLNRQALIRKYAPVAIVIGVVLMLFWLKNKIW

SEQ ID NO: 22183 - protein, 218 aa, Echinochloa colona
MVKLTMIARVTDGLPLSEGLDDVRDLKDADFYKQQAKLLFKNLSKGQHDASRMSIETGPYLFHYIIEGRVCYLTLCDRSYPKKLAFQYLEDLKSEFERVNGSQIETAARPYAFIKFDAFIQKTKKLYLDTRTQRNLAKLNDELYEVHQIMTRNVQEVLGVGEKLDQVSEMSSRLTSDTRIYAEKAKDLNRQALIRKYAPVAIVIGIVLMLFWVKNKIW

SEQ ID NO: 22184 - protein, 218 aa, Panicum virgatum
MVKLTMIARVTDGLPLSEGLDDGRDLKDADFYKQQAKQLFKNLSKGQHEASRMSIETGPYLFHYIIEGRVCYLTLCDRSYPKKLAFQYLEDLKNEFERVNGSQIETAARPYAFIKFDAFIQKTKKLYLDTRTQRNLAKLNDELYEVHQIMTRNVQEVLGVGEKLDQVSEMSSRLTSDTRIYAEKAKDLNRQALIRKYAPVAIVIGIVLMLFWVKNKIW

SEQ ID NO: 22185 - protein, 218 aa, Echinochloa colona
MVKLTMIARVTDGLPLAEGLDDGRDQKDADFYKQQAKLIFKNLSKGHHEASRMSIETGTYYFHYIIEGRVCYLTMCDRSYPKKLAFQYLEDLKNEFERVNGNQIETAARPYAFIKFDTFIQKTKKLYLDTRTQRNLAKLNDELYEVHQIMTRNVQEVLGVGEKLDQVSEMSSRLTSDTRIYADKAKDLNRQALIRKYAPVAIVIGVVLMLFWLKNKIW

SEQ ID NO: 22186 - protein, 218 aa, Pennisetum glaucum
MVKLTMIARVTDGLPLSEGLDDGRDLKDADFYKQQAKQLFKNLSKGQHEASRMSIETGPYLFHYIIEGRVCYLTLCDRSYPKKLAFQYLEDLKNEFEKVNGSQIETAARPYAFIKFDAFIQKTKKLYLDTRTQRNLAKLNDELYEVHQIMTRNVQEVLGVGEKLDQVSEMSSRLTSDTRIYAEKAKDLNRQALIRKYAPVAIVIGIVLMLFWVKNKIW

SEQ ID NO: 22187 - protein, 218 aa, Sorghum bicolor
MVKLTMIARVTDGLPLSEGLDDGRDLKDADFYKQQAKLLFKNLSKGQHEASRMSIETGPYLFHYIIEGRVCYLTLCDRSYPKKLAFQYLEDLKNEFEKVNGSQIETAARPYAFIKFDAFIQKTKKLYLDSRTQRNLAKLNDELYEVHQIMTRNVQEVLGVGEKLDQVSEMSSRLTSDTRIYADKAKDLNRQALIRKYAPVAIVIGIVLMLFWLKNKIW

SEQ ID NO: 22188 - protein, 218 aa, Panicum virgatum
MVKLTMIARVTDGLPLSEGLDDGRDLKDADFYKQLAKQLFKNLSKGQHEASRMSIETGPYLFHYIIEGRVCYLTLCDRSYPKKLAFQYLEDLKNEFERVNGSQIETAARPYAFIKFDAFIQKTKKLYLDTRTQRNLAKLNDELYEVHQIMTRNVQEVLGVGEKLDQVSEMSSRLTSDTRIYAEKAKDLNRQALIRKYAPVAIVIGIVLMLFWVKNKIW

SEQ ID NO: 22189 - protein, 218 aa, Setaria italica
MVKLTMIARVTDGLPLSEGLDDGRDLKDADFYKQQAKQLFKNLSKGQHEASRMSIETGPYLFHYIIEGRVCYLTLCDRSYPKKLAFQYLEDLKNEFEKVNGSQIETAARPYAFIKFDAFIQKTKKLYLDTRTQRNLAKLNDELYEVHQIMTRNVQEVLGVGEKLDQVSEMSSRLTSDTRIYAEKAKDLNRQALIRKYAPVAIVIGIVLMLFWVKNEIW

SEQ ID NO: 22190 - protein, 218 aa, Saccharum officinarum
MVKLTMIARVTDGLPLSEGLDDGRDLKDADFYKQQAKLLFKNLSKGQHEASRMSIETGPYLFHYIIEGRVCYLTLCDRSYPKKLAFQYLEDLKNEFEKVNGSQIETAARPYAFIKFDAFIQKTKKLYLDSRTQRNLAKLNDELYEVHQIMTRNVQEVLGVGEKLDQVSEMSSRLTSDTRIYAEKAKDLNRQALIRKYAPVAIVIGIVLMLFWLKNKIW

SEQ ID NO: 22191 - protein, 218 aa, Zea mays
MVKLTMIARVTDGLPLSEGLDDSRDLKDADFYKQQAKLLFKNLSRGQHEASRMSIETGPYLFHYIIEGRVCYLTLCDRSYPKKLAFQYLEDLKNEFEKVNGSQIETAARPYAFIKFDAFIQKTKKLYLDTRTQRNLAKLNDELYEVHQIMTRNVQEVLGVGEKLDQVSEMSSRLTSDTRIYAEKAKDLNRQALIRKYAPVAIVIGIVVMLFWVKNKIW

SEQ ID NO: 22192 - protein, 218 aa, Brachypodium distachyon
MVKLTMIARVTDGLPLAEGLDDGRDQKDSDFYKQQAKLLFKNLSNGHHEASRMSIETGPYFFHYIIEGRVCYLTMCDRSYPKKLAFQYLEDLKNEFERVNGSQIETAARPYAFIKFDTFIQKTKKLYLDTRTQRNLAKLNDELYEVHQIMTRNVKEVLGVGEKLDQVSEMSSRLTSDTRIYADKAKDLNRQAFIRKYAPVAIVIGVVIMLFWAKNKIW

SEQ ID NO: 22193 - protein, 218 aa, Leymus cinereus x Leymus triticoides
MVKLTMIARVTDGLPLAEGLDDGRDQKDSDFYKQQAKLLFKNLSKGQHEASRMSIETGSYFFHYIIEGRVCYLTMCDRSYPKKLAFQYLEDLKNEFERVNGSQIETAARPYAFIKFDTYIQKTRKLYLDTRTQRNIAKLNDELYEVHQIMTRNVQEVLGVGEKLDQVSEMSSRLTSDTRIYADKAKDLNRQAFIRKYAPVAIVIGVVIILFWAKNKIW

SEQ ID NO: 22194 - protein, 218 aa, Pennisetum glaucum
MVKLTMIARVTDGLPLAEGLDDGRDQKDADFYKQQAKLIFKNLSKGHHEASRMSIETGAYYFHYIIEGRVCYLTMCDRSYPKKLAFQYLEDLKNEFERVNGNQIETAARPYAFIKFDTFIQKTKKLYLDTRTQRNLAKLNDELYEVHQIMTRNVQEVLGVGEKLDQVSEMSSRLTSDTRVYANKAKDLNRQALIRKYAPVAIVIGVVFILFWLKNKIW

SEQ ID NO: 22195 - protein, 218 aa, Panicum virgatum
MVKLTMIARVTDGLPLAEGLDDGRDQKDADFYKQQAKLIFKNLSKGHHEASRMSIETGAYFFHYIIEGRVCYLTMCDRSYPKKLAFQYLEDLKNEFERVNGNQIETAARPYAFIKFDTFIQKTKKLYLDTRTQRNLAKLNDELYEVHQIMTRNVQEVLGVGEKLDQVSEMSSRLTSDTRIYADKAKDLNRQALIRKYAPVAIVIGVVFILFWLKNKIW

SEQ ID NO: 22196 - protein, 218 aa, Hordeum vulgare
  Sequence also found in Organisms: Secale cereale, Triticum aestivum
MVKLTMIARVTDGLPLAEGLDDGRDQKDSDFYKQQAKLLFKNLSKGQHEASRMSIETGSYFFHYIIEGRVCYLTMCDRSYPKKLAFQYLEDLKNEFERVNGSQIETAARPYAFIKFDTYIQKTKKLYLDTRTQRNIAKLNDELYEVHQIMTRNVQEVLGVGEKLDQVSEMSSRLTSDTRIYADKAKDLNRQAFIRKYAPVAIVIGVVIILFWAKNKIW

SEQ ID NO: 22197 - protein, 218 aa, Panicum virgatum
MVKLTMIARVTDGLPLAEGLDAGRDQKDADFYKQQAKLIFKNLSKGHHEASRMSIETGAYFFHYIIEGRVCYLTMCDRSYPKKLAFQYLEDLKNEFERVNGNQIETAARPYAFIKFDTFIQKTKKLYLDTRTQRNLAKLNDELYEVHQIMTRNVQEVLGVGEKLDQVSEMSSRLTSDTRIYADKAKDLNRQALIRKYAPVAIVIGVVFILFWLKNKIW

SEQ ID NO: 22198 - protein, 218 aa, Avena sativa
MVKLTMIARVTDGLPLAEGLDDGRDQKDSDFYKQQAKLLFKNLSKGQHEASRMSIETGSYFFHYIIEGRVCYLTMCDRSYPKKLAFQYLEDLKNEFERVNGNQIETAARPYAFIKFDTYIQKTKKLYLDTRTQRNIAKLNDELYEVHQIMTRNVQEVLGVGEKLDQVSEMSSRLTSDTRIYADKAKDLNRQAFIRKYAPVAIVIGVVIILFWAKNKIW

SEQ ID NO: 22199 - protein, 218 aa, Ananas comosus
MVKLTMIARITDGLPLAEGLDDGRDQKDADFYKQQAKLLFKNLSKGHYEASRMSIETGPYYFHYIIEGRVCYLTMCDRSYPKKLAFQYLEDLKNEFERVNGNQIETAARPYAFIKFDTFIQKTKKLYMDTRTQRNLAKLNDELYEVHQIMTRNVQEVLGVGEKLDQVSEMSSRLTSESRIYADKAKDLNRQALIRKWAPVAIVLGVVMVLFWVKTKIW

SEQ ID NO: 22200 - protein, 218 aa, Setaria italica
MVKLTMIARVTDGLPLAEGLDDGRDQKDADFYKQQAKLIFKNLSKGHHEASRMSIETGTYYFHYIIEGRVCYLIMCDRSYPKKLAFQYLEDLKNEFERVNGNQIETAARPYAFIKFDTFIQKTKKLYLDTRTQRNIAKLNDELYEVHQIMTRNVQEVLGVGEKLDQVSEMSRRLTSDTIVYANKAKDLNRQALIRKYAPVAIVIGVVFILFWLKNKIW

SEQ ID NO: 22201 - protein, 218 aa, Musa acuminata
MVKLTMIARVTDGLPLAEGLDDGRDQKDADFYKQQAKLLFKNLSKGHYEASRMSIETGPYFFHYIIEGRVCYLTMCDRSYPKKLAFQYLEDLKNEFERVNGSQIETAARPYAFIKFDTFIQKTKKLYLDTRTQRNMAKLNDELYEVHQIMTRNVQEVLGVGEKLDQVSELSSRLTSESRIYADKAKDLNRQALIRKWAPVAIVLGVVMLLFWVRKKIW

SEQ ID NO: 22202 - protein, 218 aa, Festuca arundinacea
MVKLTMIARVTDGLPLAEGLDDGRDQKDSDFYKQQAKLLFKNLSKGQHEASRMSIETGSYFFHYIIEGRVCYLTMCDRSYPKKLAFQYLEDLKNEFERVNGSQIETAARPYAFIKFDTYIQKTKKLYLDTRTQRNIAKLNDELYEVHQIMTRNVQEVLGVGEKLDQVSEMSNRLSNETKMYADKAKDLNRQAFIRKYAPVAIVIGVVIILFWAKNKIW

SEQ ID NO: 22203 - protein, 218 aa, Cocos nucifera
MVKLTMIARVTDGLPLAEGLDDGRDQKDIEFYKQQAKLLFKNLSKGQHEASRMSIETGPYFFHYIIEGRVCYLTMCDRSYPKKLAFQYLEDLKNEFERVNGNQIETAARPYAFIKFDTFIQKTKKLYLDTRTQRNLAKLNDELYEVHQIMTRNVQEVLGVGEKLDQVSELSSRLTSESRIYADKARDLNRQALIRKWAPVAVVLGVVMLLFWVKKKIW

SEQ ID NO: 22204 - protein, 218 aa, Zostera marina
MVKLTMIARVTDGLPLAEGLEDGREHKDVDFYKQQAKLLFKNLSKGHYEASRMTIETGPNFFHYIIEGRVCYLTMCDRSYPKKLAFQYLEDLKNEFERVNGNQIETAARPYAFIKFDSFIQKTKKLYLDTRAQRNIAKLNDELYEVHQIMTRNVQEVLGVGEKLDQVSQMSSRLTSDTRAYADKAKDLNRQALIRKWAPVAIVIGVVLLLFWVKQKIW

SEQ ID NO: 22205 - protein, 218 aa, Aristolochia fimbriata
MVKLTMIARVTDGLPLAEGLDDGSDIKDAEYYKQQAKALFKNLCKGQNEPSRMSIETGPYVFHYIIEGRVCYLTMCDRSYPKKLAFQYLEDLKNEFERVNGNQIETAARPYAFIKFDTFIQKTKKLYMDTRTQRNLAKLNDELYEVHQIMTRNVQEVLGVGEKLDHVSQMSSRLTSESRIYADKAKDLNRQALIRKYAPFAIVIGVVLLLFWVRKKIW

SEQ ID NO: 22206 - protein, 218 aa, Elaeis guineensis
MVKLTMIARVTDGLPLAEGLDDGRDQKDIEFYKQQAKLLFKNLSKGQNEASRMSIETGPYFFHYIIEGRVCYLTMCDRSYPKKLAFQYLEDLKNEFERVNGNQIETAARPYAFIKFDTFIQKTKKLYLDTRTQRNLAKLNDELYEVHQIMTRNVQEVLGVGEKLDQVSELSSRLTSESRIYADKARDLNRQALIRKWAPVAVVLGVVMLLFWVKKKIW

SEQ ID NO: 22207 - protein, 226 aa, Oryza sativa
MVKLTMIARVTDNLPLVEGLDDGRDLKDADFYKQQAKLLFKNLSKGQHEASRMSIETGPYLFHYIIEGRVCYLTMCDCSYPKKLAFQYLEDLKNEFERVNGNQIETAARPYAFIKFDTFIQKTKKLYLDTRTQRNLAKLNDELYEVHQIMTRNFQEVLGVGEKLDHDESFLFAEVSEMSNRLISDTRIYAEKAKDLNRQALIRKYAPVAIVIGIVLMLFWVKNKIW

SEQ ID NO: 22208 - protein, 218 aa, Amsonia hubrichtii
MVKLTMIARVTDGLPLVEGLDDGRDVPDADFYKKQAKALFTNLSRGQNEASRMSLETGPYYFHYIIEGRVCYLTMCDRAYPKKLAFQYLEDLKNEFERVNGSQIETAARPYAFIKFDTFIQKTKKLYQDTRTQRNIAKLNDELYEVHQIMTRNVQEVLGVGEKLDQVSQMSSRLTSESRIYADKAKDLNRQALIRKWAPVAIVLGVVSLLFWVKNKIW

SEQ ID NO: 22209 - protein, 218 aa, Musa acuminata
MVKLTMIARVTDGLPLAEGLDDGRDQKDADFYKQQAKLLFKSLSKGHYEASRMSIETGPYFFHYIIEGRVCYLTMCDRSYPKKLAFQYLEDLKNEFERVNGGQIETAARPYAFIKFDTFIQKTKKLYLDTHTQRNIAKLNDELYEVHQIMTRNVQEVLGVGEKLDQVSELSSRLTSESRIYADKAKDLNRQALIRKWAPVAIVLGVVMLLFWVRKKIW

SEQ ID NO: 22210 - protein, 218 aa, Vaccinium corymbosum
MVKLTMIARVTDGLPLAEGLDDGRDLQDAEFYKQQVKALFKNLSRGQNEPSRMSIETGPYVFHYVIEGRVCYLTMCDRAYPKKLAFQYLEDLKNEFERVNGSQIETAARPYAFIKFDTFIQKTRKLYLDTRTQRNISKLNDELYEVHQIMTRNVQEVLGVGEKLDQVSEMSSRLTSESRIYADKARDLNRQALIRKWAPVAIVLGVVFLLFWVKNKIW

SEQ ID NO: 22211 - protein, 218 aa, Solanum phureja
MVKLTMIARVTDGLPLAEGLDDGRDIQDADFYKQQAKSLFKNLSMGQIEASRMSVETGPYIFHYNIEGRVCYLTMCDRSYPKKLAFQYLEDLKNEFERVNGSQIETAARPYAFIKFDTFIQKTKKLYQDTRTQRNITKLNDELYEVHQIMTRNVQEVLGVGEKLDQVSQMSSRLTSESRIYADKARDLNRQALIRKWAPVAIVIGVVTLLFWAKNKIW

SEQ ID NO: 22212 - protein, 218 aa, Amborella trichopoda
MVKLTMIARVTDGLPLAEGLDDGRDQKDLEFYKQQAKALFKNLSRGQSDPSRMSIETGPYIFHYIIEGRVCYLTMCDRAYPKKLAFQYLEDLKNEFERVNANQIETAARPYAFIKFDTFIQKTRKLYLDTHTQRNLAKLNDDLYEVHQIMTRNVQEVLGVGEKLDQVSQMSSRLTSESRIYADKARDLNRQALIRKWAPVAIVLGIVFLLFWVRNKIW

SEQ ID NO: 22213 - protein, 218 aa, Capsicum annuum
MVKLTMIARVTDGLPLAEGLDDGRDIQDVDFYKQQAKSLFKNLSMGQIETSRMSVETGPYIFHYIIEGRVCYLTMCDRVYPKKLAFQYLEDLKNEFERVNGSQIETAARPYAFIKFDTFIQKTKKLYQDTRTQRNITKLNDELYEVHQIMTRNVQEVLGVGEKLDQVSQMSSRLTSESRIYADKARDLNRQALIRKWAPVAIVIGVVILLFWAKNKIW

SEQ ID NO: 22214 - protein, 218 aa, Solanum lycopersicum
MVKLTMIARVTDGLPLAEGLDDGRDIQDADFYKQQAKSLFKNLSMGQIEVSRMSVETGPYIFHYNIEGRVCYLTMCDRSYPKKLAFQYLEDLKNEFERVNGSQIETAARPYAFIKFDTFIQKTKKLYQDTRTQRNITKLNDELYEVHQIMTRNVQEVLGVGEKLDQVSQMSSRLTSESRIYADKARDLNRQALIRKWAPVAIVVGVVILLFWAKNKIW

SEQ ID NO: 22215 - protein, 218 aa, Eucalyptus grandis
MVKLTMIARVTDGLPLAEGLDDGRDVKDAEFYKQQVKALFKNLSKGQNEPSRMSVETGPYYFHYIIEGRVCYLTMCDRSYPKKLAFQYLEDLKNEFGRVNGAQIETAARPYAFIKFDTFIQKTKKLYQDTRTQRNISKLNDELYEVHQIMTRNVQEVLGVGEKLDQVSEMSSRLTSESRIYADKARDLNRQALIRKWAPVAIVLGVVFLLFWVKSKIW

SEQ ID NO: 22216 - protein, 218 aa, Vitis vinifera
MVKLTLIARVTDGLPLAEGLDDGRDLKDAEFYKQQVKALFKNLSKGQNEPSRMSIETGPYIFHYIIEGRVCYLTMCDRAYPKKLAFQYLEDLKNEFERVNGNQIETAARPYAFIKFDTFIQKTKKLYQDTRTQRNIAKLNDELYEVHQIMTRNVQEVLGVGEKLDQVSQMSSRLTSESRIYADKARDLNRQALIRKWAPVAIVFGVVFLLFWIRKKIW

SEQ ID NO: 22217 - protein, 218 aa, Papaver somniferum
MVKLTLIARVTDGLPLAEGLDDGRDLKDAEFYKQQAKALFKNLSKGHNEASRMSIETGPFVFHYIIEGRVCYLTMCDRAYPKKLAFQYLEDLKSEFEKVNGNQIETAARPYAFIKFDTFIQKTKKLYLDTRTQRNISKLNDELYEVHQIMTRNVQEVLGVGEKLDQVSQMSSRLTSESRIYADKARDLNRQALIRKWAPVAIVLGVVFLLFWVRKKIW

SEQ ID NO: 22218 - protein, 218 aa, Solanum tuberosum
  Sequence also found in Organisms: Solanum phureja
MVKLTMIARVTDGLPLAEGLDDSRDVPDADYYKQQVKSLFKNLSMGHNEASRMSIESGPYIFHYIIEGRVCYLTMCDRSYPKKLAFQYLEDLKTEFERVNGSQIETAARPYAFIKFDTFIQKTKKLYQDTRTQRNVAKLNDELYEVHQIMTRNVQEVLGVGEKLDQVSQMSSRLTSESRIYADKARDLNRQALIRKWAPVAIVIGVVSLLFWAKNKIW

SEQ ID NO: 22219 - protein, 218 aa, Valeriana officinalis
MVKLTMIARVTDGLPLAEGLDDGRDMQDAEFYKQQVKALFKNLSRGQNEASRMSLETGPYVFHYIIEGRVCYLTMCDRAYPKKLAFQYLEDLKNEFERVNGSQIETAARPYAFIKFDTFIQKTKKLYQDTRTQRNISKLNDELYEVHQIMTRNVQEVLGVGEKLDQVSQMSSRLTSESRIYADKAKDLNRQALIRKWAPVAIVLGVVFLLFWVKKKIW

SEQ ID NO: 22220 - protein, 218 aa, Amorphophallus konjac
MVKLTMIARVTDGLPLAEGLDDNRDQKDADFYKQQAKLLFKNLSKGHNEASRMSIETGPYFFHYIIEGRVCYLTLCDRSYPKKLAFQYLEDLKNEFERVNGNQIETAARPYAFIKFDTFIQKTKKLYSDTHTQRNLAKLNDELYEVHQIMTRNVQEVLGVGEKLDQVSEMSSRLTNESRIYAEKAKDLNRQAFIRKWAPVAIVIGVVTFLFWVKHRLW

SEQ ID NO: 22221 - protein, 218 aa, Gossypium hirsutum
  Sequence also found in Organisms: Gossypium raimondii
MVKMTMIARVTDGLPLAEGLDDGRDLVDAEMYKQQVKALFKNLSKGHNEASRMSIETGPYVFHYIIEGRVCYLTMCDRSYPKKLAFQYLEDLKNEFERVNGAQIETAARPYAFIKFDTFIQKTKKLYQDTRTQRNIAKLNDELYEVHQIMTRNVQEVLGVGEKLDQVSQMSSRLTSESRIYADKARDLNRQALIRKWAPVAIVLGVVFLLFWVKAKLW

SEQ ID NO: 22222 - protein, 218 aa, Nicotiana benthamiana
MVKLTMVARVTDGLPLAEGLDDGRDVPDADFYKQQAKSLFKNLSMGQIDASRMSVETGPYIFHYIIEGRVCYLTMCDRSYPKKLAFQYLEDLKNEFERVNGSQIETAARPYAFIKFDTFIQRTKKLYQDTRTQRNITKLNDELYEVHQIMTRNVQDVLGVGEKLDQVSQMSSRLTSESRIYADKARDLNRQALIRKWAPVAIVIGVVILLFWAKNKIW

SEQ ID NO: 22223 - protein, 218 aa, Quercus alba
MVKLTLIARVTDGLPLAEGLDDSRDLKDAEFYKQQVKALFKNLSRGQNEASRMSIETGPYIFHYIIEGRVCYLTMCDRAYPKKLAFQYLEDLKNEFERVNGAQIETAARPYAFIKFDTFIQKTKKLYQDTRTQRNIAKLNDELYEVHQIMTRNVQEVLGVGEKLDQVSEMSSRLTSESRIYADKARDLNRQALIRKWAPVAIVFGVVFLLFWVKTKIW

SEQ ID NO: 22224 - protein, 206 aa, Avena sativa
MVKLTMIARVTDGLPLAEGLDDGRDQKDSDFYKQQAKLLFKNLSKGQHEASRMSIETGSYFFHYIIEGRVCYLTMCDRSYPKKLAFQYLEDLKNEFERVNGNQIETAARPYAFIKFDTYIQKTKKLYLDTRTQRNIAKLNDELYEVHQIMTRNVQEVLGVGEKLDQVSEMSSRLTSDTRIYADKAKDLNRQAFIRKYAPVAIVIGL

SEQ ID NO: 22225 - protein, 218 aa, Allium cepa
MVKLTMIARVTDGLPLAEGLDDSRDVKDADFYKQQAKLLFKNLSKGHNEASRMSIETGNYYFHYIIEGRVCYLTMCERGYPKKLAFQYLEDLKNEFEKVDGNQIETAARPYAFIKFDTFIQKTKKLYSDTRTQRNLAKLNDELYEVHQIMTRNVQEVLGVGEKLDQVSEMSSRLTSESRIYADKAKDLNRQALIRKWAPVAIVLGVVMLLFWVRKKIY

SEQ ID NO: 22226 - protein, 218 aa, Capsicum annuum
MVKLTLIARVTDGLPLAEGLDDGRDVPDADFYKQQVKALFKNLSMRQNDASRMSIETGPYIFHYIIEGHVCYLTMCDRSYPKKLAFQYLEDLKNEFERVNGSQIETAARPYAFIKFDTFIQKTKKLYQDTRTQRNISKLNDELYEVHQIMTRNVQEVLGVGEKLDQVSQMSSRLTSESRIYADKAKDLNRQALIRKWAPVAIVLGVVFLLFWVKAKIW

SEQ ID NO: 22227 - protein, 218 aa, Tabernaemontana elegans
MVKLTMIARVTDGLPLVEGLDDGRDMPDADFYKKQAKALFTNLSRGQNEPSRMSVETGPYIFHYIIEGRVCYLMMCDRAYPKKLAFQYLEDLKSEFERLNGSQIETAARPYAFIKFDTFIQKTKKLYQDTRTQRNIAKLNDELYEVHQIMTRNVQEVLGVGEKLDQVSQMSSRLTSESRIYADKAKDLNHQALIRKWAPVAIVLGVVILLFWVKNKIW

SEQ ID NO: 22228 - protein, 218 aa, Solanum lycopersicum
MVKLTMIARVTDGLPLAEGLDDSRDVPDADYYKQQVKSLFKNLSMGHNEASRMSIESGPYIFHYIIEGRVCYLTMCDRSYPKKLAFQYLEDLKNEFERVNGSQIETAARPYAFIKFDTFIQKTKKLYQDTRTQRNVAKLNDELYEVHQIMTRNVQEVLGVGEKLDQVSQMSSRLTSESRIYADKARDLNRQALIRKWAPVAIVIGVVSLLFWAKSKIW

SEQ ID NO: 22229 - protein, 218 aa, Conyza canadensis
MVKLTMIARVIDGLPLAEGLDDGRDLQDAEFYKQQVKALFKNLSRGQNEASRMSIETGPYIFHYIIEGRVCYLTMCDRAYPKKLAFQYLEDLKNEFERGYGNQIETAARPYAFIKFDTFIQRTKKLYQDTRTQRNIAKLNDELYEVHQVMTRNVQEVLGVGEKLDQVSQMSSRLTSESRIYADKAKDLNRQAFIRKWAPVAIVLGIVILLFWVKNKIW

SEQ ID NO: 22230 - protein, 218 aa, Rosmarinus officinalis
MVKLIMIARVTDGLPLVEGLDDGRDMPDADFYKKQAKALFANLSRGLNDPSRMSIETGSYMFHYIIEGRVCYLTMCDRAYPKKLAFQYLEDLKNEFERVNGSQIETAARPYAFIKFDTFIQKTKKLYQDTRTQRNIAKLNDELYEVHQIMTRNVQEVLGVGEKLDQVSQMSSRLTSESRIYADKAKDLNRQALIRKWAPVAIVLGVVMLLFWVKNKIW

SEQ ID NO: 22231 - protein, 218 aa, Gossypium hirsutum
MVKMTTIARVTDGLPLAEGLDDGRDLVDAEMYKQQVKALFKNLSKGHNEASRMSIETGPYVFHYIIEGRVCYLTMCDRSYPKKLAFQYLEDLKNEFERVNGAQIETAARPYAFIKFDTFIQKTKKLYQDTRTQRNIAKLNDELYEVHQIMTRNVQEVLGVGEKLDQVSQMSSRLTSESRIYADKARDLNRQALIRKWAPVAIVLGVVFLLFWVKAKLW

SEQ ID NO: 22232 - protein, 218 aa, Gossypium hirsutum
  Sequence also found in Organisms: Gossypium raimondii
MVKLTMIARVTDGLPLAEGLDDGRDLTDAEMYKQQVKALFKNLSKGHNEASRMSVETGPYVFHYIIEGRVCYLTMCDRSYPKKLAFQYLEDLKNEFERVNGAQIETAARPYAFIKFDTFIQKTKKLYQDTRTQRNISKLNDELYEVHQIMTRNVQEVLGVGEKLDQVSQMSSRLTSESRIYADKARDLNRQALIRKWAPVAIVLGVVFLLFWVKAKLW

SEQ ID NO: 22233 - protein, 218 aa, Actinidia deliciosa
MVKLTMIARVTDGLPLAEGLDDGRDWQDAELYKQQIKALFKNLSRGQNEPSRMSVETGPYIFHYIIEGRVCYLTMCDRAYPKKLAFQYLEDLKNEFERVNGSQIETAARPYAFIKFDTFIQKTKKLYQDTRTQRNISKLNDELYEVHQIMTRNVQEVLGVGEKLDQVSQMSSRLTSESRIYADKARDLNRQALIRKWAPVAIVIGVVILLFWVRKKIW

SEQ ID NO: 22234 - protein, 218 aa, Liriodendron tulipifera
MVKLTMIARVTDGLPLAEGLDDGRDQKDAEFYNQQANSLFKNLSKGHNEASRMSIETGPYVFHYIIEGRVCYLTMCDRSYPKKLAFQYLEDLKNEFEKVNESQIETAARPYAFIKFDTFIQKTKKLYLDTRTQRNLAKLNDELYEVHQIMTRNIQEVLGVGEKLDQVSQLSSRLTSESRIYADKAKDLNRQAFIRKWAPVAIVLGAVFLLFWGRKKIW

SEQ ID NO: 22235 - protein, 218 aa, Allium cepa
MVKLTMIARVTDGLPLAEGLDDSRDVKDADFYKQQAKLLFKNLSKGHNEASRMSIETGNYYFHYIIEGRVCYLTMCERGYPKKLAFQYLEDLKNEFEKVDGNQIETAARPYAFIKFDTFIQKTKKLYSDTRTQRNLAKLNDELYEVHQIMTRNVQEVLGVGEKLDQVSEMSSRLTYESRTYADKAKDLNRQALIRKWAPVAIVLGVVMLLFWVRKKIY

SEQ ID NO: 22236 - protein, 218 aa, Primula obconica
MVKLTMIARVTDGLPLSEGLDDGRELQEADQYKQQVKQLFKNLSRGQNEPSRMSVETGPYIFHYIIEGRVCYLTMCDRSYPKKLAFQYLEDLKNEFERVNGDQIETAARPYAFIKFDTFIQKTKKLYQDTRTQRNIAKLNDELYEVHQIMTRNVQEVLGVGEKLDQVSEMSSRLTSESRIYADKAKDLNRQALIRKWAPVAIVLGVVILLFWVKRKIW

SEQ ID NO: 22237 - protein, 218 aa, Rhizophora mangle
MVKLTMIARVTDGLPLAEGLDDGRDIKDAEMYKQQVKALFKNLATRQNEPSRMSIETGPYIFHYIIEGRVCYLTMCDRSYPKKLAFQYLEDLKNEFERVNGVQIETAARPYAFIKFDTFIQKTKKLYQDTRTQRNIAKLNDELYEVHQIMTRNVQEVLGVGEKLDQVSEMSSRLTSESRIYADKARDLNRQALIRKWAPVAIVLGVVFLLFWVKTKIW

SEQ ID NO: 22238 - protein, 218 aa, Tabernaemontana elegans
MVKLTMIARVTDGLPLVEGLDDGRDVPDADFYKKQAKAIFTNLSRGLNDPSRMSIETGSYMFHYIIEGRVCYLTMCDRAYPKKLAFQYLEDLKNEFERVNGSQIETAARPYAFIKFDTFIQKTKKLYQDTRTQRNIAKLNDELYEVHQIMTRNVQEVLGVGEKLDQVSQMSSRLTSESRIYADKAKDLNRQALIRKWAPVAIVLGVVILLFWVKNKIW

SEQ ID NO: 22239 - protein, 218 aa, Citrullus lanatus
MVKLTMIARVTDGLPLAEGLDDGRDMQDAEFYKQQVKALFKNLSRGQNEASRMSIETGPYVFHYIIEGRVCYLTMCDRAYPKKLAFQYLEDLKNEFERVNGAQIETAARPYAFIKFDTYIQKTKKLYQDTRTQRNIAKLNDELYEVHQIMTRNVQEVLGVGEKLDQVSQMSSRLTSESRIYADKARDLNRQALIRKWAPVAIVFGVVFLLFWFKSKIW

SEQ ID NO: 22240 - protein, 218 aa, Rosmarinus officinalis
MVKLTMIARVTDGLPLAEGLDDGRDVSDADFYKQQVKSLFKNLSKGQNEPSRMSIETGPYIFHYIIEGRVCYLTMCDRAYPKKLSFQYLEDLKNEFERAYGNQIETAARPYAFIKFDTFIQKTKKLYQDTRTQRNISKLNDELYEVHQIMTRNVQEVLGVGEKLDQVSQMSSRLTSESRIYAEKAKDLNRQALIRKWAPVAVVLGVVFLLFWVKNKLW

SEQ ID NO: 22241 - protein, 218 aa, Amsonia hubrichtii
MVKLTLIARVTDGLPLAEGLDDGRDIPDPDFYKKQAKALFTNLSRGLNDPSRMSIETGPYMFHYIIEGRVCYLTMCDRAYPKKLAFQYLEDLKNEFERVNGSQIETAARPYAFIKFDAFIQKTKKLYKDTGTQRNIAKLNDELYEVHQIMTRNVQEVLGVGEKLDQVSQMSSRLTSESRMYADKAKDLNRQALIRQWAPVAIVLGIVTLLYWVKNKIW

SEQ ID NO: 22242 - protein, 218 aa, Malus domestica
MVKLTMIARVTDGLPLAEGLDDGRDVKDSEFYKQQVKALFKNLSRGQNEPSRMSVETGPFVFHYIIEGRVCYLTMCDRAYPKKLAFQYLEDLKNEFERVNGTQIETAARPYAFIKFDTFIQKTKKLYQDTRTQRNIAKLNDELYEVHQIMTRNVQEVLGVGEKLDQVSQMSSRLTSESRVYADKARDLNRQALIRKYAPIAIVLGVVFLLFWVKTKLW

SEQ ID NO: 22243 - protein, 218 aa, Aquilegia formosa
MVKLTMIARVTDGLPLAEGLEDGRDQQDADFYKQQAKALFKNLSKGQNHPSRMSIETGPYVFHYIIEGHVCYLTMCDRSYPKKLAFQYLEDLKNEFEKVDGSQIETAARPYAFIKFDAFIQKTKKLYLDTRTQRNLAKLNDELYEVHQIMTRNVQEVLGVGEKLDQVSQMSSRLTSESRVYAEKARDLNRQAFIRKWAPVAIVLGVVFILFWVRKQIW

SEQ ID NO: 22244 - protein, 218 aa, Theobroma cacao
MVKMTMIARVTDGLPLAEGLDDGRDLKDAEMYKQQVKALFKNLSKGQNEASRMSIETGPYVFHYIIEGRVCYLTMCDRAYPKKLAFQYLEDLRNEFERVNGAHIETAARPYAFIKFDTFIQKTKKLYQDTRTQRNIAKLNDELYEVHQIMTRNVQEVLGVGEKLDQVSQMSSRLTSESRIYADKARDLNRQALIRKWAPVAVVLGVVFLLFWVKAKLW

SEQ ID NO: 22245 - protein, 218 aa, Brassica napus
MVKMTLIARVTDGLPLAEGLDDGRDLPDSDMYKQQVKSLFKNLSRGHNEASRMSVETGPYIFHYIIEGRVCYLTMCDRSYPKKLAFQYLEDLKNEFERVNGSNIETAARPYAFIKFDTFIQKTKKLYQDTRTQRNIAKLNDELYEVHQIMTRNVQEVLGVGEKLDQVSEMSSRLTSESRVYADKAKDLNRQALIRKWAPVAIVLGVVFLLFWVKNKLW

SEQ ID NO: 22246 - protein, 218 aa, Cucumis sativus
  Sequence also found in Organisms: Cucumis melo
MVKLTMIARVTDGLPLAEGLDDGRDMQDAEFYKQQVKALFKNLSRGQNEASRMSVETGPYVFHYIIEGRVCYLTMCDRAYPKKLAFQYLEDLKNEFERVNGAQIETAARPYAFIKFDTYIQKTKKLYQDTRTQRNIAKLNDELYEVHQIMTRNVQEVLGVGEKLDQVSQMSSRLTSESRIYADKARDLNRQALIRKWAPVAIVFGVVFLLFWFKSKIW

SEQ ID NO: 22247 - protein, 218 aa, Cucurbita pepo
MVKLTMIARVTDGLPLAEGLDDGRDMQDAEFYKQQVKALFKNLSRGQNEASRMSIETGPYVFHYIIEGRVCYLTMCDRAYPKKLAFQYLEDLKNEFERVNGAQIETAARPYAFIKFDTYIQKTKKLYQDTRTQRNIAKLNDELYEVHQIMTRNVQEVLGVGEKLDQVSQMSSRLTSESRIYADKARDLNRQALIRKWAPVAIVFGVVFLLFWFKSKLW

SEQ ID NO: 22248 - protein, 218 aa, Lupinus angustifolius
MVKLTMIARVTDGLPLAEGLDDGRDMKDAEFYKQQVKALFKNLSRGHNEASRMSIETGPYVFNYIIEGRVCYLTMCDRAYPKKLAFQYLEDLKNEFERVNGSQIETAARPYAFIKFDTFIQKTKKLYQDTHTQRNIAKLNDELYEVHQIMTRNVQDVLGVGEQLDQVSQMSSRLSSESRIYADKAKDLNRQALIRKWAPVAIVLGVVFVLFWLKNKIW

SEQ ID NO: 22249 - protein, 218 aa, Carica papaya
MVKMTMIARVTDGLPLAEGLDDGRDLKDAEMYKQQVKALFKNLSRGQNEASKMSIETGPYVFHYLIEGRVCYLTMCDRAYPKKLAFQYLEDLKNEFERVNGNQIETAARPYAFIKFDTFIQKTKKLYQDTRTQRNIAKLNDELYEVHQIMTRNVQDVLGVGEKLDQVSQMSSRLTSESRIYAEKAKDLNRQALIRKWAPVAIVLGVVFLLFWVKTKIW

SEQ ID NO: 22250 - protein, 218 aa, Silene vulgaris
MVKVTMIARVTDGLPLAEGLDDGRDVQDADYYKQQIKALFKNLSKGQNDPSRMSVETGPYVFHYIIEGRVCYLTMCDRAYPKKLAFQYLEDLKNEFERVNGNQIETAARPYAFIKFDTFIQKTKKLYQDTRTQRNMSKLNDELYEVHQIMTRNVQEVLGVGEKLDQVSQMSSRLTSESRIYADKAKDLNRQALIRKWAPVAIVIGVVVLLFWVRKKIY

SEQ ID NO: 22251 - protein, 218 aa, Vinca minor
MVKLTMIARVTDGLPLVEGLDDGRDLPDADFYKKQAKALFANLSRGLSDPSRMSIETGSYMFHYIIEGHVCYLTMCDRSYPKKLAFQYLEDLKTEFERVNGSQIDTAARPYAFIKFDTFIQKTKKLYQDTRTQRNIAKLNDELYEVHQIMTRNVQEVLGVGEKLDQVSQMSSRLTSESRIYADKAKDLNRQAFIRKWAPVAIVLSVVILLFWVKNKIW

SEQ ID NO: 22252 - protein, 218 aa, Citrullus lanatus
MVKLTIIARVTDGLPLAEGLDDGRDLGDADYYKQQAKALFKNLSRGQNEPSRMSIETGSYVFHYIIEGHVCYLTMCDRAYPKKLAFQYLEDLKNEFERVNGAHIETAARPYAFIKFDTFIQKMKKLYQDTRTQRNIAKLNDELYEVHQIMTRNVQEVLGVGEKLDQVSEMSSRLTSESRIYADKAKDLNRQALIRKWAPVAIVLGVVVLLFWVKSKIW

SEQ ID NO: 22253 - protein, 231 aa, Hordeum vulgare
MVKLTMIARVTDGLPLAEGLDDGRDQKDSDFYKQQAKLLFKNLSKGQHEASRMSIETGSYFFHYIIEGRVCYLTMCDRSYPKKLAFQYLEDLKNEFERVNGSQIETAARPYAFIKFDTYIQKTKKLYLDTRTQRNIAKLNDELYEVHQIMTRNVQEVLGVGEKLDLTVYHSCVFPFFAEVSEMSSRLTSDTRIYADKAKDLNRQAFIRKYAPVAIVIGVVIILFWAKNKIW

SEQ ID NO: 22254 - protein, 218 aa, Rosmarinus officinalis
MVKLTMIARVTDGLPLAEGLDDGRDVSDADYYKQQVKSLFKNLSKGQNEPSRMSIETGPYIFHYIIEGRVCYLTMCDRVYPKKLSFQYLEDLKNEFERAYGNQIETAARPYAFIKFDTFIQKTKKLYQDTRTQRNISKLNDELYEVHQIMTRNVQEVLGVGEKLDQVSQMSSRLTSESRIYAEKAKDLNRQALIRKWAPVAVVLGVVFLLFWVKNKLW

SEQ ID NO: 22255 - protein, 218 aa, Malus domestica
MVKLTMIARVTDGLPLAEGLDDGRDVKDSEFYKQQVKALFKNLSTGQNEPSRMSVETGPFVFHYIIEGRVCYLTMCDRAYPKKLAFQYLEDLKNEFERVNGTQIETAARPYAFIKFDTFIQKTKKLYQDTHTQRNIAKLNDELYEVHQIMTRNVQEVLGVGEKLDQVSQMSSRLTSESRIYADKARDLNRQALIRKYAPIAIVLGVVFLLFWVKTKLW

SEQ ID NO: 22256 - protein, 218 aa, Arabidopsis lyrata
MVKMTLIARVTDGLPLAEGLDDGRDLPDSDMYKQQVKALFKNLSRGQNEASRMSVETGPYVFHYIIEGRVCYLTMCDRSYPKKLAFQYLEDLKNEFERVNGPNIETAARPYAFIKFDTFIQKTKKLYQDTRTQRNIAKLNDELYEVHQIMTRNVQEVLGVGEKLDQVSEMSSRLTSESRIYADKAKDLNRQALIRKWAPVAIVFGVVFLLFWVKTKLW

SEQ ID NO: 22257 - protein, 218 aa, Arabidopsis thaliana
MVKMTLIARVTDGLPLAEGLDDGRDLPDSDMYKQQVKALFKNLSRGQNDASRMSVETGPYVFHYIIEGRVCYLTMCDRSYPKKLAFQYLEDLKNEFERVNGPNIETAARPYAFIKFDTFIQKTKKLYQDTRTQRNIAKLNDELYEVHQIMTRNVQEVLGVGEKLDQVSEMSSRLTSESRIYADKAKDLNRQALIRKWAPVAIVFGVVFLLFWVKNKLW

SEQ ID NO: 22258 - protein, 218 aa, Brassica juncea
MVKMTLIARVTDGLPLAEGLDDGRDLPDADMYKQQVKALFKNLSRGHNEASRMSVETGPYIFHYIIEGRVCYLTMCDRSYPKKLAFQYLEDLKNEFERVNGPNIETAARPYAFIKFDTFIQKTKKLYQDTRTQRNISKLNDELYEVHQIMTRNVQEVLGVGEKLDQVSEMSSRLTSESRIYADKAKDLNRQALIRKWAPVAIVLGVVFLLFWVKNKLW

SEQ ID NO: 22259 - protein, 218 aa, Brassica napus
  Sequence also found in Organisms: Brassica oleracea, Brassica rapa
MVKMTLIARVTDGLPLAEGLDDGRDLPDSDMYKQQVKSLFKNLSRGHNEASRMSVETGPYVFHYIIEGRVCYLTMCDRSYPKKLAFQYLEDLKNEFERVNGPNIETAARPYAFIKFDTFIQKTKKLYQDTRTQRNIAKLNDELYEVHQIMTRNVQEVLGVGEKLDQVSEMSSRLTSESRIYADKAKDLNRQALIRKWAPVAIVLGVVFLLFWVKNKLW

SEQ ID NO: 22260 - protein, 218 aa, Brassica napus
  Sequence also found in Organisms: Brassica oleracea
MVKMTLIARVTDGLPLAEGLDDGRDLPDSDMYKQQVKALFKNLSRGHNEASRMSVETGPYIFHYIIEGRVCYLTMCDRSYPKKLAFQYLEDLKNEFERVNGPNIETAARPYAFIKFDTFIQKTKKLYQDTRTQRNIAKLNDELYEVHQIMTRNVQEVLGVGEKLDQVSEMSSRLTSESRVYADKAKDLNRQALIRKWAPVAIVLGVVFLLFWVKNKLW

SEQ ID NO: 22261 - protein, 218 aa, Brassica napus
  Sequence also found in Organisms: Brassica oleracea, Brassica rapa
MVKMTLIARVTDGLPLAEGLDDGRDLPDSDMYKQQVKALFKNLSRGHNEASRMSVETGPYIFHYIIEGRVCYLTMCDRSYPKKLAFQYLEDLKNEFERVNGPNIETAARPYAFIKFDTFIQKTKKLYQDTRTQRNIAKLNDELYEVHQIMTRNVQEVLGVGEKLDQVSEMSSRLTSESRIYADKAKDLNRQALIRKWAPVAIVLGVVFLLFWVKNKLW

SEQ ID NO: 22262 - protein, 218 aa, Brassica rapa
MVKMTLIARVTDGLPLAEGLDDGRDLPDSDMYKQQVKSLFKNLSRGHNEASRMSVETGPYIFHYIIEGRVCYLTMCDRSYPKKLAFQYLEDLKNEFERVNGPNIETAARPYAFIKFDTFIQKTKKLYQDTRTQRNIAKLNDELYEVHQIMTRNVQEVLGVGEKLDQVSEMSSRLTSESRVYADKAKDLNRQALIRKWAPVAIVLGVVFLLFWVKNKLW

SEQ ID NO: 22263 - protein, 218 aa, Daucus carota
MVKLTMIARVTDGLPLVEGLDDGRDVQNADIYKQQVKALFKNLSRGHNEASRMSVETGPYMFHYIIEGRVCYLTMCDRAYPKKLAFQYLEDLANEFERVNGSQIETAARPYAFIKFDTFIQKTKKLYQDTRTQRNISKLNDELYEVHQIMTRNVQEVLGVGEKLDQVSQMSSRLTSESRIYADKAKDLNRQALIRKWAPVAIVLGIVFLLFWVRKKIW

SEQ ID NO: 22264 - protein, 218 aa, Citrus clementina
MVKMTMIARVTDGLPLAEGLDDGRDLRDAEMYKQQVKALFKNLSRGQNEASRMSIETGPYVFHYIIEGRVCYLTMCDRAYPKKLAFQYLEDLKNEFERVNGAQIETAARPYAFIKFDTFIQKTKKLYQDTRTQRNIAKLNDELYEVHQIMTRNVQEVLGVGEKLDQVSEMSSRLTSESRIYADKAKDLNRQALIRKWAPVAIVLGVVFVVFWLKTKLW

SEQ ID NO: 22265 - protein, 218 aa, Humulus lupulus
MVKLTMIARVTDGLPLAEGLDDGRDIRDVEFYKQQVKALFKNLSRGQNEPSRMSVETGPYIFHYIIEGRVCYLTMCDRAYPKKLAFQYLEDLKNEFERVNGAQIETAARPYAFIKFDTFIQKTKKLYQDTQTQRNISKLNDELYEVHQIMTRNVQEVLGVGEKLDQVSQMSSRLTSESRIYADKARDLNRQALIRKWAPVAIVLGVVFLLFWVKNKLW

SEQ ID NO: 22266 - protein, 218 aa, Petroselinum crispum
MVKLTMIARVTDGLPLVEGLDDGRDVQNIDIFKQQVKALFKNLSRGHNEASRMSVETGPYMFHYIIEGRVCYLTMCDRAYPKKLAFQYLEDLANEFERVNGSQIETAARPYAFIKFDTFIQKTKKLYQDTRTQRNIAKLNDELYEVHQIMTRNVQEVLGVGEKLDQVSQMSSRLTSESRIYADKAKDLNRQALIRKWAPVAIVLGIVFLLFWVRNKIW

SEQ ID NO: 22267 - protein, 218 aa, Arachis hypogaea
MVKLTMIARVTDGLPLAEGLDDGRDLKDAEFYKQQVKALFKNLSRGHNEASRMSIETGPYVFHYIIEGRVCYLTMCDRAYPKKLAFQYLEELRNEFERVNGSQIETAARPYAFIKFDTFIQKTKKLYQDTHTQRNISKLNDELYEVHQIMTRNVQEVLGVGEQLDQVSQMSSRLSSESRMYADKARDLNRQALIRKWAPVAIVFGVVFVLFWLKNKLW

SEQ ID NO: 22268 - protein, 215 aa, Petunia hybrida
MVKLTLIARVTDGLPLAEGLDDGRDVPDADFYKQQVKALFKNLSMRQNDASRMSIETGPYIFHYIIEGHVCYLTMCDRSYPKKLAFQYLEDLKNEFERVNGNQIETAARPYAFIKFDTFIQKTKKLYQDTRTQRNISKLNDELYEVHQIMTRNVQEVLGVGEKLDQVSQMSSRLTSESRIYADKAKDLNRQALIRKWAPVAIVIGVVILLFWVKQ

SEQ ID NO: 22269 - protein, 218 aa, Lippia dulcis
MVKLTMIARVTDGLPLAEGLDDGRDVSDADFYKQQVKSLFKNLSRGHNEASRMSVETGPYIFHYIIEGRVCYLTMCDRAYPKKLAFQYLEDLKNEFERTYGNQIETAARPYAFIKFDTFIQKTKKLYQDTRTQRNISKLNDELYEVHQIMTRNVQEVLGVGEKLDEVSQMSSRLTSESRIYADKAKDLNRQALIRKWAPVAIVLGVVFLLFWVKNKLW

SEQ ID NO: 22270 - protein, 218 aa, Sesamum indicum
MVKLTMIARVTDGLPLAEGLDDGRDVPDSDFYKQQVKSLFKNLSRGQNEPSRMSIETGPYIFHYIIEGRVCYLTMCDRSYPKKLSFQYLEDLKNEFERAYGNQIETAARPYAFIKFDTFIQKTKKLYQDTRTQRNIAKLNDELYEVHQIMTRNVQEVLGVGEKLDQVSQMSSRLTSESRIYADKAKDLNRQALIRKWAPVAVVLGVVFLLFWVRKKFW

SEQ ID NO: 22271 - protein, 218 aa, Helianthus annuus
MVKLTMIARVTDGLPLAEGLDDGRDLQDAEFYKQQVKALFKNLSRGQNEASRMSVETGPYIFHYIIEGRVCYLTMCDRAYPKKLAFQYLEDLKNEFERGYGNQIETAARPYAFIKFDTFIQRTKKLYQDTRTQRNIAKLNDELYEVHQIMTRNVQEVLGVGEKLDQVSQMSSRLTSESRVYADKARDLNRQALIRKWAPVAIVLGVVILLFWARNKIW

SEQ ID NO: 22272 - protein, 218 aa, Eutrema parvulum
MVKMTLIARVTDGLPLAEGLDDGRDLPDSDMYKQQVKALFKNLSRGQNEASRMSVETGPYVFHYIIEGRVCYLTMCDRSYPKKLAFQYLEDLKNEFERVNGPNIETAARPYAFIKFDTFIQKTKKLYQDTRTQRNIAKLNDELYEVHQIMTRNVQEVLGVGEKLDQVSEMSSRLTSESRIYADKAKDLNRQALIRKWAPVAIVLGVVFLLFWVKTKLW

SEQ ID NO: 22273 - protein, 218 aa, Nicotiana tabacum
MVKLTMIARVTDGLPLAEGLDDSRDVPDSDFYKQQAKSLFKNLSMGQNEASRMSVETGPYIFHYIIEGHVCYLTMCDRSYPKKLAFQYLEDLKNEFERVNRSQIETAARPYAFIKFDTFIQKTKKLYQDTGTQRNISKLSDELYEVHQIMTRNVQDVLGVGEKLDQVSQMSSRLTSESRIYVDKARDLNRQALIRKWAPVAIVIGVVSLLFWVKNKIW

SEQ ID NO: 22274 - protein, 218 aa, Rosmarinus officinalis
MVKLTMIARVTDGLPLAEGLDDGRDMSDADYYKQQVKSLFKNLSRGQNEPSRMSIETGPYIFHYIIEGRVCYLTMCDRVYPKKLSFQYLEDLKNEFERAYGNQIETAARPYAFIKFDTFIQKTKKLYQDTRTQRNISKLNDELYEVHQIMTRNVQEVLGVGEKLDQVSQMSSRLTSESRIYAEKAKDLNRQALIRKWAPVAVVLGVVFLLFWVKNKLW

SEQ ID NO: 22275 - protein, 218 aa, Arnica chamissonis
MVKLTMIARVTDGLPLAEGLDDGRDMQDAEFYKQQVKALFKNLSRGQNEASRMSIETGPYIFHYIIEGRVCYLTMCDRAYPKKLAFQYLEDLKNEFERGYGNQIETAARPYAFIKFDTFIQRTKKLYQDTRTQRNITKLNDELYEVHQIMTRNVQEVLGVGEKLDQVSQMSNRLTSESRIYADKARDLNRQALIRKWAPVAIVLGVVILLFWAKNKIW

SEQ ID NO: 22276 - protein, 218 aa, Artemisia annua
  Sequence also found in Organisms: Chrysanthemum coronarium
MVKLTMIARVTDGLPLAEGLDDGRDMQDADFYKQQVKSLFKNLSRGQNDASRMSVETGPYVFHYIIEGRVCYLTMCDRAYPKKLAFQYLEDLKNEFERGYGNQIETAARPYAFIKFDTFIQRTKKLYQDTRTQRNISKLNDELYEVHQIMTRNVQEVLGVGEKLDQVSQMSSRLTSDTRIYADKARDLNRQALIKKWAPVAIVLGVVFLLFWARNKIW

SEQ ID NO: 22277 - protein, 218 aa, Fagus grandifolia
MVKLTLIARVTDGLPLVEGLDDARDLKDAEYYKQQVKALFKNLSRGQNEASRMSIETGPYIFHYIIEGRVCYLTMCDRAYPKKLAFQYLEDLKNEFERVNAAQIETAARPYAFIKFDAFIQKTKKLYQDTRTQRNIAKLNDELYEVHQIMTRNVQEVLGVGEKLDQVSEMSSRLTSESRIYADKARDLNRQALIRKWAPVAIVFGVVFLLFWVKTKIW

SEQ ID NO: 22278 - protein, 218 aa, Cannabis sativa
MVKLTMIARVTDGLPLAEGLDDGRDIRDVEFYKQQVKALFKNLSSGQNEPSRMSVETGPYIFHYIIEGRVCYLTMCDRAYPKKLAFQYLEDLKNEFEHVNGAQIETAARPYAFIKFDTFIQKTKKLYQDTRTQRNISKLNDELYEVHQIMTRNVQEVLGVGEKLDQVSQMSSRLTSESRIYADKARDLNRQALIRKWAPVAIVLGVVFLLFWAKNKLW

SEQ ID NO: 22279 - protein, 218 aa, Brassica napus
MVKMTLIARVTDGLPLAEGLDDGRDLPDSDMYKQQVKSLFKNLSRGHNEASRMSVETGPYVFHYIIEGRVCYLTMCDRSYPKKLAFQYLEDLRNEFERVNGPNIETAARPYAFIKFDTFIQKTKKLYQDTRTQRNIAKLNDELYEVHQIMTRNVQEVLGVGEKLDQVSEMSSRLTSESRIYADKAKDLNRQALIRKWAPVAIVLGVVFLLFWVKNKLW

SEQ ID NO: 22280 - protein, 218 aa, Daucus carota
MVKLTMIARVTDGLPLVEGLDDGRDVQNVDYYKQQVKALFKNLSRGHNEASRMSVETGPYIFHYIIEGRVCYLTMCDRAYPKKLAFQYLEDLANEFERVNGSQIETAARPYAFIKFDTFIQKTKKLYQDTRTQRNISKLNDELYEVHQIMTRNVQEVLGVGEKLDQVSQMSSRLTSESRIYADKAKDLNRQALIRKWAPVAIVLGIVFLLFWVRKKIW

SEQ ID NO: 22281 - protein, 218 aa, Daucus carota
MVKLTMIARVTDGLPLVEGLDDGRDVQNADIYKQQVKALFKNLSRGHNEASRMSVETGPYMFHYIIEGRVCYLTMCDRAYPKKLAFQYLEDLANEFERVNGSQIETAARPYAFIKFDTFIQKTKKLYQDTRTQRNISKLNDELYEVHQIMTRNVQEVLGVGEKLDQVSQMSSRLTSESRIYADKAKDLNRQALIRKWAPVAVVLGIVILLFWVRKKIW

SEQ ID NO: 22282 - protein, 218 aa, Centaurea maculosa
  Sequence also found in Organisms: Cirsium arvense
MVKLTMIARVIDGLPLAEGLDDGRDLQDAEFYKQQVKALFKNLSRGQNEASRMSVETGPYIFHYIIEGRVCYLTMCDRAYPKKLAFQYLEDLKNEFERGYGNQIETAARPYAFIKFDTFIQRTKKLYQDTRTQRNIAKLNDELYEVHQIMTRNVQEVLGVGEKLDQVSQMSSRLTSDTRIYADKARDLNRQALIKKWAPVAIVLGVVILLFWARKKIW

SEQ ID NO: 22283 - protein, 218 aa, Chrysanthemum coronarium
MVKLTMIARVTDGLPLAEGLDDGRDMQDADFYKQQVKSLFKNLSRGQNDASRMSLETGPYVFHYIIEGRVCYLTMCDRAYPKKLAFQYLEDLKNEFERGYGNQIETAARPYAFIKFDTFISRTKKLYQDTRTQRNISKLNDELYEVHQIMTRNVQEVLGVGEKLDQVSQMSSRLTSDTRIYADKARDLNRQALIRKWAPVAIVLGVVFLLFWAKKKIW

SEQ ID NO: 22284 - protein, 218 aa, Cichorium intybus
MVKLTMIARVTDGLPLAEGLDDGRDMQDAEFYKQQVKALFKNLSRGQNEASRMSIETGPYVFHYIIEGRVCYLTMCDRAYPKKLAFQYLEDLKNEFERGYDNQIETAARPYAFIKFDTFIQKTKKLYQDTRTQRNISKLNDELYEVHQIMTRNVQEVLGVGEKLDQVSQMSSRLTSDTRIYADKARDLNRQALIKKWAPVAVVVGFVILLLWAKNKIW

SEQ ID NO: 22285 - protein, 218 aa, Cirsium arvense
MVKLTMIARVTDGLPLAEGLDDGRDMQDAEFYKQQVKALFKNLSRGQNEASRMSVETGPYIFHYIIEGRVCYLTMCDRAYPKKLAFQYLEDLKNEFERGYASQIETAARPYAFIKFDTFIQRTKKLYQDTRTQRNIAKLNDELYEVHQIMTRNVQEVLGVGEKLDQVSQMSSRLTSESRIYADKARDLNRQALIRKWAPVAIVLGVVILLFWARNKIW

SEQ ID NO: 22286 - protein, 218 aa, Vigna unguiculata
MVKLTMIARVTDGLPLAEGLDDGRDLKDAEFYKQQVKALFKNLSRGHYEASRMSVETGPYVFHYIIEGRVCYLTMCDRAYPKKLAFQYLEELRNEFERVNGSQIETAARPYAFIKFDTFMQKTKKLYQDTHTQRNIAKLNDELYEVHQIMTRNVQEVLGVGEQLDQVSQMSSRLSSESRIYADKARDLNRQALIRKWAPVAIVFGVVFVLFWIKNKIW

SEQ ID NO: 22287 - protein, 218 aa, Taraxacum officinale
MVKLTMIARVTDGLPLAEGLDDGRDMQDAEFYKQQVKALFKNLSRGQNEASRMSIETGPYVFHYIIEGRVCYLTMCDRAYPKKLAFQYLEDLKNEFERGYENQIETAARPYAFIKFDTFIQRTKKLYQDTRTQRNISKLNDELYEVHQIMTRNVQEVLGVGEKLDQVSQMSSRLTSDTRIYADKARDLNRQALIKKWAPVAIVVGFVILLLWAKNKIW

SEQ ID NO: 22288 - protein, 218 aa, Euonymus alatus
MVKMTMIARVTDGLPLAEGLDDGRDMQDSEIYKQQVKALFKNLSKGQNEVSRMSIETGPYVFHYIIEGRVCYLTMCDRSYPKKLAFQYLEDLKNEFERVNGAQIETAARPYAFIKFDTFIQRTKRLYQDTRTQRNIAKLNDELFEVHQIMTRNVQEVLGVGEKLDQVSQMSSRLTSESRIYADKARDLNRQALIRKWAPVAIVLGVVFLLFWVKTKLW

SEQ ID NO: 22289 - protein, 218 aa, Flaveria ramosissima
MVKLTMIARVIDGLPLAEGLDDGRDMQDAEFYKQQVKALFKNLSRGQHEASRMSVETGPYIFHYIIEGRVCYLTMCDRAYPKKLAFQYLEDLKNEFERGYGNQIETAARPYAFIKFDTFIQRTKKLYQDTRTQRNIAKLNDELYEVHQIMTRNVQEVLGVGEKLDQVSQMSNRLTSESRVYADKARDLNRQALIRKWAPVAIVLGVVILLFWAKNKIW

SEQ ID NO: 22290 - protein, 218 aa, Lactuca sativa
MVKLTMIARVTDGLPLAEGLDDGRDMQDAEFYKQQVKALFKNLSRGQNEASRMSIETGPYVFHYIIEGRVCYLTMCDRAYPKKLAFQYLEDLKNEFERGYENQIETAARPYAFIKFDTFIQRTKKLYQDTRTQRNISKLNDELYEVHQIMTRNVQEVLGVGEKLDQVSQMSSRLTSDTRVYADKARDLNRQALIKKWAPVAIVLGVVIVLFWLKGKIW

SEQ ID NO: 22291 - protein, 218 aa, Momordica charantia
MVKLTMIARVTDGLPLAEGLDDGRDMQDSEFYKQQVKALFKNLSRGQNEASRMSVETGPYVFHYIIEGRVCYLTMCDRAYPKKLAFQYLEDLKNEFERVNGAQIETAARPYAFIKFDTYIQKTKKLYQDTRTQRNIAKLNDELYEVHQIMTRNVQEVLGVGEKLDQVSQMSSRLTSESRIYADKARDLNRQALIRKWAPVAIVFGVVFLLFWFKSKLW

SEQ ID NO: 22292 - protein, 218 aa, Mimulus guttatus
MVKITMIARVTDGLPLVEGLDDGRDMPDADFYKQQVKALFKNLSRGQNEPSRMSIETGPYIFHHIIEGRVCYLTMCDRSYPKKLAYQYLEDLKNEFERVYGNQIETAARPYAFIKFDTFIQKTKKLYQDTRTQRNVSKLNDELYEVHQIMTRNVQEVLGVGEKLDQVSQMSSRLTSESRIYADKAKDLNRQALIRKWAPVAVVLGVVFFLLWVKKKIW

SEQ ID NO: 22293 - protein, 217 aa, Quercus alba
MVKLTMIARVTDGLPLAEGLDAGRDPQDEFYKQQAKSIFKNLSKGHNESSRMSIETGPYIFHYIIEGRVCYLTMCDRSYPKKLAFQYLEELKNEFERVNGDQIETAARPYAFIKFDTYIQKIKKLYLDTRSQRNIAKLNDELYEVQQIMTRNVQEVLGVGEKLDHVSEMSSRLTSESRIYADKARDLNRQALIRKWAPVGIVIAVVLLLFWVKNKIW

SEQ ID NO: 22294 - protein, 218 aa, Olea europaea
MVKLTMIARVTDGLPLVEGLDDGRDVPDADFYKQQVKALFKNLSRGQNEPSRMSIETGPYVFHHIIEGRVCYLTMCDRAYPKKLAFQYLEDLKNEFERVYGNQIETAARPYAFIKFDTFMQKTKKLYQDTRTQRNIAKLNDELYEVHQIMTRNVQEVLGVGEKLDQVSQMSSRLTSESRIYAEKAKDLNRQALIRKWAPVAVVLGVVFLLFWVRNKFW

SEQ ID NO: 22295 - protein, 218 aa, Lippia dulcis
MVKLTMIARVTDGLPLAEGLDDGRDVPESDFYKQQVKSLFKNLSRGQNEPSRMSVETGPYIFHYIIEGRVCYLTMCDRAYPKKLAFQYLEDLKNEFERAYGNQIETAARPYAFIKFDTFIQKTKKLYQDTRTQRNISKLNDELYEVHQIMTRNVQEVLGVGEKLDQVSQMSSRLTSESRIYADKAKDLNRQALIRKWAPVAVVLGVVFLLFWVKVKIW

SEQ ID NO: 22296 - protein, 218 aa, Cajanus cajan
MVKLTMIARVTDGLPLAEGLDDGRDLKDAEFYKQQVKALFKNLSRGHYEASRMSVETGPYVFHYIIEGRVCYLTMCDRAYPKKLAFQYLEELRNEFERVNGSQIETAARPYAFIKFDTFIQKTKKLYQDTHTQRNIAKLNDELYEVHQIMTRNVQEVLGVGEQLDQVSQMSSRLSSESRIYADKARDLNRQALIRKWAPVAIVFGVVFVLFWIKNKLW

SEQ ID NO: 22297 - protein, 218 aa, Populus trichocarpa
MVKLTMIARVTDGLPLAEGLDDGRDVKDAEMYKQQVKALFKNLASGHNDASRMSIETGPYIFHYIIEGRICYLTMCDRSYPKKLAFQYLEDLKNEFERVNGPQIETAARPYAFIKFDTFIQKTKKLYQDTRTQRNIAKLNDELYEVHQIMTRNVQEVLGVGEKLDQVSQMSSRLTSESRVYADKARDLNRQALIRKWAPVAIVLGVVFLLFWIKTKLW

SEQ ID NO: 22298 - protein, 218 aa, Populus trichocarpa
MVKLTMIARVTDGLPLAEGLDDGRDVKDAEMYKQQVKALFKNLASGHNDASRMSVETGPYVFHYIIEGRVCYLTMCDRSYPKKLAFQYLEDLKNEFERVNGAQIETAARPYAFIKFDTFIQKTKKLYQDTRTQRNVAKLNDELYEVHQIMTRNVQEVLGVGEKLDQVSQMSSRLTSESRIYAEKARDLNRQALIRKWAPVAIVLGVVFLLFWVKTKLW

SEQ ID NO: 22299 - protein, 218 aa, Raphanus sativus
MVKMTLIARVTDGLPLAEGLDDGRDLPDSDMYKQQVKALFKNLSRGHNEASRMSVETGPYIFHYIIEGRVCYLTMCDRSYPKKLAFQYLEDLKNEFERVNGPNIETAARPYAFIKFDTFIQKTKKLYQDTRTQRNIAKLNDELYEVHQIMTRNVQEVLGVGEKLDQVCEMSSRLTSESRVYADKAKDLNRQALIRKWAPVAIVLGVVFLLFWVKNKLW

SEQ ID NO: 22300 - protein, 218 aa, Raphanus sativus
MVKMTLIARVTDGLPLAEGLDDGRDLPDSDMYKQQVKALFKNLSRGHNEASRMSVETGPYVFHYIIEGRVCYLTMCDRSYPKKLAFQYLEDLKNEFERVNGPNIETAARPYAFIKFDTFIQKTKKLYQDTRTQRNISKLNDELYEVHQIMTRNVQEVLGVGEKLDQVSEMSSRLTSESRIYADKAKDLNRQALIRKWAPVAIVLGVVFLLFWVKNKLW

SEQ ID NO: 22301 - protein, 218 aa, Silene vulgaris
MVKVTMIARVTDGLPLAEGLDDGRDVQDVDYYKQQIKALFKNLSKGLNDPSRMSVESGPYVFHYIIEGRVCYLTMCDRAYPKKLAFQYLEDLKNEFERVNGNQIETAARPYAFIKFDTFIQKTKKLYQDTRTQRNMSKLNDELYEVHQIMTRNVQEVLGVGEKLDQVSQMSSRLTSESRIYADKAKDLNRQALIRKWAPVAIVIGVVVLLFWVKKKIY

SEQ ID NO: 22302 - protein, 218 aa, Eutrema halophilum
MVKMTLIARVTDGLPLAEGLDDGRDLPDSDMYKQQVKALFKNLSRGQNEASRMSVESGPYVFHYIIEGRVCYLTMCDRSYPKKLAFQYLEDLKNEFERVNGPNIETAARPYAFIKFDTFIQKTKKLYQDTRTQRNIAKLNDELYEVHQIMTRNVQEVLGVGEKLDQVSEMSSRLTSESRIYADKAKDLNRQALIRKWAPVAIVFGVVFLLFWVKTKLW

SEQ ID NO: 22303 - protein, 218 aa, Triphysaria pusilla
MVKLTLIARVTDGLPLAEGLDDGRDVPDSDFYKQQVKSLFKNLSSGQNEPSRMSIETGPYIFHYIIEGRVCYLTMCDRAYPKKLAFQYLEDLKNEFERAYGNQTETAARPYAFIKFDTFIQKTKKLYQDTRTQRNVAKLNDELYEVHQIMTRNVQEVLGVGEKLDHVSQMSSRLTSESRIYAEKAKDLNRQALIRKWAPVAIVLGVVFLLFWVKNKLW

SEQ ID NO: 22304 - protein, 217 aa, Prunus persica
  Sequence also found in Organisms: Prunus mume
MVKLTMIARVTDGLPLAEGLDDGRDIQDSEFYKQQVKALFKNLSRGQNEPSRMSVETGPYVFHYIIEGRVCYLTMCDRAYPKKLAFQYLEDLKNEFERVNGTQIETAARPYAFIKFDTFIQKTKKLYQDTRTQRNIAKLNDELYEVHQIMTRNVQEVLGVGEKLDQVSQMSSRLTSESRIYADKARDLNRQALIRKWAPVAIVLGLVFLLFWVIKLR

SEQ ID NO: 22305 - protein, 218 aa, Glycine max
MVKLTMIARVTDGLPLAEGLDDGRDLKDAEFYKQQVKALFKNLSRGHYEASRMSVETGPYVFHYIIEGRVCYLTMCDRAYPKKLAFQYLEELRNEFERVNGSQIETAARPYAFIKFDTFMQKTKKLYQDTHTQRNIAKLNDELYEVHQIMTRNVQEVLGVGEQLDQVSQMSSRLSSESRIYADKARDLNRQALIRKWAPVAIVFGVVFVLFWIKNKLW

SEQ ID NO: 22306 - protein, 218 aa, Beta vulgaris
MVKVTMIARVMDGLPLAEGLDDGRDVQDVEYYKQQIKALFKNLSKGQNDPSRMSVESGPYIFHYIIEGSVCYLTMCDRSYPKKLAFQYLEDLKNEFERVNGNQIETAARPYAFIKFDTFIQRTKKLYQDTRTQRNIAKLNDELYEVHQIMTRNVQEVLGVGEKLDQVSQMSSRLTSESRIYADKARDLNRQALIKKWAPVAIVIGIVVLLFWVKKKIW

SEQ ID NO: 22307 - protein, 218 aa, Manihot esculenta
MVKLTMIARVTDGLPLAEGLDDGRDVKEIEMYKQQVKALFKNLTTRQNEPSRMSIETGPYVFHYIIEGRVCYLTMCDRTYPKKLAFQYLEDLKNEFERVNGVQIETAARPYAFIKFDTFIQKTKKLYQDTRTQRNIAKLNDELYEVHQVMTRNVQEVLGVGEKLDQVSEMSSRLTSESRIYADKARDLNRQALIRKWAPVAIVLGVVFLLFWVKTKIW

SEQ ID NO: 22308 - protein, 218 aa, Centaurea maculosa
MVKLTMIARVTDGLPLAEGLDDGRDMQDAEFYKQQVKALFKNLSRGQNEASRMSVETGPYIFHYIIEGRVCYLTMCDRAYPKKLAFQYLEDLKNEFERGYASQIETAARPYAFIKFDTFIQRTKKLYQDTRTQRNIAKLNDELYEVHQIMTRNVQEVLGVGEKLDQVSQMSSRLTSESRIYADKARDLNRQALIRKWAPVAIVLGVVILLFWARKKIW

SEQ ID NO: 22309 - protein, 218 aa, Cicer arietinum
MVKLTLIARVTDGLPLAEGLDDGRDLKDAEFYKQQVKALFKNLSRGHNDASRMSVETGPYVFHYIIEGRVCYLTMCDRAYPKKLAFQYLEELRNEFERVNGSQIETAARPYAFIKFDTFIQKTKKLYQDTHTQRNIAKLNDELYEVHQIMTRNVQEVLGVGEQLDQVSQMSSRLSSESRIYADKARDLNRQALIRKWAPVAIVFGVVFVLFWLKNKIW

SEQ ID NO: 22310 - protein, 218 aa, Chrysanthemum coronarium
MVKLTMIARVTDGLPLAEGLDDGRDMQDADFYKQQVKSLFKNLSRGQNDASRMSLETGPYVFHYIIEGRVCYLTMCDRAYPKKLAFQYLEDLKNEFERGYGNQIETAARPYAFIKFDTFISRTKKLYQDTRTQRNISKLNDELYEVHQIMTRNVQEVLGVGEKLDQVSQMSSRLTSDTRIYADKARDLNRQALIKKWAPVAIVLGVVFLLFWARNKIW

SEQ ID NO: 22311 - protein, 218 aa, Cirsium arvense
MVKLTMIARVTDGLPLAEGLDDGRDMQDAEYYKQQVKALFKNLSRGQNEASRMSVETGPYIFHYIIEGRVCYLTMCDRAYPKKLAFQYLEDLKNEFERGYGNQIETAARPYAFIKFDTFIQRTKKLYQDTRTQRNIAKLNDELYEVHQIMTRNVQEVLGVGEKLDQVSQMSSRLTSDTRIYADKARDLNRQALIKKWAPVAIVLGVVILLFWARKKIW

SEQ ID NO: 22312 - protein, 218 aa, Trifolium pratense
MVKLTMIARVTDGLPLAEGLDDGRDLTDGEFYKQQAKSLFKNLSRGHNEASRMSVESGPYVFHYIIEGRVCYLTMCDRAYPKKLAFQYLEDLRNEFERVNGSQIETAARPYAFIKFDTFIQKTKKLYQDTHTQRNIAKLNDELYEVHQIMTRNVQEVLGVGEQLDQVSQMSNRLSSESRVYADKARDLNRQALIRKWAPVAIVFGVVFVLFWLKNKIW

SEQ ID NO: 22313 - protein, 218 aa, Coffea canephora
MVKLTMIARVTDGLPLVEGLDDGRDMPDVDYYKKQAKALFTNLSRGQNEASRMSIETGPYVFHYIIEGRVCYLTMCDRAYPKKLAFQYLEDLKNEFERVNGSQIETAARPYAFIKFDTFIQKTKKLYQDTRTQRNIAKLNDELYEVHQIMTRNVQEVLGVGEKLDQVSQLSSRLTSESRIYAEKARDLNRQALIRKWAPVAVVLGVVILLFWVRKKIW

SEQ ID NO: 22314 - protein, 218 aa, Euphorbia peplus
MVKLTMIARVTDGLPLAEGLDDGRDLKDIELYKQQVKALFKNLATRQNEPSRMSIETGPFVFHYIIEGHVCYLTMCDRSYPKKLAFQYLEDLKNEFERTNGSQIETAARPYAFIKFDTFIQKTKKLYQDTRTQRNISKLNDELYEVHQIMTRNVQEVLGVGEKLDQVSEMSSRLTSESRIYADKARDLNRQAFIRKWAPVAIVLGVVFVLFWAKNKIW

SEQ ID NO: 22315 - protein, 218 aa, Linum usitatissimum
MVKLTMIARVTDGLPLAEGLDDGRDVKDIELYKQQVKALFKNLAIRQNEPSRMSIETGPYVFHYIIEGRVCYLTMCDRAYPKKLAFQYLEDLKNEFERVNGAQIETAARPYAFIKFDTFIQRTKKLYQDTHTQRNIAKLNDELYEVHQIMTRNVQEVLGVGEKLDQVSEMSSRLTSESRVYADKARDLNRQALIRKWAPVAIVFGVVFLLFWVKTKIW

SEQ ID NO: 22316 - protein, 218 aa, Lupinus angustifolius
MVKLTMIARVTDGLPLAEGLDDGRDIKDAEFYKQQVKALFKNLSRGHNEASRMSVETGPYVFHYIIEGRVCYLTMCDRAYPKKLAFQYLEELRNEFERVNGSQIETAARPYAFIKFDTFMQKTKKLYQDTHTQRNIAKLNDELYEVHQIMTRNVQEVLGVGEQLDQVSQMSSRLSSESRIYADKARDLNRQALIRKWAPVAIVLGVVFVLFWLKNKIW

SEQ ID NO: 22317 - protein, 218 aa, Tropaeolum majus
MVKMTMIARVTDGLPLAEGLDDGRDLRDAEMYKQQVKSLFKNLSRGQTGVSRMSVETGPYVFHYIIEGGVCYLTMCDRAYPKKLAFQYLEDLRNEFERVNGGQIETAARPYAFIKFDTFIQKTKKLYQDTRTQRNIAKLNDELYEVHQIMTRNVQEVLGVGEKLDQVSQRSSRLTSESRIYADKAKDLNRQALIRKWAPVAIVLGVVFLLFWVKKKIY

SEQ ID NO: 22318 - protein, 218 aa, Petroselinum crispum
MVKLTMIARVTDGLPLVEGLDDGRDVQNVDYYKQQVKALFKNLSRGHNEASRMSVETGPFIFHYIIEGRVCYLTMCDRAYPKKLAFQYLEDLANEFERANGSQIETAARPYAFIKFDTFIQKTKKLYQDTRTQRNIAKLNDELYEVHQIMTRNVQEVLGVGEKLDQVSQMSSRLTSESRIYADKAKDLNRQALIRKWAPVAIVLGIVILLFWVRKKIW

SEQ ID NO: 22319 - protein, 218 aa, Lippia dulcis
MVKLTMIARVTDGLPLVEGLDDGRDVPDADFYKQQVKALFKNLSTGQNEPSRMSIETGPYIFHYIIEGRVCYLTMCDRAYPKKLSFQYLEDLKNEFERVYGNQIETAARPYAFIKFDTFIQKTKKLYQDTRTQRNISKLNDELYEVHQIMTRNVQEVLGVGEKLDQVSEMSNRLTSESRIYADKAKDLNRQALIRKWAPVAVVLGVVFLLFWVKTKLW

SEQ ID NO: 22320 - protein, 218 aa, Solanum lycopersicum
  Sequence also found in Organisms: Solanum tuberosum
MVKLTLIARVTDGLPLAEGLDDGRDVQNADFYKQQVKALFKNLSMRQNDASRMSIETGPYVFHYIIEGHVCYLTMCDRSYPKKLAFQYLEDLKNEFERANGSQIETAARPYAFIKFDTFIQKTKKLYQDTRTQRNISKLNDELYEVHQIMTRNVQEVLGVGEKLDQVSQMSSRLTSESRIYADKAKDLNRQALIRKWAPVAIVLGVVILFFWLRTKIW

SEQ ID NO: 22321 - protein, 218 aa, Chenopodium quinoa
MVKLTMIARVMDGLPLAEGLDDGRDVQDAEYYKQQIKALFKNLSKGQNDPSRMSVESGPYIFHYIIEGPVCYLTMCDRAYPKKLAFQYLEDLKNEFERVNGNQIETAARPYAFIKFDTFIQRTKKLYQDTRTQRNISKLNDELYEVHQIMTRNVQEVLGVGEKLDQVSEMSSRLTSESRIYADKAKDLNRQALIRKWAPVAIVIGVVVLLFWVKKKIW

SEQ ID NO: 22322 - protein, 186 aa, Secale cereale
MVKLTMIARITDGLPLAEGLDDGRDLKDADFYKQQAKLLFKNLSKGQHESSRLSIETGPYYFHYIIESRVCYLTMCDRSYPKKLAFQYLEDLKNEFERVNGSQIETAARPYAFIKFDTFIQKTRKLYLDTRTQRNLAKLNDELYEVHQIMTRNVQEVLGVGEKLDQVSQMSSRLTSDTRMYADKAR

SEQ ID NO: 22323 - protein, 218 aa, Carthamus tinctorius
MVKLTMIARVIDGLPLAEGLDDGRDMQDAEFYKQQVKALFKNLSRGQNEASRMSVETGPYIFHYIIEGRVCYLTMCDRAYPKKLAFQYLEDLKNEFERGYGNQIETAARPYAFIKFDTFIQRTKKLYQDTRTQRNIAKLNDELYEVHQIMTRNVQEVLGVGEKLDQVSQMSSRLTSDTRIYADKARDLNRQALIKKWAPVAIVLGVVILLFWARKKIW

SEQ ID NO: 22324 - protein, 218 aa, Fragaria vesca
MVKLTMIARVTDGLPLAEGLDDGRDIKDSEFYKQQVKALFKNLSRGQNEPSRMSVESGPYIFHYIIEGRVCYLTMCDRAYPKKLAFQYLEDLKNEFERVNGAQIETAARPYAFIKFDTFIQKTKKLYQDTRTQRNISKLNDELYEVHQIMTRNVQEVLGVGEKLDQVSQMSNRLTSETRAYAEKARDLNRQALIRKWAPVAIVLGVVFLVFWVKTKLW

SEQ ID NO: 22325 - protein, 218 aa, Vicia sativa
MVKLTMIARVTDGLPLAEGLDDGRDLKDGEFYKQQVKALFKNLSRGHNEASRMSVESGPYIFHYIIEGRVCYLTMCDRAYPKKLAFQYLEELRNEFERVNGAQIETAARPYAFIKFDTFIQKTKKLYQDTHTQRNIAKLNDELYEVHQIMTRNVQEVLGVGEQLDQVSQMSSRLSSESRIYADKAKDLNRQALIRKWAPVAIVFGVVFLLFWLKNKIW

SEQ ID NO: 22326 - protein, 218 aa, Glycine max
MVKLTMIARVTDGLPLAEGLDDGRDLKDAEFYKLQVKALFKNLSRGHYEASRMSVETGPYVFHYIIEGRVCYLTMCDRAYPKKLAFQYLEELRNEFERVNGSQIETAARPYAFIKFDTFMQKTKKLYQDTHTQRNIAKLNDELYEVHQIMTRNVQEVLGVGEQLDQVSQMSSRLSSESRIYADKARDLNRQALIRKWAPVAIVFGVVFVLFWIKNKLW

SEQ ID NO: 22327 - protein, 218 aa, Spinacia oleracea
MVKLTMIARVMDGLPLAEGLDDGRDVQDAEYYKQQIKALFKNLSKGQNDPSRMSVESGPYIFHYIIEGPVCYLTMCDRAYPKKLSFQYLEDLKNEFERVNGNQIETAARPYAFIKFDTFIQRTKKLYQDTRTQRNISKLNDELYEVHQIMTRNVQEVLGVGEKLDQVSQMSSRLTSESRIYADKARDLNRQALIRKWAPVAIVIGVVVLLFWVKKKIW

SEQ ID NO: 22328 - protein, 218 aa, Amaranthus tuberculatus
MVKVTMLARVMDGLPLAEGLDDGRDVQDVEYYKQQIKALFKNLSKGQNDPSRMSVESGPYIFHYIIEGSVCYLTMCDRSYPKKLAFQYLEDLKNEFERVNGNQIETAARPYAFIKFDTFIQRTKKLYQDTRTQRNIAKLNDELYEVHQIMTRNVQEVLGVGEKLDQVSQMSSRLTSESRIYADKARDLNRQALIRKWAPVAIVIGVVVLLFWVKKKIW

SEQ ID NO: 22329 - protein, 218 aa, Ambrosia trifida
MVKLTMIARVTDGLPLAEGLDDGRDMQDAEFYKQQVKALFKNLSRGHNDASRMSVETGPYVFHYIIEGRVCYLTMCDRAYPKKLAFQYLEDLKNEFERGYGNQIETAARPYAFIKFDTFIQKTKKLYQDTRTQRNISKLNDELYEVHQIMTRNVQEVLGVGEKLDQVSQMSSRLTSESRVYADKARDLNRQALIRKWAPVAIVLGVVILLFWARNKIW

SEQ ID NO: 22330 - protein, 218 aa, Ambrosia trifida
MVKLTMIARVTDGLPLAEGLDDGRDMQDAEFYKQQVKALFKNLSRGHNEASRMSVETGPYVFHYIIEGRVCYLTMCDRAYPKKLAFQYLEDLKNEFERGYGNQIETAARPYAFIKFDTFIQRTKKLYQDTRTQRNITKLNDELYEVHQIMTRNVQEVLGVGEKLDQVSQMSSRLTSESRVYADKARDLNRQALIRKWAPVAIVLGVVILLFWVRRKIW

SEQ ID NO: 22331 - protein, 218 aa, Aquilegia formosa
MVKLTMIARVTDGLALAEGLEDGRDQNDADFYKHQAKDLFKSLSKGQNHPSRMSIETGPYVFHYIIEGHVCYLTMCDRSYPKKLAYQYLEDLKNEFERVNGNQIETAARPYAFIKFDTYIQKTKKLYLDTGTQRNLAKLNDELYEVHQIMTRNVQEVLGVGEKLDQVSQMSSRLTSESRVYAEKARDLNRQAFIRKWAPFAIVFGVVFLLFWAKTKIW

SEQ ID NO: 22332 - protein, 218 aa, Phaseolus vulgaris
MVKLTMIARVTDGLPLAEGLDDGRDLKDAEYYKQQVKALFKNLSRGHYEASRMSVETGPYVFHYIIEGRVCYLTMCDRAYPKKLAFQYLEELRNEFERVNGSQIETAARPYAFIKFDTFIQKTKKLYQDTHTQRNISKLNDELYEVHQIMTRNVQDVLGVGEQLDQVSQMSSRLSSESRVYADKARDLNRQALIRKWAPVAIVFGVVFVLFWIKNKIW

SEQ ID NO: 22333 - protein, 218 aa, Ricinus communis
MVKLTMIARVTDGLPLAEGLDDGRDVKDIEMYKQQVKALFKNLATRQNEPSRMSIESGSYVFHYIIEGRVCYLTMCDRSYPKKLAFQYLEDLKNEFERVNGAQIETAARPYAFIKFDTFIQKTKKLYQDTRTQRNIAKLNDELYEVHQIMTRNVQDVLGVGEKLDQVSEMSSRLTSESRIYADKARDLNRQALIRKWAPVAIVLGVVFLLFWVKTKLW

SEQ ID NO: 22334 - protein, 218 aa, Centaurea maculosa
MVKLTMIARVTDGLPLAEGLDDGRDMQDAEFYKQQVKALFKNLSRGHNEASRMSVETSPYIFHYIIEGRVCYLTMCDRAYPKKLAFQYLEDLKNEFERGYASQIETAARPYAFIKFDTFIQRTKKLYQDTRTQRNIAKLNDELYEVHQIMTRNVQEVLGVGEKLDQVSQMSSRLTSESRIYADKARDLNRQALIRKWAPVAIVFGVVILLFWARNKIW

SEQ ID NO: 22335 - protein, 218 aa, Trifolium pratense
MVKLTMIARVTDGLPLAEGLDDGRDLTDGEFYKQQAKSLFKNLSRGHNEASRMSVESGPYVFHYIIEGRVCYLTMCDRAYPKKLAFQYLEDLRNEFERVNGSQIETAARPYAFIKFDTFIQKTKKLYQDTHTQRNIAKLNDELYEVRQIMTRNVQEVLGVGEQLDQVSQMSNRLSSESRVYADKARDLNRQALIRKWAPVAIVFGVVFVLFWLKNKIW

SEQ ID NO: 22336 - protein, 218 aa, Panax ginseng
MVKLTMIARVTDGLPLVEGLDDGRDVQNVEFYKQQVKVLFKNLSRGHNEASRMSVETGPYIFHYVIEGRVCYLTMCDRAYPKKLAFQYLEDLANEFERVNGSQIETAARPYAFIKFDTFIQKTKKLYQDTRTQRNIAKLNDELYEVHQIMTRNVQEVLGVGEKLDQVSQMSSRLTSESRIYADKARDLNRQAFIRKWAPVAIVIGVVILLFWVRKKIW

SEQ ID NO: 22337 - protein, 218 aa, Panax ginseng
MVKLTMIARVTDGLPLVEGLDDGRDVQNVEFYKQQVKALFKNLSRGHNEASRMSVETGPYIFHYVIEGRVCYLTMCDRAYPKKLAFQYLEDLANEFERVNGSQIETAARPYAFIKFDTFIQKTKKLYQDTRTQRNISKLNDELYEVHQIMTRNVQEVLGVGEKLDQVSQMSSRLTSESRIYADKARDLNRQALIRKWAPVAIVIGVVILLFWVRKKIW

SEQ ID NO: 22338 - protein, 218 aa, Tropaeolum majus
MVKMTMIARVTDGLPLAEGLDDGRDLQDSEIYKQQVKALFKNLSRGQNEASRMSVETGPYVFHYIIEDSVCYLTMCDRAYPKKLAFQYLEDLKNEFGRVNGGQIETAARPYAFIKFDTFIQKTKKLYQDTRTQRNIAKLNDELFEVHQIMTRNVQEVLGVGEKLDQVSQMSSRLTSESRIYADKAKDLNRQALIRKWAPVAVVLGVVFLLFWVKMKMW

SEQ ID NO: 22339 - protein, 218 aa, Olea europaea
MVKLTMIARVIDGLPLVEGLDDSRDVPDADFYKQQVKALFKNLSRGQNEPSRMSIETGPYIFHHIIEGRVCYLTMCDRAYPKKLAFQYLEDLKNEFERVYGNQIETAARPYAFIKFDTFIQKTKKLYQDTRTQRNIAKLNDELYEVHQIMTRNVQEVLGVGEKLDQVSQMSSRLTSESRIYAEKAKDLNRQALIKKWAPVAVVLGVVFLLFWVRNKFW

SEQ ID NO: 22340 - protein, 218 aa, Raphanus sativus
MVKMTLIARVTDGLPLAEGLDDGRDLPDSDMYKQQVKALFKNLSRGHNEASRMSVETGPYVFHYIIEGRVCYLTMCDRSYPKKLAFQYLEDLRNEFERVNGPNIETAARPYAFIKFDTFIQKTKKLYQDTRTQRNIFKLNDELYEVHQIMTRNVQEVLGVGEKLDQVSEMSSRLTFEFRIYADKAKDLNRQALIRKWAPVAIVLGVVFLLFWVKNKLW

SEQ ID NO: 22341 - protein, 218 aa, Solanum phureja
MVKLTLIARVTDGLPLAEGLDDGRDVQNADFYKQQVKALFKNLSMRQNDASRMSIETGPYVFHYIIEGHVCYLTMCDRSYPKKLAFQYLEDLRNEFERTNGSQIETAARPYAFIKFDTFIQKTKKLYQDTRTQRNISKLNDELYEVHQIMTRNVQEVLGVGEKLDQVSQMSSRLTSESRIYADKAKDLNRQALIRKWAPVAIVLGVVILFFWLRTKIW

SEQ ID NO: 22342 - protein, 218 aa, Euphorbia esula
MVKLTMIARVTDGLPLAEGLDDGRDLKDIELYKQQVKALFKNLATRQNEPSRMSIETGPFVFHYIIEGHVCYLTMCDRSYPKKLSFQYLEDLKNEFERVNGVQIETAARPYAFIKFDTFIQKTKKLYQDTRTQRNISKLNDELYEVHQIMTRNVQEVLGVGEKLDQVSEMSSRLTSESRIYADKARDLNRQAFIRKWAPVAIVLGVVFVLFWAKNKIW

SEQ ID NO: 22343 - protein, 219 aa, Cannabis sativa
MVKLTMIARVTDGLPLAEGLDDGRDITDVEFYKQQVKALFKNLSRGHNEPSRMSVETGPYIFHYITEGRVCYLTMCDRAYPKKLAYQYLEDLKNEFERVNGVGQIETAARPYAFIKFDTFIQKTKKLYQDTHTQRNISKLNDELYEVHQIMTRNVQEVLGVGEKLDQVSQMSSRLTSESRIYADKARDLNRQALIRKWAPVAIVLGVVFLLFWVKNKLW

SEQ ID NO: 22344 - protein, 219 aa, Distylium racemosum
MVKLTMIARVTDGLPLAEGLDDGREQRDLEFYKQQAKSLFKKLSQGQHEPSRMSIESGPYVFHYIIEARVCYLTMCDRSYPKKLAFQYLEDLKNEFEKVNHSQIETVARPYAFIKFDTFIQKTRKLYLDTQTQRNLAKLNDDLYEVQQIMTRNVQEVLGVGEKLDQVSQMSSRLSSESRIYADKAKDLSRQALIRKWAPVAIVLGVVFMLLWLRGYIWK

SEQ ID NO: 22345 - protein, 218 aa, Artemisia annua
MVKLTMIARVTDGLPLAEGMDDGRDMQDADFYKQQVKALFKNLSRGHNEASRMSVETGPYLFHYIIEGRVCYLTMCDRAYPKKLAFQYLEDLKNEFERGYADQIETAARPYAFIKFDTFIQRTKKLYQDTRTQRNVSKLNDELYEVHQIMTRNVQEVLGVGEKLDQVSKMSSRLTSESRIYADKARDLNRQALIRKYAPVAIVLAVVILLFWVRNKIW

SEQ ID NO: 22346 - protein, 213 aa, Brassica napus
LIARVTDGLPLAEGLDDGRDLPDSDMYKQQVKALFKNLSRGHNEASRMSVETGPYIFHYIIEGRVCYLTMCDRSYPKKLAFQYLEDLKNEFERVNGPNIETAARPYAFIKFDTFIQKTKKLYQDTRTQRNIAKLNDELYEVHQIMTRNVQEVLGVGEKLDQVSEMSSRLTSESRIYADKAKDLNRQALIRKWAPVAIVLGVVFLLFWVKNKLW

SEQ ID NO: 22347 - protein, 218 aa, Echinacea purpurea
MVKLTMIARVTDGLPLAEGLDDGRDMQDAEFYKQQVKALFKNLSRGQNEASRMSVESGPYVFHYIIEGRVCYLTMCDRAYPKKLAFQYLEDLKNEFERGYGNQIETAARPYAFIKFDTFIQRTKKLYQDTRTQRNISKLNDELYEVHQIMTRNVQEVLGVGEKLDQVSQMSSRLTSDTRVYADKARDLNRQALIKKWAPVAIVLGVVILLFWARKKIY

SEQ ID NO: 22348 - protein, 218 aa, Flaveria ramosissima
MVKLTMIARVTDGLPLAEGLDDGRDMQDAEFYKQQVKALFKNLSRGQNEASRMSVETGPYVFHYIIEGRVCYLTMCDRAYPKKLAFQYLEDLKNEFERGYGNQIETAARPYAFIKFDTFIQRTKKLYQDTRTQRNISKLNDELYEVHQIMTRNVQEVLGVGEKLDQVSQMSSRLTSESRIYADKARDLNRQALIKKWAPVAIVIGVVILLFWARKKIY

SEQ ID NO: 22349 - protein, 218 aa, Panax ginseng
MVKLTMIARVTDGLPLVEGLDDGRDVQNVEFYKQQVKALFKNLSRGHNEASRMSVETGPYIFHYVIEGRVCYLTMCDRAYPKKLAFQYLEDLANEFECVNGSQIETAARPYAFIKFDTFIQKTKKLYQDTRTQRNIAKLNDELYEVHQIMTRNVQEVLGVGEKLDQVSQMSSRLTSESRIYADKARDLNRQAFIRKWAPVAIVIGVVILLFWVRKKIW

SEQ ID NO: 22350 - protein, 218 aa, Panax ginseng
MVKLTMIARVTDGLPLVEGLDDGRDVQNVEFYKQQVKALFKNLSRGHNEASRMSVETGPYIFHYVIEGRVCYLTMCDRAYPKKLAFQYLEDLANEFERVNGSQIETAARPYAFIKFDTFIQKTKKLYQDTRTQRNISKLNDELYEVHQIMTRNVQEVLGVGEKLDQVSQMSSRLTSESRIYADKARDLNRQALIRKWAPVAIVIGVVILLFWARKKIW

SEQ ID NO: 22351 - protein, 218 aa, Ipomoea batatas
MVKLTMIARVIDGLPLVEGLDDGRDVPDADLYKQQVKSLFKNLARGQNEPSRMSIETGPYMFHYIIEGRVCYLTMCERSYPKKLAFQYLEDLKNELERVNGNQIETAARPYAFIKFDTFIQKTKKLYQDTRTQRNISKLNDELYEVHQIMTRNVQEVLGVGEKLDQVSQMSSRLTSESRVYADKAKDLNRQALIRKWAPVAVVLGVVFLLLWVRKKLW

SEQ ID NO: 22352 - protein, 219 aa, Humulus lupulus
MVKLTMIARVTDGLPLAEGLDDGRDIRDVEFYKQQVKALFKNLSRGHNEPSRMSVETGPYIFHYIIEGRVCYLTMCDRAYPKKLAYQYLEDLKNEFERVNGAGQIETAARPYAFIKFDAFIQKTKKLYQDTHTQRNISKLNDELYEVHQIMTRNVQEVLGVGEKLDQVSQMSSRLTSESRIYADKARDLNRQALIRKWAPVAIVLGVVFLLFWLKNKLW

SEQ ID NO: 22353 - protein, 218 aa, Amaranthus tuberculatus
MVKVTMLARVMDGLPLAEGLDDGRDVQDVEYYKQQIKALFKNLSKGQNDASRMSVESGPYVFNYIIEGNVCYLTMCDRAYPKKLAFQYLEDLKNEFERVNGNQIETAARPYAFIKFDTFIQRTKKLYQDTRTQRNIAKLNDELYEVHQIMTRNVQEVLGVGEKLDQVSQMSSRLTSESRIYADKARDLNRQALIRKWAPVAIVIGVVVLLFWVKKKIW

SEQ ID NO: 22354 - protein, 213 aa, Daucus carota
MIARVTDGLPLVEGLDDGRDVQNVDYYKQQVKALFKNLSRGHNEASRMSVETGPYIFHYIIEGRVCYLTMCDRAYPKKLAFQYLEDLANEFERVNGSQIETAARPYAFIKFDTFIQKTKKLYQDTRTQRNIAKLNDELYEVHQIMTRNVQEVLGVGEKLDQVSQMSSRLTSESRIYADKAKDLNRQALIRKWAPVAIVLGIVFLLFWVRKKIW

SEQ ID NO: 22355 - protein, 218 aa, Cirsium arvense
MVKLTMIARVTDGLPLAEGLDDGRDLQDAEFYKQQVKALFKNLSRGHNEASRMSVETGPFIFHYIIEGRVCYLTMCDRAYPKKLAFQYLEDLKNEFERGYANQIETAARPYAFIKFDTFIQRTKKLYQDTRTQRNIAKLNDELYEVHQVMTRNVQEVLGVGEKLDQVSQMSSRLTSESRIYAEKARDLNRQALIRKWAPVAIVLGVVILLFWVRKKIW

SEQ ID NO: 22356 - protein, 218 aa, Linum usitatissimum
MVKLTMIARVTDGLPLAEGLDDGRDVKDIELYKQQVKALFKNLAIRQNEPSRMSVETGPYVFHYIIEGRVCYLTMCDRAYPKKLAFQYLEDLKNEFERVNGAHIETAARPYAFIKFDTFIQRTKKLYQDTHTQRNIFKLNDELYEVHQIMTRNVQEVLGVGEKLDQVSEMSSRLTSESRVYADKARDLNRQALIRKWAPVAIVFGVVFLLFWVKTKIW

SEQ ID NO: 22357 - protein, 217 aa, Panax ginseng
MVKLTMIARVTDGLPLAEGLDNGRDPQDEFYKQQAKSIFKNLSKGHNEASRMSLETGPLVFHYIIEGRVCYLTLCDRSYPKKLAFQYLEDLKNEFERVNGSQIETAARPYAFIKFDTFIQKTKKLYSDTRTQRNIGKLNDELYEVQQIMTRNVQEVLGVGEKLEQVSELSNRLTSESRIYADKARDLNRQALIRKWAPVAIVLGVVSLLFWVKGKIW

SEQ ID NO: 22358 - protein, 218 aa, Lupinus angustifolius
MVKLTMIARVMDGLPLAEGLDDGRDIKDAEFYKQQVKALFKNLSRGHNEASRMSVETGPYIFHYIIEGRVCYLTMCDRAYPKKLAFQYLEELRNEFERVNGSQIETAARPYAFIKFDTFIHKTKKLYQDTHTQRNIAKLNDELYEVHQIMTRNVQEVLGVGEQLDQVSQMSNRLSSESRIYADKARDLNRQALIRKWAPVAIVLGVVFVLFWLKNRIW

SEQ ID NO: 22359 - protein, 218 aa, Papaver somniferum
MVKLTMIARVTDGLLLVEGLDDVRNLQDADVYKHQAKALFKNLSSGQNDASRMSIETGPFVFHYIIEGHVCYLTMCDRSYPKKLAFQYLEDLRNEFERVNGNQIETAARPYAFIKFDTFIQKTKKLYLDTSTQRNLAKLSDELFEVHQIMTRNVQEVLGVGEKLDQISQMSSHLTSESSIYADKARDLNRQALIRKWAPVAIVFGIVILLFWVKTKIW

SEQ ID NO: 22360 - protein, 218 aa, Arnica chamissonis
MVKLTMIARVIDGLPLAEGLDDGRDMQDAEFYKQQVKALFKNLSRGQNEASRMSVETGPYVFHYIIEGRVCYLTMCDRAYPKKLAFQYLEDLKNEFERGYGNQIETAARPYAFIKFDTFIQRTKKLYQDTRTQRNISKLNDELYEVHQIMTRNVQEVLGVGEKLDQVSQMSSRLTSESRIYADKARDLNRQALIKKWAPVAIVLGVVILLFWARKKIY

SEQ ID NO: 22361 - protein, 218 aa, Euonymus alatus
MVKMTMIARVTDGLLLVEGLDDGRDIQDSEMYKQQVKALFKNLSKGHNEASRMSIETGPYVFNYIIEGRVCYLTMCDRSYPKKLAFQYLEDLKNEFERVNGAQIETAARPYAFIKFDTFIQRTKKLYQDTHTQRNIAKLNDELFEVHQIMTRNVQEVLGVGEKLDQVSQMSSRLTSESRIYADKARDLNRQAFIRKWAPVAIVLGVVFLLFWVKTKLW

SEQ ID NO: 22362 - protein, 218 aa, Lotus japonicus
MVKLTMIARVTDGLPLAEGLDDGRDMKDSEYYKQQVKALFKNLSRGHNEASRMSVESGPYFFHYIIEGRVCYLTMCDRAYPKKLAFQYLEELRNEFERVNGSQIETAARPYAFIKFDTFIQKTKKLYQDTHTQRNISKLNDELYEVHQIMTRNVQEVLGVGEQLDQVSQMSSHLSSESRIYADKARDLNRQALIRKWAPVAIVLGVVFVLFWLKNKIW

SEQ ID NO: 22363 - protein, 215 aa, Orobanche aegyptiaca
MVKLTMIARVTDGLPLAEGLDDGRDVPDSDFYKHQVKSLFKNLSRGQNEPSRMSVETGPYVFYYIIEGRVCYLTMCDRAYPKKLAFQYLEDLKNEFERAYGNQIETAARPYAFIKFDTFIQRTKKLYQDTRTQRNIAKLNDELYEVHQIMTRNVQEVLGVGEKLDQVSEMSSRLTSESRIYADKAKDLNRQALIRKWAPVAVVLGVVFLLLWVKN

SEQ ID NO: 22364 - protein, 218 aa, Plantago ovata
MVKLTMIARVTDGLPLAEGLDDGRDVPDSDFYKQQVKSLFKNLSRGHNEASRMSIETGSYIFHYIIEGRVCYLTMCDRAYPKKLAFQYLEDLKNEFERTYGNQIETAARPYAFIKFDTFILKTKKLYQDTRAQRNIDKLNDELYEVHQIMTRNVQEVLGVGEKLDQVSQMSSRLTSESRIYADKAKDLNRQALIRKWAPVAVVLGVVFFLLWVRKKLW

SEQ ID NO: 22365 - protein, 219 aa, Podocarpus macrophillus
MVKLTMIARVTDGLPLAEGLDDGREQRDMEFYKQQAKSLFKKLSQGQHEPSRMSIESGPYVFHYIIEARVCYLTMCDRAYPKKLAFQYLEDLKNEFEKVNHSQIETVARPYAFIKFDTFIQKTRKLYLDTQTQRNLAKLNDDLYEVQQIMTRNVQEVLGVGEKLDQVSQMSSRLSSESRIYADKAKDLNRQAFIRKWAPVAIVLGVVFVLLWLRGYIWK

SEQ ID NO: 22366 - protein, 215 aa, Rosa hybrid cultivar
MVKLTMIARVTDGLPLAEGLDDGRDIKDSEFYKQQVKALFKNLSRGQNEPSRMSVESGPYIFHYIIEGRVCYLTMCDRAYPKKLAFQYLEDLRNEFERVNGAQIETAARPYAFIKFDTFIQKTKKLYQDTRTQRNISKLNDELYEVHQIMTRNVQEVLGVGEKLDQVSQMSSRLTSETRAYADKARDLNRQALIRKWAPVAIVLGVVFLVSGSKR

SEQ ID NO: 22367 - protein, 219 aa, Sciadopitys verticillata
MVKLTMIARVTDGLPLAEGLDDGREQRDLEFYKQQAKSLFKKLSQGQHEPSRMSIESGPYVFHYIIEARVCYLTMCDRSYPKKLAFQYLEDLKNEFEKVNYSQIETVARPYAFIKFDTFIQKTRKLYLDTQTQRNLAKLNDDLYEVQQIMTRNVQEVLGVGEKLDQVIQMSSRLSSESRIYADKAKDLSRQALIRKWAPVAIVLGVVFVLLWLRGYIWK

SEQ ID NO: 22368 - protein, 219 aa, Taxus baccata
MVKLTMIARVTDGLPLAEGLDDGREQRDLEFYKQQAKSLFKKLSQGQHEPSRMSIESGPYIFHYIIEARVCYLTMCDRSYPKKLAFQYLEDLKNEFEKVNHSQIETVARPYAFIKFDTFIQKTRKLYLDTQTQRNLAKLNDDLYEVQQIMTRNVQEVLGVGEKLDQVSQMSSRLSSESRIYAEKAKDLSRQALIRKWAPVAIVLGVVFVLLWLRGYIWK

SEQ ID NO: 22369 - protein, 218 aa, Tragopogon dubius
MVKLTMIARVTDGLPLAEGLDDGRDMQDAEFYKQQVKALFKNLSRGQNEASRMSIETGPYVFHYIIEGRVCYLTMCDRAYPKKLAFQYLEDLKNEFERGYEHQIETAARPYAFIKFDTFIQRTKKLYQDTRTQRNISKLNDELYEVHQIMTRNVQEVLGVGEKLDQVSQMSSHLTSESSKYANKARDLNRQALIKKWAPVAIVLGVVILLFWARNKIW

SEQ ID NO: 22370 - protein, 218 aa, Trigonella foenum-graecum
MVKLTMIARVTDGLPLAEGLDDGRDIKDGELYKQQVKSLFKNLSRGHNEASRMSVESGPYVFHYIIEGRVCYLTMCDRAYPKKLAFQYLEELRNEFERTNGSQIETAARPYAFIKFDTFIQKTKKLYQDTHTQRNIAKLNDELYEVHQIMTRNVQEVLGVGEQLDQVSQLSSRLSSESRIYADKARDLNRQALIRKWAPVAIVFGVVFVLFWLKNKIW

SEQ ID NO: 22371 - protein, 218 aa, Vinca minor
MVKLTLIARVTDGLPLVEGLDDGRDLPDADFYKKQAKALFANLPRGLNDPSRMSIETGSYMFHYIIEGHACYLTLCDRAYPKKLAFQYLEDLKNEFERVNGSQVDTAARPYAFIKFDAFIQKTKKLYQDTKTQRNIAKLNDELYEVHQIMTRNVQEVLGVGEKLDQVSQMSSRLTSESRIYADKAKDLNRQAFIRKWAPVAIVLGVVMLLFWVKNKIW

SEQ ID NO: 22372 - protein, 218 aa, Conyza canadensis
MVKLTMIARVTDGLPLAEGLDDGRDMPDAEFYKQQVKALFKNLSRGHNEASRMSVETGPYVFHYVIEGRVCYLTMCDRAYPKKLAFQYLEDLVNEFERGYGNQIETAARPYAFIKFDTFIQRTKKLYQDTRTQRNITKLNDELYEVHQIMTRNVQEVLGVGEKLDQVSQMSSRLTSESRVYADKAKDLNRQALIKKWAPVAIVLGVVILLFWARKKIY

SEQ ID NO: 22373 - protein, 218 aa, Cycas rumphii
MVKLTMIARVIDGLPLAEGLDDGREQRDLEFYKQQAKSLFKKLAQGQHQPSRMSIESGPYVFHYIIEAGVCYLTMCDRSYPKKLAFQYLEDLKNEFEKVNRSQIETVARPYAFIKFDTFIQKTRKLYLDTQTQRNLAKLNDDLYEVQQIMTRNVQEVLGVGEKLDQVSQMSSRLSSESRIYADKAKDLNRQALIKKWAPVAIVLGVVLVLLWMRRYIW

SEQ ID NO: 22374 - protein, 218 aa, Medicago truncatula
MVKLTMIARVTDGLPLAEGMDDARDLKDGELYKQQVKSLFKNLSRGHNEASRMSVESGPYVFHYIIEGRVCYLTMCDRAYPKKLAFQYLEELRNEFERVNGSQIETAARPYAFIKFDAFIQKTKKLYQDTQTQRNIAKLNDELYEVHQIMTRNVQEVLGVGEQLDQVSQLSSRLSSESRIYADKARDLNRQALIRKWAPVAIVFGVVFVLFWLKNKIW

SEQ ID NO: 22375 - protein, 218 aa, Ambrosia trifida
MVKLTMIARVIDGLPLAEGLDDGRDMQDAEFYKQQVKALFKNLSRGHNDASRMSLESGPYVFHYIIEGRVCYLTMCDRAYPKKLAFQYLEDLKNEFERGYGNQIETAARPYAFIKFDTFIQKTKKLYQDTRTQRNISKLNDELYEVHQIMTRNVQEVLGVGEKLDQVSQMSSRLTSESRIYADKARDLNRQALIKKRAPVAIVLGVVILLFWARKKIY

SEQ ID NO: 22376 - protein, 203 aa, Catharanthus roseus
MVKLTMIARVTDGLPLVEGLDDGRDMPDADFYKKQAKALFTNLSRGQNDASRMSIETGPYIFHYIIEGRVCYLTMCDRAYPKKLAFQYLEDLKNEFERLNGSQIETAARPYAFIKFDTFIQKTKKLYQDTRTQRNIAKLNDELYEVHQIMTRNVQEVLGVGEKLDQVSQMSSRLTSESRIYAGKAKDLNRQALIRKWAPVAIV

SEQ ID NO: 22377 - protein, 218 aa, Cicer arietinum
MVKLTLIARVTDGLPLAEGLDDGRDLKDAEFYKQQVKALFKNLSRGHNDASRMSVETGPYVFHYIIEGRVCYLTMCDRAYPKKLAFQYLEELRNEFERANGSQIETAARPYAFVKFDTFIQKTKKLYQDTHTQRNIAKLNDELYEVHQIMTRNVQEVLGVGEQLDQVSQMSSHLSLESHKYANKARDLNRQALIRKWAPVAIVFGVVFVLFWLKNKIW

SEQ ID NO: 22378 - protein, 215 aa, Raphanus sativus
EDDMIARVLTVALAEGLDDGRDLPDSDMYKQQVKSLFKNLSRGHNEASRMSVETGPYVFHYIIEGRVCYLTMCDRSYPKKLAFQYLEDLKNEFERVNGPNIETAARPYAFIKFDTFIQKTKKLYQDTRTQRNIAKLNDELYEVHQIMTRNVQEVLGVGEKLDQVSEMSSRLTSESRIYADKAKDLNRQALIRKWAPVAIVLGVVFLLFWVKNKLW

SEQ ID NO: 22379 - protein, 218 aa, Helianthus annuus
MVKLTMIARVTDGLPLAEGLDDGRDVQDAEFYKQQVKALFKNLSRGHNDASRMSVETGPYVFHYIIEGRVCYLTMCDRAYPKKLAFQYLEDLKNEFERGYGNQIETAARPYAFIKFDTFIQRTKKLYQDTRTQRNITKLNDELYEVHQIMTRNVQEVLGVGEKLDQVSQMSSRLTSESRVYADKARDLNRQAFIKKWAPVAIVLGVVILLFWARKKIY

SEQ ID NO: 22380 - protein, 219 aa, Pinus pinaster
MVKLTMIARVTDGLPLAEGLDDGREQRDLEFYKQQAKSLFKKLSHGQHEPSRMSIETGPYIFHYIIEARVCYLTMCDRSYPKKLAFQYLEELKNEFEKLYQSQVETVARPYAFIKFDTFIQKTRKLYLDTRTQRNLAKLNDDLYEVQQIMTRNVQEVLGVGEKLDQVSQMSSRLSSESRKYADKAKDLSRQAFIKKWAPVAIVLGVVIVLLWMRSYIWQ

SEQ ID NO: 22381 - protein, 219 aa, Pinus taeda
MVKLTMIARVTDGLPLAEGLDDGREQRDVEFYKQQAKSLFKKLSQGQSEPSRMSIESGPYVFHYIIESRVCYLTMCDRSYPKKLAFQYLEDLKNEFEKVNHSQIETVARPYAFIKFDTFIQKTRKLYLDTHTQRNLAKLNDDLYEVQQIMTRNVKEVLGVGEKLDQVSEMSSRLSSESRIYADKAKDLSRQALIKKWAPVAIVLGVVSVLLFMRGYIWQ

SEQ ID NO: 22382 - protein, 219 aa, Pinus taeda
MVKLTMIARVTDGLPLAEGLDDGREQRDLEFYKQQAKALFKKLSHGQHEPSRMSIETGPYIFHYIIEARVCYLTMCDRSYPKKLAFQYLEELKNEFEKLYQSQVETVARPYAFIKFDTFIQKTRKLYLDTRTQRNLAKLNDDLYEVQQIMTRNVQEVLGVGEKLDQVSQMSSRLSSESRKYADKAKDLSRQAFIKKWAPVAIVLGVVFVLLWMRWYIWQ

SEQ ID NO: 22383 - protein, 219 aa, Pteridium aquilinum
MVKLTMIARVTDGLPLAEGLDDGRGEKDLEYYKQQAKTLFKKLSQSQHEPSRMSIETGPNTFHYIIEGGVCYLTMCDRSYPKKLAFQYLEDLQREFEKVNRSQIETVARPYAFIKFDTFIQKTRKLYLDTRTQRNLAKLNDDLYEVQQIMTRNIQEVLGVGEKLDQVSQMSNRLTSESRIYAEKAKDLSRQALIRKWAPVAIVIGVVLLLLWARRSFYQ

SEQ ID NO: 22384 - protein, 218 aa, Ambrosia trifida
MVKLTMIARVIDGLPLAEGLDDGRDMQDAEFYKHQVKALFKNLSRGHNDASRMSLESGPYVFHYIIEGRVCYLTMCDRAYPKKLAFQYLEDLKNEFERGYGNQIETAARPYAFIKFDTFIQKTKKLYQDTRTQRNITKLNDELYEVHQIMTRNVQEVLGVGEKLDQVSQMSSRLTSESRIYADKARDLNRQALIKKWAPVAIVLGVVILLFWARKKIY

SEQ ID NO: 22385 - protein, 218 aa, Pseudotsuga menziesii
MVKLTMIARVTDGLPLAEGLDDGREQGDLDFYKQQAKSLFKKLSQGQHEPSRMSIETDPYVFHYIIEARVCYLTMCDRSYPKKLAFQYLEELKNEFEKLYQSQVETVARPYAFIKFDTFIQKTRKLYLDTRTQRNLAKLNDDLYEVQQIMTRNVQEVLGVGEKLDQVSQMSSRLSSESRKYADKAKDLSRQAFIKKWAPVAIVLGVVFVFLWMRMYIW

SEQ ID NO: 22386 - protein, 218 aa, Picea glauca
MVKLTMIARVTDGLPLAEGLDDGREQKDLEFYKQQAKSLFKKLSQGQHEPSRMSYETGPFVFHYIIEARVCYLTMCDRSYPKKLAFQYLEELKNEFEKLYQSQVETVARPYAFIKFDTFIQKTRKLYLDTRTQRNLAKLNDDLYEVQQIMTRNVQEVLGVGEKLDQVSQMSSRLSSESRKYADKAKDLSRQAFIKKWAPVAIVLGVVFVLLWMRRYIW

SEQ ID NO: 22387 - protein, 219 aa, Pinus pinaster
MVKLTMIARVTDGLPLAEGLDDGREQRDLEFYKQQAKSLFKKLSQGQSEPSRMSIESGPYVFHYIIESRVCYLTMCDRSYPKKLAFQYLEDLKNEFEKVNHSQIETVARPYAFIKFDTFIQKTRKLYLDTHTQRNLAKLNDDLYEVQQIMTRNVKEVLGVGEKLDQVSEMSSRLSSESRIYAHKAKDLSRQALIKKWAPVAIVLGVVSVLLFMRGYIWQ

SEQ ID NO: 22388 - protein, 218 aa, Abies balsamea
MVKLTMIARVTDGLPLAEGLDDGREQRDLEYYKQQAKLLFKKLSQAQHEPSRMSIETGPYVFHYIIEARVCYLTMCERSYPKKLAFQYLEELKNEFEKMYQSQVETVARPYAFIKFDTFIQKTRKLYLDTRTQRNLAKLNDDLYEVQQIMTRNVQEVLGVGEKLDQVSQMSSRLSSESRKYADKAKDLSRQAFIKKWAPVAIVLGVVFVLLWMRRYIW

SEQ ID NO: 22389 - protein, 218 aa, Ambrosia trifida
MVKLTMIARVIDGLPLAEGLDDGRDMQDAEFYKHQVKALFKNLSRGHNDASRMSLESGPYVFHYIIEGRVCYLTMCDRAYPKKLAFQYLEDLKNEFERGYGNQIETAARPYAFIKFDTFIQKTKKLYQDTRTQRNITKLNDELYEVHQIMTRNVQEVLGVGEKLDQVSQMSSRLTSESRIYADKARDLNRQALIKKWAPVVIVLGVVILLFWARKKIY

SEQ ID NO: 22390 - protein, 219 aa, Pseudotsuga menziesii
MVKLTMIARVTDGLPLAEGLDDGREQRDLEFYKQQAKSLFKKLSQGQNEPSRMSIESGPFVFHYIIESRVCYLTMCDRSYPKKLAFQYLEDLKNEFEKANHSQIETVARPYAFIKFDTFIQKTRKLYLDTHTQRNLAKLNDDLYEVQQIMTRNVKEVLGVGEKLDQVSQMSSRLSSESRIYAHKAKDLSRQALIKKWAPVAIVLGVVLVMLLMRSYIWQ

SEQ ID NO: 22391 - protein, 218 aa, Chrysanthemum coronarium
MVNLTMIARVTDGLPLAEGLTDGRDMQDVDFYKKQVKALFKNLSRGHNGASRMSVETGPYLFHYIIEGRVCYLTMCDRAYPKKLAFQYLEDLTNEFERGYADQIETVARPYAFIKFDTFIQRTKKLYQDTRTQRNISKLNDELYEVHQIMTRNVQEVLGVGEQLDQVSRMSSRLTSESRIYADKAKDLNRQALIRKYAPVGIVLTVVILLFWVRNKIW

SEQ ID NO: 22392 - protein, 1522 aa, Brachypodium distachyon
MATPAPAPASRRIAGTEVPITGSDKIRWIDLTVPSSSSAPESATDPFVSVPPRAASGCHIVYPGSDSQRYLAWRIHEEHQNVLEVIELCASKEFPSSGLRLIFEEELCPFAFICESEGARRDKSVYLLYVVTVSGVAFLCNLHSPFSYVSGSILAQNDIVEFSLQTLTQSAKVTAVKAKPGCLVIGRQDGSICCYSLGKVAPCSPGFSNELRDDAGIGRLWTLMSRTKAVGPVQDIETAIVNERELLFVLHLDGSLRVWDIFSHTKVLNYNVQSNGFEGQPSRLWVGEADDDQELITLAVLHQGTVVPACDRVAVYGFSFGAGEKFLLSPEPSVFDVPLLEGKLVDLKISTEKLWILKEVGPMLYEIVQYDTDTGEMCSYVLQEDAISEQMFQSSESALDDLVWTADSIFSSTKEHSFSFISSMFLRRLLQPGVNHWCALRETLLEYKRFLSDSEFQSLTTSGLGKEILSIIEQEESSQTASSTAYHWKKFSARYLHNWCRNNRPYGLLLDTNGEVFGLIRKGSFSLFRCLERVEQLIYGFSDELGNLNGLELTILSEKSETEILIEVLTCMGHIHHLLGRSSAAIYHESLISSVISLDEIASQILKILETGFSPQSSSALIALLGTDAYVERRQIAHKSQRKFSVEMLLSFQKLQSRSISWPAVFDVIERFMKYLNTELTRQECESKRVCNINSMLLVQATSQVARTMFESAFDLFLFLRYLVGVGGQVSLLQSDAARIKLKLLPMIQDILGQWIVLHFIGISPTMPPTIEDFSYQLSSLQLGIADELSLHRKLGSSDFTLACLLDFPKSAEGDALSPCFPTPAEVINLVRRFSSSIMCRSNVEHVDGFLDTSWVHSFLGSTINLAALFVRHGQYGAAENLLGILETYWNNGRASQTDKDTDIASLARLHLNGFCLLMLAHDEANIVLKESKVHEAIRCFFRAASGQEAPKALKKFSSETGFQFSGECRSISLWRLHYYEWAMQIFEQHSMSEGACQFALAALEQVDSIFYLNNGSDAEDLPETAAMIKGRLWANVFKYSLDLKKFHDAYCAIISNTDEDSKYVCLRRFIIVLCELGETKVICSGEIPFTGLVEKVEQELFWKAERSDLSSKPNLYKVLYSFEAYRNNWRKAAAYMYRYFVRLSREGNAGGTLQLSHVLQERLHALAAAINSLQLVDPSSAWLDSVCEADDQISPSKKPRNLLMENSAFGTDSERSRLQFCVDIEILEKEYTLTEALYMLSTVNSRSNFSESYSIETLTDILINENLYDLAFTIVLKFWKDSGMKRELERVFAAIAQQCCPNKVGNSGRDLTGSQQLLLLPSSQDDAWDDNNKSIAVAHQVRGSCQWETLEIYLDKYTDLHPRLPVIVAETLLYTDPEIELPLWLVQMFKTSKGGNRMISWGMSGKEADPAALFRLYINYGRHTEATNLLVQYLDSFASSRPVDVLHRKKMSAAWFPYTTIERFWSQLEEMQSAGHSVDQCDKLKKLLHGALMNHLQQVVVDSEDVLSSVGGGQGTESQSS

SEQ ID NO: 22393 - protein, 1502 aa, Setaria italica
MAAPATRRIVGAEVPIPGSDKLRWIDLTVPSSSPAPAGSADPFVCVPPRAASGCHIIPLGDSQCYLSWRIHEEHLNVLEVIELGASKEFPSSGLRLVFQEALCPFAFLCEREGHRRGELVYMLYALTVSGVAILCHLRSPFSYVSGSVLHQDDIVEFSLQTHAQSAKVTAVTAKPGCIVIGRQDGSICSYSLGKLAPNSPGFLNELRDDAGIGRLWTLMSRTRTVGPVQDIVVTVVNERDLLFVLHLDGHLRIWDNHTKLLNYNVCSNDIEGHPSRLWVGEADDDQEMISLAVLHQNTVVQDCDHVALYGFSFSTGEKFPFSPEPSISTVPLLEGKLVDLKIGKDKLWILKEFGSMLYEILQYDTKAEKICSYVLQEDAISEQLFQSSDNALDDLVWTADSVFSSLKEQAFTFISSMFLRRLLQPGVNHCSALRETLLEHKRFLSDSEFQSLTANGLRKEILSIIEQEVSSQTASATAYHWKKFCARYLHNWCWNNRPYGLLLDTNKEVFGLIRKGSFSLFRCLEGVEMLIYGSSDELRNIDDLGMNLMDADIELLNEVLRCMGHIHHLLGRSSTAIYYESLISSVISSDEIASQIVKILETGFSPQSSSSLVTLLGTDAYVERRQAAHKSQRKFSVDMLLSFHKLRSRSASWSVVFDVIEKFMKCLNTNINVQDYESKRVCNVNSVLLVQATSQVARTMFESAFDLFLFLSYLVGVGGQVSLLQSDVARIKLKLFPMIQDILGQWIVLHFVGISPTSPPTIEDFSYQLSSLQLGKVDELSLHRKLGCSDFTLACLLDFPISPRVGVMSHCFPSPVEVINLVRSFSSLIMGGGNFDCVQTFLGSTINLSAVLIRHGQYEAAQNLLGILETYLNNEKVSRTGQDADTACSAYLHLNGFCLLMLAHDEANTVLRESKVHDAIRCFFRAASGHEASKALQKFSLETGFQVSGECRSISLWRLHYYEWAMQIFEQHSMSEGACQFALAALEQVDNIVDLDNGTEAESLPETAAMIKGRLWANVFKYSLDLKNFQDAYCAIISNPDDDSKYICLRRFIIVLCELGETKVLCNGEIPFTGLVEKVEQELFWKAERSDLSSRPNLYKVLYSFEAYRNNWRKAAGYMYRYFVRLNREGNAGGSCQLPHVLQERLHALSAAINALQLVDPSFAWLDSVCEADDQISPSKRPRNLLMENLAFGTDSELSRLQFCVDIEILEKEYTLTKAQFMLSTVKSTFNFSESQSIESLMDILINEKLYDLAFTIVLKFWKDSGMKRELERVFSAIAQQCCPNRSDKSGRNLTDSKQLLVLPSSEDDAWDGNIKSIAVTQQLQGNCHWDTLELFMKKYNDLHPRLPVVVAETLLYTDPEIELPLWLVQMFKTNKAGNRIWGMSGKEADPAALFRLYINYGRHAEATNLLVEYLELFASSRPADVLHRKKMSAAWFPYTAVERLWCHLGEMQRAGHSVDQCDRLKKLLHGALMSHLQQVVVDSEDVLSSVGGGQGMEGQSN

SEQ ID NO: 22394 - protein, 1504 aa, Oryza sativa
MATTTPAARKIAGTEVPIPGSDRVRWIELTVPSTPSPSPEGDSDPFVLVPPRAASGFHVVSSGDSQCYLAWRFHEEQQNVLEVIDLCAFKEFPSSGLRLVFQEELCPFSFLCAREGGRRGTPVYLLYVLTVSGVALLCHLRSPFSYISGSIFPQDDIVEFNLQTQVQSAKVTAVTAMSGCLVIGRQDGSICCYSLGKLALNSPGFLNELRDDAGIGRLWSLVSRTKAVGPVQDIVTATVNERELLFVLHLDGSLRIWDIFNHTKLLSYNVRSNDIEGQPSRIWVGDADDDQELIFLAVLRQGTVTGACDCVSVYGFSFGAGERFLFSPEPSFFSIPLVEGKLIDLKISMDKLWILKEVGSMLYEIVQYDCDTEIMHSYVLQEVSVSDQLFQSSENTLDDLVWTADSIFSSKKEQTFGFISSMFLRRLLQPGVNHSSALRETLLEHKRFLSDSYFQSLTTSGLRKEILSTIEQEGSSQTASSTAYHWKKFSARYLHNWCWNNRPYGLLLDTNREVFGLIRKGSFSLFRCLEGMEQFIYGSSDDLRNLDILGVNPSDNISQSEILIEVLRCMDHISHLLGRSAAAIYHESLISSVISPDEIVSQILKILGTGFSPQSPSALITLFGTDAYAERRQTAHKSQRKFSVEMLLSFRKLQSKSTSWSAVFDVIENFMKYLNTNVTIQEYELKRVCNVNTALLVQATSQVARTMFESTFDLYLFLNYLVSIGGQVSLSQNDIARIKLKLFPVIQDILGQWIVLHFVGISPTTPPTIEDFSYQLSSLQLGKADDLSLHRKFGCSYFTLACLLDFPKSADGDVLSPWFPNPTELVNLVRRFSGSIMSENIAGNADCFLSSTINLAAVLVRHGQYEAAQSLLGILDTHMNYVKASQADQDTDLARSSCLHLNGFCLLVLARDEANIVLKESKVHEAIRCFFRAASGQEAPKALQKFSVETGFQISGECRSFTAWRLRYYEWAMQIFEQHSMSEGACEFALGALEQIDSIVDLDNGSEAEDIPETTTMIKGRLWANVFKYKLDLKNFQEAYCAIISNPDNDSKYVCLRRFIIVLCELGETKVICNGEIPFTGLVEKVEQELFWKAERSDLLSRPNLYKVLYSFEAYRNNWRKAAAHMYRYFVRLSREGNAGGTRQLSHTLQERLHALSAAINALQLVDPSFAWLDSVCEADDQISPSKKPCNLLMKNSAFGTDSELSRLKFCVDIEILEKEYTLTEALYMLSTVNSRFNFSDNQSIEALTDILINENMYDMVFTIVLKFRKESGMKRELERVFAAIAQQCCPNRVGNSGKNLLLPSSDDDACDGNGNSIAMAHQSQGSCHWETLEIYLEKYKDLHPRLPVIVAETLLYTDPEIELPLWLVQMFKTTKAGNRMISWGMSGTEADPATLFRLYINYGRHTEAANLLVEYLESFTSSRPVDVLHRKKMSAAWFPYTAIERLWCQLEEMQNAGHSVDQCDRLKKLLHGSLISHLQQVVVDSDDVLSSLGGGKGMGSQSN

SEQ ID NO: 22395 - protein, 271 aa, Panicum virgatum
MVADTESSDSLPGSSNAAVEMPIHGSLDQRSQEKTPKKTHKAEREKLKRDQLNELFLELGSMLDLDRQNTGKATVVGDAARVLRDLVTQVESLRKEQSALLLERQYVSLEKSELQEENATLKSQISELANKLCARMGNSSLGMLHRVANTRSPDLATHPLPHQMWSNIPNISSVAMAHQMNTASPLHSQHHSANNAEVYALRPQELQLFPGASSSPERECSHPRSAGATSSSLTDSLPSQLCLSLTQSSQEERTSDVLVDTERTTKQLADC

SEQ ID NO: 22396 - protein, 268 aa, Sorghum bicolor
MLPYPNPHHFGVSQEPPHPNPTSFPMLPPGAHLDQQHYVDHHFFPGHGHFNSETLEAVLRPTRAAPECEAAVAAAAQQGGRRNGVPAGGGQGQGHARARKRPFRTDRHSKIRTAQGVRDRRMRLSLDVARDFFALQDRLGFDKASKTVDWLLTQSKPAIERLAATDLSQRSVGGGSDDAALSPPTSGAAADGPGKRGGVAEKLSSRSGGSASMEMEHTCDLDRLVSAAPVLREYYYGLSEMMSNDNGGDGDDDGEYEEDGDFLDGMQY

SEQ ID NO: 22397 - protein, 280 aa, Zea mays
MLPYPNPHHHFGVSQEPPHPNPTTGFPMLPRGAHLDQRYVDHHFFPGHGHTNSETLEAVLRPTRAAPECEAAVVTAPPQGGSGRRNGAVPAAGGQGQGHAHAHARAPRKRPFRTDRHSKIRTAQGVRDRRMRLSLDVARDFFALQDRLGFDKASKTVDWLLTQSKPAIERLAATTEPSQRSVGGSDDAALSPPTSGVADGSGMRGGVAEKLGSRSGGSAASMEMEMEHASELDRLVSAAPVLRQYYYGLSEMMSNDNGGDGDDDGEYEEEDGDFLDGMKY

SEQ ID NO: 22398 - protein, 469 aa, Glycine max
MAATRPVQCLLRRVCRGSRSFGVATEVNASSSSSSQKIIDKEYEHSAHNYHPLPIVFSQAKGTSVWDPEGNKYLDFLSGYSAVNQGHCHPKILKALQEQAQRLTVSSRAFYNDRFPVFAEYVTNMFGYDMVLPMNTGAEGVETALKLARKWGYEKKRIPKDEAIIVSCCGCFHGRTLGVISLSCDNEATRGFGPLLPGNLKVDFGDAEALERIFKEKGEHIAAFILEPIQGEAGVIFPPDGYLKAVRDICSKYNVLMIADEIQTGLARTGKMLACEWEEVRPDIVILGKALGGGVIPVSAVLADKDVMLCIQPGQHGSTFGGNPLASAVAIASLEVIKNERLVERSAQMGEELAGQLLKIQQQYPDYVKEVRGRGLFIGVEFNSKNLFPVSGYELCKKLKYRGVLAKPTHDTIIRFTPPLCISLDEIQQGSKVLADVLEIDLPKLQKTKPKDAAPVASSACDRCGRVLY

SEQ ID NO: 22399 - protein, 472 aa, Cajanus cajan
MATTRPVQCLLRRVFRGSRSFGVATEVNASSSSSSSSQRIIDKEHEHSAHNYHPLPIVFSQAKGTSVWDPEGNKYLDFLSGYSAVNQGHCHPKILKALQEQVERLTVSSRAFYNDQFPLFAEYVTTMFGYDMVLPMNTGAEGVETAMKLARKWGYEKKRIPKDEAIIVSCCGCFHGRTLGVISMSCDNEATRGFGPLFPGHLKVDFGDAEALERIFKEKGEHIAGFILEPMQGEAGIIIPPDGYLKAVRDLCSKYNILMIADEIQTGLARTGKMLACEWEDVRPDVVILGKALGGGVIPVSAVLADKDVMLCIKPGQHGSTFGGNPLASAVAIASLEVIKDERLVERSAQMGGELIGQMLKIQQQYPNYVKEVRGRGLFVGVEFNSKSLFPVSGYELTKKLKNRGVLTKPTHDTTIRFTPPLCISGDEIQQGSKALAEVLEIDLPKLQKEKPKDAAPVASSACDRCGRVLYG

SEQ ID NO: 22400 - protein, 469 aa, Phaseolus vulgaris
MAAKTQVQCLLRRVFRGSRSFGVSAEVNASSSSSQRIMDKEYEHSAHNYHPLPIVFSKAKGTSVWDPEGNKYLDFLAGYSAVNQGHCHPKILKALQEQAERLTVSSRAFYNDRFPLFAEYVTTLFGYDMVLPMNTGAEGVETAMKLARKWGYEKKRIPKDEAIIVSCCGCFNGRTLGVISMSCDNEAIRGFGPLLPGHLKVDFGDADALERIFKEKGERIAAFILEPIQGEAGVIIPPDGYLKAVRDLCSKYNILMIADEIQTGLGRTGKMLACEWEEVRPDVVVLGKALGGGVIPVSAVLADKDVMLCIQPGQHGSTFGGNPLASAVAIASLEVIKNEKLVERSVQMGEKLIGQLLEIQEQYPDYVKEVRGRGLFIGVELNRKKLFPVSVYELSTKLKERAVLAKPTHDTIIRFTPPLCISEDEIKQGSKAWADVLGIDLPKLQKAKPIETAPVSDSACDRCGRVMYD

SEQ ID NO: 22401 - protein, 469 aa, Trifolium pratense
MASTRQVHCLMRRFYRGSRTFAVATQPTASSSSQTIIDKEFQHSAHNYHPLPIVFAHAKGSAVWDPEGNKYIDFLSGYSAVNQGHCHPKILKALKDQAERLTVSSRAFYNDRFPVFAEYLTALFGYDMVLPMNTGAEGVETALKLARKWGYEKKKIPNDEALIVSCCGCFNGRTLGVISMSCDNEATRGFGPLMPGHLKVDFGDAEALEKIFKEKGDHIAAFILEPIQGEAGVKIPPDGYLKAVRDLCSKYNVLMIADEIQTGLARTGKMLACEWEDVRPDVVILGKALGGGIIPVSAVLADKDVMLCIKPGQHGSTFGGNPLASAVAIASLEVIKEERLTERSVKMGGELLGLLHKIQKQYPDHVKEVRGRGLFIGVELNSESLSPVSGFELSEKLKERGVLAKSTHDTIIRFTPPLCISADEIQQGSKALADVLEIDLPMLKKMKPKDAAPLAGPSACDRCGRVVYG

SEQ ID NO: 22402 - protein, 470 aa, Trifolium pratense
MASSTRQVQCLMRRFCRGSRTFAVATQPTSSSSSQTIIDKEFQHSAHNYHPLPIVFAHAKGSAVWDPEGNKYIDFLSGYSAVNQGHCHPKILKALKDQAERLTVSSRAFYNDRFPVFAEYLTALFGYDMVLPMNTGAEGVETALKLARKWGYEKKKIPNDEALIVSCCGCFNGRTLGVISMSCDNEATRGFGPLMPGHLKVDFGDAEAVEKIFKEKGDHIAAFILEPIQGEAGVKIPPDGYLKAVRDLCSKYNVLMIADEIQTGLARTGKMLACEWEDVRPDVVILGKALGGGIIPVSAVLADKDVMLCIKPGQHGSTFGGNPLASAVAIASLEVIKEERLTERSVKRGGELLGLLHKIQKQYPDHVKEVRGRGLFIGVELNSQNLSPVSGFELSEKLKERGVLAKSTHDTIIRFTPPLCISADEIQQGSKALADVLEIDLPMLKKMKPKDAAPLAGPSACDRCGRVVYG

SEQ ID NO: 22403 - protein, 470 aa, Trifolium pratense
MASSTRQVQCLMRRFCRGSRTFAVATQPTSSSSSQTIIDKEFQHSAHNYHPLPIVFAHAKGSAVWDPEGNKYIDFLSGYSAVNQGHCHPKILKALKDQAERLTVSSRAFYNDRFPVFAEYLTALFGYDMVLPMNTGAEGVETALKLARKWGYEKKKIPNDEALIVSCCGCFNGRTLGVISMSCDNEATRGFGPLMPGHLKVDFGDAEAIEKIFKEKGDRIAAFILEPIQGEAGVKIPPDGYLKAVRDLCSKYNVLMIADEIQTGLARTGKMLACEWEDVRPDVVILGKALGGGIIPVSAVLADKDVMLCIKPGQHGSTFGGNPLASAVAIASLEVIKEERLTERSVKMGGELLGLLHKIQKQYPDHVKEVRGRGLFIGVELNSQNLSPVSGFELSEKLKERGVLAKSTHDTIIRFTPPLCISADEIQQGSKALADVLEIDLPMLKKMKPKDAAPLAGPSACDRCGRVVYG

SEQ ID NO: 22404 - protein, 472 aa, Arachis hypogaea
MAARRPVQCLLQRVCGGSRRFGVALQGHASSSSSQQLIDKEYQYSAHNYHPIPIVFSQAKGAAVWDPEGNKYLDFLSAYSAVNQGHCHPKILKALTEQAEKLTLSSRAFYNDRFPPFAEHLTSMLGYDMVLPMNTGAEGVETALKLARKWGYEKKRIPKDEAIIVSCCGCFHGRTLAVISMSCDNEATRGFGPLLPGHLKVDFGDVEALERIFKEKGEHIAGFLLEPIQGEAGVIIPPDGYLKAVRDLCSRYNVLMIADEIQTGLARTGKMLACDWEEVRPDVVILGKALGGGVFPVSAVLADKDVMLCIKPGEHGSTFGGNPLASAVAIAALNVIKEERLVERSEQLGKELGRELHKIQQQYPKYVKEVRGRGLFGAVELNSKSLSPVSAYDLCEKLKDRGVLAKPTHDTIIRFTPPLCISWDEIQQGSKALADVLEIDLPKLQKTKPKHDASQVASHSRACDRCGRLLYG

SEQ ID NO: 22405 - protein, 469 aa, Lotus japonicus
MATMRQVQCLMRRISRGSRSYGVATQLNASSSSQTVIDKEYKHSAHNYHPLPIVFSQAKGACVWDPEGNKYIDFLSGYSAVNQGHCHPKILKALQEQAESLTVSSRAFYNDRFPLFAEYVTNMFGYDMVLPMNTGAEGVETAMKLARKWGYEKKRIPNNEALIVSCCGCFNGRTLGVISMSCDNEATRGFGPLMPGNLKVDFGDAEALERIFKEHGDKIAGFILEPIQGEAGIKIPPVGYLKAVRDLCSKYNVLMIADEIQSGLGRAGKMLACDWEDVRPDVVILAKALGGGILPVSAVLADKDVMLCIKPGQHGSTFGGNPLASAVAIASLDVIKEERLVERSAQMGEELLNQLRKIQQKFPDHVKEVRGKGLFIGLELNSKRLFPVSGFELSDKLKDRGVLAKPTHDTIIRFTPPLCISRDEILEASKALSDVLETDLPKLLKMKPKDAAPPAAPEACDRCGRVLYG

SEQ ID NO: 22406 - protein, 469 aa, Pisum sativum
MAATRQVQCLMRRVCRGTRTFAVATQSNASSSSQTIIDKEHQHSAHNYHPLPIVFAHAKGSSVWDPEGNKYIDFLSGYSAVNQGHCHPKILKALHDQADRLTVSSRAFYNDRFPVFAEYLTALFGYDMVLPMNTGAEGVETALKLARKWGYEKKKIPNDEALIVSCCGCFNGRTLGVISMSCDNEATRGFGPLMPGHLKVDFGDAEAIERIFKEKGDRVAAFILEPIQGEAGVVIPPDGYLKAVRDLCSKYNVLMIADEIQTGLARTGKMLACDWEDVRPDVVILGKALGGGILPVSAVLADKDVMLCIKPGQHGSTFGGNPLASAVAIAALEVIKEERLTERSTKLGGELLGLLHKIQKKHPEHVKEVRGKGLFIGVELNSESLSPVSGFELSEKLKERGVLAKSTHDTIIRFTPPLCISADEIQQGSKALAEVLEIDLPLLKKTKPKDAVPLAGPSPCDRCGRLVYG

SEQ ID NO: 22407 - protein, 470 aa, Cicer arietinum
MAATKQVQCLMRRVCNGRSRTFGVAAQPNASSSSQTIIDKEFQHSAHNYHPLPIVFAHAKGSAVWDPEGNKYIDFLSGYSAVNQGHCHPKILKALKDQAEKLTVSSRAFYNDRFPVFAEYLTALFGYDMVLPMNTGAEGVETALKLARKWGYEKKKIPNNEALIVSCCGCFNGRTLGVISMSCDNEATRGFGPLMPGHLKVDFGDAEAVEKIFKENGNRIAAFILEPIQGEAGVKIPPEGYLKTVRDLCSKYNVLMIADEIQTGLARTGKMLACDWEDVRPDIVVLGKALGGGIIPVSAVLADKEVMLCIKPGQHGSTFGGNPLASAVAIASLEVIKEEKLAERSAKMGDELLGLLHKIHKQYPDHVKEVRGRGLFIGVELNREKLSPVSGFELSVKLKDRGVLAKATHDTIIRFTPPLCISDDEIRQGSKALADVLEIDLPLLKKMKPKEAAPLAGPSACDRCGRVVYG

SEQ ID NO: 22408 - protein, 453 aa, Trifolium pratense
GSRTFTVATQPTTSSSSQTIIDKEFQHSAHNYHPLPIVFAHAKGSAVWDPEGNKYIDFLSGYSAVNQGHCHPKILKALKDQAERLTVSSRAFYNDRFPVFAEYLTALFGYDMVLPMNTGAEGVETALKLARKWGYEKKKIPNDEALIVSCCGCFNGRTLGVISMSCDNEATRGFGPLMPGHLKVDFGDAEAVEKIFKEKGDRIAAFILEPIQGEAGVKIPPDGYLKAVRDLCSKYNVLMIADEIQTGLARTGKMLACEWEDVRPDIVILGKALGGGIIPVSAVLADKDVMLCIKPGQHGSTFGGNPLASAVAIASLEVIKEERLTERSVKMGGELLGLLHKIQKQYPDHVKEVRGRGLFIGVELNSQNLSPVSGFELSEKLKERGVLAKSTHDTIIRFTPPLCISADEIQQGSKALADVLETDLPILKKMKPKDAAPPAGPSACDRCGRVVYG

SEQ ID NO: 22409 - protein, 469 aa, Lupinus angustifolius
MASRKPVQCLLQGVCREGSRRSFGVTPQANASSSQKIIDKEYEFSAHNYHPIPIVFSRARRSTVWDPEGNKYLDFLSAYSAVNQGHCHPKIMKALQEQAEKLTLSSRAFYNDRFPPFAEYLTSMFGYDMVLPMNTGAEGVETALKLARKWGYEKKKIPKDEAVIVSCCGCFHGRTIAVISMSCDTEATHGFGPLLPGQLKVGFGDAEALERIFKENGQRIAGFLFEPIQGEAGVIIPPDGYLKTVRDLCSKYNVLMIADEIQTGLARTGKMLACDWEDVRPDVVILGKALGGGVIPVSAVLADKDVMLCIKPGEHGSTFGGNPLASAVAIASLNVIRDEKLAERSFQLGEELTRLLLKVQQQYPNYVKEVRGRGLFNAVELNSKNLSPVSAYDLCQKLKDRGVLAKPTHDSIIRFTPPLCMSLDEIQEGSKALVDVLEIDLPNLLKMKPKDASPSAPSACDRCGRVLYG

SEQ ID NO: 22410 - protein, 469 aa, Vicia sativa
MAATRQVHCLMRTVSRGTRFFAVATQSNASSSSQTIIDKEYQHSAHNYHPLPIVFAHAKGSSVWDPEGNKYIDFLSGYSAVNQGHCHPKTLKALHDQADRLTVSSRAFYNDRFPVFAEYLTALFGYDMVLPMDTGAEGVETALKLARKWGYEKKKIPNDEALIVSCCGCFNGRTWGVITMSCDNEATRGFGPLKPGQLKVDLGDQKPIERIFKEKGNRIPAFILKPIQGEARVVIPPDGYLKAVRDLCSKYNVLMIADEIQTGLARTGKMLACEWEDVRPDVVILGKALGGGIIPVSAVLADKDVMLCIKPGQHGSTFGGNPLASAVAIASLEVIKEERLTERSTKMGGELLGLLHKIQKKHPDHVKEVRGRGLFIGVELNSESLSPVSGFELSEKLKERGVLAKSTHDTIIRFTPPLCISADEIQQGSKALADVLEIDLPLLKKMKPKDAVPPAGPSPCDRCGRLVYG

SEQ ID NO: 22411 - protein, 755 aa, Glycine max
MTRVVQMSVDGDGKELRELNQCLRDGKKIAGGERGLYEGDEVKCNGVAEEVKIGKGGIVESSSVQQHIPQPQGAIICWERFLHIRSLKVLLVEYDDSTRHVVTALLRNCSYEVIDAANGLQAWKILEDLTNHIDLILTEVAMPGLSGIGLLYKIMGHKTRKNIPVVMMSSHDSMGLVFKCLSKGAVDFLVKPIRKNELKNLWQHVWRRCHSSSGSGSESGTQTQKSVKSKSLEKFDNNSGSNGEDDNGSIGLNNGDGSDNGSGTQSSWTKHAVEVDSPKPVSHWDKIAECPDSTCAQVVHSNAEIGENKVVPLAAKECPEQKEQLVKTAGSKHSNAPDVGPSKFNDQINRGQLDLNCENQSSKLRCKGLSLSDAITSTSDSQMHSGGFEALYKKPKSSDIENKDTNNDEELPSLELSLKRLRGVEDAGIAIQDDRNVLRRSDQSAFSRYNAALNPKKSPTGCVGSNSPHNNSLEVTKKDSSHDIQSHSSGNPPNQNSNGASNNIDMGSTTNNAYAKSAVISEPAVASTTKCLYQTSAYQPEKNNLVCTSQQVVLHNTEDTTATMLAPPKLDRHKDSAAPDFHLHCENHNCIADNMKHQLPPDHDAESIKKMATAAPHCGSSNAVEVLVEGNVGNHSINRSASGSNNGSNGQNGSSTAVNAGGTNMKSNNGLTGNSGSGDASGSVSANRVDQNKTSQREAALTKFRQKRKERRERCFHKKVRYQSRKRLAEQRPRFRGQFVRQSSNENASEATTDS

SEQ ID NO: 22412 - protein, 749 aa, Glycine max
MSVDGDGKELRELNQCLRDGKKIAGGERGLYEGDEVKCNGVAEEVKIGKGGIVESSSVQQHIPQPQGAIICWERFLHIRSLKVLLVEYDDSTRHVVTALLRNCSYEVIDAANGLQAWKILEDLTNHIDLILTEVAMPGLSGIGLLYKIMGHKTRKNIPVVMMSSHDSMGLVFKCLSKGAVDFLVKPIRKNELKNLWQHVWRRCHSSSGSGSESGTQTQKSVKSKSLEKFDNNSGSNGEDDNGSIGLNNGDGSDNGSGTQSSWTKHAVEVDSPKPVSHWDKIAECPDSTCAQVVHSNAEIGENKVVPLAAKECPEQKEQLVKTAGSKHSNAPDVGPSKFNDQINRGQLDLNCENQSSKLRCKGLSLSDAITSTSDSQMHSGGFEALYKKPKSSDIENKDTNNDEELPSLELSLKRLRGVEDAGIAIQDDRNVLRRSDQSAFSRYNAALNPKKSPTGCVGSNSPHNNSLEVTKKDSSHDIQSHSSGNPPNQNSNGASNNIDMGSTTNNAYAKSAVISEPAVASTTKCLYQTSAYQPEKNNLVCTSQQVVLHNTEDTTATMLAPPKLDRHKDSAAPDFHLHCENHNCIADNMKHQLPPDHDAESIKKMATAAPHCGSSNAVEVLVEGNVGNHSINRSASGSNNGSNGQNGSSTAVNAGGTNMKSNNGLTGNSGSGDASGSVSANRVDQNKTSQREAALTKFRQKRKERRERCFHKKVRYQSRKRLAEQRPRFRGQFVRQSSNENASEATTDS

SEQ ID NO: 22413 - protein, 738 aa, Phaseolus vulgaris
MSVDGDSKELKELSQRLRDAKKIAGGEHELCEGDEVKCNGVNEEVKVGQGGTVESSSTQQHIPQPQGAIVCWERFLHIRSLKVLLVENDDCTRHVVTALLRNCSYEVIDAANGLQAWKILDDLTNHIDLILTEVAMPGLSGIGLLYKIMGHKTRKNIPVVMMSSLDSMGLVFKCLSKGAVDFLVKPIRKNELKNLWQHVWRRCHSSSGSGSESGTQTQKSVKSKSLGKSDNFGSNDDDNGSGGLNNGDGSDNGSGTQSSWTKRAVEVDSPKPVSQWDQIAECPDSTCAQVVHSNAEINGNRVVLLGAKESPEQKEQPVKTAGSKHSNVPDAGPSKPLDLNCENQSTKLRCKGLSLSDAITSTSDSQMHSGEFEALNKRPKSSDIENKGNNNDEELPSLGHLCLKRLRGVKDAGVTIQDDRSVLRRSDQSAFSRYNAASNTKISPTGCVGSNSPYNNSLEVTKKDSSRDIQSHSSGNPPNQNSNGASNNIDMGSTTNNAYAKSAVISESAVASTKCLYQTSTFQPIKNNLVCNSQQVILHNPEDKAATRLALPKVDRHQDSAAPDFHLHHENHNCTADMHQLPPDHDAESAKKTAIAATPHCVSSSVVEVLVEGNVGNLSINRSVSGSNNGSNGQNGSSTAVNAGGTNMESNNGLPGNSGSGDASGSGSANKVDQNKTSQREAALTKFRQKRKERNERCFHEKVRYQSRKKLAEQRPRFRGQFARQSSNEKTSEATTER

SEQ ID NO: 22414 - protein, 290 aa, Phaseolus vulgaris
MEKVSVNRMNARFALPNGSFDFLQFKHSNFFLKYPNPNLNPSPNPNPNLLRLRRLNCSVSDGTVPSSVGATDSALVVKKKAAEVSSDLKGTSIFLVGMKSSLKTSLGKLLADALRYYYFDSDSLVEEALGGALAEKSFTESDTKGFYESETEVLKQLSSMGRLVVCAGNGAVTSPTNLALLRHGITLWIDVPVDLVARDVIEDESQFTPSEIPISGSYPEVKDELGAIYVKYRAGYATADAIISVQKVASRLGCDNLDEVTREDLTLEALKEIEKLTRVKKMIEEAARPF

SEQ ID NO: 22415 - protein, 219 aa, Zea mays
MDPYHYQTMYDPRGFPIIHPQPYLQHPVAGALGDSRVRGGGSGARRRPGAKLSTDPQSVAARERRHRISDRFRVLRSLVPGGSKMDTVSMLEQAIHYVKFLKTQISLHQAALMQHEEGCHAELAAYSAVAVVGDNEVTLASHGRTGACDEMMQLQVAAEEALSYGVDAHQPYGLDPRQLSGGHELPPLPASCIFLEEPADACYSVCDLDDGDTGLPGSY

SEQ ID NO: 22416 - protein, 225 aa, Panicum virgatum
MEPYHYQAVYDPRGFPMIHPQPYLHHPAAAGALSDSRVRGGGGGGGVRRRPGAKLSTDPQSVAARERRHRISDRFRVLRSLVPGGSKMDTVSMLEQAIHYVKFLKAQVSLHQAALMQHEEGCPAELAAAYSAVAGAGEVTLASSSCRAGACEEVVMMQLQQVPLPEAMSYDVGAPRLHGLDPGLQMSGGHELPPLPSCVFVEESAACGYSVCDLDEGETDLHGSY

SEQ ID NO: 22417 - protein, 457 aa, Triticum aestivum
MEIFYYLVFGGLAAVVAGLELGKSGKDRVATPTAFNAFKNNYVLVYSLMMSGDWLQGPYVYYLYSQYGFDKGDIGRLFIAGFGSSMLFGTIVGSLADRQGRKRACITYCITYILSCITKHSPHYRVLLLGRILGGVATSLLFSAFESWLVAEHNKRGYDPQWLSITFSKAIFLGNGLIAIIAGLFANLLADNLGFGPVAPFDAAACFLAIGMAIIMSSWSENYGDQSEGKDLMSQFKVAAKAIASDEKIALLGAIQSLFEGSMYTFVFLWTPALSPNDEDIPHGFIFATFMLSSMLGSSIASRLLARKMKVEGYMQIVFAVSAFTLFLPVATSLLVPTSSVKGSGISFGGSLQLLGFCTFESCVGIFWPSIMKMRSQYIPEEARSTIMNFFRIPLNLFVCVVLYNVNAFPITVMFGMCSIFLFMAAILQRRLMVVADLHKLSTKSQEMTAQDELLNP

SEQ ID NO: 22418 - protein, 457 aa, Triticum aestivum
MEIFYYVVFGGLAAVVAGLELGKSGKDRVATPTAFNAFKNNYVLVYSLMMSGDWLQGPYVYYLYSQYGFDKGDIGRLFIAGFGSSMLFGTIVGSLADRQGRKRACITYCITYILSCITKHSPHYRVLLLGRILGGVATSLLFSAFESWLVAEHNKRGYDPQWLSITFSKAIFLGNGLIAIIAGLFANLLADNLGFGPVAPFDAAACFLAIGMAIIMSSWSENYGDQSEGKDLMSQFKVAAKAIASDEKIALLGAIQSLFEGSMYTFVFLWTPALSPNDEDIPHGFIFATFMLSSMLGSSIASRLLARKMKVEGYMQIVFAVSAFTLFLPVATSLLVPTSSVKGSGISFGGSLQLLGFCTFESCVGIFWPSIMKMRSQYIPEEARSTIMNFFRIPLNLFVCVVLYNVNAFPITVMFGMCSIFLFMAAILQRRLMLVADLHKLSTKSQDMTAEDEPLNP

SEQ ID NO: 22419 - protein, 457 aa, Triticum aestivum
MEIFYYVVFGGLSAVVAGLELGKSGKDRVATPTAFNAFKNNYVLVYSLMMSGDWLQGPYVYYLYSQYGFDKGDIGRLFIAGFGSSMLFGTIVGSLADRQGRKRACITYCITYILSCITKHSPQYRVLLLGRILGGIATSLLFSAFESWLVAEHNKRGYDPQWLSITFSKAIFLGNGLIAIIAGLFANLLADNLGFGPVAPFDAAACFLAIGMAIIMSSWTENYGDQSEGKDLMSQFKVAAKAIASDEKIALLGAIQSLFEGSMYTFVFLWTPALSPNDEDIPHGFIFATFMLSSMLGSSIASRLLARKMKVEGYMQIVFAVSAFTLFLPVATSLLVPTSSVKGSGISFGGSLQLLGFCTFESCVGIFWPSIMKMRSQYIPEEARSTIMNFFRIPLNLFVCVVLYNVNAFPITVMFGMCSIFLFMAAILQRRLMVVADLNKLSTKSQEMTAQDELLNP

SEQ ID NO: 22420 - protein, 458 aa, Secale cereale
MEIFYYLVFGGLAVVVAGLELGKSGKDRVATPTAFNAFKNNYVLVYSLMMSGDWLQGPYVYYLYSQYGFDKGDIGRLFIAGFGSSMLFGTIVGSLADRQGRKRACITYCITYILSCITKHSPHYRVLLLGRILGGVATSLLFSAFESWLVAEHNKRGYDPQWLSITFSKAIFLGNGLIAIIAGLFANLLADNLGFGPVAPFDAAACFLAIGMAIIMSSWTENYGDQSEGKDLMSQFKVAAKAIASDEKIALLGAIQSLFEGSMYTFVFLWTPALSPNDQDIPHGFIFATFMLSSMLGSSIASRLLARKMKVEGYMQMVFAVSALTLFLPVATSLLVPTSPVKGSGGISFGGSLQLLGFCIFESCVGIFWPSIMKMRSQYIPEEARSTIMNFFRIPLNLFVCVVLYNVNAFPITVMFGMCSIFLFMAAILQRRLMLVADLHKLSTKSQEMTAQDEPLNP

SEQ ID NO: 22421 - protein, 456 aa, Festuca arundinacea
MEVFYYLVFGALSAVVAGLELGKSGKDRVATPTAFNAFKNNYVLVYSLMMSGDWLQGPYVYYLYSQYGFDKGDIGRLFIAGFGSSMLFGTIVGSLADKQGRKRACITYCITYILSCITKHSPQYRVLMIGRILGGVATSLLFSAFESWLVAEHNKRGYDPQWLSITFSKAIFLGNGLIAIIAGLFANLLADNLGFGPVAPFDAAACFLAIGMAIIMSSWSENYGDSSEGKDLIAQFKGAAKAIASDEKIALLGAIQSLFEGSMYTFVFLWTPALSPNDEDIPHGFIFATFMLSSMLGSSIASRLLARKMKVEGYMQIVFSVSAVTLFLPVATSLLVPASLKGNGISFAGSLQLLGFCTFESCVGIFWPSIMKMRSQYIPEEARSTIMNFFRIPLNLFVCVVLYNVNAFPITVMFGMCSIFLFMAAILQRRLMVVADLHKLSTKAQEMTGEDEPLNP

SEQ ID NO: 22422 - protein, 456 aa, Avena sativa
MEVFYYLVFGALSAVVAGLELGKSGKDRVATTTAFNAFKNNYVIVYSLMMSGDWLQGPYVYYLYQQYGFDKGDIGRLFIAGFGSSMLFGTIVGSLADKQGRKRACITYCITYILSCITKHSPQYRVLMVGRVLGGIATSLLFSAFESWLVAEHNKRGYDPQWLSITFSKAIFLGNGLIAIIAGLFANLLADNLGFGPVAPFDAAACFLAIGMAIIMSSWSENYGDSSEGKDLIAQFKGAAKAIASDEKIALLGAIQSLFEGSMYTFVFLWTPALSPNEEDIPHGFIFATFMLSSMLGSSIASRLLARKMKVEGYMQIVFSVSAVTLFLPVATSFLVPSSVKGNGISFAGSLQLLGFCTFESCVGIFWPSIMKMRSQYIPEEARSTIMNFFRIPLNLFVCVVLYNVSAFPITVMFGMCSIFLFMAAILQRRLMVVADLHKLSTKAQEMTGEDEPLNP

SEQ ID NO: 22423 - protein, 457 aa, Brachypodium distachyon
MEVFYYVVFGALAAVVAGLELGKSGKDRVATTTAFNAFKNNYVLVYSLMMSGDWLQGPYVYYLYSQYGFDKGDIGRLFIAGFGSSMLFGTIVGSLADKQGRKRACITYCITYILSCITKHSPEYRVLMVGRVLGGIATSLLFSAFESWLVAEHNKRGYDPQWLSITFSKAIFLGNGLIAIIAGLFANLLADNLGFGPVAPFDAAACFLAIGMAIIMSSWSENYGDSSESKDLMAQFKVAAKAIASDEKIALLGAIQSLFEGSMYTFVFLWTPALSPNEEDIPHGFIFATFMLSSMLGSSIASRLLARKMKVEGYMQIVFSVSAVTLFLPVATSILVSPSSVKGGGISFGGSLQLLGFCTFESCVGIFWPSIMKMRSQYIPEEARSTIMNFFRIPLNLFVCVVLYNVNAFPITVMFGMCSIFLFIAAILQRRLMVVADLHKLSTKAQEMTVEDEPLNP

SEQ ID NO: 22424 - protein, 441 aa, Triticum aestivum
MEVFYYLVFGGLAAVVAALELGKSGKDRVATPTAFNSFKNNYVLVYSLMMSGDWLQGPYVYYLYSQYGFDKGDIGRLFIAGFGSSMLFGTIVGSLADRQGRKRACITYCITYILSCITKHSPQYRVLLLGRILGGVATSLLFSAFESWLVAEHNKRGYDPQWLSITFSKAIFLGNGLIAIIAGLFANLLADNLGFGPVAPFDAAACFLAIGMAIIMSSWSENYGDQSEGKDLMSQFKVAAKAIASDEKIALLGAIQSLFEGSMYTFVFLWTPALSPNDEDIPHGFIFATFMLSSMLGSSIASRLLARKMKVEGYMQIVFAVSAFTLFLPVATSLLVPTSSVKGSGISFGGSLQLLGFCTFESCVGIFWPSIMKMRSQYIPEEARSTIMNFFRIPLNLFVCVVLYNVNAFPITVMFGMCSIFLLMAAILQRRLMLVADLHKL

SEQ ID NO: 22425 - protein, 456 aa, Oryza sativa
MEVFYYLVFGGLAAVVAGLELGKSGKDRVATTPAFNAFKNNYILVYSLMMSGDWLQGPYVYYLYSQYGFDKGDIGRLFIAGFGSSMLFGTIVGSLADKQGRKRACITYCISYILSCITKHSPEYKILMIGRVLGGIATSLLFSAFESWLVAEHNKRGFDPQWLSITFSKAIFLGNGLVAIIAGLFANLLADNLGFGPVAPFDAAACFLAIGMAIILSSWSENYGDTSDNKDLIAQFKVAAKAIASDEKIALLGAIQSLFEGSMYTFVFLWTPALSPNDEEIPHGFIFATFMLSSMLGSSIASRLLARKLKVEGYMQIVFSISAFTLFLPVVTNFLVPPSSVKGGGISFGGCLQLLGFCIFESCVGIFWPSIMKMRSQYIPEEARSTIMNFFRIPLNLFVCVVLYNVNAFPITVMFGMCAIFLFMAAILQRRLMVVSDLHRSTKAVEMTGEDEPLNP

SEQ ID NO: 22426 - protein, 457 aa, Pennisetum glaucum
MEAFYYVVFGALAAVVAGLELGKSGKDRVATTSAFDSFKNNYVLVYSLMMSGDWLQGPYVYYLYSQYGFDKGDIGRLFIAGFGSSMLFGTIVGSLADKQGRKRACITYCVSYILSCITKHSPEYKILMIGRILGGVATSLLFSAFESWLVAEHNKRGFDPQWLSITFSKAIFLGNGLIAIVSGLFANLLAENLGFGPVAPFDAAACFLAIGMAIIMSSWSENYGDPSESKDLMAQFKVAAKAIASDEKIALLGAIQSLFEGSMYTFVFLWTPALSPNEEDIPHGFIFATFMLSSMLGSSIASRLLARKLKVEGYMQIVFAISAVTLVLPVVTNFLVPPSSVKGGSMSFGGSLQLLGFCTFEACVGIFWPSIMKMRSQYIPEEARSTIMNFFRIPLNLFVCVVLYNVNAFPITIMFGMCSIFLFMAAILQRRLMVVSDLHKSSTKAQEMIGEDEPLNP

SEQ ID NO: 22427 - protein, 457 aa, Sorghum bicolor
MEVFYYVVFGALAAVVAGLELGKSGKDRVATTSAFNSFKNNYVLVYSLMMSGDWLQGPYVYYLYSQYGFDKGDIGRLFIAGFGSSMLFGTIVGSLADKQGRKRACITYCISYILSCITKHSPEYRVLMIGRILGGIATSLLFSAFESWLVAEHNKRGFDPQWLSITFSKAIFLGNGLIAIVSGLFANLLAENLGFGPVAPFDAAACFLAIGMAIIMSSWSENYGDPSESKDLMAQFKVAAKAIASDEKIALLGAIQSLFEGSMYTFVFLWTPALSPNEEDIPHGFIFATFMLSSMLGSSIASRLLARKLKVEGYMQIVFSISAVTLVLPVVTNILVPTSSVKGGSISVGGSLQLLGFCTFEACVGIFWPSIMKMRSQYIPEEARSTIMNFFRIPLNLFVCVVLYNVNAFPITVMFGMCSIFLFMAAILQRRLMVVSDLHKSSTKAQEMIEEDEPLNP

SEQ ID NO: 22428 - protein, 457 aa, Saccharum officinarum
MEVFYYVVFGALAAVVAGLELGKSGKDRVATTSAFNSFKNNYVLVYSLMMSGDWLQGPYVYYLYSQYGFDKGDIGRLFIAGFGSSMLFGTIVGSLADKQGRKRACITYCISYILSCITKHSPEYRVLMIGRILGGIATSLLFSAFESWLVAEHNKRGFDPQWLSITFSKAIFLGNGLIAIISGLFANLLAENLGFGPVAPFDAAACFLAIGMAIIMSSWSENYGDPSESKDLMAQFKVAAKAIASDEKIALLGAIQSLFEGSMYTFVFLWTPALSPNEEDIPHGFIFATFMLSSMLGSSIASRLLARKLKVEGYMQIVFSISAVTLVLPVVTNILVPTSSVKGGSISVGGSLQLLGFCTFEACVGIFWPSIMKMRSQYIPEEARSTIMNFFRIPLNLFVCVVLYNVNAFPITVMFGMCSIFLFMAAILQRRLMVISDLHKSSTKAQEMIDEDEPLNP

SEQ ID NO: 22429 - protein, 457 aa, Setaria italica
MEVFYYVVFGALAAVVAGLELGKSGKDRVATTSAFNSFKNNYVLVYSLMMSGDWLQGPYVYYLYRQYGFDKGDIGRLFIAGFGSSMLFGTIVGSLADKQGRKRACITYCISYILSCITKHSPEYKILMIGRILGGIATSLLFSAFESWLVAEHNKRGFDPQWLSITFSKAIFLGNGLIAIVSGLFANLLAENLGFGPVAPFDAAACFLAIGMAIIMSSWSENYGDPSESKDLMAQFKVAAKAIASDEKIALLGAIQSLFEGSMYTFVFLWTPALSPNEEDIPHGFIFATFMLSSMLGSSIASRLLARKLKVEGYMQIVFAISAVTLVLPVVTNFLVPPSSVKGGSISFGGSLQLLGFCTFEACVGIFWPSIMKMRSQYIPEEARSTIMNFFRIPLNLFVCVVLYNVNAFPITVMFGMCSIFLFMASILQRRLMVVSDLHKSSTKAQEMIGEDEPLNP

SEQ ID NO: 22430 - protein, 458 aa, Zea mays
MEVFYYVVFGALAAVVAGLELGKSGKDRVATTSAFNSFKNNYVLVYSLMMSGDWLQGPYVYYLYSQYGFDKGDIGRLFIAGFGSSMLFGTIVGSLADKQGRKRACVTYCISYILSCITKHSPEYRVLMIGRILGGIATSLLFSAFESWLVAEHNKRGFDPQWLSITFSKAIFLGNGLIAIVSGLFANLLAENLGFGPVAPFDAAACFLAIGMAIIMSSWSENYGDPSESKDLMAQFKVAAKAIASDEKIALLGAIQSLFEGSMYTFVFLWTPALSPNEEDIPHGFIFATFMLSSMLGSSIASRLLARKLKVEGYMQIVFSISAVTLVLPVATNILVPTSSVKGGSVSIGGSLQLLGFCTFEACVGIFWPSIMKMRSQYIPEEARSTIMNFFRIPLNLFVCVVLYNVNAFPITVMFGMCSIFLFMAAILQRRLMVVSDQVHKSSTKAQEMIGEDEPLNP

SEQ ID NO: 22431 - protein, 455 aa, Hordeum vulgare
MEVFYYLVFGGLAAVVAALELGKSGKDRVATPTAFNSFKNNYVLVYSLMMSGDWLQGPYVYYLYSQYGFDKGDIGRLFIAGFGSSMLFGTIVGSLADKQGRKRACITYCITYILSCITKHSPQYRILMIGRVLGGIATSLLFSAFESWLVAEHNKRGFDPQWLSITFSKAIFLGNGLVAIVAGLFANLLADNLGFGPVAPFDAAACFLAIGMAIILSSWGENYGDASEGKDLMAQFKVAAKAIASDEKIALLGAIQSLFEGSMYTFVFLWTPALSPNDEDIPHGFIFATFMLSSMLGSSIASRLLARKMKVEGYMQIVFLISAFTLFLPVVTNFIVPPAEKGSSISFGGCLQLLGFCIFESCVGIFWPSIMKMRSQYIPEEARSTIMNFFRIPLNLFVCVVLYNVNAFPIAVMFGMCSIFLFIAAILQRRLMFVSDLHRATKATEMTAEDEPLNP

SEQ ID NO: 22432 - protein, 457 aa, Oryza sativa
MEVFYYLVFGGLAAVVAGLELGKSAKDRVTTSQAFNSFKNNYVLVYSLMMSGDWLQGPYVYYLYSQYGFDKGDIGRLFIAGFGSSMLFGTIVGSLADKQGRKRACITYCISYILSCITKHSPEYKILMIGRVLGGIATSLLFSAFESWLVAEHNKRGFDSQWLSITFSKAIFLGNGLVAIVSGLFANLLADNLGFGPVAPFDAAACFLAIGMAIIMSSWSENYGDPSESKDLMSQFKVAAKAIASDEKIALLGAIQSLFEGSMYTFVFLWTPALSPNEEDIPHGFIFATFMLSSMLGSSIAARLLARKLKVEGYMQIVFTISAFTLFLPVVTNILVPTSSVKGGSISFGGTLQLLGFCTFEACVGIFWPSIMKMRSQYIPEEARSTIMNFFRIPLNLFVCVVLYNVNAFPITVMFGMCSIFLFMAAILQRRLMVVSDLHKSSTKAQEMVDEDEPLNP

SEQ ID NO: 22433 - protein, 455 aa, Brachypodium distachyon
MELFYYLVFGGLSAVVAALELGKSGKDRVATPTAFNSFKNNYVLVYSLMMSGDWLQGPYVYYLYSQYGFDKGDIGRLFIAGFGSSMLFGTIVGSLADKQGRKRACVTYCITYILSCITKHSPQYRILMVGRVLGGIATSLLFSAFESWLVAEHNKRGFDPQWLSITFSKAIFLGNGLVAIVAGLFANLLADNLGLGPVAPFDAAACFLAIGMAIILSSWGENYGDASDGKDLIAQFKVAAKAIASDEKIALLGAIQSLFEGSMYTFVFLWTPALSPNHEDIPHGFIFATFMLSSMLGSSIASRLLARKLKVEGYMQIVFSISAFTLFLPVVTNFLVPSSEKGSSISFGGSLQLLGFCIFESCVGIFWPSIMKMRSQYIPEEARSTIMNFFRIPLNLFVCVVLYNVNAFPITVMFGMCSIFLFIAAILQRRLMVVSDLHRTTKAAEMTAEDVPLNP

SEQ ID NO: 22434 - protein, 457 aa, Zea mays
MEVFYYVVFGALAAIVAGLELGKSGKDRVATTSAFNSFKNNYVLVYSLMMSGDWLQGPYVYYLYSQYGFDKGDIGRLFIAGFGSSMLFGTIVGSLADKQGRKRACITYCISYILSCITKHSPEYRVLMIGRILGGIATSLLFSAFESWLVAEHNKRGFDPQWLSITFSKAIFLGNGLIAIVSGLFANLLAENLGFGPVAPFDAAACFLAIGMAVIMSSWSENYGDPSDSKDLMAQFKVAAKAIASDEKIALLGAIQSLFEGSMYTFVFLWTPALSPNEEDIPHGFIFATFMLSSMLGSSVASRLLARKLKVEGYMQIVFSISAVTLVLPVVTNILVPTSSVKGGSISIGGSLQLLGFCTFEACVGIFWPSIMKMRSQYIPEEARSTIMNFFRIPLNLFVCVVLYNVNAFPITVMFGMCSIFLFMAAILQRRLMVVSDLHKSSTKAQEMIGEDEPLNP

SEQ ID NO: 22435 - protein, 455 aa, Secale cereale
MEVFYYLVFGGLAAVVAALELGKSGKDRVATPTAFNSFKNNYVLVYSLMMSGDWLQGPYVYYLYSQYGFDKGDIGRLFIAGFGSSMLFGTIVGSLADKQGRKRACITYCITYILSCITKHSPQYRILMIGRVLGGIATSLLFSAFESWLVAEHNKRGFDPQWLSITFSKAIFLGNGLVAIVAGLFANLLADNLGFGPVAPFDAAACFLAIGMAIILSSWGENYGDASEGKDLMAQFKVAARAIASDEKIALLGAIQSLFEGSMYTFVFLWTPALSPNDEDIPHGFIFATFMLSSMLGSSIASRLLARKMKVEGYMQIVFSISAFTLFLPVVTNFIVPPSEKGGSISFGGSLQLLGFCIFESCVGIFWPSIMKMRSQYIPEEARSTIMNFFRIPLNMFVCVVLYNVNAFPIAVMFGMCSIFLFIAAILQRRLMFVSDLHRSTKAAEMTTEDEPLNP

SEQ ID NO: 22436 - protein, 457 aa, Panicum virgatum
MEVFYYVVFGALAAVVAGLELGKSGKDRVATTSAFNSFKNNYVLVYSLMMSGDWLQGPYVYYLYRQYGFDKGDIGRLFIAGFGSSMLFGTIVGSLADKQGRKRACITYCISYILSCITKHSPEYRILMIGRILGGIATSLLFSAFESWLVAEHNKRGFDPQWLSITFSKAIFLGNGLVAIVSGLFANLLAENLGFGPVAPFDAAACFLAIGMAIIMSSWSENYGDTSESKDLMAQFKVAAKAIASDEKIALLGAIQSLFEGSMYTFVFLWTPALSPNEEDIPHGFIFATFMLSSMLGSSIASRLLARKLKVEGYMQIVFSISAVTLVLPVVTNFLVPPSSVKGGSISFGGCLQLLGFCTFEACVGIFWPSIMKMRSQYIPEEARSTIMNFFRIPLNLFVCVVLYNVNAFPITVMFGMCSIFLFMAVILQRRLMVVSDLHKSSTKAQEMIGEDEPLNP

SEQ ID NO: 22437 - protein, 455 aa, Triticum aestivum
MEVFYYLVFGGLAAVVAALELGKSGKDRVATPTAFNSFKNNYVLVYSLMMSGDWLQGPYVYYLYSQYGFDKGDIGRLFIAGFGSSMLFGTIVGSLADKQGRKRACITYCITYILSCITKHSPQYRILMIGRVLGGIATSLLFSAFESWLVAEHNKRGFDPQWLSITFSKAIFLGNGLVAIVAGLFANLLADNLGFGPVAPFDAAACFLAIGMAIILSSWGENYGDASEGKDLMAQFKVAAKAIASDEKIALLGAIQSLFEGSMYTFVFLWTPALSPNEEDIPHGFIFATFMLSSMLGSSIASRLLARKMKVEGYMQIVFSISAFTLFLPVVTNFIVPPSEKGGSISFGGCVQLLGFCIFESCVGIFWPSIMKMRSQYIPEEARSTIMNFFRIPLNLFVCVVLYNVNAFPIAVMFGMCSIFLFIAAILQRRLMFVSDLHRSTKAAEMTAEDEPLNP

SEQ ID NO: 22438 - protein, 457 aa, Panicum virgatum
MEAYYYVVFGALAAVVAGLELGKSGKDRVATASVFNSFKNNYVLVYSLMMSGDWLQGPYVYYLYSQYGFDKGDIGRLFIAGFGSSMLFGTIVGSLADKQGRKRACITYCISYILSCITKHSPEYKILMIGRILGGIATSLLFSAFESWLVAEHNKRGFDPQWLSITFSKAIFLGNGLVAIVSGLFANLLAENLGFGPVAPFDAAACFLAIGMAIIMSSWSENYGDPSESKDLMAQFKVAAKAIASDEKIALLGAIQSLFEGSMYTFVFLWTPALSPNEEDIPHGFIFATFMLSSMLGSSIASRLLARKLKVEGYMQIVFSISAVTLVLPVVTNFLVPPSSVKGGSISFGGCLQLLGFCTFEACVGIFWPSIMKMRSQYIPEEARSTIMNFFRIPLNLFVCVVLYNVNAFPITVMFGMCSIFLFMAVILQRRLMVVSDLHKSSTKAQEMIGEDEPLNP

SEQ ID NO: 22439 - protein, 456 aa, Setaria italica
MEVFYYLVFGALAAVVAALELGKSGKDRVATSPAFNSFKNNYILVYSLMMSGDWLQGPYVYYLYSQYGFDKGDIGRLFIAGFGSSMLFGTIVGSLADKQGRKRACVTYCITYILSCFTKHSPEYKILMIGRVLGGIATSLLFSAFESWLVAEHNKKGFDPQWLSITFSKAIFLGNGLVAIVAGLFANFLADNMGFGPVAPFDAAACFLAIGMAIILSSWGENYGDSSDSKDLMTQFKVAAKAIASDEKIALLGAIQSLFEGSMYTFVFLWTPALSPNDEEIPHGFIFATFMLSSMLGSSIASRLLARKLKVEGYMQIVFAVSAFTLFLPVVTNFLVPPSSAKGGSISLGGCLQLLGFCTFESCVGIFWPSIMKMRSQYIPEEARSTIMNFFRIPLNLFVCVVLYNVNAFPITVMFGMCSIFLFMAAILQRRLMVVSDLHKSTKAVEMTAEDEPLNP

SEQ ID NO: 22440 - protein, 456 aa, Panicum virgatum
MEAFYYLVFGALAAVVAALELGKSGKDRVATSPAFNSFKNNYILVYSLMMSGDWLQGPYVYYLYSQYGFDKGDIGRLFIAGFGSSMLFGTIVGSLADKQGRKRACVTYCITYILSCFTKHSPEYKILMVGRVLGGIATSLLFSAFESWLVAEHNKKGFDPQWLSITFSKAIFLGNGLVAIVAGLFANFLADNMGFGPVAPFDAAACFLAIGMAIILSSWGENYGDSSDSKDLMTQFKVAAKAIASDEKIALLGAIQSLFEGSMYTFVFLWTPALSPNDEEIPHGFIFATFMLSSMLGSSIASRLLARKMKVEGYMQIVFSVSACTLFLPVVTNFLVPPSSEKGGSISLGGCLQLLGFCTFESCVGIFWPSIMKMRSQYIPEEARSTIMNFFRIPLNLFVCVVLYNVNAFPITVMFGMCSIFLFMAAILQRRLMVVSDLHKSTKAVEMNAEDEPLNP

SEQ ID NO: 22441 - protein, 456 aa, Saccharum officinarum
MEMFYYLVFGALAAIVAALELGKSGKDRVATSPAFNSFKNNYILVYSLMMSGDWLQGPYVYYLYSQYGFDKGDIGRLFIAGFGSSMLFGTIVGSLADKQGRKRACVTYCITYILSCFTKHSPQYKILMIGRVLGGIATSLLFSAFESWLVAEHNKKGFDPQWLSITFSKAIFLGNGLVAIVAGLFANFLADNMGFGPVAPFDAAACFLAIGMAIILSSWGENYGDSSDSKDLITQFKGAAKAIASDEKIALLGAIQSLFEGSMYTFVFLWTPALSPKDEEIPHGFIFATFMLSSMLGSSIASRLLARKLKVEGYMQIVFSVSAFTLFLPVVTNFLVPPSGEKGGSISLGGCLQLLGFCTFESCVGIFWPSIMKMRSQYIPEEARSTIMNFFRIPLNLFVCVVLYNVNAFPITVMFGMCSIFLFMAAILQRRLMVVSDLHRSTKAAEMTAEDEPLNP

SEQ ID NO: 22442 - protein, 456 aa, Sorghum bicolor
MEMFYYLVFGALAAIVAALELGKSGKDRVATSPAFNSFKNNYILVYSLMMSGDWLQGPYVYYLYSQYGFDKGDIGRLFIAGFGSSMLFGTIVGSLADKKGRKRACVTYCITYILSCFTKHSPQYKILMVGRVLGGIATSLLFSAFESWLVAEHNKKGFDPQWLSITFSKAIFLGNGLVAIVAGLFANFLADNMGFGPVAPFDAAACFLAIGMAIILSSWGENYGDSSDSKDLITQFKGAAKAIASDEKIALLGAIQSLFEGSMYTFVFLWTPALSPKDEEIPHGFIFATFMLSSMLGSSIASRLLARKLKVEGYMQIVFSVSAFTLFLPVVTNFLVPPSGEKGGSISLGGCLQLLGFCTFESCVGIFWPSIMKMRSQYIPEEARSTIMNFFRIPLNLFVCVVLYNVNAFPITVMFGMCSIFLFMAAILQRRLMVVSDLHRSTKAVEMTAEDEPLNP

SEQ ID NO: 22443 - protein, 456 aa, Zea mays
MEVFYYLVFGALAAIVAALELAKSGKDRVATSPAFNSFKNNYILVYSLMMSGDWLQGPYVYYLYSQYGFDKGDIGRLFIAGFGSSMLFGTIVGSLADKQGRKRACVTYCITYILSCITKHSPQYKVLMIGRVLGGIATSLLFSAFESWLVAEHNKKGFDPQWLSITFSKAIFLGNGLVAIVAGLFANFLADNMGFGPVAPFDAAACFLAIGMAIILSSWGENYGDSSDSKDLITQFKGAAKAIASDEKIALLGAIQSLFEGSMYTFVFLWTPALSPKDEEIPHGFIFATFMLSSMLGSSIASRLLARKLKVEGYMQIVFSVSAFTLFLPVVTNFLVPPSGEKGGSISLGGCLQLLGFCTFESCVGIFWPSIMKMRSQYIPEEARSTIMNFFRIPLNLFVCVVLYNVNAFPITVMFGMCSIFLLMAAVLQRRLMAVSDLHRSTKAVMMTAEDEPLNP

SEQ ID NO: 22444 - protein, 428 aa, Triticum aestivum
RVATPTAFNSFKNNYVLVYSLMMSGDWLQGPYVYYLYSQYGFDKGDIGRLFIAGFGSSMLFGTIVGSLADKQGRKRACITYCITYILSCITKHSPQYRILMIGRVLGGIATSLLFSAFESWLVAEHNKRGFDPQWLSITFSKAIFLGNGLVAIVAGLFANLLADNLGFGPVAPFDAAACFLAIGMAIILSSWGENYGDASEGKDLMAQFKVAAKAIASDEKIALLGAIQSLFEGSMYTFVFLWTPALSPNDEDIPHGFIFATFMLSSMLGSSIASRLLARKMKVEGYMQIVFSISAFTLFLPVVTNFIVPPSEKGGSISFGGSVQLLGFCIFESCVGIFWPSIMKMRSQYIPEEARSTIMNFFRIPLNLFVCVVLYNVNAFPIAVMFGMCSIFLFIAAILQRRLMFVSDLHRSTKAAEMTAEDEPLNP

SEQ ID NO: 22445 - protein, 429 aa, Pennisetum glaucum
RVATSPAFNSFKNNYILVYSLMMSGDWLQGPYVYYLYSQYGFDKGDIGRLFIAGFGSSMLFGTIVGSLADKQGRKRACITYCITYILSCFTKHSPQYKILMIGRVLGGIATSLLFSAFESWLVAEHNKKGFDPQWLSITFSKAIFLGNGLVAIVAGLFANFLADNMGFGPVAPFDAAACFLAIGMAIILSSWGENYGDSSDSKDLMTQFKVAAKAIASDEKIALLGAIQSLFEGSMYTFVFLWTPALSPNDEEIPHGFIFATFMLSSMLGSSIASRLLARKLKVEGYMQIVFAVSAFTLVLPVVTNFLVPPSSEKGGSISLGGCLQLLGFCTFESCVGIFWPSIMKMRSQYIPEEARSTIMNFFRIPLNLFVCVVLYNVNAFPITVMFGMCSIFLCMAAILQRRLMVVSDHHKSTKAVEMTAEDEPLNP

SEQ ID NO: 22446 - protein, 462 aa, Ananas comosus
MEVFYYVVFGGLAMVVALLELSKTSKDRVSTSSAFNSFKNNYLVVYSLMMAGDWLQGPYVYYLYSQYGFDKGDIGRLFIAGFGSSMLFGTIVGSLADKQGRKRACVTYCISYILSCITKHSPEYKVLMVGRILGGIATSLLFSAFESWLVAEHNKRGFDPQWLSLTFSKAIFLGNGLVAIVAGLFANLLADNLGFGPVAPFDAAACFLAIGMAIILSSWTENYGDPSENKDLLAQFKVAASAIASDEKIALLGAIQSLFEGSMYTFVFLWTPALSPNDEEIPHGFIFATFMLSSMLGSSIASRLLARQSLKVEGYMQIVFAISAFTLLLPVLTSILVAPSTVKGGGISLGGCIQLIGFCTFEACVGVFWPSIMKMRSQYIPEEARSTIMNFFRIPLNIFVCVVLYNVDAFPITIMFGMCSIFLFMASILQRRLMAVADSHKSKPQDWSALKERDGEEEPLNA

SEQ ID NO: 22447 - protein, 462 aa, Chelidonium majus
MEMFYYLVFGALSAIVAVLELSKNNKDRINTSSAFNSFKNNYLVVYSLMMAGDWLQGPYVYFLYSQYGFSKGEIGRLFIAGFGSSMLFGTIVGSLADKQGRKRACVTYCITYILSCITKHSPQYKVLMLGRILGGVATSLLFSAFESWLVAEHNKRGFEQQWLSLTFSKAIFLGNGLIAIVAGLFANMLADNLGFGPVAPFDAAACFLAIGMAIILSSWSENYGDPSESKDLLTQFKGAAVAIASDEKIALLGAIQSLFEGSMYTFVFLWTPALSPNDEDIPHGFIFATFMLASMLGSSIASRLMARTSLKVESYMQIVFAVSATTFLLPIVTGFFVPASKGKGGSISFAGCIQLFGFCTFESCVGIFWPSIMKMRSQYIPEEARSTIMNFFRVPLNIFVCIVLYNVNAFPITVMFGMCSIFLFMASILQRRLMVVAESHKSKQQDWALSKERDSEVEPLNI

SEQ ID NO: 22448 - protein, 462 aa, Ananas comosus
MEVFYYLVFGALAVVVAVLELSKTSKDRVATSSAFNSFKNNYLVVFSLMMAGDWLQGPYVYFLYSQYGFDKGDIGRLFIAGFGSSMLFGTIVGSLADKQGRKRACVTYCITYILSCITKHSPEYKVLMVGRILGGIATSLLFSAFESWLVAEHNKRGFDPQWLSLIFSKAIFLGNGLIAIVSGLFANMLADNLGFGPVAPFDAAACFLAIGMAIILSSWTENYGDPSDSKDLMGQFKVAATAIASDEKIALLGAIQSLFEGSMYTFVFLWTPALSPNDEEIPHGFIFATFMMSSMLGSSIASRLLARVTLKVESYMQIVFVVSAFTLLLPVIINFLVAPSTGKDSSLPFGGCILLFGFCIFESCVGIFWPSMMKMRSQYIPEEARSTIMNFFRIPLNLFVCVVLYNVNAFPITVMFGMCSIFLFMASILQRRLMVIADRPKSKPQDWTALREMDGEEEPLNV

SEQ ID NO: 22449 - protein, 463 aa, Papaver somniferum
MEMFYYLVFGAMSVVVAILEFSKNNKDRINTSTAFNAFKNNYLVVYSLMMAGDWLQGPYVYFLYSQYGFSKGDIGRLFIAGFGSSMLFGTVVGSLADKTGRKRACITYCITYILSCITKHSPQYKVLMVGRILGGIATSLLFSAFESWLVAEHNKRGYEQQWLSLTFSKAIFLGNGLIAIFAGLFGNMLADNLGFGPVAPFDAAACFLAIGMAIILSTWSENFGDPSENKDLLTQFRGAAVAIASDEKIALLGAIQSLFEGSMYTFVFLWTPALSPNDEDIPHGFIFATFMLASMLGSSIASRLMARQNLKVEGYMQIVFAVSACTFLLPLVTGFLVPPSGEKGGSISFAGCIQLFGFCTFESCVGIFWPSIMKMRSQYIPEEARSTIMNFFRIPLNIFVCIVLYNVNAFPITVMFGMCSIFLLMASILQRRLMVVAELHNKSKPEDWTSLKERDTEAEPLNI

SEQ ID NO: 22450 - protein, 462 aa, Eschscholzia californica
MEMFYYLVFGALSMVVAVLEFSKNNKDRINTSSAFNSFKNNYLVVYSLMMAGDWLQGPYVYFLYSQYGFSKGDIGRLFIAGFGSSMLFGTIVGSLADKQGRKRACITYCITYILSCITKHSPQYKILMVGRILGGIATSLLFSAFESWLVAEHNKRGFEQQWLSLTFSKAIFLGNGLVAIVAGLFANMLADNLGFGPVAPFDAAACFLAIGMAIILSSWGENYGDASDNKDLLTQFKGAAVAIASDEKIALLGAIQSLFEGSMYTFVFLWTPALSPNDEDIPHGFIFATFMLASMLGSSIASRLMARSSLKVESYMQIIFAISAATFLLPIVTSLLVPPSNVKGGSITFAGCIQLFGFCTFESCVGIFWPSIMKMRSQYIPEEARSTIMNFFRVPLNIFVCIVLYNVNAFPITVMFGMCSIFLFIASILQRRLMVVAELHKSKSQDWTSVKDRDSEVEPLNI

SEQ ID NO: 22451 - protein, 400 aa, Triticum aestivum
QGPYVYYLYSQYGFDKGDIGRLFIAGFGSSMLFGTIVGSLADRQGRKRACITYCITYILSCITKHSPQYRVLLLGRILGGIATSLLFSAFESWLVAEHNKRGYDPQWLSITFSKAIFLGNGLIAILAGLFANLLADNLGFGPVAPFDAAACFLAIGMAIIMSSWSENYGDQSEGKDLMSQFKVAAKAIASDEKIALLGAIQSLFEGSMYTFVFLWTPALSPNDEDIPHGFIFATFMLSSMLGSSIASRLLARKMKVEGYMQIVFSISAFTLFLPVVTNFIVPPSEKGGSISFGGCVQLLGFCIFESCVGIFWPSIMKMRSQYIPEEARSTIMNFFRIPLNLFVCVVLYNVNAFPIAVMFGMCTIFLFIAAILQRRLMFVSDLHRSTKAAEMTAEDEPLNP

SEQ ID NO: 22452 - protein, 460 aa, Allium cepa
MEAFYYLVFGALSIVVAVLELSKSSNDRITTSSAFNSFKTNYIVVYSLMMAGDWLQGPYVYYLYSTYGFDKGDIGRLFIAGFGSSMLFGTIVGSLADKQGRKRACVTYCLTYILSCITKHSPQYKVLMVGRILGGIATSLLFSSFESWLVAEHNKRGFEPQWLSLTFSKAIFFGNGLIAIISGLFANMLADNLGFGPVAPFDAAACFLAIGMAVILSTWSENYGDPSDNKNLITQFKGAAIAIASDEKIALLGAIQSLFEGSMYTFVFLWTPALSPNDEDIPHGFIFATFMLSSMLGSSIASRLLARPLLKVESYMQVVFVVSSFTLLLPILTTFLVTPPSVKGGSISFAGCIQLFGFCTFEACCGIFWPSIMKMRSQYIPEEARSTIMNFFRIPLNIFVCVVLYNVNAFPITIMFGMCSIFLFMASILQRRLMVVAENHKSKSHISMKERDTEAEPLNI

SEQ ID NO: 22453 - protein, 462 aa, Musa acuminata
MDAFYYLVFGGLAAVVAAMELSKTSRDRVATSSPFNAFKNNYLLVYSLMMAGDWLQGPYVYYLYSQYGFDKGDIGRLFIAGFGSSMLFGTIVGSLADKRGRKRACVTYCITYILSCITKHSPEYKVLMVGRILGGISTSLLFSAFESWLVAEHNKRGFDPQWLSVTFAKAIFLGNGLIAIVSGLFANLLADNLGFGPVAPFDAAACCLAIGMAIILSSWSENYGDPSDSKDLITQFKGAAAAIASDEKIALLGAIQSLFEGSMYTFVFLWTPALSPNDEDIPHGFIFATFMVSSMLGSSIASRLMARGTLKVESYMQIVFAISAFTLLLPIISNFLVAPSTAKGGSISFGSCIQLLGFCVFEACVGIFWPSIMKMRSQYIPEEARSTIMNFFRIPLNIFVCIVLYNVNAFPITIMFGMCSIFLFMASVLQRRLMVVAESHKSKPQDWTGLKERDDEAESLNI

SEQ ID NO: 22454 - protein, 462 aa, Allium cepa
MEALYYILFGALSLVVAVLELSKSNKDRISTSSAFSSFKNNYLVVYSLAMAGDWLQGPYVYYLYSQYGFSKGDIGRLFIAGFGSSMIFGTIVGSLADKQGRKRACVTYCITYILSCITKHFPQYKVLMLGRILGGIATSLLFSAFESWLVAEHNKRGFESQWLSLTFSKAIFLGNGLIAIISGLFANMLADNLGFGPVAPFDAAACFLAIGMAIILSSWTENYGDPSDSKDLMTQFKAAAIAIASDEKIALLGAIQSLFEGSMYTFVFLWTPALSPNDEDIPHGFIFATFMLSSMLGSSIASRLMARSSLKVESYMQAVFAVSAFTLLLPILTTFIASPPSVKGGSISFSGMIQLFGFCIFESCVGIFWPSIMKMRSQYIPEEARSTIMNFFRIPLNIFVCVVLYNVNAFPITIMFGMCSIFLFMASVLQRRLMVVAEIHKSKSQDWTAMKERDTEAEPLNM

SEQ ID NO: 22455 - protein, 460 aa, Allium cepa
MEAFYYLVFGALSIVVALLELSKSGNDRTATSPSFNSFKNNYLVVYSLMMAGDWLQGPYVYYLYSTYGFDKGDIGRLFIAGFGSSMLFGTIVGSLADKQGRKRACVTYCITYILSCITKHSPQYKILMLGRVLGGIATSLLFSSFESWLVAEHNKRGFEPQWLSLTFSKAIFLGNGLVAIISGLFANMLADNLGFGPVAPFDAAACFLAIGMSIILSTWTENYGDASDNKDLLTQFKVAASAIASDEKIALLGAIQSLFEGSMYTFVFLWTPALSPNDEDIPHGFIFATFMLSSMLGSSIASRLMARPVLRVESYMQVVFLVSSFTLLLPILTTFLTTPPSVKGGSISFAGCMQLFGFCTFEACCGIFWPSIMKMRSQYIPEEARSTIMNFFRIPLNIFVCVVLYNVNAFPITVMFGMCSIFLFMASVLQRRLMVVAEVHRAKHISMKEIDPEAEPLNIS

SEQ ID NO: 22456 - protein, 443 aa, Ananas comosus
MEVFYYVVFGGLAMVVALLELSKTSKDRVSTSSAFNSFKNNYLVVYSLMMAGDWLQGPYVYFLYSQYGFDKGDIGRLFIAGFGSSMLFGTIVGSLADKQGRKRACVTYCITYILSCITKHSPEYKVLMVGRILGGIATSLLFSAFESWLVAEHNKRGFDPQWLSLIFSKAIFLGNGLIAIVSGLFANMLADNLGFGPVAPFDAAACFLAIGMAIILSSWTENYGDPSDSKDLMGQFKVAATAIASDEKIALLGAIQSLFEGSMYTFVFLWTPALSPNDEEIPHGFIFATFMMSSMLGSSIASRLLARVTLKVESYMQIVFVVSAFTLLLPVIINFLVAPSTGKDASLPFGGCILLFGFCIFESCVGIFWPSMMKMRSQYIPEEARSTIMNFFRIPLNLFVCVVLYNVNAFPITVMFGMCSIFLFMASILQRRLMVIADRPKSS

SEQ ID NO: 22457 - protein, 461 aa, Amborella trichopoda
MEVFYYLVFGVLSVVVAVLELSKTSKDRITTSSAFNSFKNNYLVVYSLMMAGDWLQGPYVYFLYSQYGFSKGEIGRLFIAGFGSSMLFGTVVGSLADKQGRKRACITYCITYILSCITKHSPQYKVLMLGRILGGIATSLLFSAFESWLVAEHFKRGFEAQWLSFTFSKAIFLGNGLVAIVSGLFANFIADNLGFGPVAPFDAAACFLAIGMAIILSSWTENYGDPSESKDLLTQFKGAAVAIASDEKIALLGAIQSLFEGSMYTFVFLWTPALSPNDEDIPHGFIFATFMLASMLGSSIASRLMARASLKVESYMQIVFIISAFTLLLPILTTFLVVPSNIKGGSISFSGSIQLFGFCIFESCVGIFWPSIMKMRSQYIPEEARSTIMNFFRIPLNIFVCIVLYNVNAFPITVMFGMCSIFLFMASVLQRRLMIVAESHKSKPQDTWAKERDVEEEPLNI

SEQ ID NO: 22458 - protein, 462 aa, Phalaenopsis aphrodite
MELFYYLLFAVLSAVVALLELSKTSKDRIATSTAFNSFKNNYLVVYSLMMAGDWLQGPYVYFLYSQYGFDKGDIGRLFIAGFGSSMLFGTIVGSLADKQGRRRACVTYCITYILSCITKHSPQYKVLMLGRILGGIATSLLFSAFESWLVAEHNKRGFEPQWLSLTFSKAIFLGNGLVAIVSGLFANILADNLGFGPVAPFDAAACFLAIGMAIILSSWSENFGDSSDNKSLLSQFKGAAVAIASDEKIALLGAIQSLFEGSMYTFVFLWTPALSPNEEDIPHGFIFATFMLSSMLGSSTASRLLARSTPKVESYMQIIFGISALTLLLPIITNFLVSSTGVKGGSISVAGCIQLFGFCTFEACVGIFWPSIMKMRSQYIPEEARSTIMNFFRIPLNIFVCVVLYNVNAFPITVMFGMCSIFLFMAAVLQRRLMVVSESHKSKPQDWMAVKERDNETEPLNI

SEQ ID NO: 22459 - protein, 462 aa, Aquilegia formosa
MELFYFLVFGGLSLIVAALELSKNNKDRINTSTVFNSFKNNYVLVYSLMMAGDWLQGPYVYYLYSQYGFGKGDIGRLFIAGFGSSMLFGTIVGSLADKQGRKRACVTYCITYILSCFTKHSPEYKVLMVGRILGGIATSLLFSSFESWLVAEHNKRGFEQQWLSLTFSKAIFFGNGLVAILAGLFGNVLADTLGFGPVAPFDAAAVFLAIGMAIILSSWNENYGDPSESKDLLTQFRGAAVAIGSDEKIALLGAIQSLFEGSMYTFVFLWTPALSPNDEEIPHGFIFATFMLSSMLGSSLASRLLARATFKVESYMQIVFAVSAGTFLLPIITSYIVPPSKVKGGGISFAGCIQVLGFCTFEACVGLFWPSIMKMRSQYIPEEARSTIMNFFRIPLNIFVCIVLYNVNAFPITVMFGMCSIFLFMASILQRRLMVVAESHRTKSQEWTSMKERETEEEPLNI

SEQ ID NO: 22460 - protein, 462 aa, Musa acuminata
MEAFYWLLFGGLAAVVAALEMSKTNRDRAATSSAFNSFKNNYLLVYSLMMAGDWLQGPYVYYLYSQYGYGKGDIGRLFIAGFGSSMLFGTIVGSLADKQGRKRASVTYCITYILSCITKHSPQYKVLMLGRILGGIATSLLFSAFESWLVAEHNKRGFEPQWLSITFSKAIFLGNGLVAIIAGLFANLLTDNLGFGPVAPFDAAACFLAIGMAVILSTWTENYGDPSESKNLVTQFKVAASAISSDTKIALLGAIQSLFEGSMYTFVFLWTPALSPNDEDIPHGFIFATFMLSSMLGSSIASRLLSRAAPKVESYMQLVFAIAAVTLLLPVITSFLVAPSTVKGGSISFGGCIQLFGFCTFEACVGIFWPSIMKMRSQYIPEEARSTIMNFFRIPLNIFVCVVLYNVNAFPMTVMFAMCSVFLFLASILQRRLMIVAESHRSKSEDWTSLKERDAEAEPLNI

SEQ ID NO: 22461 - protein, 457 aa, Papaver somniferum
LVFGAMSVVVAVLEFSKNNKDRINTSTAFNAFKNNYLVVYSLMMAGDWLQGPYVYFLYSQYGFSKGDIGRLFIAGFGSSMLFGTVVGSLADKTGRKRACITYCITYILSCITKHSPQYKVLMVGRILGGIATSLLFSAFESWLVAEHNKRGYEQQWLSLTFSKAIFLGNGLIAIFAGLFGNMLADNLGFGPVAPFDAAACFLAIGMAIILSTWSENFGDPSESKDLLTQFRGAAVAIASDEKIALLGAIQSLFEGSMYTFVFLWTPALSPNDEDIPHGFIFATFMLASMLGSSIASRLMARQNLKVEGYMQIVFAVSACTFLLPLVTGFLVPPSGEKGGSISFAGCIQLFGFCTFESCVGIFWPSIMKMRSQYIPEEARSTIMNFFRIPLNIFVCIVLYNVNAFPITVMFGMCSIFLLMASILQRRLMVVAELHNKSKPEDWTSLKERDTEAEPLNI

SEQ ID NO: 22462 - protein, 462 aa, Amorphophallus konjac
MEMFYYLLFGALSLVVAGLECSKTSKDRITTSSVFNSFKNNYLVVYSLMMAGDWLQGPYVYFLYSQYGFDKGDIGRLFIAGFGSSMLFGTIVGSLADKQGRRRACVTYCITYILSCITKHSPQYKVLMLGRILGGIATSLLFSAFESWLVAEHNKRGFDPQWLSLTFSKAIFLGNGLVAIVSGLFANLLTDNLGLGPVAPFDAAACFLAIGMAIILSSWTENYGDPSESKDLLTQFRGAAVAIASDEKIALLGAIQSLFEGSMYTFVFLWTPALSSNEENIPHGFIFATFMLSSMLGSSIASRLMTRASLKVESYMQIVFVISALTLLLPIVTSFLVAPSSVKGGSISFSGSIQLFGFCIFEACVGIFWPSIMKMRSQYIPEEARSTIMNFFRIPLNIFVCIVLYNVNAFPITVMFGMCSIFLLMASVLQRRLMVVAETHKSKPQDWTALKERDSEAEPLSV

SEQ ID NO: 22463 - protein, 461 aa, Tabernaemontana elegans
MELFYYLVFGGLAAVVAALELSKNNKDRIVTSQPFNSFKNNYLLVYSLMMAGDWLQGPYVYYLYSVYGFGKGDIGQLFIAGFGSSMLFGTIVGSLADKQGRKRACVTYCITYILSCITKHSPQYKVLMLGRVLGGIATSLLFSAFESWLVAEHFKRGFDQQWLSLTFSKAIFLGNGLVAILAGLFGNLLVDTLSLGPVSPFDAAACFLAIGMAVIMSSWTENYGDPSESKDLLTQFKNAAVAIASDEKIALLGAIQSLFEGSMYTFVFLWTPALSPNNEEIPHGFIFATFMLASMLGSSIASRLLARNSLKVESYMQIVFIISSASLLLPIITSFLVAPSKVKGGGITFAGCLQLLGFCTFESCVGIFWPSIMKMRSQYIPEEARSTIMNFFRIPLNIFVCIVLYNVDAFPITVMFGMCSIFLFMASVLQRRLAVIADKPKTDDWTAMKEKDTEAEPLNVP

SEQ ID NO: 22464 - protein, 460 aa, Elaeis guineensis
MEALYYLVFGGLSVVVALLEFSKTSKDRISTSVAFNSFKNNYIVVYSLMMAGDWLQGPYVYYLYHTYGFGKGEIGRLFIAGFGSSMLFGTIVGSLADKQGRKRACVTYCISYILSCITKHSPEFKVLMLGRILGGIATSLLFSAFESWLVAEHNKRGFEPQWLSLTFSKAIFIGNGLVAIVCGLFANLLTDTLGFGPVSPFDAAACFLAIGMAIILSTWGENYGDPSESKDLLSQFKVAAVAIASDEKIALLGAIQSLFEGSMYTFVFLWTPALSPNDEDIPHGFIFATFMLSSMLGSSIASRLMARAKVEGYMQVVFAISSITLLLPVITSFLVTSSSVKGGSISIGGCILLVGFCTFEACVGIFWPSIMKMRSQYIPEEARSTIMNFFRIPLNIFVCIVLYNVDAFPMTVMFGMCSIFLFIASILQRRLMVVAESHRSKTQDWTAMKERDDEAEPLNI

SEQ ID NO: 22465 - protein, 455 aa, Allium cepa
METFYYLVFGALSVVVAVLELSKSSNDRANTSSAFNSFKNNYLVVYSLMMAGDWLQGPYVYYLYTTYGFDKGDIGRLFIAGFGSSMLFGTIVGSLADKTGRKRACVTYCITYILSCITKHSPQYKILMVGRILGGIATSLLFSSFESWLVAEHNKRGFEPQWLSLTFSKAIFLGNGLVAIIAGLFANMLADNLGFGPVAPFDAAACFLAIGMAVILSTWTENYGDPSDSKDLITQFRNAASAIVSDEKIALLGAIQSLFEGSMYTFVFLWTPALSPNEEDIPHGFIFATFMLSSMLGSSIASRLMARPVVRVESYMQIVFLISSFTLLLPIITTFLGTTPSVKGGSISFAGCIQLFGFCTFEACCGLFWPSIMKMRSQYIPEEARSTIMNFFRIPLNIFVCVVLYNVNAFPITIMFGMCSIFLFIASILQRRLMVVSEAHRSKSQRDTEVVPLNL

SEQ ID NO: 22466 - protein, 464 aa, Musa acuminata
MEVFYYVVFGGLAAVAAVMELSKTSKDRIATSSAFNAFKNNYCLVYSLMMAGDWMQGPYVYYLYSQYGFDKGDIGRLFIAGFGSSMLFGTIVGSLADKRGRKRACITYCITYILSCITKHSPQYKVLLLGRILGGIATSLLFSAFESWLVAEHNKRGFDPQWLSVTFSKAIFLGNGLIAIVSGLFANLLADNLGFGPVAPFDAAACLLGIGMAIILSSWGENYGDPSNSKDLITQFKGAAVAIAADEIIALLGAIQSLFEGSMYTFVFLWTPALSPNDEDIPHGFIFATLMLSSMLGSSIASRLMARSTLRVEFYMQIVFAVSAFTLLLPLISNFFVAPSTVKGGSISFSGCVQLLGFCVFEACIGIFWPSMMKMRSQYIPEESRSTIMNFFRIPLNIFVCIILYNVNAFPISIMFGMCSIFLFMASVLQRRLMVVAETHKSKPHDWTTLKEKDSESDMLSIQI

SEQ ID NO: 22467 - protein, 462 aa, Arabidopsis lyrata
MEIFYFVVFGGLAAIVAGLELSKSNKDRINTSSAFNSFKNNYLLVYSLMMAGDWLQGPYVYYLYSTYGFGKGEIGQLFIAGFGSSMLFGTIVGSLADKQGRKRASITYCITYILSCITKHSPQYKVLMVGRVLGGIATSLLFSAFESWLVAEHNKRGFEQQWLSLTFSKAIFLGNGLVAIIAGLFGNFLVDSLALGPVAPFDAAACFLAIGMAVIISSWSENYGDPSENKDLLTQFKNAASAIASDEKIALLGAIQSLFEGSMYTFVFLWTPALSPNEEDIPHGFIFATFMLASMLGSSIASRLLAHSAPKVESYMQIVFVISSTALMLPVVTSFLVAPSGVKGGSISFSGCIQLMGFCTFEACVGIFWPSIMKMRSQYIPEEARSTIMNFFRIPLNIFVCLVLYNVDAFPMTVMFGMCSVFLFVASILQRRLMNVAEIHKSRSQEWSAEKEMTSEADPLNP

SEQ ID NO: 22468 - protein, 462 aa, Arabidopsis thaliana
MEIFYFVVFGGLAAIVAGLELSKSNKDRINTSSAFNSFKNNYLLVYSLMMAGDWLQGPYVYYLYSTYGFGKGEIGQLFIAGFGSSMLFGTIVGSLADKQGRKRASITYCITYILSCITKHSPQYKVLMVGRVLGGIATSLLFSAFESWLVAEHNKRGFEQQWLSVTFSKAIFLGNGLVAIIAGLFGNYLVDSLSLGPVAPFDAAACFLAIGMAVIISSWSENYGDPSENKDLLTQFKNAASAIASDEKIALLGAIQSLFEGSMYTFVFLWTPALSPNEEDIPHGFIFATFMLASMLGSSIASRLLAHSSPKVESYMQIVFVISSAALMLPVVTSFLVAPSGVKGGSISFSGCIQLMGFCTFEACVGIFWPSIMKMRSQYIPEEARSTIMNFFRIPLNIFVCLVLYNVDAFPMTVMFGMCSVFLFVASILQRRLMNVAEIHKSRSQEWSAEKEMTSEADPLNP

SEQ ID NO: 22469 - protein, 460 aa, Ricinus communis
MEMFYFMVFGGLAAVVAAIELSKTSRDRVNTTSAFNAFKNNYLLVYSLMMAGDWLQGPYVYYLYSTYGFGKGEIGQLFIAGFGSSMLFGTIVGSLADKQGRRRACVTYCITYILSCITKHSPEYKVLMLGRVLGGIATSLLFSAFESWLVAEHFKRGFDQQWLSVTFSKAIFLGNGLVAIMAGLFGNLLVDNLGLGPVAPFDAAACFLAIGMAIILSSWTENYGDTSESKDLLSQFKGAAVAIASDEKIALLGAIQSLFEGSMYTFVFLWTPALSPNGEDIPHGFIFATFMLASMLGSSIASRLMARSSIKVESYMQIVFIISAASLLLPVITSFLIVPSGVRGGGISFSACVQLLGFCTFEACVGIFWPSIMKMRSQYIPEEARSTIMNFFRIPLNIFVCVVLYNVDAFPIIVMFGMCSIFLFVASLLQRRLMIIAESQKSRSQDWTAMREMEAEPLNA

SEQ ID NO: 22470 - protein, 460 aa, Vitis vinifera
MEVFYFLVFGALSAVVAVIELSKNNKDRVNTTTAFNSFKNNYLLVYSLMMAGDWLQGPYVYFLYSTYGFGKGEIGQLFIAGFGSSMLFGTIVGSLADKQGRKRACVTYCITYILSCITKHSPQYRILMVGRVLGGIATSLLFSAFESWLVAEHNKRGFEQQWLSVTFSKAIFLGNGLVAILSGLFGNLLVDNLSLGPVAPFDAAACFLAVGMAVILSSWSENYGDPSENKDLLTQFKGAAVAIASDEKIALLGAIQSLFEGSMYTFVFLWTPALSPNEEEIPHGFIFATFMLASMLGSSVASRLLARASLKVESYMQIVFVISSASLLLPIVTNILVEPSKVKGGSISFAGCVQLLGFCTFEACVGIFWPSIMKMRSQYIPEEARSTIMNFFRIPLNIFVCIVLYNVNAFPITVMFGMCSIFLFVASILQRRLMVIADKSKTEDWASMKDKNMEAEPLNI

SEQ ID NO: 22471 - protein, 455 aa, Allium cepa
METFYYLVFGALSVVVAALELSKSSNDRANTSSAFNSFKNNYLVVYSLMMAGDWLQGPYVYYLYTTYGFDKGDIGRLFIAGFGSSMLFGTIVGSLADKTGRKRACVTYCITYILSCITKHSPQYKILMVGRILGGIATSLLFSSFESWLVAEHNKRGFEPQWLSLTFSKAIFLGNGLVAIIAGLFANMLADNLGFGPVAPFDAAACFLAIGMSVILSTWTENYGDPSDSKDLITQFRSAASAIVSDEKIALLGAIQSLFEGSMYTFVFLWTPALSPNEEDIPHGFIFATFMLSSMLGSSIASRLMARPVVRVESYMQIVFLISSFTLLLPIITTFLGTTPSVKGGSISFAGCIQLFGFCTFEACCGLFWPSIMKMRSQYIPEEARSTIMNFFRIPLNIFVCVVLYNVNAFPITIMFGMCSIFLFIASILQRRLMVVSEAHRSKSQRDTEVVPLNL

SEQ ID NO: 22472 - protein, 462 aa, Eutrema halophilum
MEIFYIVVFGGLAAIVAGLELSKSNKDRINTSSAFNSFKNNYLLVYSLMMAGDWLQGPYVYYLYSTYGFGKGEIGQLFIAGFGSSMLFGTIVGSLADKQGRKRASITYCITYILSCITKHSPQYKILMVGRVLGGIATSLLFSAFESWLVAEHNKRGFEQQWLSVTFSKAIFLGNGLVAIIAGLFGNFLVDSLSLGPVAPFDAAACFLAIGMAVIISSWSENYGDPSENKDLLTQFKNAASAIASDEKIALLGAIQSLFEGSMYTFVFLWTPALSPNDEDIPHGFIFATFMLASMLGSSIASRLLAHSSPKVESYMQIVFVISSAALMLPVLTSFLVAPSGVKGGSISFSGCIQLMGFCTFEACVGIFWPSIMKMRSQYIPEEARSTIMNFFRIPLNIFVCLVLYNVDAFPMTVMFGMCSVFLFVASILQRRLMNVAEIHKSRSQEWSAAKEMTSEADPLNP

SEQ ID NO: 22473 - protein, 462 aa, Eutrema parvulum
MEIFYFVVFGGLAAIVAGLELSKSNKDRINTSSAFNSFKNNYLLVYSLMMAGDWLQGPYVYYLYSTYGFGKGEIGQLFIAGFGSSMLFGTIVGSLADKQGRKRASITYCITYILSCITKHSPQYKVLMVGRVLGGIATSLLFSAFESWLVAEHNKRGFEQQWLSVTFSKAIFLGNGLVAIIAGLFGNFLVDSLSLGPVAPFDAAACFLAIGMAVIISSWSENYGDPSENKDLLTQFKNAASAIASDEKIALLGAIQSLFEGSMYTFVFLWTPALSPNDEDIPHGFIFATFMLASMLGSSIASRLLAHSSPKVESYMQIVFVISSAALMLPVVTSFLVAPSGVKGGSISFSGCIQLMGFCTFEACVGIFWPSIMKMRSQYIPEEARSTIMNFFRIPLNIFVCLVLYNVDAFPMTVMFGMCSVFLFVASILQRRLMNVAEIHRSRSQEWSAAKEMTSEADPLNP

SEQ ID NO: 22474 - protein, 459 aa, Spinacia oleracea
MEWFFYLLFGSLSAVVAVIELSKNNKDRINTSTAFNSFKNNYVLVYSLMMAGDWLQGPYVYYLYSTYGFGKGDIGQLFIAGFGSSMLFGTIVGSLADKQGRKRACVTYCITYILSCITKHSPQYKVLMLGRILGGIATSLLFSAFESWLVAEHNKRGFEQQWLSVTFSKAIFLGNGLVAILSGLVGNLLVDTFGFGPVAPFDAAACLLAIGMAIILSSWTENYGDPSENKDLLAQFKGAAIAIASDEKIALLGAIQSLFEGSMYTFVFLWTPALSPNDEEIPHGFIFATFMLASMLGSSIASRLLARSSPRVESYMQIVFSISAVSLLLPIVTNFLVEPSKVKGGGISFSGCIQVLGFCAFEACVGIFWPSIMKMRSQYIPEEARSTIMNFFRIPLNIFVCVVLYNVNAFPITVMFGMCSIFLFVASILQRRLMAISEKPKTEAYGLKERDTESEPMNI

SEQ ID NO: 22475 - protein, 459 aa, Citrullus lanatus
MEIFYFLVFGALSLVVAALELTKTNKDRINTPSAFNAFKNNYLLVYSLMMAGDWLQGPYVYYLYSQYGFGKGEIGQLFIAGFGSSMLFGTIVGSLADKQGRKRACITYCITYILSCITKHSPEYKVLMLGRVLGGIATSLLFSAFESWLVAEHNKRGFEQQWLSITFSKAIFLGNGLVAILAGLFGNVLVDSLSLGPVAPFDAAACFLAIGMAIIMSSWTENYGDPSENKDLLTQFRGAAVAIASDEKIALLGAIQSLFEGSMYTFVFLWTPALSPNNEDIPHGFIFATFMLASMLGSSLASRLMARNSPKVESYMQIVFIVSSASLVLPIVTSFLVAPSDVKGGSISFAGCIQLLGFCVFEACVGIFWPSIMKMRSQYIPEEARSTIMNFFRIPLNIFVCVVLYNVDAFPITVMFGMCAIFLFVASILQRRLQAIAEKPKSGDWGLSEKNSEADPLNI

SEQ ID NO: 22476 - protein, 460 aa, Citrullus lanatus
MEVFYYFVFGGLGAIVAAIELTKNNRDRINTTTAFNSFKNNYLLVYSLMMAGDWLQGPYVYYLYSQYGYGKGEIGQLFIAGFGSSMLFGTIVGSLADKQGRKRACVTYCITYILSCITKHSPQYKVLMLGRILGGIATSLLFSAFESWLVAEHNKRGFEQQWLSITFSKAIFLGNGLIAILSGLFGNVLVDSLALGPVAPFDAAACFLALGMAIILSSWTENYGDPSENKDLLTQFRGAAVAIASDEKIALLGAIQSLFEGSMYTFVFLWTPALSPNNEEIPHGFIFATFMLASMLGSSLASRLLARASLRVENYMQIVFIVSAASLVLPIVTSFLVAPSQVKGGSISFSGCIQLIGFCVFEACVGIFWPSIMKMRSQYIPEEARSTIMNFFRIPLNIFVCVVLYNVDAFPITVMFGMCSIFLFVASILQRRLMVIADKLKTETRPTFREKDAEMEPLNA

SEQ ID NO: 22477 - protein, 740 aa, Glycine max
MASTSSLHLSQALLARAVYLHGSSSDRVSLSFPSFSGLKSHSPCKAAATSSRRRGACASTSVVRAAAVETLDQTTEVSLVEKSVNTIRFLAIDAVEKANSGHPGLPMGCAPMGHILYDEVMRYNPKNPTWFNRDRFILSAGHGCMLQYALLHLAGYDSVLEEDLKEFRQWGSRTPGHPENFETVGIEVTTGPLGQGIANAVGLALAEKHLAARFNKPDNEIVDHYTYVILGDGCQMEGISNEACSLAGHWGLGKLIALYDDNHISIDGDTEIAFTENVDQRFEALGWHVIWVKNGNTGYDEIRAAIKEAKAVKDKPTMIKVTTTIGFGSPNKANSYSVHGSALGTKEVDATRKNLGWPYEPFHVPEDVKKHWSRHTPEGAKLEAEWNAKFAEYEKKYSEEAAELKAIITGELPAGWEKALPTYTPESPADATRNLSQQNLNALVKVLPGLLGGSADLASSNMTLLKSYGDFQKNTPEERNVRFGVREHGMGAICNGIALHSPGFIPYCATFFVFTDYMRAAIRISALCEAGVIYVMTHDSIGLGEDGPTHQPIEHLASFRAMPNTLMLRPADGNETAGSYKVAVVNRKRPSILALSRQKLTQLPGTSIEGVEKGGYIISDNSSGNKPDVILIGTGSELEIAAAAAEDLRKEGKAVRVVSFVSWELFDEQSDEYKESVLPASVTVRVSIEAGSTFGWQKIVGSQGKAIGIDRFGASAPAGKIYKEFGITKEAVIAAAKELS

SEQ ID NO: 22478 - protein, 742 aa, Glycine max
MASSSSLHLSQALLARAVYLHGSSSSDRVSLSFPSFSGLKSHSTCKAAAATSSRRRGACPSTNVVRAAAVETLDQTTEVSLVEKSVNTIRFLAIDAVEKANSGHPGLPMGCAPMGHILYDEIMRYNPKNPAWFNRDRFVLSAGHGCMLQYALLHLAGYDTVQEQDLKEFRQWGSRTPGHPENFETLGVEVTTGPLGQGIANAVGLALAEKHLAARFNKPDNEIVDHYTYVILGDGCQMEGISNEACSLAGHWGLGKLIALYDDNHISIDGDTEIAFTENVDQRFEALGWHVIWVKNGNTGYDEIRAAIKEAKAVKDKPTLIKVTTTIGFGSPNKANSYSVHGSALGAKEVDATRKNLGWPYEPFHVPEDVKKHWSRHTPEGAKLEAEWNAKFVEYEKQYSEEAAELKAIITGELPAGWEKALPTYTPESPADATRNLSQQNLNALVKVLPGLLGGSADLASSNMTLLKSYGDFQKNTPEERNVRFGVREHGMGAICNGIALHSPGFIPYCATFFVFTDYMRAAIRISALCEAGVIYVMTHDSIGLGEDGPTHQPIEHLASFRAMPNTLMLRPADGNETAGSYKVAVVNRKRPSILALSRQKLTQLPGTSIEGVEKGGYTISDNSSGNKPDVILIGTGSELEIAAAAAEDLRKEGKAVRVVSFVSWELFDEQSDEYKESVLPASVTARVSIEAGSTFGWHKIVGSKGKAIGIDRFGASAPAGKIYKEFGITKEAVIAAAKELS

SEQ ID NO: 22479 - protein, 745 aa, Cajanus cajan
MASSSSLHLSQALLARAVYLHGFNSSSSDRVSLTFPSFSGLKSHSPCKAATSTSASRRRGGAISTTTVRATAVETLDQTTEVSLVEKSINTIRFLAIDAVEKANSGHPGLPMGCAPMGHILYDEVMRYNPKNPTWFNRDRFVLSAGHGCMLQYALLHLAGYDSVQEEDLKNFRQWGSRTPGHPENFETVGVEVTTGPLGQGIANAVGLALAEKHLAARFNKPDNEIVDHYTYVILGDGCQMEGISNEACSLAGHWGLGKLIALYDDNHISIDGDTEIAFTENVDQRFEALGWHVIWVKNGNTGYDEIRAAIKEAKAVKDKPTLIKVTTTIGFGSPNKANSYSVHGSALGAKEVDATRKNLGWPYEPFHVPEDVKKHWSRHAPDGAKLEAEWNAKFSEYEKKYSEEAAELKAIITGELPAGWEKALPTYTPESPADATRNLSQQNLNALVKVLPGLLGGSADLASSNMTLLKSYGDFQKATPEERNVRFGVREHGMGAICNGIALHSPGFIPYCATFFVFTDYMRAAIRISALCEAGVIYVMTHDSIGLGEDGPTHQPIEHLASFRAMPNVLMLRPADGNETAGSYKVAVLNKKRPSILALSRQKLPQLPGTSIEGVEKGGYIISDNSSGNKPDIILIGTGSELEIAAAAAEDLRKEGKAVRVVSFVSWELFEEQSDEYKESILPASVSARVSIEAGSTFGWHKIVGSKGKAIGIDRFGASAPAGKIYKEFGITKEAVIAAAKEVS

SEQ ID NO: 22480 - protein, 739 aa, Cicer arietinum
MASSLHLSQALLARAVYLNSDRGSLSSSSSSSTSTLSFPSLKSSSCKPATYSPGSRRRTTTVRATAVETLDKTAELSLVEKSVNTIRFLAIDAVEKANSGHPGLPMGCAPMGHILYDEIMRYNPKNPSWFNRDRFVLSAGHGCMLQYALLHLAGYDSVKEEDLKEFRQWGSKTPGHPENFETYGIEVTTGPLGQGIANGVGLALAEKHLAARFNKPDSEIVDHYTYVILGDGCQMEGISNEACSLAGHWGLGKLIAFYDDNHISIDGDTEIAFTEDVDKRFEALGWHVIWVKNGNTGYDEIRAAIKEAKTVTDKPTLIKVTTTIGFGSPNKANSYSVHGAALGAKEVDATRQNLGWPYEPFHVPEDVKKHWSRHTPEGAALEAEWNAKFAEYEKKYAEEAAELKAIITRELPAGWEKALPTYTPETPADATRNLSQQNLNALAKVLPGLLGGSADLASSNMTLLKSFGDFQKGTPEERNVRFGVREHAMGAICNGIALHSPGFIPYCATFFVFTDYMRAAIRISALCEAGVIYVMTHDSIGLGEDGPTHQPIEHLASFRAMPNVLMLRPADGNETAGAYRVAVLNQKRPSILALSRQKLPNLPGTSIEGVEKGGYIISDNSSGNKPDVILIGTGSELEIAAAAADDLRKEGKAVRVVSFVSWELFDDQSDEYKESVLPSSVTARVSIEAGSTFGWHKIVGSKGKTIGIDRFGASAPAGKIYKEFGITKEAVISAAKEVS

SEQ ID NO: 22481 - protein, 751 aa, Lupinus angustifolius
MASSSSLYLSQALLARAVHGLNPSSDRVSLSTSTLYLPSFSGLRSHSSSTSSSCKAPTSTSSSRRVSSSSSSSVRATAIETLDKTTDVTLVEKSINTIRFLSIDAVEKANSGHPGLPMGCAPMGHILYDEVMRYNPKNHTWFNRDRFILSAGHGCMLQYALLHLAGYDSVLEEDLKSFRQWGSRTPGHPENFETLGIEVTTGPLGQGIANAVGLALAEKHLAARFNKPDSEIVDHYTYVILGDGCQMEGISNEAASLAGHWGLGKLIAFYDDNHISIDGDTEIAFTESVDKRFEGLGWHVIWVKNGNTGYDEIRAAIKEAKTVTDKPTLIKVTTTIGYGSPNKSNSYSVHGSALGAKEVDATRKNLAWPYEPFHVPEDVKKHWSRHTPEGAALEAEWNAKFAEYEKKYKEEASELKYIISGEFPAGWEKALPTYTPENPADATRNLSQQNLNSLVKVLPGLIGGSADLASSNMTLLKSFGDFQKDTPEERNIRFGVREHGMGAICNGIALHSPGFIPYCATFFVFTDYMRAAIRISALSEAGVIYVMTHDSIGLGEDGPTHQPIEHLASFRAMPNILMLRPADGNETAGSYKVAVVNRKRPSIIALSRQKLPNLSGTSIEGVEKGGYTISDNSSGNKPDVILIGTGSELEIAAAAAEDLRKEGKAVRVVSFVSWELFDDQSDEYKESVLPAAVTARVSIEAATTFGWEKIVGSKGKAIGIDRFGASAPAGKIYKEFGITKEAVIAAAKELS

SEQ ID NO: 22482 - protein, 747 aa, Lupinus angustifolius
MASSSSLHLSQALLARAVHGCFNPSSDRLSLSTSTLSLPPFSTLRSHSSSTSSPCKTYSSNSSRRRVGSVRASAVETLDKTTEVSLVEKSINTIRFLSIDAVEKANSGHPGLPMGCAPMGHILYDEIMRYNPKNPTWFNRDRFVLSAGHGCMLQYALLHLAGYDSVLEEDLKSFRQWGSRTPGHPENFETIGIEVTTGPLGQGIANAVGLALAEKHLAARFNKPDSEIVDHYTYVILGDGCQMEGISNEAASLAGHWGLGKLIAFYDDNHISIDGDTEIAFTESVDKRFEGLGWHVIWVKNGNTGYDEIRAAIKEAKTVKDKPTLIKVTTTIGYGSPNKSNSYSVHGSALGAKEVDATRKNLGWPYEPFHVPEDVKKHWSRHTPEGAAVEAEWNAKFAEYEKKYKEEATELKYIISGEFPAGWEKALPTYTPEIPADATRNLSQQNLNALVKVLPGLIGGSADLASSNMTLLKSFGDFQKDTPEERNIRFGVREHGMGAICNGIALHSPGFIPYCATFFVFTDYMRAAIRISALSEARVIYVMTHDSIGLGEDGPTHQPIEHLSSFRAMPNILMLRPADGNETAGSYKVAVVNRKRPSIIALSRQKLPNLAGTSIEGVEKGGYTISDNSSGNKPDVILIGTGSELEIAAAAAEDLRKEGKAVRVVSFVSWELFDDQSDEYKESVLPAAVTARVSIEAATTFGWGKIVGSKGKAIGIDRFGASAPAGKIYKEFGITKEAVIAAAKELS

SEQ ID NO: 22483 - protein, 745 aa, Gossypium hirsutum
MASTSSVTLSQALLSRAISSHASAQSSDHRPSLSTLSFPGFSGLKSSIPRASSSRRRLPSRSNHKRQVRAAAVETIGTAAETSLVEKSVNTIRFLSIDAVEKANSGHPGLPMGCAPMGHILYDEVMRYNPKNPYWFNRDRFILSAGHGCMLQYALLHLAGYDSVLEEDLKSFRQWGSRTPGHPENFETPGVEVTTGPLGQGIANAVGLALAEKHLAARFNKPDNEIVDHYTYVILGDGCQMEGISNEACSLAGHWGLGKLIAFYDDNHISIDGDTEIAFTENVDTRFEGLGWHVIWVKNGNTGYDEIRAAIKEAKAVKDKPTLIKVTTTIGYGSPNKANSYSVHGSALGAKEVDATRKNLGWPYEPFHVPEDVKAHWSRHTPQGAALEAEWNAKFAEYEQKYKEEAAELKAIITGELPAGWEKALPTYTPESPADATRNLSQQNLNALVKVLPGLLGGSADLASSNMTLLKMYGDFQKDTPEERNVRFGVREHGMGAICNGIALHSPGFIPYCATFFVFTDYMRAAIRISALCEAGVIYVMTHDSIGLGEDGPTHQPIEHLASFRAMPNVLMLRPADGNETAGAYKVAVLNRKRPSILALSRQKLPQLPGTSIEGVEKGGYIISDNSSGNNPNVILIGTGSELEIAAKAADELRKEGKTVRVVSFVSWELFDEQSDAYKESVLPSAVSARVSIEAGSTFGWAKIVGSKGKAIGIDRFGASAPAGKIYKEFGLTPEAVVAAAKELC

SEQ ID NO: 22484 - protein, 745 aa, Gossypium raimondii
MASTSSVTLSQALLSRAISSHASAQSSDHRPSLSTISFPGFSGLKSSIPRASSSRRRLPSRSNHKRQVRAAAVETIGTAAETSLVEKSVNTIRFLSIDAVEKANSGHPGLPMGCAPMGHILYDEVMRYNPKNPYWFNRDRFILSAGHGCMLQYALLHLAGYDSVLEEDLKSFRQWGSRTPGHPENFETPGVEVTTGPLGQGIANAVGLALAEKHLAARFNKPDNEIVDHYTYVILGDGCQMEGISNEACSLAGHWGLGKLIAFYDDNHISIDGDTEIAFTENVDTRFEGLGWHVIWVKNGNTGYDEIRAAIKEAKAVKDKPTLIKVTTTIGYGSPNKANSYSVHGSALGAKEVDATRKNLGWPYEPFHVPEDVKAHWSRHTPQGAALEAEWNAKFAEYEQKYKEEAAELKAIITGELPAGWEKALPTYTPESPADATRNLSQQNLNALVKVLPGLLGGSADLASSNMTLLKMYGDFQKDTPEERNVRFGVREHGMGAICNGIALHSPGFIPYCATFFVFTDYMRAAIRISALCEAGVIYVMTHDSIGLGEDGPTHQPIEHLASFRAMPNVLMLRPADGNETAGAYKVAVLNRKRPSILALSRQKLPQLPGTSIEGVEKGGYIISDNSSGNNPNVILIGTGSELEIAAKAADELRKEGKTVRVVSFVSWELFDEQSDAYKESVLPSAVSARVSIEAGSTFGWAKIVGSKGKAIGIDRFGASAPAGKIYKEFGLTPEAVVAAAKELC

SEQ ID NO: 22485 - protein, 735 aa, Medicago truncatula
MASSSLHLSQAFLARAVYLNPEIRAASLSSTSSLSFPALKSSSSSKPPTSRRRTTPAIRATAVETLDKTTEASLVEKSVNTIRFLAIDAVEKANSGHPGLPMGCAPMGHILYDEVMRYNPKNPSWFNRDRFVLSAGHGCMLQYALLHLAGYDSVQEDDLKQFRQWGSKTPGHPENFETYGIEVTTGPLGQGIANGVGLALAEKHLAARFNKPDSEIVDHYTYVILGDGCQMEGISNEACSLAGHWGLGKLIAFYDDNHISIDGDTEIAFTENVDQRFEALGWHVIWVKNGNTGYDEIRAAIKEAKAVTDKPTLIKVTTTIGFGSPNKANSYSVHGAALGAKEVDATRQNLGWPYEPFHVPEDVKKHWSRHTPEGAALEAEWNAKFAEYEKKYKEEAAELKAIINRELPADWEKALPTYTPETPADATRNLSQQNLNALAKVLPGLIGGSADLASSNMTLLKSFGDFQKATPEERNVRFGVREHAMGAICNGIALHSPGFIPYCATFFVFTDYMRAAIRISALCEAGVIYVMTHDSIGLGEDGPTHQPIEHLASFRAMPNVLMLRPADGNETAGSYRVAVLNQKRPSILALSRQKLPNLPGTSIEGVEKGGYTISDNSSGNKPDVILIGTGSELEIAAAAADDLRKEGKTVRVVSFVSWELFDDQSDEYKESVLPASVTARVSIEAGSTFGWHKIVGSKGKTIGIDRFGASAPAGKIYKEYGITKEAVISAAKEVS

SEQ ID NO: 22486 - protein, 738 aa, Trigonella foenum-graecum
MAASSLHLSQAFLARAVYLNSENRAASLSSTSSLSFPALKSSSCKPATSSTASRRRATPTVRATAVETLDKTTEASLVEKSVNTIRFLAIDAVEKANSGHPGLPMGCAPMGHILYDEVMRYNPKNPSWFNRDRFVLSAGHGCMLQYALLHLAGYDSVKDEDLKQFRQWGSKTPGHPENFETYGIEVTTGPLGQGIANGVGLALAEKHLAARFNKPDSEIVDHYTYVILGDGCQMEGISNEACSLAGHWGLGKLIAFYDDNHISIDGDTEIAFTENVDQRFEALGWHVIWVKNGNTGYDEIRAAIKEAKAVTDKPTLIKVTTTIGFGSPNKANSYSVHGAALGSKEVDATRQNLGWPYEPFHVPEDVKKHWSRHTPEGAALEAEWNAKFVEYEKKYKEEATELKAIINRELPADWEKALPTYTPETPADATRNLSQQNLNALAKVLPGLIGGSADLASSNMTLLKSFGDFQKATPEERNVRFGVREHAMGAICNGIALHSPGFIPYCATFFVFTDYMRAAIRISALCEAGVIYVMTHDSIGLGEDGPTHQPIEHLASFRAMPNVLMLRPADGNETAGAYRVAVLNQKRPSILALSRQKLPNLLGTSIEGVEKGGYTISDNSSGNKPDVILIGTGSELEIAAAAADDLRKEGKTVRVVSFVSWELFDDQSDEYKESVLPASVTARVSIEAGSTFGWHKIVGSKGKTIGIDRFGASAPAGKIYKEFGITKEAVISAAKEVS

SEQ ID NO: 22487 - protein, 747 aa, Manihot esculenta
MASTSSLTLSQALLAPAISHHGSAQSSDHHRLSLSTPSLPSFSGLKSTSSIPLATSSVRRRLAARQQIQIRAAAVETLDATAETSLVEKSVNTIRFLAIDAVEKANSGHPGLPMGCAPMGHILYDEIMRYNPKNPYWFNRDRFVLSAGHGCMLQYALLHLAGYDSVKEDDLKSFRQWGSRTPGHPENFETPGVEVTTGPLGQGIANAVGLALAEKHLAARYNKPDNEIVDHYTYVILGDGCQMEGIANEVCSLAGHWGLGKLIAFYDDNHISIDGDTAIAFTESVDKRFEGLGWHVIWVKNGNTGYDEIRAAIKEAKAVKDKPTLIKVTTTIGYGSPNKANSYSVHGSALGAKEVDATRKNLGWPYEPFHVPEDVKKHWSRHVPEGAAFEAEWNAKFAEYEKKYKEEAAELKSIITGELPAGWEKALPTYTPDSPAEATRNLSQTNLNALAKVLPGLLGGSADLASSNMTLLKMFGDFQKDTPEERNVRFGVREHGMGAICNGIALHSPGLIPYCATFFVFTDYMRAAIRISALCEAGVIYVMTHDSIGLGEDGPTHQPIEHLASFRAMPNILMLRPADGNETAGAYKVAVLNRKRPSILALSRQKLPNLAGTSIEGVEKGGYIISDNSSGNKPDVILIGTGSELEIAAKAAEELRKGGKAVRVVSFVSWELFDEQSDAYKESVLPEAVSARVSIEAGSTFGWQKIVGAKGKAIGIDRFGASAPAGKIYKEFGITVEAVIAAAKEAS

SEQ ID NO: 22488 - protein, 745 aa, Gossypium hirsutum
MASSSSLTLSQALLARAISSHGSAQPSDHRVSLSALSIPTFSGLKSASPRASTSCRRLPTRSTRNHQVRSAAVETIGTAAETSLVEKSVNTIRFLAIDAVEKANSGHPGLPMGCAPMGHILYDEVMRYNPKNPYWFNRDRFVLSAGHGCMLQYALLHLAGYDSVREDDLKNFRQWESRTPGHPENFETPGVEVTTGPLGQGIANAVGLALAEKHLAARFNKPDNEIIDHYTYVILGDGCQMEGIANEACSLAGHWGLGKLIAFYDDNHISIDGDTEIAFTESVDKRFEGLGWHVIWVKNGNTGYDEIRAAIKEAKAVKDKPTLIKVTTTIGYGSPNKANSYSVHGSALGAKEVDATRKNLGWPYEPFHVPEDVKGHWSRHVPQGAALEAEWNAKFSAYEKKYKEEAAELKSIITGELPAGWEKALPTYTPESPADATRNLSQQNLNALVKVLPGLLGGSADLASSNMTLLKMFGDFQKDTPEERNVRFGVREHGMGAICNGIALHSPGLIPYCATFFVFTDYMRAAIRISALSQARVIYVMTHDSIGLGEDGPTHQPIEHLASFRAMPNVLMLRPADGNETAGAYKVAVLKRKTPSILALSRQKLPQLAGTSIEGVEKGGYIISDNSSGNNPDVILIGTGSELEIAVKAADELRKEGKAVRVVSLVSWELFDEQSDAYKESVFPSAVTARVSIEAGSTFGWGKIVGSKGKAIGIDRFGASAPAGRIYKEFGLTPEAVIAAAKELC

SEQ ID NO: 22489 - protein, 745 aa, Gossypium raimondii
MASSSSLTLSQALLARAISSHGSAQPSDHRVSLSALSIPTFSGLKSASPRASTSCRRLPTRSTRNHQVRSAAVETIGTAAETSLVEKSVNTIRFLAIDAVEKANSGHPGLPMGCAPMGHILYDEVMRYNPKNPYWFNRDRFVLSAGHGCMLQYALLHLAGYDSVREDDLKNFRQWESRTPGHPENFETPGVEVTTGPLGQGIANAVGLALAEKHLAARFNKPDNEIIDHYTYVILGDGCQMEGIANEACSLAGHWGLGKLIAFYDDNHISIDGDTEIAFTESVDKRFEGLGWHVIWVKNGNTGYDEIRAAIKEAKAVKDKPTLIKVTTTIGYGSPNKANSYSVHGSALGAKEVDATRKNLGWPYEPFHVPEDVKGHWSRHVPQGAALEAEWNAKFSAYEKNYKEEAAELKSIITGELPAGWEKALPTYTPESPADATRNLSQQNLNALVKVLPGLLGGSADLASSNMTLLKMFGDFQKDTPEERNVRFGVREHGMGAICNGIALHSPGLIPYCATFFVFTDYMRAAIRISALSQARVIYVMTHDSIGLGEDGPTHQPIEHLASFRAMPNVLMLRPADGNETAGAYKVAVLKRKTPSILALSRQKLPQLAGTSIEGVEKGGYIISDNSSGNNPDVILIGTGSELEIAVKAADELRKEGKAVRVVSLVSWELFDEQSDAYKESVFPSAVTARVSIEAGSTFGWGKIVGSKGKAIGIDRFGASAPAGRIYKEFGLTPEAVIAAAKELC

SEQ ID NO: 22490 - protein, 744 aa, Populus trichocarpa
MASTSSLTLSQALLARAVSHNAIDHLRDSRLSLVSLPAFSGLKSTTCTATRATTTTSRRRRVSSRQVRAAAVETLDATTETSLVEKSVNTIRFLAIDAVEKANSGHPGLPMGCAPMGHILYDEVMRYNPKNPYWFNRDRFVLSAGHGCMLQYALLHLAGYDSVKEEDLKSFRQWGSRTPGHPENFETPGVEVTTGPLGQGIANAVGLALAEKHLAARFNKPDNEIVDHYTYVILGDGCQMEGISNEACSLAAHWGLGKLIAFYDDNHISIDGDTEIAFTEDVDKRFEGLGWHVIWVKNGNTGYDEIRAAIKEAKSVKDKPTMIKVTTTIGYGSPNKANSYSVHGSALGAKEVDATRQNLGWPYEPFHVPEDVKQHWSRHTPAGAAFEAEWNAKFVEYEKKYSEEAAELKSIANGELPAGWEKALPTYTPESPADATRNLSQQNLNALAKVLPGLLGGSADLASSNMTLLKMFGDFQKDTPEERNVRFGVREHGMGAICNGIALHCPGLIPYCATFFVFTDYMRAAMRISALCEAGVIYVMTHDSIGLGEDGPTHQPIEHLASFRAMPNILMLRPADGNETAGAYKVAVLNRKRPAILALSRQKLPQLPGTSIEGVEKGGYIISDNSSSNKPDVILIGTGSELEIAAKAAEELRKEGKAVRVVSFVSWELFDEQSDAYKESVLPAAVEARVSIEAGSTFGWEKIVGDKGKAIGIDRFGASAPAGKIYKEYGITTEAVIAAAKEVS

SEQ ID NO: 22491 - protein, 742 aa, Rosmarinus officinalis
MASSSSLTLSQAILSRTSIPRHGSAQQLHPSSASIPSFSGLKSASSGVATLSRRRASAMVRHPVSASAAVETLEKTTETELVEKSVNTIRFLAIDAVEKANSGHPGLPMGCAPMGHILYDEVMRYNPKNPYWFNRDRFVLSAGHGCMLQYALLHLAGYDSVKEDDLKNFRQWESRTPGHPENFETPGVEVTTGPLGQGIANAVGLALAEKHLAARYNKPDSEIVDHYTYVILGDGCQMEGISNEAASLAGHWGLGKLIAFYDDNHISIDGDTEIAFTESVDTRFEGLGWHIIWVKNGNTGYDEIRAAIKEAKAVTDKPTLIKVTTTIGFGSPNKANSYSVHGSALGAKEVEATRQNLGWPFEPFHVPEDVKSHWSRHTPEGAALEAEWNAKFAEYEKKYPEESAELKSIITGAFPAGWEKALPTYTPESPADATRNLSQQNLNALAKVLPGLIGGSADLASSNMTLLKMFGDFQKNTPEERNVRFGVREHGMGAICNGIALHSPGFIPYCATFFVFTDYMRAAMRISALSEAGVIYVMTHDSIGLGEDGPTHQPIEHLASFRAMPNILMLRPADGNETAGSYKVAVLNRKRPSVLALSRQKLPQLPGTSIEGVEKGGYTISDNSSGNKPDVILIGTGSELEIAAKAADELRKEGKAVRVVSFVSWELFDDQSAEYKESVLPASVTARVSIEAGTTFGWEKIVGSKGKAIGIDRFGASAPAGKIYKELGITAEAVVAAAKELI

SEQ ID NO: 22492 - protein, 752 aa, Prunus mume
MTSSTSVTLSQALLARAISHHGSSSTSDRVSLSAALTLPTFSGLKSTSSSPSSSSSTSSKLSRFQRRRVGANRPVRAAAVETLDKTTETSLVEKSVNTIRFLAIDAVEKANSGHPGLPMGCAPMGHILYDEIMRYNPKNPYWFNRDRFVLSAGHGCMLQYALLHLAGYDSVKEEDLKGFRQWGSKTPGHPENFETPGVEVTTGPLGQGIANAVGLALAEKHLAARFNKPDSEIVDHYTYVILGDGCQMEGISNEVASLAGHWGLGKLIAFYDDNHISIDGDTEIAFTESVDTRFEGLGWHVIWVKNGNTGYDEIRAAIKEAKAVTDRPTLIKVTTTIGFGSPNKANSYSVHGAALGAKEVDATRKNLGWPYEPFHVPEDVKSHWSRHTAEGSALEAEWNAKFAEYEKKYKEEAAELKSIITGELPAGWEKALPTYTPESPADATRNLSQANLNALVKVLPGLLGGSADLASSNMTLLKSFGDFQKNTPEERNVRFGVREHGMGAICNGIALHSPGLIPYCATFFVFTDYMRAAIRISALSEAGVIYVMTHDSIGLGEDGPTHQPIEHLASFRAMPNILMLRPADGNETAGSYRVAVLNRKRPSILALSRQKLPNLPGTSIEGVEKGGYIISDNSSGNKPDVILLATGSELEIAFKAGEELRKEGKAVRVVSFVSWELFDEQSDAYKESVLPAAVTARVSIEAGSTFGWEKLLGSKGKAIGIDHFGASAPAGKIYKEFGLTVEAVIAAAKEVS

SEQ ID NO: 22493 - protein, 744 aa, Platanus occidentalis
MAASSSLTVSQALVGRTIAHHGSTSHSDRLALPGFSLSTLAGRGIKSSPSQSPRAPGAQKRVSSRSLVRAAAVETLDKTETSLVEKSINTIRFLAIDAVEKANSGHPGLPMGCAPMGHILYDEVMRYNPKNPYWFNRDRFVLSAGHGCMLQYALLHLAGYDSVKEEDLKSFRQWGSKTPGHPENFETPGCEVTTGPLGQGIANAVGLALAEKHLAARYNKPDNEIVDHYTYVILGDGCQMEGISNEACSLAGHWGLGKLIAFYDDNHISIDGDTDIAFTESVDTRFEGLGWHVIWVKNGNTGYDDIRAAIKEAKAVKDKPTLIKVTTTIGFGSPNKANSYSVHGSALGAKEVDATRKNLGWPYEPFHVPEDVKKHWSRHVPEGASLEAEWNAKFTEYEKKYKEEAAELKSIVSGELPAGWEKALPTYTPESPADATRNLSQQCLNALAKVLPGLLGGSADLASSNMTLLKMFGDFQKDTPEERNVRFGVREHGMGAICNGIALHSPGLIPYCATFFVFTDYMRAAIRISALCEAGVIYVMTHDSIGLGEDGPTHQPIEHLASFRAMPNILMLRPADGNETAGAYRVAVLNSKRPSILALSRQKLPQLPGTSIEGVEKGGYVISDNSSGNKPDVILIGTGSELEIAAKAADELRKEGKAVRVVSFVSWELFDEQSDAYKESVLPAAVSARVSIEAGSTFGWGKIVGSKGKAIGIDRFGASAPAGKIYKEFGLTAEAIIAAAKALC

SEQ ID NO: 22494 - protein, 745 aa, Theobroma cacao
MASTSSTTLSQALLARAISYHGSTQSSDHRVSLSTLSLPTFSGLKSTTSRASAFRRRPPVRSYQNRQVRAAAVETIGTAAETSLVEKSVNTIRFLAIDAVEKANSGHPGLPMGCAPMGHILYDEVMRYNPKNPYWFNRDRFVLSAGHGCMLQYALLHLAGYDSVLEEDLKNFRQWGSKTPGHPENFETLGVEVTTGPLGQGVANAVGLALAEKHLAARFNKPDNEIVDHYTYVILGDGCQMEGIANEACSLAGHWGLGKLIAFYDDNHISIDGDTEIAFTESVDKRFEGLGWHVIWVKNGNTGYDDIRAAIKEAKAVKDKPTLIKLTTTIGYGSPNKANSYSVHGSALGAKEVDATRKNLGWPYEPFHVPEDVKTHWSRHVPQGAALEAEWNAKFAEYEKKYKEEAAELKTIITGELPAGWEKALPTYTPESPPDATRNLSQQNLNALVKVLPGLLGGSADLASSNMTLLKMYGDFQKDTPEERNVRFGVREHGMGAISNGIALHSPGLIPYCATFFVFTDYMRAAIRISALCEAGVIYVMTHDSIGLGEDGPTHQPIEHLASFRAMPNILMLRPADGNETAGAYKVAVLNRKRPSILALSRQKLPQLAGTSIEGVEKGGYIVSDNSSGNKPDVILIGTGSELEIAAKAAEELRNGGKAVRVVSLVSWELFDEQSDAYKESVLPSAVSARVSIEAGSTFGWEKIVGSKGKSIGIDRFGASAPAGRIYKEFGLTPEAVVTAAKELC

SEQ ID NO: 22495 - protein, 752 aa, Ricinus communis
MASTSSLTLSQALLARAISHHVSTQSSDRLSLSTPSLPAFSGLKSTSSSIPRATSSRRSRRNSSIPTARRLQTPTRAAAVETLDVTTDTSLVEKSVNTIRFLAIDAVEKANSGHPGLPMGCAPMGHILYDEIMKYNPKNPYWFNRDRFVLSAGHGCMLQYALLHLAGYDSVKEEDLKSFRQWGSKTPGHPENFETPGVEVTTGPLGQGIANAVGLALAEKHLAARFNKPDNEIVDHYTYAILGDGCQMEGIANEACSLAGHWGLGKLIAFYDDNHISIDGDTEIAFTESVDKRFEALGWHVIWVKNGNTGYDEIRAAIKEAKAVTDKPTMIKVTTTIGYGSPNKANSYSVHGSALGAKEVDATRKNLGWPFEPFHVPEDVKNHWSRHIPGGAAFEAEWNAKFAEYEKKYKEEAAELKSIIKGELPAGWEKALPTYTPESPADATRNLSQANLNALAKVLPGLLGGSADLASSNMTLLKMFGDFQKDTPEERNVRFGVREHGMGAICNGIALHSPGLIPYCATFFVFTDYMRAAMRISALSEAGVIYVMTHDSIGLGEDGPTHQPIEHLASFRAMPNILMFRPADGNETAGAYRIAVLNRKRPSVLALSRQKLPQLPGTSIEGVEKGGYTISDNSSGNKPDVILIGTGSELEIAAKAAEELRREGKAVRVVSFVSWELFDEQSDAYKESVLPAAVTARVSIEAGSTFGWQKIVGGKGKAIGIDRFGASAPAGKIYKEYGITAEAVIAAAKELC

SEQ ID NO: 22496 - protein, 752 aa, Prunus persica
MTSSTSVTLSQALLARAISHHGSSSTSDRVSLSAALTLPTFSGLKSTSSSPSSSSSTSSKLSRFQRRRLGANRPVRAAAVETLDKTTETSLVEKSVNTIRFLAIDAVEKANSGHPGLPMGCAPMGHILYDEIMRYNPKNPYWFNRDRFVLSAGHGCMLQYALLHLAGYDSVKEEDLKGFRQWGSKTPGHPENFETPGVEVTTGPLGQGIANAVGLALAEKHLAARYNKPDSEIVDHYTYVILGDGCQMEGISNEAASLAGHWGLGKLIAFYDDNHISIDGDTEIAFTESVDTRFEGLGWHVIWVKNGNTGYDEIRAAIKEAKAVTDRPTLIKVTTTIGFGSPNKANSYSVHGAALGAKEVDATRKNLGWPYEPFHVPEDVKSHWSRHTAEGSALEAEWNAKFAEYEKKYKEEAAELKSIISGELPAGWEKALPTYTPENPADATRNLSQANLNALAKVLPGLLGGSADLASSNMTLLKSFGDFQKNTPEERNVRFGVREHGMGAICNGIALHSPGLIPYCATFFVFTDYMRAAIRISALSEAGVIYVMTHDSIGLGEDGPTHQPIEHLASFRAMPNILMLRPADGNETAGAYRVAVLNRKRPSILALSRQKLPNLPGTSIEGVEKGGYIISDNSSGNKPDVILIATGSELEIVFKAGEELRKEGKAVRVVSFVSWELFDGQSDAYKESVLPAAVTARVSIEAGSTFGWQKLVGSKGKAIGIDHFGASAPAGKIYKEFGLTVEAVIAAAKEVS

SEQ ID NO: 22497 - protein, 753 aa, Quercus alba
MASSTSLTLSQALLARATSLHHGSTQSSTDRVSLSTFTGLKSSSSTTPLISSSRRAANRRCASLPGPTRARPGVVKAVSVETAVDQAADTALVEKSINTIRFLAIDAVEKANSGHPGLPMGCAPMGHVLYDEVMRYNPKNPYWFNRDRFVLSAGHGCMLQYALLHLAGYDSVQEEDLKGFRQWGSKTPGHPENFETPGVEVTTGPLGQGIANAVGLALAEKHLAARFNKPDSEIVDHYTYAILGDGCQMEGISNEACSLAGHWGLGKLIAFYDDNHISIDGDTEIAFTESVDKRFEGLGWHVIWVKNGNTGYDEIRAAIKEAKAVTDKPTLIKVTTTIGFGSPNKANSYSVHGSALGAKEVDATRKNLGWPFEPFHVPEDVKKHWSRHVPKGSALEAEWNAKFAEYEKKYKEEAAELKSIANGELPVGWEKALPTYTPESPADATRNLSQQCLNALAKVLPGLLGGSADLASSNMTLLKMFGDFQKDTPEERNVRFGVREHGMGAICNGIALHSPGLIPYCATFFVFTDYMRAAIRISALSEAGVIYVMTHDSIGLGEDGPTHQPIEHIASFRAMPNILMLRPADGNETAGAYKVAVLNRKRPSILALSRQKLKQLPGTSIEGVEKGGYIISDNSSGNKPDVILIGTGSELEIAAQAAEELRKEGKAVRVVSFISWELFDEQSDAYKESVLPAAVSARVSIEAGSTFGWEKIVGSKGKAIGIDRFGASAPAGKIYKEYGLTAEAVIAAAKELS

SEQ ID NO: 22498 - protein, 744 aa, Populus trichocarpa
MASTSSLTLSQALLARAISHHATDQRRDSRLSLVSLPAFSGLKSTTSTASRATTTTNRRRRVSSRHVRAAAVETLDATTETSLVEKSVNTIRFLAIDAVEKANSGHPGLPMGCAPMGHILYDEVMRYNPKNPYWFNRDRFVLSAGHGCMLQYALLHLAGYDSVKEEDLKSFRQWGSRTPGHPENFETPGVEVTTGPLGQGVANAVGLALAEKHLAARFNKPDSEIVDHYTYIILGDGCQMEGISNEACSLAAHWGLGKLIAFYDDNHISIDGDTEIAFTEDVDKRFEGLGWHVIWVKNGNNGYDEIRAAIKEAKAVKDKPTLIKVTTTIGYGSPNKANSYSVHGSALGAKEVDATRQNLGWPFEPFHVPEDVKQHWSRHIPAGAAFEAEWNTKFAEYEKKYSEEAAEFKSIMTGELPTGWEKALPTYTPESPADATRNLSQQNLNALAKVLPGLLGGSADLASSNMTLLKMFGDFQKDTPEERNVRFGVREHGMGGICNGIALHSPGLIPYCATFFVFTDYMRGAIRISALSEAGVIYVMTHDSIGLGEDGPTHQPIEHLASFRAMPNILMLRPADGNETAGAYKVAVLNRKRPSILALSRQKLPHLPGTSIEGVEKGGYILSDNSSGNKPDVILMGTGSELEIAAKAAEELRKEGKAVRVVSFVSWELFDEQSDAYKESVLPAAVTARVSIEAGSTFGWQKLVGAKGKAIGIDRFGASAPAGKIYKEFGITAEAVIAAAKEFS

SEQ ID NO: 22499 - protein, 711 aa, Vicia sativa
PSSTSSLSFPSLKPKPPTSSTISRRRTPTPTTTVRATAVETLDKTAEVSLVEKSVNTIRFLAIDAVEKANSGHPGLPMGCAPMGHILYDEIMRYNPKNPSWFNRDRFVLSAGHGCMLQYALLHLAGYDSVKEEDLKQFRQWGSKTPGHPENFETYGIEVTTGPLGQGIANGVGLALAEKHLAARFNKPDSEIVDHYTYVILGDGCQMEGISNEACSLAGHWGLGKLIAFYDDNHISIDGDTEIAFTENVDQRFEALGWHVVWVKNGNTGYDEIRAAIKEAKAVTDKPTLIKVTTTIGFGSPNKANSYSVHGAALGSKEVDATRQNLGWPYEPFHVPEDVKKHWSRHTPEGAALEAEWNTKFAEYEKKYKEEAAELKAIINRELPADWEKALPTYTPETPADATRNLSQANLNALAKVLPGLIGGSADLASSNMTLLKSFGDFQKATPEERNVRFGVREHAMGAICNGIALHSPGFIPYCATFFVFTDYMRAAIRISALSEAGVIYVMTHDSIGLGEDGPTHQPIEHLASFRAMPNVLMLRPADGNETAGSYRVAVLNPKRPSILALSRQKLPNLPGTSIEGVEKGGYTISDNSSGNKPDVILIGTGSELEIAAAAADDLRKEGKTVRVVSFVSWELFDDQSDEYKESVLPASVTARVSIEAGSTFGWHKIVGSKGKTIGIDRFGASAPAGKIYKEYGITKEAVISAAKEVS

SEQ ID NO: 22500 - protein, 745 aa, Citrullus lanatus
MASTSSAALSQAVLPRAISHHASNASADRVSLSSRSLPSFSGLKSTNSAAVAASSRRTRPSRRRCGVVRASVAETLDKTTETSLIEKSVNTIRFLSIDAVEKANSGHPGLPMGCAPMGHVLYDEVMRYNPKNPYWFNRDRFVLSAGHGCMLQYALLHLAGYDSVKEEDLKNFRQWESRTPGHPENFETPGVEVTTGPLGQGVANAVGLALAEKHLAARFNKPDSEIVDHYTYVILGDGCQMEGIANEACSLAGHWGLGKLIAFYDDNHISIDGDTEIAFTESVDKRFEGLGWHVIWVKNGNNGYDEIRAAIREAKAVKDKPTLIKVTTTIGYGSPNKANSYSVHGSALGAKEVDATRQNLGWPYEPFHVPEDVKKHWSRHIPQGAALEAEWNTKFAEYEKKYAEEAAELKSIINGELPAGWEKALPTYTPESPADATRNLSQQNLNALAKVLPGFLGGSADLASSNMTLLKSFGNFQKDTPEERNLRFGVREHGMGAICNGIALHSPGLIPYCATFFVFTDYMRAAIRISALSQAGVIYVMTHDSIGLGEDGPTHQPIEHLASFRAMPNILMLRPADGNETAGAYKVAVLNRKRPSILALSRQKLPNLPGTSIEGVEKGGYILSDNSSGNKPDVILIGTGSELEIAAKAAEELRKEGKAVRLVSFVSWELFDEQSDAYKESVLPAAVSARVSIEAGTTFGWEKIVGSKGKAIGIDRFGASAPAGKIYKEFGITVEAVIAAAKQVI

SEQ ID NO: 22501 - protein, 737 aa, Tripterygium wilfordii
SLTISQALLARAISHHQTPDHRLSPSNLSFPAFSGLKSTNSQTPRAAISRRRIASRHSTVRAAAVETLDATAETSLVEKSINTIRFLAIDAVEKANSGHPGLPMGCAPMGHILYDEIMRYNPKNPYWFNRDRFVLSAGHGCMLQYALLHLAGYDSVKEEDLKSFRQWGSKTPGHPENFETPGVEVTTGPLGQGIANAVGLALAEKHLGARFNKADNEIIDHYTYCILGDGCQMEGISNEACSLAAHWGLGKLIAFYDDNHISIDGDTEIAFTESVDTRFEGLGWHVIWVKNGNTGYDEIRAAIKEAKAVKDKPTLIKVTTTIGFGSPNKANSYSVHGSALGAKEVDATRQNLGWPYEPFHVPEEVKTHWSRHAPEGAALEAAWNAKFAEYEKKYQDEAAELKSIITGELPAGWEKALPTYTPESPADATRNLSQQNLNALAKVLPGFLGGSADLASSNMTLLKMFGDFQKDTPEERNVRFGVREHGMGAICNGIALHSPGLIPYCATFFVFTDYMRAAIRISALCEAGVIYVMTHDSIGLGEDGPTHQPIEHLASFRAMPNILMLRPADGNETAGAYKVAILNRKRPSILALSRQKLPQLPGTSIEGVEKGGYTISDNSSGNKPDVILMGTGSELEIAAKAAEELRKEGKAVRVVSFVSWELFDEQSDAYKESVLPTAVTARVSIEAASTFGWAKIVGSKGKAIGIDTFGASAPAGKIYKEFGITAEAVIAAAKEFF

SEQ ID NO: 22502 - protein, 742 aa, Euonymus alatus
MASTSSLTLSQALLARAISHHQSPDHRLSPFNLSFPAFSGLKSTNSLTPRAASSRRRIPSRQRTVRAAAVETLDATAETSLVEKSINTIRFLAIDAVEKANSGHPGLPMGCAPMGHILYDEIMRYNPKNPYWFNRDRFVLSAGHGCMLQYALLHLAGYDSVEEEDLKSFRQWGSKTPGHPENFETPGVEVTTGPLGQGVGNAVGLALAEKHLAARFNKADNEIIDHYTYCILGDGCQMEGISNEACSLAAHWGLGKLIAFYDDNHISIDGDTEIAFTESVDTRFEGLGWHVIWVKDGNTGYDEIRAAIKEAKAVKDKPTLIKVTTTIGFGSPNKANSYSVHGSALGAKEVDATRQNLGWPYEPFHVPEEVKKHWNRHVPEGAALEAAWNAKYAEYEKKYKEEAAELKSIITGELPVGWEKALPTYTPESPADATRNLSQQCLNALAKVIPGFLGGSADLASSNMTLLKMFGDFQKDTPEERNVRFGVREHGMGAICNGIALHSPGLIPYCATFFVFTDYMRAAIRISALCEAGVIYVMTHDSIGLGEDGPTHQPIEHLASFRAMPNILMLRPADGNETAGAYKVAIVNRKRPSILALSRQKLPQLPGTSVEGVEKGGYIISDNSSGNKPDVILMGTGSELEIAAKAAEELRKEGKAVRVVSFVSWELFDEQSDAYKESVLPAAVTARVSIEAASTFGWTKIVGSKGKAIGIDRFGASAPAGKIYKEFGITPEAVIAAAKEFF

SEQ ID NO: 22503 - protein, 745 aa, Cucumis sativus
MASTSSAALSQAVLPRTISHHASNPSADRVSLSTRSLPTFSGLKSTNSAAVVASSRRNRSSRSRCGVVRASVAETVDKTTDTSLIEKSVNTIRFLSIDAVEKANSGHPGLPMGCAPMGHVLYDEVMRYNPKNPYWFNRDRFVLSAGHGCMLQYALLHLAGYDSVKEEDLKNFRQWESRTPGHPENFETPGIEVTTGPLGQGVANAVGLALAEKHLAARFNKPDNEIVDHYTYVILGDGCQMEGIANEACSLAGHWGLGKLIAFYDDNHISIDGHTEIAFTENVDKRFEALGWHVIWVKNGNNGYDEIRAAIREAKAVKDKPTLIKVTTTIGYGSPNKANSYSVHGSALGAKEVDATRQNLGWPYEPFHVPEDVKKHWSRHTPQGAALEAEWNAKFAEYEKKYAEEAAELKGIISGELPAGWEKALPTYTPESPADATRNLSQQNLNALAKVLPGFLGGSADLASSNMTLLKSFGNFQKDTPEERNLRFGVREHGMGAICNGIALHSPGLIPYCATFFVFTDYMRAAIRISALSQAGVIYVMTHDSIGLGEDGPTHQPIEHLASFRAMPNILMLRPADGNETAGAYKVAVLNQKRPSILALSRQKLPNLPGTSIEGVEKGGYILSDNSSGNKPDVILIGTGSELEIAAKAAEELRKEGKAVRLVSFVSWELFNEQSDAYKESVLPAAVSARVSIEAGTTFGWEKIVGSKGKAIGIDRFGASAPAGKIYKEFGITVEAVIAAAKQVI

SEQ ID NO: 22504 - protein, 744 aa, Platanus occidentalis
MAASSSLTVSQSLVGRTIAHHGSSTQSDRLALPGFSLSTLAGRSIKSSSSPSPRVFGARKRVNSRPSVRAAAVETLDKTDTTLVEKSINTIRFLAIDAVEKANSGHPGLPMGCAPMGHILYDEVMRYNPKNPYWFNRDRFVLSAGHGCMLQYALLHLAGYDSVKEEDLKSFRQWGSKIPGHPENFETPGVEVTTGPLGQGIANAVGLALAEKHLAARFNKPDNEIVDHYTYVILGDGCQMEGISNEACSLAGHWGLGKLIAFYDDNHISIDGDTDIAFTESVDTRFEGLGWHVIWVKNGNTGYDDIRAAIKEAKAVKDKPTLIKVTTTIGYGSPNKANSYSVHGSALGGKEVDATRKNLGWPYEPFHVPEDVKKHWSRHIPEGSALEAEWNAKFAEYEKKYKEEAAELKSLITGEFPAGWEKALPTYTPESPADATRNLSQQCLNALAKVLPGLLGGSADLASSNMTLLKMFGDFQKGTPEERNVRFGVREHGMGAICNGIALHSPGFVPYCATFFVFTDYMRAAMRISALSEAGVIYVMTHDSIGLGEDGPTHQPIEHLASFRAMPNILMLRPADGNETAGAYKVAVVNRKRPSILALSRQKLPQLPGTSIEGVEKGGYIVSDNSSGNKPDVILVGTGSELEIAAKAADELRKEGKAVRVVSFVSWELFDEQSDAYKESVLPVAVSARVSIEAGSTFGWEKIVGSKGVAIGIDRFGASAPAGKIYKEFGLTAEAVIAAAKAVC

SEQ ID NO: 22505 - protein, 748 aa, Eucalyptus grandis
MASTSSPTLSQAILARPISGSASNSSSSDRVSLSLSALKFSPLSSSRRASGSSCRRRRSSVQGPSSAVRPIRAAAVETLDTATEASLVEKSVNTIRFLAIDAVEKANSGHPGLPMGCAPMGHILYDEVMRYNPKSPYWFNRDRFVLSAGHGCMLQYALMHLAGYDSVQEEDLKGFRQWGSKTPGHPENFETTGIEVTTGPLGQGIANAVGLALVEKHLAARFNKPDSEIVDHYTYVILGDGCQMEGISNEACSLAGHWGLGKLIAFYDDNHISIDGDTEIAFTESVDTRFEGLGWHVIWVKNGNTGYDEIRAAIKEAKAVKDKPTLIKVTTTIGYGSPNKANSYSVHGSALGAKEVDATRKNLGWPYEPFHVPEDVKAHWSRHVPAGAAIEAEWNAKFAEYEKKYKEEAAELKSIFKGELPAGWEKALPTYTPESPADATRNLSQQCLNALAKVLPGLLGGSADLASSNMTLLKMFGDFQKGTPEERNVRFGVREHGMGAICNGIALHSPGLIPYCATFFVFTDYMRAAMRISALCEAGVIYVMTHDSIGLGEDGPTHQPIEHLASFRAMPNILMLRPADGNETAGAYKVAVLNRKRPSVLALSRQKLPQLSGTSIEGVEKGGYIISDNSSGNKPDVILIGTGSELEIAVKAADELRKEGKAVRVVSFVSWELFDDQSAEYKESVLPAAVSARVSIEAGSTFGWSKIVGSGGKAIGIDRFGASAPAGIIYKEFGITAEAVVAAAKELC

SEQ ID NO: 22506 - protein, 740 aa, Panax ginseng
MAASSSLTLSQAILSRSIPRHGSNSSSQQTPIFSFPLFSHLPTFSTSLRSSSRRCSSAAGRQVVRAAVVETLDKTETSLVEKSVNTIRFLAIDAVEKANSGHPGLPMGCAPMGHILYDEVMRYNPKNPYWFNRDRFVLSAGHGCMLQYALLHLAGYDSVLEEDLKSFRQWGSRTPGHPENFETPGVEVTTGPLGQGIANAVGLALVEKHLAARFNKPDSEIVDHYTYVILGDGCQMEGIANEACSLAGHWGLGKLIAFYDDNHISIDGDTEIAFTESVDTRFEGLGWHIIWVKNGNTGYDDIRAAIKEAKAVTDKPTLIKVTTTIGFGSPNKANSYSVHGSALGAKEVDATRKNLGWPYEPFHVPEDVKQHWSRHTCEGASLEAAWNAKFAEYEKKYAEEAVELKSIITGVLPAGWETALPTYTPEIPADATRNLSQTCLNALAKVLPGLLGGSADLASSNMTLLKMFGDFQKGTPEERNVRFGVREHGMGAICNGIALHSPGLIPYCATFFVFTDYMRGAIRISALSEAGVIYVMTHDSIGLGEDGPTHQPIEHLASFRAMPNILMLRPADGNETAGAYKVAVLNRKRPSILALSRQKLPNLPGTSIEGVEKGGYTISDNSSGNKPDVILIGTGSELEIAAKAADELRKEGKAVRVVSFVSWELFDEQSDDYKESVLPAAVTARVSIEAASTFGWGKLVGSEGKAIGIDKFGASAPAGKTYKEYGITVEAIIAAAKELI

SEQ ID NO: 22507 - protein, 742 aa, Citrullus lanatus
MASTSSLTLSQALLSREISRHGSNSSSDRVPLSIPTFSGLKSTKPPRLAGSAHRPRATHYRRQIVRAAVAETLGTTAETALVEKSINTIRFLAIDAVEKANSGHPGLPMGCAPMGHILYDEVMKYNPKNPYWFNRDRFVLSAGHGCMLQYALLHLAGYDSVKEEDLKSFRQWESRTPGHPENFETPGVEVTTGPLGQGIANAVGLALAEKHLAARFNKPDSEIVDHYTYVILGDGCQMEGIANEACSLAGHWGLGKLIALYDDNHISIDGDTEIAFTESVDTRFEALGWHVIWVKNGNTGYDEIRAAIQEAKAVKDKPTLIKVTTTIGFGSPNKANSYSVHGSALGAKEVEATRSNLGWPYEPFHVPEDVQKHWSRHIPQGADFEAEWNAKFAEYEKKYAEEAAELRSIITGELPAGWEDALPKYTPESPGDATRNLSQQCLNALAKVLPGFLGGSADLASSNMTLLKMYGDFQKNTPEERNVRFGVREHGMGAICNGIALHSPGFIPYCATFFVFTDYMRAAMRISALSEAGVIYVMTHDSIGLGEDGPTHQPIEHLASFRAMPNILMFRPADGNETAGAYKVAVVNRKRPSIMALSRQKLPQLPGTSIEGVEKGGYTISDNSSGNKPDVILIGTGSELEIAFQAGEELRKEGKAVRVVSFVSWELFDEQSDAYKESVLPEAVSARVSIEAGSTFGWQKIVGSKGKAIGIDRFGASAPAGKIYKEFGITVEAVVAAARELS

SEQ ID NO: 22508 - protein, 744 aa, Catharanthus roseus
MASSSSLTLSQAILARSVPRHGSSSSSSSSNIPSISFPTFSGLKSTNPSTTTVSRRRSSTSRRQNQVFAAATIETIEKTDTELVDKSVNTIRFLAIDAVEKANSGHPGLPMGCAPMGHILYDEVMKYNPKNPYWFNRDRFVLSAGHGCMLQYALLHLAGYDAVQEEDLKNFRQWGSKTPGHPENFETPGVEVTTGPLGQGIANAVGLALAEKHLAARYNKPDAEIVDHYTYVILGDGCQMEGISNEACSLAGHWGLGKLIAFYDDNHISIDGDTEIAFTENVDTRFEGLGWHVIWVKNGNTGYDEIRAAIKEAKAVKDKPTLIKVTTTIGFGSPNKANSYSVHGSALGAKEVEATRSNLGWPYEPFHVPEDVKKHWSRHIPNGAAYEAEWNAKFSEYEKKYPEEAAEFKSIITGELPAGWEKALPTYTPESPADATRNLSQQNLNALAKVLPGLLGGSADLASSNMTLLKMYGDFQKNTPEERNVRFGVREHGMGAICNGIALHSPGLIPYCATFFVFTDYMRAAMRISALCEAGVIYVMTHDSIGLGEDGPTHQPIEHLASFRAMPNILMLRPADGNETAGAYKVAVLNRKRPSVLALSRQKLPQLAGTSIEGVEKGGYIVSDNSSGNKPDVILVGTGSELEIAVKAADELRKEGKAVRVVSFVSWELFDEQSAEYKESVLPASVTARVSIEAGSTFGWERIVGTKGKAIGIVGFGASAPAGKIYKEFGITAEAVIAAAKEVM

SEQ ID NO: 22509 - protein, 742 aa, Cucumis sativus
MASTSSLTLSQALLSREISRHGSNSSSDRVPLSIPTFSGLKSTKPPRLTGSAHRPRATHYRRQIVRAAIAETLGTTAETALVEKSINTIRFLAIDAVEKANSGHPGLPMGCAPMGHILYDEVMKYNPKNPYWFNRDRFILSAGHGCMLQYALLHLAGYDSVREEDLKSFRQWESRTPGHPENFETPGVEVTTGPLGQGIANAVGLALAEKHLAARFNKPDSEIVDHYTYVILGDGCQMEGIANEACSLAGHWGLGKLIALYDDNHISIDGDTEIAFTESVDTRFEGLGWHVIWVKNGNTGYDEIRAAIQEAKAVKDKPTMIKVTTTIGFGSPNKANSYSVHGSALGAKEVEATRSNLGWPYEPFHVPEDVQKHWSRHTPLGADFEAEWNAKFAEYEKKYPEEAAELKSIITGELPAGWEDALPKYTPESPGDATRNLSQQCLNALAKVLPGFLGGSADLASSNMTLLKMYGDFQKNTPEERNLRFGVREHGMGAICNGIALHSPGFIPYCATFFVFTDYMRAAMRISALSEAGVIYVMTHDSIGLGEDGPTHQPIEHLASFRAMPNILMFRPADGNETAGAYKVAVVNRKRPSIMALSRQKLPHLPGTSIEGVEKGGYIVSDNSSGNKPDVILIGTGSELEIAFQAGEELRKEGKAVRVVSFVSWELFDDQSDAYKESVLPEAVTARVSIEAGSTFGWGKIVGSKGKAIGIDRFGASAPAGKIYKEFGLTVEAVVAAARELS

SEQ ID NO: 22510 - protein, 739 aa, Panax ginseng
MASSSLTISQAILSRSIPRHGGSNSSTQQPASSLSSFSHLPTFSTSLKSSSRRRNSAAGRRIVRATAVETLEKTETSLVEKSVNTIRFLAIDAVEKANSGHPGLPMGCAPMGHILYDEVMRYNPKNPYWFNRDRFVLSAGHGCMLQYALLHLAGYDSVLEEDLKQFRQWGSKTPGHPENFETPGVEVTTGPLGQGVANAVGLALVEKHLAARFNKPDSEIVDHYTYVILGDGCQMEGIANEACSLAGHWGLGKLIAFYDDNHISIDGDTEIAFTESVDTRFEGLGWHIIWVKNGNTGYDDIRAAIKEAKAVTDKPTLIKVTTTIGFGSPNKANSYSVHGSALGAKEVDATRKNLGWPYEPFHVPEDVKQHWSRHASEGASLEAEWNAKFAEYEKKYAEEAAELKSIFTGVLPSGWESALPKYTPESPADATRNLSQTCLNALAPVLPGLLGGSADLASSNMTLLKMFGDFQKGTPEERNVRFGVREHGMGAICNGIALHSPGLIPYCATFFVFTDYMRGAIRISALSEAGVIYVMTHDSIGLGEDGPTHQPIEHLASFRAMPNILMLRPADGNETAGAYKVAVVNRKRPSILALSRQKLPNLPGTSIEGVEKGGYTISDNSSGNKPDVILIGTGSELEIAAKAADELRKEGKAVRVVSFVSWELFDEQSDVYKESVLPAAVTARVSIEAGSTFGWVKIVGSGGKAIGIDGFGASAPAGKIYKEYGITAEAVIAAAKELF

SEQ ID NO: 22511 - protein, 745 aa, Actinidia deliciosa
MASSSSLNLSQATLSRSAAQQHHRGSNRPASLTTSSLPTFPGLKSSSRAASTRRRSVRASASTSRRSVRASAAVETLETTATELIDKSVNTIRFLAIDAVEKANSGHPGLPMGCAPMGHVLYDEIMRYNPKNPYWFNRDRFVLSAGHGCMLQYALLHLAGYDSVQEEDLKQFRQWGSKTPGHPENFETPGVEVTTGPLGQGLANAVGLALAEKHLAARFNKPDSEIVDHYTYAILGDGCQMEGISNEACSIAGHWGLGKLIAFYDDNHISIDGDTEIAFTESVDTRFEGLGWHVIWVKNGNTGYDEIRAAIKEAKAVKDKPTLIKVTTTIGYGSPNKANSYSVHGSALGAKEVDATRQNLGWPYEPFHVPEDVKKHWSCHVPAGAALEAEWNAKFAEYEKKYTEEAVELKSIITGELPAGWEKALPTYTPESPADATRNLSQQCLNALAKVIPGFLGGSADLASSNMTLLKMFGDFQKSTPEDRNLRFGVREHGMGAICNGIALHSPGLIPYCATFFVFTDYMRAAMRISALSEAGVIYVMTHDSIGLGEDGPTHQPIEHLASFRAMPNILMFRPADGNETAGAYKVAVLNPKRPSVLALSRQKLPQLPGTSIEGVEKGGYIVSDNSSGNKPDVILIGTGSELEIAAKAADELRKEGKAVRLVSFVSWELFDDQSDAYKESVLPEAVSARVSIEAGSTFGWEKIVGSKGKAIGIDRFGASAPAGKIYKEYGITAEAVVAAAKALC

SEQ ID NO: 22512 - protein, 739 aa, Cleome spinosa
MASTSSLALSQALLARALSHHGSDQRVSLPAFSGLKSTGPRAASSSRRRAGPTRHRDTRPVIRAAAVETIDTTTEASVVEKSINTIRFLAIDAVQKANSGHPGLPMGCAPMGHILYDEVMRYNPKNPYWFNRDRFVLSAGHGCMLQYALLHLAGYDSVKEEDLKNFRQWGSRTPGHPENFETPGIEVTTGPLGQGIANGVGLALAERHLAARFNKPDSEIVDHYTYVILGDGCQMEGISNEACSLAGHWGLGKLIAFYDDNHISIDGDTEIAFTENVDQRFEALGWHVIWVKNGNTGYDEIRAAIKEAKAVKDKPTLIKVTTTIGFGSPNKANSYSVHGSALGEKEVEATRKNLGWPYEPLHVPDDVKSHWSRHTPEGAALEADWNAKFAEYEKKYPEEAAELKAIITGELPSGWEKALPTYTPESPGDATRNLSQQCLNALANVVPGFLGGSADLASSNMTLLKMFGDFQKGTPEERNLRFGVREHGMGAICNGITLHSPGLIPYCATFFVFTDYMRAAMRISALSEAGVIYVMTHDSIGLGEDGPTHQPVEHLVSFRAMPNILMFRPADGNETAGAYKIAVSKRKTPSVLALSRQKLPQLPGTSIEGVEKGGYTISDNSSGNKPDVILIGTGSELEIAAKAAEELRKEGKAVRVVSFVCWELFAEQSDAYKESVLPSDVSARVSIEAGSTFGWEKVVGSKGKAIGIDSFGASAPAGLLYKEFGITVDAVIAAAKALI

SEQ ID NO: 22513 - protein, 729 aa, Vitis vinifera
MAAASASSSLYLLPRTLNHHSSTPHPNRLSLSGLTPKTQALRTRHGRRARATVRAAAVETLQKADTSLVEKSINTIRFLSIDAVEKANSGHPGLPMGCAPMGHILYDEVMRYNPSNPYWFNRDRFVLSAGHGCMLQYALLHLAGYDSVKEEDLKSFRQWGSRTPGHPENFETPGVEVTTGPLGQGIANAVGLAAVEKHLAARFNKPDNEIVDHYTYVILGDGCQMEGISNEVCSLAGHWGLGKLIAFYDDNHISIDGDTEIAFTESVDTRFEGLGWHVIWVKNGNTGYDEIRAAIKEAKAVKDKPTLIKVTTTIGYGSPNKANSYSVHGSALGAKEVDATRKNLGWPHEPFHVPEDVKKHWSRHIPDGAALEAEWNAKFAEYEKKYKEEAAELKSIITGELPAGWDKALPTYTPESAADATRNLSQQCLNALAKVLPGLLGGSADLASSNMTLLKMFGDFQKGTPEERNVRFGVREHGMGAICNGIALHSLGLIPYCATFFVFTDYMRAAIRISALSEAGVIYVMTHDSIGLGEDGPTHQPIEHLASFRAMPNILMLRPADGNETAGAYKVAVVNRKRPSILALSRQKLPQLPGTSIAGVEKGGYAISDNSSGNKPDVILIGTGSELEIAAKAGDELRKEGKTVRVVSLVSWELFDDQSDAYKESVLPAAVTARVSIEAGSTFGWEKIVGSKGKAIGIDRFGASAPAGKIYKEFGITVEAVIEAAKAVW

SEQ ID NO: 22514 - protein, 738 aa, Panax ginseng
MASSSLTISQAILSRSIPRHVGSNSSTQQPASSLSSFSHVPTFSTSLKSSSRRRNSAAGRLVRATAVETLEKTETSLVEKSVNTIRFLAIDAVEKANSGHPGLPMGCAPMGHILYDEVMRYNPKNPYWFNRDRFVLSAGHGCMLQYALLHLAGYDSVLEEDLKQFRQWGSRTPGHPENFETPGVEVTTGPLGQGIANAVGLALVEKHLAARFNRPDSEIVDHYTYVILGDGCQMEGIANEACSLAGHWGLGKLIAFYDDNHISIDGDTEIAFTESVDTRFEGLGWHIIWVKNGNTGYDDIRAAIKEAKAVTDKPTLIKVTTTIGFGSPNKANSYSVHGSALGAKEVDATRKNLGWPYEPFHVPEDVKQHWSRHSSEGASLEAEWNAKFAMYEKKYAEEAAELKSIFTGVLPSDWDSALPKYTPESPADATRNLSQTCLNALAPVLPGLLGGSADLASSNMTLLKMFGDFQKGTPEERNVRFGVREHGMGAICNGIALHSPGLIPYCATFFVFTDYMRGAIRISALSEAGVIYVMTHDSIGLGEDGPTHQPIEHLASFRAMPNILMLRPADGNETAGAYKVAVVNRKRPSILALSRQKLPNLPGTSIEGVEKGGYTISDNSSGNKPDVILIGTGSELEIAAKAADELRKEGKAVRVVSFVSWELFDEQSDVYKESILPAAVTARVSIEAGSTFGWEKIVGSGGKAIGIDGFGASAPAGKIYKEYGITAEAVIAAAKELF

SEQ ID NO: 22515 - protein, 738 aa, Panax ginseng
MASSSLTISQAILSRSIPRHVGSNSSTQQPASSLSSFSHVPTFSTSLKSSSRRRNSAAGRLVRATAVETLEKTETSLVEKSVNTIRFLAIDAVEKANSGHPGLPMGCAPMGHILYDEVMRYNPKNPYWFNRDRFVLSAGHGCMLQYALLHLAGYDSVLEEDLKQFRQWGSRTPGHPENFETPGVEVTTGPLGQGVANAVGLALVEKHLAARFNKPDSEIVDHYTYVILGDGCQMEGIANEACSLAGHWGLGKLIAFYDDNHISIDGDTEIAFTESVDTRFEGLGWHIIWVKNGNTGYDDIRAAIKEAKAVTDKPTLIKVTTTIGFGSPNKANSYSVHGSALGAKEVDATRKNLGWPYEPFHVPEDVKQHWSRHASEGASLEAEWNAKFAMYEKKYAEEAAELKSIFTGVLPSDWDSALPKYTPESPADATRNLSQTCLNALAPVLPGLLGGSADLASSNMTLLKMFGDFQKGTPEERNVRFGVREHGMGAICNGIALHSPGLIPYCATFFVFTDYMRGAIRISALSEAGVIYVMTHDSIGLGEDGPTHQPIEHLASFRAMPNILMLRPADGNETAGAYKVAVVNRKRPSILALSRQKLPNLPGTSIEGVEKGGYTISDNSSGNKPDVILIGTGSELEIAAKAADELRKEGKAVRVVSFVSWELFDEQSDVYKESILPAAVTARVSIEAGSTFGWEKIVGSGGKAIGIDGFGASAPAGKIYKEYGITAEAVIAAAKELF

SEQ ID NO: 22516 - protein, 743 aa, Fragaria vesca
MTSSSSVTLSQALLARAISHSNSTSDRVSLSSAISLPSFSGLKSTSSAAASVKLARVPRRRLSRPVRAAAVETLDKTTETSLVEKSVNTIRFLAIDAVEKANSGHPGLPMGCAPMGHILYDEIMRYNPKNPYWFNRDRFVLSAGHGCMLQYALLHLAGYDSVKEEDLKGFRQWGSKTPGHPENFETPGVEVTTGPLGQGIANAVGLALAEKHLAARFNKPDSEIVDHYTYCILGDGCQMEGISNEAASLAGHWGLGKLIAFYDDNHISIDGDTEIAFTENVDARYEALGWHVLWVKNGNTGYDEIRAAIKEAKAVTDKPTLIKVTTTIGFGSPNKANSYSVHGAALGAKEVDATRQNLGWPYEPFHVPEDVKSHWSRHTPEGAALEAEWNAKFAEYEKKYAEEAAELKSIITGELPAGWEKALPTYTPEVPADATRNLSQANLNALAPVLPGLIGGSADLASSNMTLMKMFGDFQKGTPEERNIRFGVREHAMGAISNGISLHSPGFIPYCATFFVFTDYMRNAIRLSALAESRVIYVMTHDSIGLGEDGPTHQPIEHLASFRAMPNILMLRPADGNETAGSYKVAVENKKRPSILALSRQKLPNLAGTSVEGVATGGYIVSDNSTGNKPDVILIGTGSELEIAYKAGEELRKEGKAVRVVSFVSWELFEDQSDAYKESVLPAAVTARVSIEAGSTFGWHKIIGTKGKAIGIDRFGASAPAPIIYKEYGITVEAVIAAAKEVC

SEQ ID NO: 22517 - protein, 735 aa, Panax ginseng
MAASSSLTLSQAILSRSIPRHGSNSSTQQTPSSSLSSFSHLPTFSTSLRSSSRHRSSAAGRQVVRAAVVETLDKTETSLVEKSVNTIRFLAIDAVEKANSGHPGLPMGCAPMGHILYDEVMRYNPKNPYWFNRDRFVLSAGHGCMLQYALLHLAGYDSVLEEDLKSFRQWGSRTPGHPENFETPGVEVTTGPLGQGVANAVGLALVEKHLAARFNKPDSEIVDHYTYVILGDGCQMEGIANEACSLAGHWGLGKLIAFYDDNHISIDGDTEIAFTESVDTRFEGLGWHIIWVKNGNTGYDDIRAAIKEAKAVTDKPTLIKVTTTIGFGSPNKANSYSVHGSALGAKEVDATRKNLGWPYEPFHVPEDVKQHWSRHTSEGASLEAAWNAKFAEYEKKYAEEAVELKSIITGVLPAGWETALPTYTPESPADATRNLSQTCLNALAKVLPGLLGGSADLASSNMTLLKMFGDFQKGTPEERNVRFGVREHGMGAICNGIALHSPGLIPYCATFFVFTDYMRGAIRISALSEAGVIYVMTHDSIGLGEDGPTHQPIEHLASFRAMPNILMLRPADGNETAGAYKVAVLNRKRPSILALSRQKLPNLPGTSIEGVEKGGYTISDNSSGNKPDVILIGTGSELEIAAKAADELRKEGKAVRVVSFVSWELFDEQSDDYKESVLPAAVTARVSIEAASTFGWGKLVGRGIDKFGASAPAGKTYKEYGITSEAVIAAAKELI

SEQ ID NO: 22518 - protein, 739 aa, Cucumis melo
TSSLTLSQALLSREISRHGSNSSSDRVPLSIPTFSGLKSTKPPRLAGSVHRPRATHYRRQIVRAAVAETLGTTAETALVEKSINTIRFLAIDAVEKANSGHPGLPMGCAPMGHILYDEVMKYNPKNPYWFNRDRFILSAGHGCMLQYALLHLAGYDSVREEDLKSFRQWGSRTPGHPENFETPGVEVTTGPLGQGIANAVGLALAEKHLAARFNKPDSEVVDHYTYVILGDGCQMEGIANEACSLAGHWGLGKLIALYDDNHISIDGDTEIAFTESVDTRFEALGWHVIWVKNGNTGYDEIRAAIQEAKAVKDKPTMIKVTTTIGFGSPNKANSYSVHGSALGAKEVEATRSNLGWPYEPFHVPEDVQKHWSRHTPLGADFEAEWNAKFAEYEKKYPEEAAELKSIITGERPAGWEDALPKYTPESPGDATRNLSQQCLNALAKVLPGFLGGSADLASSNMTLLKMYGDFQKNTPEERNLRFGVREHGMGAICNGIALHSPGFIPYCATFFVFTDYMRAAMRISALSEAGVIYVMTHDSIGLGEDGPTHQPIEHLASFRAMPNILMFRPADGNETAGAYKVAVVNRKRPSIMALSRQKLPHLPGTSIEGVEKGGYIISDNSSGNKPDVILIGTGSELEIAFQAGEELRKEGKAVRVVSFVSWELFEEQSDAYKESVLPEAVSARVSIEAGSTFGWGKIVGSKGKAIGIDRFGASAPAGKIYKEFGITVEAVVAAARELS

SEQ ID NO: 22519 - protein, 748 aa, Citrus sinensis
MASSSSFTLSQALLTRGTSHHGFTQSSEHHRLALSTLSLPSFSGLKSTSSSTLRTPTSRRRLSTSQASLPIRAAAVETLETSTDAALVEKSVNTIRFLAVDAVEKANSGHPGLPMGCAPMGHILYDEVMRYNPKNPYWFNRDRFVLSAGHGCMLQYALLHLAGYDSVQEDDLKNFRQWGSKTPGHPENFETPGIEVTTGPLGQGMANAVGLALAEKHLAARYNKPDNEIVDHYTYVILGDGCQMEGIANEASSLAGHLGLGKLIAFYDDNHISIDGDTEIAFTENVDKRFEGLGWHVIWVKNGNTGYDDIRAAIKEAKAVTDKPTLIRVTTTIGFGSPNKANSYSVHGSALGAKEVDATRKNLGWPYEPFHVPEDVKKHWSRHVAEGATLEAEWNAKFAEYEKKYPEEAAEFKSISSGQLPAGWEKALPTYTPESPAEATRNLSQTCLNALAKTLPGLLGGSADLASSNMTLLKMFGDFQKDTPEERNVRFGVREHGMGAICNGIALHSPGLIPYCATFFVFTDYMRAAIRISALCEAGVIYVMTHDSIGLGEDGPTHQPIEHLASFRAMPNILMLRPADGNETAGAYKVAVANRKRPSILALSRQKLPHLAGTSIDGVEKGAYIISDNSSGNKPDVILIGTGSELEIAAKAAEELRKGGKAVRVVSFVSWELFDEQSDAYKESVLPAAVSARVSIEAGSTFGWEKIVGSKGKAIGIDRFGASAPAGKIYKEFGITAEAVITAAKEVC

SEQ ID NO: 22520 - protein, 748 aa, Citrus clementina
MASSSSFTLSQALLTRGTSHHGFTQSSEHHRLALSTLSLPSFSGLKSTSSSTLRTPTSRRRLSTSQASRPIRAAAVETLETSTDAALVEKSVNTIRFLAVDAVEKANSGHPGLPMGCAPMGHILYDEVMRYNPKNPYWFNRDRFVLSAGHGCMLQYALLHLAGYDSVQEDDLKNFRQWGSKTPGHPENFETPGIEVTTGPLGQGMANAVGLALAEKHLAARYNKPDNDIVDHYTYVILGDGCQMEGIANEASSLAGHLGLGKLIAFYDDNHISIDGDTEIAFTENVDKRFEGLGWHVIWVKNGNTGYDDIRAAIKEAKAVTDKPTLIRVTTTIGFGSPNKANSYSVHGSALGAKEVDATRKNLGWPYEPFHVPEDVKKHWSRHVAEGATLEAEWNAKFAEYEKKYPEEAAEFKSISSGQLPAGWEKALPTYTPESPAEATRNLSQTCLNALAKTLPGLLGGSADLASSNMTLLKMFGDFQKDTPEERNVRFGVREHGMGAICNGIALHSPGLIPYCATFFVFTDYMRAAIRISALCEAGVIYVMTHDSIGLGEDGPTHQPIEHLASFRAMPNILMLRPADGNETAGAYKVAVANRKRPSILALSRQKLPHLAGTSIDGVEKGAYIISDNSSGNKPDVILIGTGSELEIAAKAAEELRKGGKAVRVVSFVSWELFDEQSDAYKESVLPAAVSARVSIEAGSTFGWEKIVGSKGKAIGIDRFGASAPAGKIYKEFGITAEAVITAAKEVC

SEQ ID NO: 22521 - protein, 734 aa, Panax ginseng
MAASSSLTLSQAILSRSIPRHGSNSSSQQTPSSLSSFSHLPTFSTSLRSSSRRCSSAAGRQVVRAAVVETLDKTETSLVEKSVNTIRFLAIDAVEKANSGHPGLPMGCAPMGHILYDEVMRYNPKNPYWFNRDRFVLSAGHGCMLQYALLHLAGYDSVLEEDLKSFRQWGSRTPGHPENFETPGVEVTTGPLGQGIANAVGLALVEKHLAARFNKPDCEIVDHYTYAILGDGCQMEGIANEACSLAGHWGLGKLIAFYDDNHISIDGDTEIAFTESVDTRFEGLGWHIIWVKNGNTGYDDIRAAIKEAKAVTDRPTLIKVTTTIGFGSPNKANSYSVHGSALGAKEVDATRKNLGWPYEPFHVPEDVKQHWSRHTSEGASLEAAWNAKFAEYEKKYAEEAAELKSIITGVLPDGWETSLPTYTPEIPADATRNLSQTCLNALAKVLPGLLGGSADLASSNMTLLKMFGDFQKGTPEERNVRFGVREHGMGAICNGIALHSPGLIPYCATFFVFTDYMRGAIRISALSEAGVIYVMTHDSIGLGEDGPTHQPIEHLASFRAMPNILMLRPADGNETAGAYKVAVLNRKRPSILALSRQKLPNLPGTSIEGVEKGGYTISDNSSGNKPDVILIGTGSELEIAAKAADELRKEGKAVRVVSFVSWELFDEQSDDYKESVLPAAVTARVSIEAASTFGWGKLVGRGIDKFGASAPAGKTYKEYGITSEAVIAAAKELI

SEQ ID NO: 22522 - protein, 743 aa, Triphysaria pusilla
MASSSLTLSQAILSRSSIPRHGSTHNLLPSPSSSALPSFSGLKSISSSSVSRRRASGAAIARLPVRASAAVETLEKTTDTELIDKSVNTIRFLSIDAVEKANSGHPGLPMGCAPMGHLLYDEVMRYNPKNPYWFNRDRFVLSAGHGCMLQYALLHLAGYDAVKEEDLKSFRQWGSKTPGHPENFETPGIEVTTGPLGQGIANAVGLALAEKHLAARYNKPDSEIVDHYTYCILGDGCQMEGISNEACSLAGHWGLGKLIAFYDDNHISIDGDTEIAFTENVDTRFEALGWHVIWVKNGNTGYDEIRAAIKEAKSVTDKPTLIKVTTTIGFGSPNKANSYSVHGSALGSKEVEATRQNLGWPFEPFHVPDDVKSHWSRHTAEGAAFEAEWNAKFAEYSKKYSEEAAELKSIITGEFPAGWEKALPTYTPESPADATRNLSQQNLNALAKVLPGLIGGSADLASSNMTLLKTFGDFQKNTPEERNVRFGVREHGMGAICNGIAHHSPGFVPYCATFFVFTDYMRGAMRISALSEAGVIYVMTHDSIGLGEDGPTHQPIEHLASFRAMPNILMLRPADGNETAGAYKVAAVNRKRPSVLALSRQKLTQLPGTSIEGVEKGGYIISDNSSGNKPDVILIGTGSELEIAAKAADELRKEGKVVRVVSFVSWELFDDQSDEYKESVLPASVTARVSIEAASTFGWDKIVGSKGKAIGIDRFGASAPAGKIYQEFGITAEAVIAAAKALC

SEQ ID NO: 22523 - protein, 743 aa, Triphysaria pusilla
MASSSSLTLSQAILSRPSIPRHVSAQHIHPSSTSPTLPSFSGLKSTSSSTVSRRRATASVTRLPIRASAAVETLDKTTDTELIDKSVNTIRFLAIDSVEKANSGHPGLPMGCAPMGHLLYDEVMRYNPKNPYWFNRDRFVLSAGHGCMLQYALLHLAGYDAVKEEDLKSFRQWGSKSPGHPENFETPGIEVTTGPLGQGIANAVGLALVEKHLAARYNKPDSEIVDHYTYCILGDGCQMEGISNEACSLAGHWGLGKLIAFYDDNHISIDGDTEIAFTENVDTRFEALGWHVIWVKNGNTGYDEIRAAIKEAKSVTDKPTLIKVTTTIGFGSPNKANSYSVHGSALGSKEVDATRQNLGWPYEPFHVPDDVKSHWSRHTAEGAAIEAEWDAKFADYSKKYPEEAAELKSIITGEFPAGWEKALPTYTPESPADATRNLSQQNLNALAKVLPGLIGGSADLASSNMTLLKTFGDFQKNTPEERNVRFGVREHGMGAICNGIALHSPGFVPYCATFFVFTDYMRGAMRISALSEAGVIYVMTHDSIGLGEDGPTHQPIEHLASFRAMPNILMLRPADGNETAGAYKVAVVNRKRPSVLALSRQKLTQLPGTSIEGVEKGGYIISDNSSGNKPDVILIGTGSELEIAAKAGDELRKEGKAVRVVSFVSWELFDDQSDEYKESVLPASVTARVSIEAASTFGWGKIVGSKGKAIGIDRFGASAPAGKIYEEFGITAEAVIAAAKELC

SEQ ID NO: 22524 - protein, 743 aa, Triphysaria pusilla
MASSSLTLSQAILSRSSIPRHGSTQNLLPSPSSSALPSFSGLKSISSSSVSRRRASGAAITRLPVRASAAVETLEKTTDTELIDKSVNTIRFLSIDAVEKANSGHPGLPMGCAPMGHLLYDEVMRYNPKNPYWFNRDRFVLSAGHGCMLQYALLHLAGYDAVKEEDLKSFRQWGSKTPGHPENFETPGIEVTTGPLGQGIANAVGLALAEKHLAARYNKPDSEIVDHYTYCILGDGCQMEGISNEACSLAGHWGLGKLIAFYDDNHISIDGDTEIAFTENVDTRFEALGWHVIWVKNGNTGYDEIRAAIKEAKSVTDKPTLIKVTTTIGFGSPNKANSYSVHGSALGSKEVEATRQNLGWPFEPFHVPDDVKSHWSRHTAEGAAFEAEWNAKFAEYSKKYSEEAAELKSIITGEFPAGWEKALPTYTPESPADATRNLSQQNLNALAKVLPGLIGGSADLASSNMTLLKTFGDFQKNTPEERNVRFGVREHGMGAICNGIAHHSPGFVPYCATFFVFTDYMRGAMRISALSEAGVIYVMTHDSIGLGEDGPTHQPIEHLASFRAMPNILMLRPADGNETAGAYKVAAVNRKRPSVLALSRQKLTQLPGTSIEGVEKGGYIISDNSSGNKPDVILIGTGSELEIAAKAADELRKEGKTVRVVSFVSWELFDDQSDEYKESVLPASVTARVSIEAASTFGWDKIVGSKGKAIGIDRFGASAPAGKIYQEFGITAEAVIAAAKALC

SEQ ID NO: 22525 - protein, 741 aa, Cleome gynandra
MASTSSLALSQALLARAISHHGSDQRVSLPTTFTGLNSTAPRAASSSFRRRAGQTGRRSLRPVIRAAAVETLDPTTEASLVEKSVNTIRFLAIDAVEKAKSGHPGLPMGCAPMGHILYDEVMRYNPKNPYWFNRDRFVLSAGHGCMLQYALLHLAGYDSVLEEDLKNFRQWGSKTPGHPENFETPGIEVTTGPLGQGIANGVGLALAEKHLAARFNKPDNEIVDHYTYVILGDGCQMEGISNEACSLAGHWGLGKLIALYDDNHISIDGDTDIAFTESVDQRFESLGWHVIWVKNGNNGYDEIRAAIKEAKAVKDKPTLIKVTTTIGFGSPNKANSYSVHGSALGDKEVEATRKNLGWPYEPFHVPDDVKSHWSRHTPEGAALEADWNTKFAEYEKKYPEEAAELKSIITGELPSGWEKALPTYTPESAGDATRNLSQQCLNALANVIPGFLGGSADLASSNMTLLKMFGDFQKGTPEERNLRFGVREHGMGAICNGICLHSPGLIPYCATFFVFTDYMRAAMRISALSEAGVIYVMTHDSIGLGEDGPTHQPIEHLVSFRAMPNIMMFRPADGNETAGAYKIAVSKRKTPSVLALSRQKLPQLPGTSIEGVEKGGYTISDNSSGNKPDVILIGTGSELEIAAMAADELRKEGKAVRVVSFVCWELFNEQSDAYKESVLPSDVSARVSIEAGSTFGWEKIVGSKGKAIGIDSFGASAPAGILYKEFGITVDAVVAAAKELI

SEQ ID NO: 22526 - protein, 744 aa, Euphorbia peplus
MASTTSSLSLSQVLLARAISHQTSDNHHRLSLSTPSLPAFSGLKSTTSSIPRATSSPRNNRRRVSRVRAAAVEAVDVTTETALVDKSVNTIRFLAIDAVEKANSGHPGLPMGCAPMGHILYDEVMKYNPKNPYWFNRDRFVLSAGHGCMLQYALLHLAGYDSVQEEDLKQFRQWGSRTPGHPENFETPGVEVTTGPLGQGIANAVGLALAEKHLAARFNKPGSEVVDHYTYCILGDGCQMEGIANEACSLAGHWGLGKLIAFYDDNHISIDGDTEIAFTESVDKRFEGLGWHVIWVKNGNTGYDEIRAAIKEAKAVTDKPTMIKVTTTIGYGSPNKSNSYSVHGSALGSKEVDATRQNLGWPYEPFHVPEDVKKHWSRHVDGGASFEAEWNAKFAEYEKKYPQEAAEFKSIITGELPAGWEKALPTYTPETPAEATRNLSQTNLNALATVLPGLIGGSADLASSNMTLLKMFGDFQKDTPEERNVRFGVREHAMGAICNGIGLHSPGFIPYCATFFVFTDYMRASMRISALSETGVIYVMTHDSIGLGEDGPTHQPIEHLASFRAMPNILMLRPADGNETAGSYKVAVDNRKRPSVLALSRQKLPNLPGTSIEGVEKGGYTISDNSTGNKPDVILIATGSELEIAAKAGDELRKEGKTVRVVSFVSWELFEDQSAEYKESVLPEAVTARVSIEAATTFGWHKIVGSKGKAIGIDHFGASAPAGKIYKEFGITAEAVIAAAKEVC

SEQ ID NO: 22527 - protein, 739 aa, Gossypium raimondii
MASTSSLTLSQALLARTIFSDGSTQFSDYRVSLPTTTFSGLKLTTPRSRRVLPTRLNRSLRVRSAAVETIGTPAETSLLEKSVNTIRFLAIDAVEKANSGHPGLPMGCAPMGHILYDEIMRYNPKNPYWFNRDRFVLSAGHGCMLQYALLHLAGYDSVQEDDLKNFRQWQSRTPGHPENFETPGVEVTTGPLGQGIANAVGLALAEKHLAARFNKPDNEIVDHYTYAILGDGCQMEGVANEACSLAGHWGLGKLIAFYDDNHISIDGDTEIAFTENVEERFKGLGWHVIWVKNGNTGYDEIRAAIKEAKAVKDKPTLIKVTTTIGYGSPNKANSYSVHGSALGAKEVDATRKNLAWPHEPFHVPEDVKGHWSRHVQQGAALEAEWNAKFAEYEKKYKNEAAELKLIITGEPPAGWEKALPTYTPESPADATRNLSQQNLNALVKVLPGFLGGSADLASSNMTLLKMYGNFQKDTPEERNLRFGVREHGMGAICNGIAHHSPGLIPYCATFFVFTDYMRAAIRMSALSQAGVIYVMTHDSIGLGEDGPTHQPIEHLASLRAMPNVFMLRPADGNETAGAYKVAILNRNTPSIIALSRQKLPQLPGTSIEGVEKGGYIISDNSSGNNPDIILIGTGSELEIAAKAADELRKGGKAVRVVSLVSWELFDNQSDAYKESVLPSGVSARVSIEAGSTFGWEKIVGSKGKAIGIDRFGASAPAGRLYKEFGLTPEAVVAAAKELC

SEQ ID NO: 22528 - protein, 743 aa, Triphysaria pusilla
MASSSLTLSQAILSRSSIPRHGSTQTLLPSPSSSALPSFSGLKSTSSFSVSRRRASGAAIARLHVRASAAVETLEKTTDTELIDKSVNTIRFLSIDAVEKANSGHPGLPMGCAPMGHLLYDEVMRYNPKNPYWFNRDRFVLSAGHGCMLQYALLHLAGYDAVKEEDLKSFRQWGSKTPGHPENFETPGIEVTTGPLGQGIANAVGLALAEKHLAARYNKPDSEIVDHYTYCILGDGCQMEGISNEACSLAGHWGLGKLIAFYDDNHISIDGDTEIAFTENVDTRFEALGWHVIWVKNGNTGYDEIRAAIKEAKSVTDKPTLIKVTTTIGFGSPNKANSYSVHGSALGSKEVEATRQNLGWPFEPFHVPDDVKSHWSRHTAEGAAFEAEWNAKFAEYSKKYPEEAAELKSIITGEFPAGWEKALPVYTPESPADATRNLSQQNLNALAKVLPGLIGGSADLASSNMTLLKTFGDFQKNTPEERNVRFGVREHGMGAICNGIAHHSPGFVPYCATFFVFTDYMRGAMRISALSEAGVIYVMTHDSIGLGEDGPTHQPIEHLASFRAMPNILMLRPADGNETAGAYKVAAVNRKRPSVLALSRQKLTQLPGTSIEGVEKGGYIISDNSSGNKPDVILIGTGSELEIAAKAADELRKEGKAVRVVSFVSWELFDEQSDEYKESVLPASVTARVSIEAASTFGWDKIVGSKGKAIGIDRFGASAPAGKIYQEFGITAEAVIAAAKALC

SEQ ID NO: 22529 - protein, 750 aa, Tropaeolum majus
MASTSSLTLSQALLAKSISTQSSDHRVSLSTLSVPSFSGLKSSTSSARVSAAAAFSRRRRLFSTGQQQVQRTVRAAAVETVETTTEASLVDKSVNTIRFLAIDAVEKAKSGHPGLPMGCAPMGHILYDEIMKYNPKNPYWFNRDRFVLSAGHGCMLQYALLHLAGYDSVKEEDLKQFRQWGSKSPGHPENFETPGVEVTTGPLGQGIANAVGLALAEKHLAARFNKPDSEIVDHYTYCILGDGCQMEGISNEACSLAGHWGLGKLIAFYDDNHISIDGDTEIAFTESVDQRFEGLGWHVIWVKNGNTGYDEIRAAIKEAKAVTDKPTLIKVTTTIGYGSPNKANSYSVHGSALGEKEVDATRQNLGWPYEPFHVPEDVKSHWSRHTPEGAAFEAEWNAKFAAYEKKYSEEAAELNSIIKGELPAGWEKALPTYTPETPGDATRNLSQQCLNALAPVVPGLVGGSADLASSNMTLLKMFGDFQKATPEERNIRFGVREHGMGAICNGIALHTPGLIPYCATFFVFTDYMRAAMRISALSEAGVIYVMTHDSIGLGEDGPTHQPIEHLASFRAMPNILMLRPADGNETAGSYKVAIQNRKRPSILALSRQKLPNLPGSSIEGVEKGGYIISDNSSDNKPDVILIGTGSELEIAFKAGEELRKEGKTVRVVSFVSWELFDDQSDDYKESVLPAGVTARVSIEAGTTFGWHKIVGSKGKAIGIDHFGASAPAGIIYKEFGITVEAVIAAAKEVL

SEQ ID NO: 22530 - protein, 743 aa, Triphysaria pusilla
MASSSSLTLSQAILSRPSIPRHVSAQHIHPSSTSPTLPSFSGLKSTSSSTVSRRRATASVTRLPLRASAAVETLDKTTDTELIDKSVNTIRFLAIDSVEKANSGHPGLPMGCAPMGHLLYDEVMRYNPKNPYWFNRDRFVLSAGHGCMLQYALLHLAGYDAVKEEDLKSFRQWGSKSPGHPENFETPGIEVTTGPLGQGIANAVGLALVEKHLAARYNKPDSEIVDHYTYCILGDGCQMEGISNEACSLAGHWGLGKLIAFYDDNHISIDGDTEIAFTENVDTRFEALGWHVIWVKNGNTGYDEIRAAIKEAKSVTDKPTLIKVTTTIGFGSPNKANSYSVHGSALGSKEVDATRQNLGWPYEPFHVPDDVKSHWSRHTAEGAAIEAEWDAKFSDYSKKYPEEAAELKSIITGEFPAGWEKALPTYTPESPADATRNLSQQNLNALAKVLPGLIGGSADLASSNMTLLKTFGDFQKNTPEERNVRFGVREHGMGAICNGIALHSPGFVPYCATFFVFTDYMRGAMRISALSEAGVIYVMTHDSIGLGEDGPTHQPIEHLASFRAMPNILMLRPADGNETAGAYKVAVVNRKRPSVLALSRQKLTQLPGTSIEGVEKGGYIISDNSSGNKPDVILIGTGSELEIAAKAGDELRKEGKAVRVVSFVSWELFDDQSDEYKESVLPASVTARVSIEAASTFGWGKIVGSKGKAIGIDRFGASAPAGKIYEEFGITAEAVIAAAKELC

SEQ ID NO: 22531 - protein, 730 aa, Amsonia hubrichtii
RSVPRHGSSSSSNPSLPSISLPTFSGLKSTVPPTTVSRRRSSVPAISRRQNQVFASAAVETLEKTDTELVEKSVNTIRFLAIDAVEKANSGHPGLPMGCAPMGHILYDEVMRYNPKNPYWFNRDRFVLSAGHGCMLQYALLHLAGYDAVKDEDLKGFRQWGSKTPGHPENFETPGVEVTTGPLGQGIANAVGLALAEKHLAARYNKPDSEIVDHYTYCILGDGCQMEGISNEACSLAGHWGLGKLIAFYDDNHISIDGDTEIAFTETVETRFEALGWHVIWVKNGNTGYDEIRAAIKEAKAVKDRPTLIKVTTTIGFGSPNKANSYSVHGSALGAKEVEATRKNLGWPYEPFHVPEDVKKHWSRHVPSGAAYEAEWNAKFAEYEKKYAEEAAELKSIITGELPAGWEKALPTYTPESPADATRNLSQQNLNALAKVLPGLLGGSADLASSNMTLLKMFGDFQKSTPEERNVRFGVREHGMGAICNGIALHSPGLIPYCATFFVFTDYMRAAMRISALCEAGVIYVMTHDSIGLGEDGPTHQPIEHLASFRAMPNILMLRPADGNETAGAYKVAVVNRKRPSVLALSRQKLPQLAGSSIEGVEKGGYTISDNSSGNKPDVILIGTGSELEIAVKAADELRKEGKAVRVVSFVSWELFDEQSAEYKESVLPASVTARVSIEAGSTFGWEKIVGSKGKAIGIDRFGASAPAGKIYKEFGLTAEAVVAAAKEVM

SEQ ID NO: 22532 - protein, 730 aa, Phaseolus vulgaris
MASSSSLSLSQALLRPTPLSSSHCPSLRVSPSLRPAPPTAPLSLRRRAAPVRASVPLKTVEKATSDIALVEKSVNTIRFLAIDSVEKANSGHPGLPMGCAPMGHVLYDEAMKYNPKNPKWFNRDRFVLSAGHGCMLQYALLHLAGFDSVKEEDLRQFRQWGSRTPGHPENFETPGVEVTTGPLGQGIANAVGLALAEKHLAARFNKPDNEIVDHYTYAILGDGCQMEGIANEACSLAGHWGLGKLIAFYDDNHISIDGNTEIAFTESVDSRFEGLGWHVIWVKNGNNGYDDIRAAIEEAKSVKDKPTLIKVTTTIGFGSPNKANSYSVHGSALGAKEVDATRQNLGWPYEPFHVPEDVKKHWSRHIPEGAALEAEWNIKFAEYEKKYKEEAAELKSIINGELPAGWEKALPTYTPESPADATRNLSQQNLNALAKVLPGLLGGSADLASSNMTLLKMFGDFQKDTPAERNVRFGVREHGMGAICNGIALHSPALIPYCATFFVFTDYMRGAIRLSALSEAGVIYVMTHDSIGLGEDGPTHQPIEHLASFRAMPNILMLRPADGNETAGAYKVAVLNRKRPSILALSRQKLPNLPGSSIEGVEKGGYTISDNSTGNKPDAILIGTGSELEIAAKAAEDLRKEGKTVRVVSLVSWELFDEQSEAYKESVLPAAVSARVSIEAGSTFGWEKIVGSKGKAIGIDRFGASAPAGKIYKEFGITKEAVIAAAKELI

SEQ ID NO: 22533 - protein, 741 aa, Orobanche aegyptiaca
MACSSSFTLSQAILSRSANPRHGSAHQLHPSSSVSIPSFSGIKSTSSTVTRRRPSSAVTRLPVRASSAIETLQKTTDTELVDKSVNTIRFLAIDAVEKANSGHPGLPMGCAPMGHILYDEVMRYNPKSPYWFNRDRFVLSAGHGCMLQYALLHLAGYDAVKEEDLKSFRQWGSKTPGHPENFETPGVEVTTGPLGQGVANAVGLALAEKHLAARYNKQDSEIVDHYTYVILGDGCQMEGISNEACSLAGHWGLGKLIAFYDDNHISIDGDTEIAFTENVETRFEALGWHVIWVKNGNNGYDEIRAAIKEAKAVKDKPTLIKVTTTIGFGSPNKANSYSVHGSALGAKEVKATRQNLGWPYEPFHVPEDVKNHWSRHVAEGAAFEAQWNAKFAEYAKKYPEEAAELKSIITGELPGGWEKALPTYTPESPADATRNLSQQNLNALAKVLPGLLGGSADLASSNMTLLKTFGDFQKTTPEERNIRFGVREHSMGAICNGIALHSPGLIPYCATFFVFTDYMRAAMRISALSEAGVIYVMTHDSIGLGEDGPTHQPIEHLASFRAMPNILMFRPADGNETAGAYKVAVVNRKRPSVLALSRQKLPQLPGTSIEGVEKGGYIVSDNSSGNKPDVILIGTGSELEIAVRAGDELRKEGKGVRVVSFVSWELFDEQSDEYKEGVLPSSVTARVSIEAGSTFGWEKIVGPKGKAIGIDRFGASAPAGKIYKEFGITSEAVIAAAKKLC

SEQ ID NO: 22534 - protein, 737 aa, Cajanus cajan
HHSHSLPTMPSSLSLSQPALLRPAALPSSDRPSLRLPLALRHAATPLSLALRRRPASVRASVSVRTVEKAPAEAALVEKSVNTIRFLAVDAVEKANSGHPGLPMGCAPMGHVLYDEAMRYNPKNPFWFNRDRFVLSAGHGCMLQYALLHLAGYDSVKQEDLKEFRQWGSRTPGHPENFETPGIEVTTGPLGQGIANAVGLALAEKHLAARFNKPDNEIIDHYTYVILGDGCQMEGIANEACSLAGHWGLGKLIAFYDDNHISIDGNTEIAFTESVDSRFEGLGWHVIWVKNGNNGYDDIRAAIKEAKAVKDRPTLIKVTTTIGYGSPNKANSYSVHGSALGAKEVDATRQNLGWPYEPFHVPEDVKKHWSRHIPEGAALEAEWNAKFAEYEKKYKEEAAELKSIINGELPAGWEKALPTYTPESPADATRNLSQQNLNALAKVLPGLLGGSADLASSNMTLLKMSGDFQKDTPSERNVRFGVREHGMGAICNGIALHSPGLIPYCATFFVFTDYMRGAIRLSALSEAGVIYVMTHDSIGLGEDGPTHQPVEHLASFRAMPNILMLRPADGNETAGAYKVAVVNRKRPSILALSRQKLPQLPGTSIEGVEKGGYTISDNSTGNKPDVILIGTGSELEIAAKAADDLRKEGKAVRVVSLVSWELFDEQSEAYKESVLPAAVSARVSIEAGSTFGWEKIVGAKGKAIGIDRFGASAPAGKIYKEFGITKEAVVAAAKELI

SEQ ID NO: 22535 - protein, 734 aa, Lupinus angustifolius
MSSSSSLSLSQSLLTKPTSHRSPSLSPTHLSLPTHHLTTTRRRITTLHHRRITPIRASAAVETLNKPTADLSLVEKSVNTIRFLAVDAVEKANSGHPGLPMGCAPMGHVLYDEVMRYNPKNPYWFNRDRFVLSAGHGCMLQYALLHLAGYDSVKEEDLKQFRQWESRTPGHPENFETPGIEVTTGPLGQGIANAVGLALAEKHLAARFNKPDNEIVDHYTYAILGDGCQMEGIANEACSLAGHWGLGKLIAFYDDNHISIDGNTEIAFTENVDSRFEGLGWHVIWVKNGNNGYDDIRAAIKEAKAVKDKPTLIKVTTTIGFGSPNKANSYSVHGSALGAKEVDATRNNLGWPYEPFHVPEDVKKHWSRHIPEGAALEAEWNAKFAEYEKKYKEEAAELKSLISGELPAGWEKALPTYTPEIPADATRNLSQQNLNALAKVLPGLLGGSADLASSNMTLLKTSGDFQKNTPAERNIRFGVREHGMGAICNGIALHSPGLIPYCATFFVFTDYMRGAIRLSALSQAGVIYVMTHDSIGLGEDGPTHQPIEHLASFRAMPNILMLRPADGNETAGAYKVAVLNRKRPSILALSRQKLPNLPGSSIEGVEKGGYIISDNSTGNKPDVILIGTGSELEIAAKAADDLRKEGKAVRVVSFVSWELFDEQSESYKESVLPAAVSARVSIEAGTTFGWEKIVGSKGRAIGIDHFGASAPAGKIYKEFGITKEAVIAAAKELI

SEQ ID NO: 22536 - protein, 736 aa, Rosmarinus officinalis
MASSTSLTVSKVVLSRSSFASHGSIPASSSLSVPSSGLKSATSITTTSASRRHGPIPIRASAAVETLGQTTDTELMEKSVNTIRFLSIDAVEKANSGHPGLPMGCAPIGHVLYDEVMRYNPKNPYWFNRDRFVLSAGHGCMLQYALLHLAGYDAVKEEDLRNFRQWGSKTPGHPENFETPGVEVTTGPLGQGAANAVGLALAEKHLAARYNKPDSKIIDHYTYCILGDGCQMEGIANEACSLAGHWGLGKLIAFYDDNHISIDGNTEIAFTESVEARFEALGWHVIWVKNGNTGYDEIRAAIEEAKAVKDKPTLIKVTTTIGFGSPNKANSYSVHGSALGAKEVEATRKNLGWPHEPFHVPEDVKKHWSRHVADGAALEAEWNTKFAQYEKKYPEEAAELNSIITGQLPAGWEKALPTYTPESPADATRNLSQQNLNALAKVLPGLLGGSADLASSNMTLLKMFGDFQKNIPEERNVRFGVREHSMGAICNGIALHSPGLIPYCATFFVFTDYMRAAMRISALSEARVLYVMTHDSIGLGEDGPTHQPIEHLASFRAMPNILMLRPADGNETAGAYRVAVLNRKRPSVLALSRQKLPNLPGTSIEGVEKGGYTISDNSTGNKPDVILIGTGSELEIAAKAGDELRKEGKAVRVVSFVSWELFDDQSDEYKESVLPAAVTARVSIEAGTTFGWGKIIGDKGKAIGIDRFGASAPAPKIYKEFGLTVEAVIAAAKEVC

SEQ ID NO: 22537 - protein, 731 aa, Glycine max
MASSTSSISLSQALLRPTTTSLPSSSSSLRLTPTLRPTPPALSLRRRLTTSIRAAASVKTVEKATADAALVEKSVNTIRFLAIDAVEKANSGHPGLPMGCAPMGHVLYDETMKYNPKNPFWFNRDRFVLSAGHGCMLQYALLHLAGFDSVKEEDLREFRQWGSRTPGHPENFETPGIEVTTGPLGQGIANAVGLALAEKHLAARYNKPDNEIVDHYTYAILGDGCQMEGIANEACSLAGHWGLGKLIAFYDDNHISIDGNTEIAFTESVDSRFEGLGWHVIWVKNGNNGYDDIRAAIKEAKAVKDKPTLIKVTTTIGYGSPNKANSYSVHGSALGAKEVDATRQNLGWSHEPFHVPEDVKKHWSRHTPEGAALEAEWNAKFAEYEKKYKEEAAELKSIINGEFPAGWEKALPTYTPESPADATRNLSQTNLNALAKVLPGLLGGSADLASSNMTLLKMFGDFQKDTPAERNVRFGVREHGMGAICNGIALHSPGLIPYCATFFVFTDYMRGAIRLSALSEAGVIYVMTHDSIGLGEDGPTHQPIEHLASFRAMPNILMLRPADGNETAGAYKVAVLNRKRPSILALSRQKLPQLPGTSIEGVEKGGYTISDNSTGNKPDVILIGTGSELEIAAKAADDLRKEGKAVRVVSLVSWELFDEQSEAYKESVFPAAVSARVSIEAGSTFGWEKIVGAKGKAIGIDRFGASAPAGRIYKEFGITKEAVVAAAKELI

SEQ ID NO: 22538 - protein, 730 aa, Vigna unguiculata
MASSSSLSLSKALLRPTPLPSSHHPSLRLSPSLRPSPPTPPLSLRRRATHVRASVPVKTAEKATSDVALVEKSVNTIRFLAIDAVEKANSGHPGLPMGCAPMGHVLYDEVMKYNPKNPKWFNRDRFVLSAGHGCMLQYALLHLAGFDSVKEEDLREFRQWGSRTPGHPENFETPGVEVTTGPLGQGIANAVGLALAEKHLAARFNKPDNEIVDHYTYVILGDGCQMEGIANEACSLAGHWGLGKLIAFYDDNHISIDGNTEIAFTESVDSRFEGLGWHVIWVKNGNNGYEDIRAAIEEAKSVKDKPTLIKVTTTIGYGSPNKANSYSVHGSALGAKEVDATRKNLGWPYEPFHVPEDVKKHWSRHIPEGAAFEAEWNIKFAEYERKYKEEAAELKSIINGELPAGWEEALPTYTPESPADATRNLSQQNLNALAKVLPGLLGGSADLASSNMTLLKTFGDFQKDTPAERNVRFGVREHGMGAICNGIALHSPGLIPYCATFFVFTDYMRGAIRLSALSEARVVYVMTHDSIGLGEDGPTHQPIEHLASFRAMPNILMLRPADGNETAGAYKVAVLNRKRPSILALSRQKLPNLPGSSIEGVEKGGYTISDNSSGNKPDVILIGTGSELEIAAKAGEELRKEGKSVRVVSLVSWELFDEQSEEYKESVLPGAVSARVSIEAGSTFGWEKIVGPKGKAIGIDRFGASAPAGKIYKEFGITKEAVIAAAKELI

SEQ ID NO: 22539 - protein, 729 aa, Lupinus angustifolius
MASTSSLSLSQSLFFIKPTSPKPSSYSLSIPTNHGFSSKSSLSSSSSLRRRTITASTAAPTTEGTTTLVDKSVNSIRFLSIDAVEKANSGHPGLPMGCAPMGHILYDEVMKYNPKNPKWFNRDRFVLSAGHGCMLQYALLHLAGYDSVKEEDLKEFRQWGSKTPGHPENFETPGVEVTTGPLGQGIANAVGLALAEKHLAARFNKPDNEIIDHYTYAILGDGCQMEGIANEACSLAGHWGLGKLIAFYDDNHISIDGDTEIAFTESVDSRFEGLGWHVIWVKNGNNGYDDIRAAIKEAKAVKDKPTLIKVTTTIGYGSPNKSNSYSVHGSALGAKEVDATRKNLGWPHEPFQVPEEVKKHWSRHIPEGAALETEWNAKFAEYEKKYEDDAAVLKSIISGELPAGWEKELPTYTPESPADATRNLSQHNLNALAKVLPGLLGGSADLASSNMTLLKAFGNFQKDTPEERNVRFGVREHGMGAICNGIALHSPGLIPYCATFFVFTDYMRGAIRLSALSEAGVIYVMTHDSIGLGEDGPTHQPIEHLASFRAMPNILMLRPADGNETAGAYRVAVLNRKRPSILALSRQKLPNLPGTSIEGVEKGGYTISDNSSGNKPDVILIGTGSELEIAAQAADDLRKEGKAVRVVSFVSWELFDEQSDAYKESVLPASVSARVSIEAASTFGWAKIVGSKGKAIGIDGFGASAPAGRIYKEFGITKEAVIAAAKELI

SEQ ID NO: 22540 - protein, 735 aa, Petroselinum crispum
MAASSSLTLSQAILSRSIPRHNPSCSSPQQQNPSSSLSSLPIFSLKSAPRRRNYRPAVVRAAAVETLEKTEIELVEKSVNTIRFLAIDAVEKANSGHPGLPMGCAPMGHILYDEVMRYNPKNPYWFNRDRFVLSAGHGCMLQYALLHLAGYDSVLEEDLKQFRQWGSRTPGHPENFETPGVEVTTGPLGQGIANAVGLALAEKHLAARFNKPDSEIVDHYTYCIVGDGCQMEGISNEACSLAGHWGLGKLIAFYDDNHISIDGDTEIAFTESVDTRFEGLGWHIIWVKNGNTGYDEIRAAIKEAKAVTDKPTLIKVTTTIGFGSPNKANSYSVHGAALGASEVDATRKNLGWPYEPFHVPEDVKQHWSRHTPAGASLEAEWNAKFAEYEKKYAEEAAELKSIITGVQPAGWEKSLPTYTPEVPADATRNLSQACLNALAPAVPGLIGGSADLASSNMTLLKMFGDFQKGTPEERNVRFGVREHGMGAICNGIALHSPGFVPYCATFFVFTDYMRGAMRISALSEAGVIYVMTHDSIGLGEDGPTHQPIEHLASFRAMPNMLMFRPADGNETAGAYKVAVINRKRPSILALSRQKLPNLPGTSIEGVEKGGYTISDNSTGNKPDVILIGTGSELEIVAKAADELRKEGKAVRAVSFVSWELFDEQSAEYKESVLPAAVTARVSIEAASTFGWAKIVGSAGKAIGIDGFGASAPAGKIYKEYGITVEAVVAAAKELC

SEQ ID NO: 22541 - protein, 746 aa, Solanum lycopersicum
MASSSSLTLSQAILSRSVSRHGSSSSPNSQLSPSSISLPTFSGLKSTTATSFRRRILPSAAGAGRHSAIRASAAVETLQKTDNALVEKSVNTIRFLAIDAVEKANSGHPGLPMGCAPMGHILYDEIMRYNPKNPYWFNRDRFVLSAGHGCMLQYALLHLAGYDAVREEDLKSFRQWGSKTPGHPENFETPGVEVTTGPLGQGIANAVGLALSEKHLAARFNKPDAEIVDHYTYCILGDGCQMEGISQEAASLAGHWGLGKLIAFYDDNHISIDGDTEIAFTEDVAARYEALGWHVIWVKNGNTGYDEIRAAIKEAKAVTDKPTLIKVTTTIGFGSPNKSNSYSVHGSALGAKEVEATRQNLGWPYEPFHVPEEVKSHWSRHVPEGAALEAGWNTKFAEYEKKYPEEAADLKSIITGELPADWEKALPTYTPESPADATRNLSQQNLNALAKVLPGFLGGSADLASSNMTLMKMFGDFQKSTPEERNIRFGVREHGMGAICNGIALHSPGLIPYCATFFVFTDYMRAAIRISALAESRVIYVMTHDSIGLGEDGPTHQPIEHLASFRAMPNVLMLRPADGNETAGAYRVAILKNKTPSILALSRQKLPQLAGTSIEGTAKGGYTISDNSSGNKPDVILIGTGSELEIAVKAADELRKEGKAVRVVSFVSWELFDEQSAEYKESVLPAAVTARVSIEAGTTFGWEKIVGSKGKAIGIDRFGASAPAGKIYKEFGITAEAVIAAAKQVS

SEQ ID NO: 22542 - protein, 745 aa, Aristolochia fimbriata
MAASSSLTVSHALVARATAHHGSANHPDRSALPGFNLSTFAGKALKASSSASLCRKGRKLPAGARKAPVRAAAVEALPKAETALVEKSINTIRFLAIDAVEKANSGHPGLPMGCAPMGHILYDEVMRYNPKNPYWFNRDRFVLSAGHGCMLQYALLHLAGYDSVKEEDLKSFRQWGSRTPGHPENFETPGIEVTTGPLGQGIANAVGLALVEKHLAARFNKPDNEIVDHYTYAILGDGCQMEGIANEACSLAGHWGLGKLIAFYDDNHISIDGDTEIAFTESVDTRFEGLGWHVIWVKNGNTGYDEIRAAIEEAKAVKDKPTLIKVTTTIGYGSPNKANSYSVHGSALGAKEVDATRQNLGWPYEPFHVPEDVKSHWSRHAEAGATLEAEWNAKFAEYEKKYKEEAAELKSLVSGEFPAGWEKALPTYTPESPADATRNLSQQCLNALAKVLPGLLGGSADLASSNMTLLKMFGDFQKETPAERNVRFGVREHGMGAICNGIALHSPGLIPYCATFFVFTDYMRAAMRISALSEAGVIYVMTHDSIGLGEDGPTHQPIEHLASFRAMPNILMLRPADGNETAGAYKVAVLNRKRPSVLALSRQKLPQLPGTSIEGVEKGGYVISDNSSGGKPEVILIGTGSELEIAAKAADELRKEGKKVRVVSFISWELFDEQSDEYKESVLPSDVTARVSIEAGSTFGWEKIVGSKGKSIGIDRFGASAPAGKIYKEFGITAENVIAVAKSIL

SEQ ID NO: 22543 - protein, 746 aa, Solanum tuberosum
MASSSSLTLSQAILSRSVSRHGSSSSTNSQLSPSSLSLPTFSGLKSTTATSFRRHILPSAAASGRHSAIRASAAVETLEKTDNALVEKSVNTIRFLAIDAVEKANSGHPGLPMGCAPMGHILYDEIMRYNPKNPYWFNRDRFVLSAGHGCMLQYALLHLAGYDAVREEDLKSFRQWGSKTPGHPENFETPGVEVTTGPLGQGIANAVGLALSEKHLAARFNKPDAEIVDHYTYCIVGDGCQMEGISQEAASLAGHWGLGKLIAFYDDNHISIDGDTEIAFTEDVAARYEALGWHVIWVKNGNTGYDEIRAAIKEAKAVTDKPTLIKVTTTIGFGSPNKSNSYSVHGSALGAKEVEATRQNLGWPYEPFHVPEEVKSHWSRHVPEGAALEAGWNSKFAEYEKKYPEEAADLKSIITGELPADWEKALPTYTPESPADATRNLSQQNLNALAKVLPGFLGGSADLASSNMTLMKMFGDFQKSTPEERNIRFGVREHGMGAICNGIALHSPGLIPYCATFFVFTDYMRAAIRISALAESRVIYVMTHDSIGLGEDGPTHQPIEHLASFRAMPNVLMLRPADGNETAGAYRVAILKSKTPSILALSRQKLPQLAGTSIEGTAKGGYTISDNSSGNKPDVILIGTGSELEIAVKAADELRKEGKAVRVVSFVSWELFDEQSAEYKESVLPAAVTARVSIEAGTTFGWEKIVGSKGKAIGIDRFGASAPAGKIYKEFGITAEAVIAAAKQVS

SEQ ID NO: 22544 - protein, 746 aa, Solanum phureja
MASSSSLTLSQAILSRSVSRHGSSSSTNSQLSPSSLSLPTFSGLKSTTATSFRRHILPSAAASGRHSAIRASAAVETLEKTDNALVEKSVNTIRFLAIDAVEKANSGHPGLPMGCAPMGHILYDEIMRYNPKNPYWFNRDRFVLSAGHGCMLQYALLHLAGYDAVREEDLKSFRQWGSKTPGHPENFETPGVEVTTGPLGQGIANAVGLALSEKHLAARFNKPDAEIVDHYTYCIVGDGCQMEGISQEAASLAGHWGLGKLIAFYDDNHISIDGDTEIAFTEDVAARYEALGWHVIWVKNGNTGYDEIRAAIKEAKAVTDKPTLIKVTTTIGFGSPNKSNSYSVHGSALGAKEVEATRQNLGWPYEPFHVPEEVKSHWSRHVPEGAALEAGWNSKFAEYEKKYPEEAADLKSIITGELPADWEKALPTYTPESPADATRNLSQQNLNALAKVLPGFLGGSADLASSNMTLMKMFGDFQKSTPEERNIRFGVREHGMGAICNGIALHSPGLIPYCATFFVFTDYMRAAIRISALAESRVIYVMTHDSIGLGEDGPTHQPIEHLASFRAMPNVLMLRPADGNETAGAYRVAILKSKTPSILALSRQKLPQLAGTSIEGTAKGGYTISDNSSGNKPDVILIGTGSELEIAVKAADELRKEGKAVRVVSFVSWELFDEQSAEYKESVLPAAVTARVSIEAGTTFGWAKIVGSKGKAIGIDRFGASAPAGKIYKEFGITAEAVIAAAKQVS

SEQ ID NO: 22545 - protein, 745 aa, Chelidonium majus
MAASSSLTISQALVGRKIAHHGSTSHSDRLSLPGFSLSTLSGRTLKSSSSSKISSVGSRKRVNSLSSTVRAAAVETLQKTDNALVDKSVNTIRFLAIDAVEKANSGHPGLPMGCAPMGHILYDEIMRYNPKNPYWFNRDRFVLSAGHGCMLQYALLHLAGYDSVQEDDLKSFRQWGSRTPGHPENFETPGVEVTTGPLGQGVANAVGLALAEKHLAARFNKPDSEIVDHYTYCILGDGCQMEGIANEACSLAGHWGLGKLIAFYDDNHISIDGDTEIAFTESVDTRFEGLGWHVIWVKNGNTGYDEIRAAIKEAKAVTDKPTLIKVTTTIGFGSPNKANSYSVHGAALGAKEVDATRQNLGWPYEPFHVPEDVKKHWSRHASEGAALEAEWNAKFAEYEKKYKEEAAELKSIITGEFPAGWEKALPTYTPEIPADATRNLSQTCLNALAPVIPGLVGGSADLASSNMTLMKMFGDFQKDTPEERNIRFGVREHAMGAICNGIALHAPGFVPYCATFFVFTDYMRGAMRISALSEAGVIYVMTHDSIGLGEDGPTHQPIEHLASFRAMPNILMFRPADGNETAGAYKVAVVNRKRPSILALSRQKLSNLPGTSIEGVEKGGYIISCNASGNKPDVILAATGSELEIAAKAGDELRKEGKTVRVVSFVSWELFDEQSDEYKESVLPEAVTARVSIEAASTFGWQKIVGSKGKSIGIDRFGASAPAPKIYKEYGITAEAVIAAAKSLL

SEQ ID NO: 22546 - protein, 717 aa, Trifolium pratense
LNSDRAASSLSSTSTLSFPTLKPATSSSSGSRRRNATTTIRATAVETLDKTAEVSLVEKSVNTIRFLAIDAVEKANSGHPGLPMGCAPMGHILYDEIMRYNPKNPSWFNRDRFVLSAGHGCMLQYALLHLAGYDSVKEEDLKQFRQWGSKTPGHPENFETYGIEVTTGPLGQGIANGVGLALAEKHLAARFNKPDNEIIDHYTYCILGDGCQMEGIANEACSLAGHWGLGKLIAFYDDNHISIDGDTEIAFTESVEKRFEGLGWHVIWVQNGNTGFDEIRAAIKEAKAVKDRPTLIKFTTTIGYGSPNKSNSYSVHGSALGAKEVDATRNNLGWPYEPFHVPEDVKKHWSRHIPEGAALESEWNAKFAAYEKKYKEEAAVLKSIISGELPSGWEKALPTYTPEVPADATRNLSQTNLNALAKVLPGLLGGSADLASSNMTLLKAFGNFQSETPAERNVRFGVREHGMGAICNGIALHSPGLIPYCATFFVFTDYMRGAIRLSALSEAGVIYVMTHDSIGLGEDGPTHQPIEHLASFRAMPNILMLRPADGNETAGAYKVAVLNRKRPSILALSRQKLPNLPGTSIEGVGKGGYIVSDNSTGNKPDVILIGTGSELEIAYYAAEDLRKEGKAVRVVSFVSWELFDEQSDAYKESVLPGAVSARVSIEAGSTFGWEKIVGSKGKAIGIDRFGASAPAGRIYKEFGITKEAVIAAAKELI

SEQ ID NO: 22547 - protein, 742 aa, Gossypium hirsutum
MASTSSLTLSQALLARTIFSDGSTQFSDCSVSLPTTTFSGLKLTTPRSRRVLPTRFNRSLRVRSAAVETIGTPAETSLLEKSVNTIRFLAIDAVEKANSGHPGLPMGCAPMGHILYDEIMRYNPKNPYWFNRDRFVLSAGHGCMLQYALLHLAGYDSVQEDDLKNFRQWQSRTPGHPENFETPGVEVTTGPLGQGIANAVGLALAEKHLAARFNKPDNEIVDHYTYAILGDGCQMEGVANEACSLAGHWGLGKLIAFYDDNHISIDGDTEIAFTENVEERFKGLGWHVIWVKNGNTGYDEIRAAIKEAKAVKDKPTLIKVTTTIGYGSPNKANSYSVHGSALGAKEVDATRKNLVWPHEPFHVPEDVKGHWSRLVQQGAALEAEWNAKFAEYEKKYKDEAAELKLIITGELPAGWEKALPTYTPESPADATRNLSQQNLNALVKVLPGFFGGSADLASSNMTLLKMYGNFQKDTPEERNLRFGVREHGMGAICNGIAHHSPGLIPYCATFFVFTDYMRAAIRMSALSQAGVIYVMTHDSIGLGEDGPTHQPIEHLASLRAMPNVFMLRPADGNETAGAYKVAILNRNTPSIIALSRQKLTQLPGTSIKGVEKGGYIISDNSSGNNPDIILIGTGSELEIAAKAADELRKAGKAVRVVSLVSWELFDNQSDAYKESVLPSGVSARVSIEAGSTFGWEKIVGSKGKAIGIDRFGASAPAGRLYKEFGLTPEAVVAAAKELCWHY

SEQ ID NO: 22548 - protein, 735 aa, Cyclamen graecum
MAASSSLSLSNAILSHRRHASAPKPSLPAFSGLKPAPRATLAPSRAAKSLRRVAHLTRASAAVETVEKTATELVDKSVNTIRFLAIDAVEKANSGHPGLPMGCAPMGHILYDEVMRYNPKNPYWFNRDRFVLSAGHGCMLQYALLHLAGYDSVQEEDLKQFRQWGSRTPGHPENFETPGIEVTTGPLGQGVANAVGLALAEKHLAARFNKPGSEIVDHYTYVILGDGCQMEGIANEACSIAAHWGLGKLIAFYDDNHISIDGNTEIAFTENVDTRFEGLGWHVIWVKNGNTGYDEIRAAIEEAKSVKDKPTLIKVTTTIGYGSPNKANSYSVHGAALGAKEVDATRQNLGWPYEPFHVPEDVKKHWARHTPEGAALEAEWNAKFAEYEKKYAEEATELKSIITGELPAGWEKVLPKYTPDSPPEATRNLSQTNLNALATVIPGFLGGSADLASSNMTLLKMFGDFQKNTPEERNIRFGVREHGMGAICNGIALHSPGLIPYCATFFVFTDYMRAAIRISALCEAGVIYVMTHDSIGLGEDGPTHQPIEHLASFRAMPNVLMLRPADGNETAGSYKVAVLNRKRPSILALSRQKLPNLPGTSIEGVGKGGYIISDNSISGNKPDVILIGTGSELEIAAKAADELRKKLKAVRVVSFVSWELFDEQSDEYKESVLPEEVTARVSIEAGSTFGWQKIVGSKGKAIGIDRFGASAPAGKIYKEFGITVEAVIEAAKALF

SEQ ID NO: 22549 - protein, 745 aa, Panax ginseng
MAAASSSLSPSQSLISRSIPNNHGSTQQHSDRLALPGINLSSISATRTLSHASRAVIQSRRVGLRASVRASAVAETLEKTDTALVEKSVNTIRFLAIDAVEKANSGHPGLPMGCAPMGHVLYDEVMRYNPKNPYWFNRDRFVLSAGHGCMLQYALLHLAGYDSVKEEDLKSFRQWGSKTPGHPENFETPGIEVTTGPLGQGVANAVGLALAEKHLAARYNKPGNEIVDHYTYVILGDGCQMEGISNEACSLASHWGLGKLIAFYDDNHISIDGNTGIAFTESVDKRFEGLGWHVIWVKNGNTGYDEIRAAIEEAKAVKDKPTLIKVTTTIGFGSPNKANSYSVHGSALGAKEVDATRKNLGWSHEPFHVPEDVRKHWSHHTTKGAALEAEWNAKFAEYEKKYAEEAAELKSIFTGVLPSGWESALPKYTPESPADATRNLSQTCLNALAPVLPGLLGGSADLASSNMTLLKMFGDFQKGTPEERNVRFGVREHGMGAICNGIALHSPGLIPYCATFFVFTDYMRGAIRISALSEAGVIYVMTHDSIGLGEDGPTHQPIEHLASFRAMPNILMLRPADGNETAGAYKVAVVNRKRPSILALSRQKLPNLPGTSIEGVEKGGYTISDNSSGNKPDVILIGTGSELEIAAKAADELRKEGKAVRVVSFVSWELFDEQSDVYKESVLPAAVTARVSIEAGSTFGWVKIVGSGGKAIGIDGFGASAPAGKIYKEYGITAEAVIAAAKELF

SEQ ID NO: 22550 - protein, 735 aa, Daucus carota
MAASSSLTLSQAILSRSIPRHNPTCSSPQQQNPSSSLSSLPIFSLKSAPRRRNYRPAVVRAAAVETLEKTEIELVEKSVNTIRFLAIDAVEKANSGHPGLPMGCAPMGHILYDEVMRYNPKNPYWFNRDRFVLSAGHGCMLQYALLHLAGYDSVLEEDLKQFRQWGSKTPGHPENFETPGVEVTTGPLGQGIANAVGLALAEKHLAARFNKPDSEIVDHYTYCIVGDGCQMEGISNEACSLAGHWGLGKLIAFYDDNHISIDGDTEIAFTESVDTRFEGLGWHIIWVKNGNTGYDEIRAAIKEAKAVTDKPTLIKVTTTIGFGSPNKANSYSVHGAALGASEVDATRKNLGWPYEPFHVPEDVKKHWSRHTPDGAALEAEWNTKFAEYEKKYAEDAAELKSIITGVQPAGWEKSLPTYTPEVPADATRNLSQACLNALAPAVPGLIGGSADLASSNMTLLKMFGDFQKGTPEERNVRFGVREHGMGAICNGIALHSPGFVPYCATFFVFTDYMRGAMRISALSEAGVIYVMTHDSIGLGEDGPTHQPIEHLASFRAMPNMLMFRPADGNETAGAYKVAVINRKRPSILALSRQKLPNLPGTSIEGVEKGGYTISDNSTGNKPDVILIGTGSELEIVAKAADELRKEGKAVRAVSFVSWELFDEQSAEYKESVLPAAVTARVSIEAASTFGWAKIVGSAGKAIGIDGFGASAPAGKIYKEYGITVEAVVAAAKELC

SEQ ID NO: 22551 - protein, 744 aa, Olea europaea
MASSSSLTVSPPTLSGSSTRRHGSAQELHMAPNSLSLPKFTGLKSTNSTATAAVFRCRTPIITSLPVRASAVETIEKTTDSTLLDKSVNTIRFLAIDAVEKANSGHPGLPMGCAPMGHILYDEVMRYNPKNPKWFNRDRFVLSAGHGCMLQYALLHLAGYDSVKEEDLRSFRQWGSKTPGHPENFETPGVEVTTGPLGQGVANAVGLALAEKHLAARYNKPDCEVVDHYTYVILGDGCQMEGIANEASSLAAHWGLGKLIAFYDDNHISIDGNTEIAFSESVDARFEGLGWHVIWVKNGNTGYEEIRAAIEEAKAVKDKPTLIKVTTTIGYGSPNKANSYSVHGSALGAKEVEATRKSLSWPHEPFHVPEDVKKHWSRHVPDGAALEAEWNAKFAEYEKKYPEKAAELKSIITGELPAGWEKALPTYTPEAPADATRNLSQQNLNALAKVLPGLLGGSADLASSNMTLLKMFGDFQKSTPEERNVRFGVREHGMGAICNGIACHTPGLIPYCATFFVFTDYMRAAMRISALSEARVIYVMTHDSIGLGEDGPTHQPIEHLASFRAMPNILMLRPADGNETAGAYKVAVLNRKRPSVLALSRQKLPQLAGTSIEGVEKGGYIISDNSSSNKPDVILIGTGSELEIAVKAADELRKEGKAVRVVSFVSWELFDEQSNDYKESVLPSAVTARVSIEAGSTFGWEKIVGVKGKAIGIDGFGASAPAGKIYKEFGITMEAVVAAAKEVS

SEQ ID NO: 22552 - protein, 745 aa, Mimulus guttatus
MASSSSLTLSQAILSRSTISRHGSAQQLHPSPTSAALSIPSFSGLKAASSSAAASVSRRRAPATRLPVRASAAVETLEKTTDALVEKSVNTIRFLAIDAVEKANSGHPGLPMGCAPMGHVLYDEVMRYNPKNPYWFNRDRFVLSAGHGCMLQYALLHLAGYDAVKEEDLKSFRQWGSKTPGHPENFETPGVEVTTGPLGQGIANAVGLALAESHLAARYNKPDSKIVDHYTYCILGDGCQMEGISNEACSLAGHWGLGKLIAFYDDNHISIDGDTEIAFTENVDQRFEALGWHVIWVKNGNTGYDEIRDAIKEAKSVTDKPTLIKVTTTIGFGSPNKANSYSVHGAALGTKEVEATRENLGWPYEPFHVPDEVKKHWSRHTPEGAAYESEWNSKFAEYEKKYPEEAAELKSIITGELPSGWEKALPKYTPETPGDATRNLSQTNLNALAKVLPGLIGGSADLASSNMTLLKMFGDYQKKTPEERNVRFGVREHSMGAICNGIALHSPGFIPYCATFFVFTDYMRSAMRISALSEAGVIYVMTHDSIGLGEDGPTHQPIEHLASFRAMPNILMLRPADGNETAGCYKVAVDNRKRPSVLALSRQKLPNLAGTSIEGVEKGGYTISDNSSDNKPDVILIGTGSELEIAAKAADELRKEGKKVRVVSFVSWELFEDQSAEYKESVLPSAVTARVSIEAGTTFGWHKIVGSKGKAIGIDKFGASAPAGKIYKEYGITAEAVIAAAKEVC

SEQ ID NO: 22553 - protein, 738 aa, Arachis hypogaea
MASSSLSVSQSILSRPASSSRRSSLPSFSGLRPTASSNPTQPAISLRRIPPISALKVSASSSSAVDTVDRTAADPAIVEKSVNTIRFLAIDAVEKANSGHPGLPMGCAPMGHVLYDEVMRYNPKNPKWFNRDRFVLSAGHGCMLQYALLHLAGYDSVKEEDLKQFRQWESRTPGHPENFETPGIEVTTGPLGQGIANAVGLALAEKHLAARFNKPDNEIVDHYTYAILGDGCQMEGIANEACSLAGHWGLGKLIAFYDDNHISIDGNTEIAFTESVDRRFEGLGWHVIWVKNGNNGYDEIRAAIKEAKAVKDRPTLIKVTTTIGYGSPNKANSYSVHGSALGAKEVEATRQNLGWAHEPFHVPEDVKKHWSRHIPEGAALEAEWNKKFAEYEKKYKEEAAELKCIINGEFPAGWEKALPTYTPETPGDATRNLSQHNLNALAKVLPGLLGGSADLASSNMTLMKMFGNFQKDTPAERNIRFGVREHGMGAISNGIALHSPGLIPYCATFFVFTDYMRAAIRLSALSQAGVIYVMTHDSIGLGEDGPTHQPIEHLASFRAMPNVLMLRPADGNETAGSYKVAVLNRKRPSILALSRQKLPNLPGTSIEGVGKGGYTISDNSTGNKPDVILIGTGSELEIAAKAADDLRKEGKAVRVVSFVSWELFNEQSEAYKESVLPAAVSARVSIEAGSTFGWERIIGSKGKAIGIDRFGASAPAGKIYKEFGITKEAVIAAAKSLI

SEQ ID NO: 22554 - protein, 742 aa, Valeriana officinalis
MAASSSLTLSQAILTRSSPRHASSTQEFSSLSTFTRLPAFSGLKSSAPLPTRVASRRRSAPRSSVRASAAVETLDKTDTALVDKSVNTIRFLAIDAVEKANSGHPGLPMGCAPMGHILYDEVMRYNPKNPYWFNRDRFVLSAGHGCMLQYALLHLAGYDAVKEEDLKSFRQWGSKTPGHPENFETPGVEVTTGPLGQGIANAVGLALAEKHLAARFNKAGDEIVDHYTYCIVGDGCQMEGIANEACSLAGHWGLGKLIAFYDDNHISIDGDTEIAFTESVDTRFEGLGWHIIWVKNGNTGYDEIRAAIEEAKKVTDKPTLIKVTTTIGYGSPNKANSYSVHGAALGAKEVDATRSNLGWPYEPFHVPEDVKKHWSRHTPEGAALEAAWNAKFAEYEKKYPEEAAELKSITDGVLPAGWEKALPTYTPDIPGDATRNLSQTMLNALAKVLPGLIGGSADLASSNMTLMKMFGDFQKNTPEERNVRFGVREHGMGAICNGIALHSPGFVPYCATFFVFTDYMRGAIRISALSEAGVIYVMTHDSIGLGEDGPTHQPIEHLASFRAMPNILMFRPADGNETAGAYKVAVENRKRPSILALSRQKLPNLPGTSIEGVEKGGYTITDNSSGNKPDVILIGTGSELEIAAKAADELRKEGKTVRVVSFVSWELFEDQSEEYKESVLPAAVTARVSIEAASTFGWHKIVGSGGKAIGIDKFGASAPAPKIYKEYGITAEAVIEAAKSLW

SEQ ID NO: 22555 - protein, 753 aa, Eucalyptus grandis
MASASSLTVSQAVLARSASAPRGGAGQSPSSDRLSVPSPRLPTFSGLKSSPAAAAAAGSAHRRLRRLAVPRPIRATAAVETLGPSAAAETALVDKSVNTIRFLAIDSVEKANSGHPGLPMGCAPIGHVLYDEVMRYNPKNPYWFNRDRFVLSAGHGCMLQYALLHLAGYDSVKEEDLKSFRQWGSKTPGHPENFETPGIEVTTGPLGQGIANAVGLALAEKHLAARFNKPDNEIVDHYTYAVLGDGCQMEGIANEACSLAGHWGLGKLIAFYDDNHISIDGNTEIAFTENVEKRFEGLGWHVIWVKNGNTGYDEIRAAIKEAKAVKDKPTLIKVTTTIGYGSPNKSNSYSVHGSALGAKEVDATRNNLGWPYEPFHVPEDVKKHWSRHTPVGAAVEAEWNAKFAEYEKKYKDEAAVLKSIIKGELPAGWEKALPTYTPEIPADATRNLSQQCLNALVDVVPGLLGGSADLASSNMTLLKKFGNFQKDTPEERNVRFGVREHGMGAICNGIALHSPGLIPYCATFFVFTDYMRAAMRISALAESGVIYVMTHDSIGLGEDGPTHQPVEHLASFRAMPNILMLRPADGNETAGAYKVAIVNRKRPSVLALSRQKLPNLPGTSIEGVEKGGYVISDNSSGNKPDVILIGTGSELEIAAKAADELRKEGKTVRVASFISWELFDEQSPEYKESVLPSGVTARVSIEAGSTFGWEKIVGSKGKAIGIDRFGASAPAGKLYKEFGITVEAVIAAAKQVS

SEQ ID NO: 22556 - protein, 741 aa, Solanum tuberosum
  Sequence also found in Organisms: Solanum phureja
MASSSSLTLSQAIFSPSLPRHGSSSSSSPSLSFSTFSGLKSTPFTSSHRRILPSTTVTKQQFSVRASAAVETLEKTDAAIVEKSVNTIRFLAIDAVEKANSGHPGLPMGCAPMGHILYDEVMKYNPKNPYWFNRDRFVLSAGHGCMLQYALLHLAGYDSVQEDDLKSFRQWGSRIPGHPENFETPGVEVTTGPLGQGIANAVGLAVAEKHLAARFNKPDAEIVDHYTYVILGDGCQMEGISNEVCSLAGHWGLGKLIAFYDDNHISIDGDTEIAFTEDVSARFESLGWHVIWVKNGNTGYDEIRAAIKEAKAVKDKPTMIKVTTTIGFGSPNKANSYSVHGSALGAKEVEATRNNLGWPYEPFHVPEDVKSHWSRHTPEGAALETEWNAKFAEYEKKYAEEAADLKSIITGELPAGWEKALPTYTPESPADATRNLSQQNLNALAKVLPGFLGGSADLASSNMTLLKMFGDFQKNTPEERNLRFGVREHGMGAICNGIALHSLGLIPYCATFFVFTDYMRGAMRISALSEAGVIYVMTHDSIGLGEDGPTHQPIEHLASFRAMPNILMFRPADGNETAGAYKVAVLKRKTPSILALSRQKLPQLAGTSIEGAAKGGYIVSDNSSGNKPDVILIGTGSELEIAVKAAEELKKEGKTVRVVSFVCWELYDEQSAEYKESVLPSSVTARVSIEAGSTFGWQKFVGDKGKAIGIDGFGASAPADKIYKEFGITAEAVVAAAKQVS

SEQ ID NO: 22557 - protein, 738 aa, Chenopodium quinoa
MAASSSLSTLSHQTLLSHPKTHLATTPTSSLIVPTTSKVNGVLLKSSSSRRRRAAPRATVVRAAAVEALESTDTDQLVEKSVNTIRFLAIDAVEKANSGHPGLPMGCAPMGHILYDEIMRYNPKNPYWFNRDRFVLSAGHGCMLQYALLHLAGYDSVLEEDLKTFRQWGSRIPGHPENFETPGVEVTTGPLGQGIANAVGLALAEKHLAARFNKPDAEIVDHYTYCILGDGCQMEGIAQEACSLAGHWGLGKLIALYDDNHISIDGDTAIAFTESVDLRFEALGWHVIWVKNGNTGYDEIRAAIKEAQSVKDKPTLIKVTTTIGFGSPNKSNSYSVHGSALGSKEVEATRQNLGWPYEPFHVPEEVKKHWSRHTPEGASLEAEWTSKFAEYEKKYPTEAAEFKSIITGELPAGWEKALPTYTPETPGDATRNLSQQCLNALAKVLPGLLGGSADLASSNMTLLKMFGDFQKDTPEERNVRFGVREHGMGAICNGIALHSPGLIPYCATFFVFTDYMRGAMRISALSESGVIYVMTHDSIGLGEDGPTHQPIEHLASFRAMPNILMLRPADGNETAGSYKVAVENRKTPSILALSRQKLPNLPGTSIEGVAKGGYTISDNSSGNKPDVILIGTGSELEIAAKAGDELRKEGKSVRVVSFVSWELFEQQSDEYKESVLPADVTARVSIEAGSTFGWHKIVGSKGKAIGIDKFGASAPAGIIYKEYGITAEAVIEAAKSVC

SEQ ID NO: 22558 - protein, 705 aa, Panax ginseng
SSFSHLPTFSTSLRSSSRHRSSAAGHQVVRAAVVETLDKTETSLVEKSVNTIRFLAIDAVEKANSGHPGLPMGCAPMGHILYDEVMRYNPKNPYWFNRDRFVLSAGHGCMLQYALLHLAGYDSVLEEDLKSFRQWGSRTPGHPENFETPGVEVTTGPLGQGVANAVGLALVEKHLAARFNKPDSEIVDHYTYVILGDGCQMEGIANEACSLAGHWGLGKLIAFYDDNHISIDGDTEIAFTESVDTRFEGLGWHIIWVKNGNTGYDDIRAAIKEAKAVTDKPTLIKVTTTIGFGSPNKANSYSVHGSALGAKEVDATRKNLGWPYEPFHVPEDVKQHWSRHTSEGASLEAAWNAKFAEYEKKYAEEAAELKSIITGVLPDGWETALPTYTPEIPADATRNLSQTCLNALAKVLPGLLGGSADLASSNMTLLKMFGDFQKGTPEERNVRFGVREHGMGAICNGIALHSPGLIPYCATFFVFTDYMRGAIRISALSEAGVIYVMTHDSIGLGEDGPTHQPIEHLASFRAMPNILMLRPADGNETAGAYKVAVLNRKRPSILALSRQKLPNLPGTSIEGVEKGGYMISDNSSGNKPDVILIGTGSELEIAAKAADELRKEGKAVRVVSFVSWELFDEQSDDYKESVLPAAVTARVSIEAASTFGWGKLVGSEGKAIGIDKFGASAPAGKTYKEYGITVEAIIAAAKELI

SEQ ID NO: 22559 - protein, 740 aa, Lotus japonicus
MASTSTSPSLSLSQALLTRPSSLPSSTRLSLPAFSGLRQSTTLSLSLSHTPTTHRRLPAAVKASVAAETAKKVTTDESLVDKSVNTIRFLAVDAVEKANSGHPGLPMGCAPMGHVLYDEIMRYNPKNPKWFNRDRFVLSAGHGCMLHYALLHLAGFDSVKEEDLKEFRQWGSRTPGHPENFETPGIEVTTGPLGQGIANAVGLALAEKHLAARYNKPDSEIVDHYTYVILGDGCQMEGIANEACSLAGHWGLGKLIAFYDDNHISIDGNTDIAFTESVDSRFEGLGWHVIWVKNGNNGYDDIRAAIKEAKAVPDKPTLIKVTTTIGFGSPNKANSYSVHGSALGAKEVEATRANLAWPHEPFHVPEDVKKHWSRHIPEGAALEAEWNAKFAEYEKKYKEEAAEFKSIINGDLPAGWEKALPTYTPETPADATRNLSQTNLNALAKVLPGLLGGSADLASSNMTLLKMFGNFQKDTPAERNVRFGVREHGMGAICNGIALHSPGLIPYCATFFVFTDYMRGAIRLSALSEAGVIYVMTHDSIGLGEDGPTHQPIEHLASFRAMPNILMLRPADGNETAGAYKVAVVNRKRPSILALSRQKLPNLPGTSIEGVEKGGYTISDNSTGNKPDVILIGTGSELEIAAKAADDLRKEGKAVRVVSFVSWELFDEQSEAYKESVLPSAVSARVSIEAGSTFGWEKIVGSKGKAIGIDHFGASAPAGRIYKEFGITKEAVIAAAKELI

SEQ ID NO: 22560 - protein, 719 aa, Panax ginseng
MAPIPLPTNPIFFSFSFSHLPTFSTSLRSSSRHRSSAAGRQVVRAAVVETLDKTETSLVEKSVNTIRFLAIDAVEKANSGHPGLPMGCAPMGHILYDEVMRYNPKNPYWFNRDRFVLSAGHGCMLQYALLHLAGYDSVLEEDLKSFRQWGSRTPGHPENFETPGVEVTTGPLGQGVANAVGLALVEKHLAARFNKPDSEIVDHYTYVILGDGCQMEGIANEACSLAGHWGLGKLIAFYDDNHISIDGDTEIAFTESVDTRFEGLGWHIIWVKNGNTGYDDIRAAIKEAKAVTDKPTLIKVTTTIGFGSPNKANSYSVHGSALGAKEVDATRKNLGWPYEPFHVPEDVKQHWSRHTSEGASLEAAWNAKFAEYEKKYAEEAAELKSIITGVLPDGWETALPTYTPEIPADATRNLSQTCLNALAKVLPGLLGGSADLASSNMTLLKMFGDFQKGTPEERNVRFGVREHGMGAICNGIALHSPGLIPYCATFFVFTDYMRGAIRISALSEAGVIYVMTHDSIGLGEDGPTHQPIEHLASFRAMPNILMLRPADGNETAGAYKVAVLNRKRPSILALSRQKLPNLPGTSIEGVEKGGYTISDNSSGNKPDVILIGTGSELEIAAKAADELRKEGKAVRVVSFVSWELFDEQSDDYKESVLPAAVTARVSIEAASTFGWGKLVGSEGKAIGIDKFGASAPAGKTYKEYGITSEAVIAAAKELI

SEQ ID NO: 22561 - protein, 741 aa, Solanum lycopersicum
MASSSSLTLSQAIFSPSLPRHGSSSSSSPSISFSTFSGLKSTPFTSSHRRILPSTTVTKQHFSVRASSAVETLEKTDAAIVEKSVNTIRFLAIDAVEKANSGHPGLPMGCAPMGHILYDEVMKYNPKNPYWFNRDRFVLSAGHGCMLQYALLHLAGYDSVQEDDLKSFRQWGSKIPGHPENFETPGVEVTTGPLGQGIANAVGLAVAEKHLAARFNKPDAEIVDHYTYVILGDGCQMEGISNEACSLAGHWGLGKLIAFYDDNHISIDGDTEIAFTEDVSARFEALGWHVIWVKNGNTGYDEIRAAIKEAKAVKDKPTMIKVTTTIGFGSPNKANSYSVHGSALGAKEVEATRNNLGWPYEPFHVPEDVKSHWSRHTPEGAALETEWNAKFAEYEKKYAEEAADLKSIITGELPAGWEKALPTYTPESPADATRNLSQQNLNALAKVVPGFLGGSADLASSNMTLLKMFGDFQKNTPEERNLRFGVREHGMGAICNGIALHSLGLIPYCATFFVFTDYMRGAMRISALSEAGVIYVMTHDSIGLGEDGPTHQPIEHLASFRAMPNILMFRPADGNETAGAYKVAVLKRKTPSILALSRQKLPQLAGTSIEGAAKGGYIVSDNSSGNKPDVILIGTGSELEIAVKAAEELKKEGKTVRVVSFVCWELYDEQSAEYKESVLPSSVTARVSIEAGSTFGWQKFVGDKGKAIGVDGFGASAPADKIYKEFGITAEAVVAAAKQVS

SEQ ID NO: 22562 - protein, 732 aa, Cyclamen graecum
LSLSLLPRHGSTPKISIPAFSGLKPTSQSATRAALDPSRASLAHPRAAPRRFWTPRASAAVEALPKAGTELVDKSVNTIRFLAIDAVEKANSGHPGLPMGCAPIGHVLYDEVMRYNPKNPYWFNRDRFVLSAGHGCMLQYALLHLAGYDSVQEEDLKQFRQWGSRTPGHPENFETPGVEVTTGPLGQGIANAVGLALAEKHLAARFNKPGSEIVDHYTYAILGDGCQMEGIANEVCSLAGHWGLGKLIAFYDDNHISIDGDTEIAFTESVDKRFEGLGWHVIWVKNGNTGYDEIRAAIKEAKSVTDKPTLIKVTTTIGFGSPNKANSYSVHGAALGAKEVDATRQNLGWPYEPFHVPEDVKKHWSRHTPEGAALEAEWNAKFAEYEKKYAEEAAELKSIITGELPAGWVKALPTYTPESPAEATRNLSQTNLNALATVLPGFLGGSADLASSNMTLLKMFGDFQKNTPEERNIRFGVREHGMGAICNGIALYSPGLIPYCATFFVFTDYMRAAIRISALSEAGVIYVMTHDSIGLGEDGPTHQPIEHIASFRAMPNVLMLRPADGNETAGSYKVAVLNRKRPSILALSRQKLPNLPGTSIEGVEKGGYTISDNSTGNKPDVILIGTGSELEIAAKAADELRKEGKAVRVVSFVSWELFDEQTDEYKESVLPEAVTARVSIEAASTFGWQKLVGSKGKAIGIDRFGASAPAGKIYKEFGITAEAVVEAAKALI

SEQ ID NO: 22563 - protein, 741 aa, Nicotiana benthamiana
MASSSSSLTLSQAILSRSVPRHGSASSSQLSPSSLTFSGLKSNPNITTSRRRTPPSAAVRSPAIRASAATETIEKTETALVDKSVNTIRFLAIDAVEKANSGHPGLPMGCAPMGHILYDEVMRYNPKNPYWFNRDRFVLSAGHGCMLQYALLHLAGYDAVKEEDLKSFRQWGSKTPGHPENFETPGVEVTTGPLGQGIANAVGLALAEKHLAARFNKPDAEIVDHYTYVILGDGCQMEGISQEACSLAGHWGLGKLIAFYDDNHISIDGDTEIAFTEDVGARFEALGWHVIWVKNGNTGYDEIRAAIKEAKAVTDKPTMIKVTTTIGFGSPNKANSYSVHGSALGAKEVEATRSNLGWPYEPFHVPEDVKSHWSRHVPEGAALEAGWNTKFAEYEKKYPEEAAELKSIVTGELPAGWEKALPTYTPESPADATRNLSQQNLNALAKVLPGFLGGSADLASSNMTLLKMFGDFQKNTPEERNLRFGVREHGMGAICNGIALHSQGLIPYCATFFVFTDYMRGAMRISALSEAGVIYVMTHDSIGLGEDGPTHQPIEHLASFRAMPNILMFRPADGNETAGAYKMAVLKRKTPSILALSRQKLPQLTGSSMEGAAKGGYILSDNSSGNKPDVILIGTGSELEIAVKAADELRKEGKTVRVVSFVCWELFEEQSADYKESVLPSSVTARVSIEAGSTFGWEKYVGSKGKAIGIDRWGASAPAGIIYQEYGITAEAVVAAAKQVS

SEQ ID NO: 22564 - protein, 740 aa, Mesembryanthemum crystallinum
MAASSSLTLSHQSLLSHSLPHPKSSAAVAAASLLIPTSSTNPSAKLLLKSTSRRRRVASRASVVKAAVAETLEKTDSELVEKSVNTIRFLAIDAVEKANSGHPGLPMGCAPMGHILYDEVMRYNPKNPYWFNRDRFVLSAGHGCMLQYALLHLAGYDSVLEDDLKSFRQWGSRSPGHPENFETPGIEVTTGPLGQGIANAVGLALAEKHLAARYNKPDAEIVDHYTYCILGDGCQMEGISNEACSLAGHWGLGKLIAFYDDNHISIDGDTAIAFTENVDQRFEALGWHIIWVKNGNTGYDEIRAAIKEAKAVTDKPTLIKVTTTIGFGSPNKANSYSVHGAALGAKEVDATRQNLGWPYEPFHVPEEVKSHWSRHTPEGAALEAEWNAKFAEYEKKYAAEAAELKSIITGELPAGWEKALPTYTPEVPADATRNLSQTCLNALANVLPGLIGGSADLASSNMTLMKMFGDFQKETPEERNVRFGVREHGMGAICNGIALHSPGFVPYCATFFVFTDYMRGAMRISALSEAGVIYVMTHDSIGLGEDGPTHQPIEHLASFRAMPNIFMLRPADGNETAGAYKVAVENRKTPSILALSRQKLPNLPGTSIEGVEKGGYIISDNSSGNKPDVILAGTGSELEIAAKAGDELRKEGKTVRVVSLVSWELYEKQSDEYKESVFPAAVTARVSIEAASTFGWGKFVGSKGKAIGIDKFGASAPAGKIYKEYGITVEAVIEAAKSLF

SEQ ID NO: 22565 - protein, 722 aa, Daucus carota
SQSLSLSRSLPAISQHPHRISLPTVNLSAASLKCSRRVGSRAAAVRASAAVDVAEKTETGLVEKSVNTIRFLAIDAVEKANSGHPGLPMGCAPMGHILYDEIMKYNPKNPFWFNRDRFVLSAGHGCMLQYALLHLAGYDSVKEEDLKSFRQWGSKTPGHPENFETPGIEVTTGPLGQGVANAVGLALAEKHLAARFNKPGSEIVDHYTYVILGDGCQMEGISNEACSLASHWGLGKLIAFYDDNHISIDGDTAIAFTESVDKRFEGLGWHVIWVKNGNTGYDEIRAAIEEAKAVTDKPTLIKVTTTIGFGSPNKANSYSVHGSALGAKEVDATRKNLGWPHEPFHVPEDVKKHWSRHTPEGAALEAEWNAKFADYEKKYKEEAQELKSLISGELPVGWEKALPTYTPETPGDSTRNLSQANLNALAKVLPGLLGGSADLASSNMTLLKMFGDFQKDTPEERNVRFGVREHGMGAICNGIALHSPGLIPYCATFFVFTDYMRAAMRLSALCEAGVIYVMTHDSIGLGEDGPTHQPIEHIASFRAMPNILMLRPADGNETAGAYKVAVLNRKRPSVLALSRQKLPNLPGTSIEGVEKGGYIITDNSSGNKPDIILIGTGSELEIAAKAADELRKSGKTVRVVSFVSWELFDEQSAAYKESVLPADVSARVSIEAGTTFGWEKIVGSKGKAIGIDHFGASAPADKIYKEFGLTVEAVIAAAKELC

SEQ ID NO: 22566 - protein, 744 aa, Eschscholzia californica
ASSSLSVSQALLARKITNLIGSTSNSDRLSLPGFNLSTLSGRTLKSSTSSKISSVPRSRKNTISRSSIRASVVETVEKADTALIDKSVNTIRFLSIDAVEKANSGHPGLPMGCAPMGHILYDEIMRYNPKNPYWFNRDRFVLSAGHGCMLHYALLHLAGYDSVKEEDLKNFRQWGSKTPGHPENFETPGIEVTTGPLGQGIANAVGLALAEKHLAARFNKPDSEVVDHYTYCILGDGCQMEGVANEACSLAGHWGLGKLIAFYDDNHISIDGDTEIAFTESVDTRFEALGWHVIWVKNGNTGYDEIRAAIREAKAVTDKPTLIKVTTTIGYGSPNKANSYSVHGSALGTKEVDATRQNLGWPFEPFHVPEDVKKHWSRHESVGASLETEWNTKFAEYEKKYKEEAAELKTFITGEFPAGWEKALPAYTPEIPGDATRNLSQTCLNALAKVLPGLVGGSADLASSNMTLMKMFGNFQKDTPAERNIRFGVREHGMGAICNGIVHHSPGFIPYCATFFVFTDYMRGAMRISALSEAGVIYVMTHDSIGLGEDGPTHQPIEHLASFRAMPNILMLRPADGNETAGAYKVAVVNRKRPSVLALSRQKLPNLPGTSIEGVEKGGYTISDNSTGNKPDVILIGTGSELEIAAKAADELRKEGKTVRVVSFVSWELFDEQSDEYKESVLPAAVTARVSIEAGSTFGWEKIVGSKGKAIGIDTFGASAPAGKIYKEYGITSEAVIAAAKSIS

SEQ ID NO: 22567 - protein, 741 aa, Eutrema parvulum
MASTSSLALSQALLARAISHHGSDQRVSLPAFSGLKSTASRASASSRRRSATSMSKIRSPCPLVRAAAVETMEPTTDSSIVDKSVNTIRFLAIDAVEKANSGHPGLPMGCAPMAHILYDEVMRYNPKNPYWFNRDRFVLSAGHGCMLLYSLLHLAGYDSVLEEDLKSFRQWGSKTPGHPENFETPGIEVTTGPLGQGIANAVGLALAEKHLAARFNKPDAEVVDHYTYVILGDGCQMEGISNEAASLAGHWGLGKLIAFYDDNHISIDGDTEIAFTENVDQRFEALGWHVIWVKNGNTGYDEIRAAIKEAKTVTDKPTLIKVTTTIGYGSPNKANSYSVHGAALGEKEVEATRNNLGWPYEPFQVPEEVKSHWSRHTPEGTALESDWNATFAAYEKKYPEEAAELKSIISGELPAGWEKALPTYTPESPADATRNLSQQCLNALAKVVPGFLGGSADLASSNMTLLKAFGDFQKATPEERNLRFGVREHGMGAISNGICLHSPGLIPYCATFFVFTDYMRGAMRISALSEAGVIYVMTHDSIGLGEDGPTHQPIEHIASFRAMPNTLMFRPADGNETAGAYKIAVTKRKTPSILALSRQKLPQLPGTSIEGVEKGGYTISDNSSGNKPDVILIGTGSELEIAAQAAEVLKKEGKTVRVVSFVCWELFDEQSDEYKESVLPSDVSARVSIEAGSTFGWGKLVGSKGKSIGVNSFGASAPAPLLYKEFGITAEAVVDAAKSLF

SEQ ID NO: 22568 - protein, 739 aa, Amaranthus tuberculatus
MAASSSLTLSHHQTILSHPKTHLPNSSTSSILVPTTSSKVNGILLKATNSRRRRVGSRVTVVKAAAVETLESTGTEQVVEKSINTIRFLAIDAVEKANSGHPGLPMGCAPMGHILYDEVMRYNPKNPYWFNRDRFVLSAGHGCMLQYALLHLAGYDSVLEEDLKTFRQWGSKIPGHPENFETPGVEVTTGPLGQGIANAVGLALAEKHLAARFNKPDAEIVDHYTYCILGDGCQMEGIAQEACSLAGHWGLGKLIALYDDNHISIDGDTAIAFTESVDTRFEALGWHVIWVKNGNTGYDEIRAAIKEAQAVKDKPTLIKVTTTIGFGSPNKSNSYSVHGSALGAKEVEATRQNLGWPYEPFYVPDEVKKHWSRHTPEGASLEAEWNAKFAEYEKKYPAEATELKSIITGELPAGWEKALPTYTPEIPGDATRNLSQQCLNALAKVLPGLIGGSADLASSNMTLLKMFGDFQKDTPEERNVRFGVREHGMGAICNGIALHSPGFIPYCATFFVFTDYMRGAMRISALSEAGVIYVMTHDSIGLGEDGPTHQPIEHLASFRAMPNILMLRPADGNETAGAYKVAVEQRKTPSILALSRQKLPNLPGTSIEGVEKGGYTITDNSSGNKPDVILIGTGSELEIAAKAGDELRKEGKAVRVVSFVSWELFDQQSDEYKESVLPSDVTARVSIEAGSTFGWEKIVGAKGKAIGIDKFGASAPAGTIYKEYGITVEAVIEAANSFS

SEQ ID NO: 22569 - protein, 741 aa, Arabidopsis lyrata
MASTSSLALSQALLARAISHHGSDQRGSLPAFSGLKSTGSRASASSRRRIAQSMNKNRSLRPLVRAAAVETVEPTTDSSIVDKSVNSIRFLAIDAVEKANSGHPGLPMGCAPMAHILYDEVMRYNPKNPYWFNRDRFVLSAGHGCMLLYALLHLAGYDSVQEEDLKQFRQLGSKTPGHPENFETPGIEVTTGPLGQGIANAVGLALAEKHLAARFNKPDAEVVDHYTYAILGDGCQMEGISNEACSLAGHWGLGKLIAFYDDNHISIDGDTEIAFTENVDQRFEALGWHVIWVKNGNTGYDEIRAAIKEAKAVTDKPTLIKVTTTIGYGSPNKANSYSVHGAALGEKEVEATRNNLGWPYEPFQVPDDVKSHWSRHTPEGATLESDWSAKFAAYEKKYPEEAAELKSIITGELPAGWEKALPTYTPESPGDATRNLSQQCLNALAKVIPGFLGGSADLASSNMTLLKAFGDFQKATPEERNLRFGVREHGMGAISNGIALHSPGLIPYCATFFVFTDYMRGAMRISALSEAGVIYVMTHDSIGLGEDGPTHQPIEHIASFRAMPNTLMFRPADGNETAGAYKIAVTKRKTPSILALSRQKLPQLPGTSIEGVEKGGYTISDDSSGNKPDVILIGTGSELEIAAQAAEVLRKEGKTVRVVSFVCWELFDEQSDEYKESVLPSDVSARVSIEAASTFGWGKIVGGKGKSIGINSFGASAPAPLLYKEFGITVEAVVDAAKSFF

SEQ ID NO: 22570 - protein, 746 aa, Lactuca sativa
MAASTSLTLSQAALSRSAVPRHGSSTTATQQSTSLATLSIPTFSGLKSTSTSSSRAPTRRQVSSTRRRVIANAAVETLEKTDTALVDKSVNTIRFLAIDAVEKANSGHPGLPMGCAPMGHILYDEVMRYNPKNPYWFNRDRFVLSAGHGCMLQYALLHLAGYDSVLEEDLKQFRQWGSRTPGHPENFETPGIEVTTGPLGQGIANAVGLALAEKHLAARYNKPDAEIVDHYTYCILGDGCQMEGIANEACSLAGHWGLGKLIAFYDDNHISIDGDTEIAFTESVDTRFEALGWHIIWVKNGNTGYDEIRAAIKEAKAVTDKPTLIKVTTTIGFGSPNKANSYSVHGAALGAKEVDATRQNLGWPYEPFHVPEEVKKHWSRHTPEGAALEAEWNTKFAEYEKKYAEDAAELKSIAEGVFPAGWEKALPIYTPETPGDATRNLSQTMLNALAPVLPGLIGGSADLASSNMTLMKMFGDFQKSTPEERNVRFGVREHGMGAICNGIALHSPGFVPYCATFFVFTDYMRGAMRISALSEAGVIYVMTHDSIGLGEDGPTHQPIEHLASFRAMPNILMFRPADGNETAGAYKVAVESRKRPSILALSRQKLPNLTGTSIEGVAKGGYTITDNSTGNKPDVILIGTGSELEIAAKAADELRKEGKAVRVVSFVSWELFEEQSEEYKESVLPSGVTARVSIEAASTFGWAKIVGSKGKAIGIDKFGASAPAPKIYKEYGITAEAVIAAAKEVC

SEQ ID NO: 22571 - protein, 735 aa, Cicer arietinum
MSSSTSSLSLTNPHLTRLTSTTRLSSLPSTISLRSPTTPSTHLSLSHTHLRRTSVKSSAVVTQTSENSTADLSLVEKSVNTIRFLAIDSVEKANSGHPGLPMGCAPMGHVIYDEVLRYNPKNPKWFNRDRFVLSAGHGCMLQYALLHLAGYDSVKEEDLKAFRQWESKTPGHPENFETPGVEVTTGPLGQGIANAVGLALAEKHLAARFNKPDNEIIDHYTYCILGDGCQMEGIANEACSLAGHWGLGKLIAFYDDNHISIDGDTEIAFTESVEKRFEGLGWHVIWVKNGNTGYDEIRAAIREAKSVKDRPTLIKVTTTIGYGSPNKSNSYSVHGSALGAKEVDATRNNLGWSHEPFHVPADVKKHWSRHIPEGAALESEWNAKFAEYEKKYKEEAAVLKSIISGDLPSGWEKALPTYTPETPADATRILSQQNLNALAKVLPGLLGGSADLASSNMTLLKTFGDFQSDSPGERNVRFGVREHGMGAICNGIALHSPGLIPYCATFFVFTDYMRGAIRLSALSEAGVIYVMTHDSIGLGEDGPTHQPIEHLASFRAMPNILMLRPADGNETAGAYKVAVLNRKRPSILALSRQKLPNLAGTSIEGVEKGGYIVSDNSTGNKPDVILIGTGSELEIAYKAAEDLRKEGKAVRVVSFVSWELFDEQSEAYKESVLPAAVSARVSIEAGSTFGWHKIVGSKGKAIGIDRFGASAPAGRIYKEFGITKEAVIAAAKELI

SEQ ID NO: 22572 - protein, 741 aa, Capsicum annuum
MASSSLTLSQAIFSPSLPRHGSSSSSSPSLSFPIFSGLKSTPFTSSHRRFLLPSTSFTKQQLSVRASAAVETLEKTDAALVEKSVNTIRFLAVDAVEKANSGHPGLPMGCAPMGHILYDEVMKYNPKNPYWFNRDRFVLSAGHGCMLQYALLHLAGYDSVQEEDLKSFRQWGSRIPGHPENFETPGVEVTTGPLGQGIANAVGLALAERHLAARFNKPDSEIVDHYTYVILGDGCQMEGISNEACSLAGHWGLGKLIAFYDDNHISIDGDTEIAFTEDVSARFESLGWHVIWVKNGNTGYDEIRAAIKEAKAVKDKPTMIKVTTTIGFGSPNKANSYSVHGSALGAKEVEATRNNLGWPYEPFHVPGDVKTHWSRHTSEGAALETEWNAKFAEYEKKYPEEAADLKSIITGELPAGWAKALPTYLPESPADATRNLSQQNLNALAKVLPGFLGGSADLASSNMTLLKMFGDFQKNSPEERNLRFGVREHGMGAICNGIALHSLGLIPYCATFFVFTDYMRGAMRISALSEAGVIYVMTHDSIGLGEDGPTHQPIEHLASFRAMPNILMFRPADGNETAGAYKVAVLKRKTPSVLALSRQKLPQLAGTSIDGVAKGGYIVSDNSSGNKPDIILLGTGSELEIAVKAADELRKEGKTVRVVSLVSWELYDEQPADYKESVLPASVTARVSIEAGSTFGWQKFLGDKGKAIGVDGFGASAPADRIYKEFGITAEAVVAAAKEVS

SEQ ID NO: 22573 - protein, 741 aa, Arabidopsis thaliana
MASTSSLALSQALLARAISHHGSDQRGSLPAFSGLKSTGSRASASSRRRIAQSMTKNRSLRPLVRAAAVETVEPTTDSSIVDKSVNSIRFLAIDAVEKAKSGHPGLPMGCAPMAHILYDEVMRYNPKNPYWFNRDRFVLSAGHGCMLLYALLHLAGYDSVQEEDLKQFRQWGSKTPGHPENFETPGIEVTTGPLGQGIANAVGLALAEKHLAARFNKPDAEVVDHYTYAILGDGCQMEGISNEACSLAGHWGLGKLIAFYDDNHISIDGDTEIAFTENVDQRFEALGWHVIWVKNGNTGYDEIRAAIKEAKTVTDKPTLIKVTTTIGYGSPNKANSYSVHGAALGEKEVEATRNNLGWPYEPFQVPDDVKSHWSRHTPEGATLESDWSAKFAAYEKKYPEEASELKSIITGELPAGWEKALPTYTPESPGDATRNLSQQCLNALAKVVPGFLGGSADLASSNMTLLKAFGDFQKATPEERNLRFGVREHGMGAICNGIALHSPGLIPYCATFFVFTDYMRGAMRISALSEAGVIYVMTHDSIGLGEDGPTHQPIEHIASFRAMPNTLMFRPADGNETAGAYKIAVTKRKTPSILALSRQKLPHLPGTSIEGVEKGGYTISDDSSGNKPDVILIGTGSELEIAAQAAEVLRKDGKTVRVVSFVCWELFDEQSDEYKESVLPSDVSARVSIEAASTFGWGKIVGGKGKSIGINSFGASAPAPLLYKEFGITVEAVVDAAKSFF

SEQ ID NO: 22574 - protein, 743 aa, Chrysanthemum coronarium
MASLTLSQAALTRATVTRHGSSTTTPQQPTSLSTLQIPTFSGLKSTPPTSSRAPTRRHVSATRRRVVTNAAVETLEKTDTALVDKSVNTIRFLAIDAVEKANSGHPGLPMGCAPMGHILYDEVMRYNPKNPYWFNRDRFVLSAGHGCMLQYALLHLAGYDAVTTEDLKQFRQWGSKTPGHPENFETPGVEVTTGPLGQGIANAVGLALAEKHLAARYNKPDAEIVDHYTYCIVGDGCQMEGIANEACSLAGHWGLGKLIAFYDDNHISIDGDTEIAFTESVDTRFEALGWHIIWVKNGNTGYDEIRAAIKEAKAVTDKPTLIKVTTTIGFGSPNKANSYSVHGAALGAKEVDATRQNLGWPYEPFHVPDDVKAHWSRHTPEGAALEAEWNAKFAEYEKKYAEDAAELKSIADGVLPAGWEKALPTYTPETPGDATRNLSQTMLNALAPVLPGLIGGSADLASSNMTLMKMFGDFQKATPEERNVRFGVREHGMGAICNGIALHSPGFIPYCATFFVFTDYMRGAIRISALSEAGVIYVMTHDSIGLGEDGPTHQPIEHLASFRAMPNILMFRPADGNETAGAYKVAVESRKRPSILALSRQKLPNLPGTSIEGTAKGGYTITDNSTGNKPDVILIATGSELEIAAKAGDELRKEGKTVRVVSFVSWELFDEQSADYQESVLPSSVTARVSIEAGSTFGWGKIVGTKGKAIGIDKFGASAPAPKIYKEYGITVEAVIAAAKELI

SEQ ID NO: 22575 - protein, 743 aa, Artemisia annua
MASLTLSQAALTRATVTRHGSSTTTPQQPTSLSTLQIPTFSGLKSTPAASSRAPTRRHVSATRRRVVTNAAVETLEKTDTALVDKSVNTIRFLAIDAVEKANSGHPGLPMGCAPMGHILYDEVMRYNPKNPYWFNRDRFVLSAGHGCMLQYALLHLAGYDAVTTEDLKQFRQWGSKTPGHPENFETPGVEVTTGPLGQGIANAVGLALAEKHLAARYNKPDAEIVDHYTYCILGDGCQMEGIANEACSLAGHWGLGKLIAFYDDNHISIDGDTEIAFTESVDTRFEALGWHIIWVKNGNTGYDEIRAAIQEAKAVTDKPTLIKVTTTIGFGSPNKANSYSVHGAALGAKEVDATRQNLGWPYEPFHVPDDVKAHWSRHTPDGAALEAEWNAKFAEYEKKYAEDAAELKSIADGVLPAGWEKALPTYTPETPGDATRNLSQTMLNALAPVLPGLIGGSADLASSNMTLMKMFGDFQKATPEERNVRFGVREHGMGAICNGIALHSPGFIPYCATFFVFTDYMRGAIRISALSEAGVIYVMTHDSIGLGEDGPTHQPIEHLASFRAMPNILMFRPADGNETAGAYKVAVESRKRPSILALSRQKLPNLQGTSIEGTAKGGYTITDNSTGNKPDVILIGTGSELEIAAKAADELRKEGKTVRVVSFVSWELFDEQSADYQESVLPSSVTARVSIEAGSTFGWGKIVGTKGKAIGIDKFGASAPAPKIYKEYGITVEAVVAAAKAVI

SEQ ID NO: 22576 - protein, 750 aa, Musa acuminata
MAASSSVNAAQAIVGLAVSSHGSHSADRVAVPAGGFALSSLAGRSLTCSHSPRFQQQRRCPRQASRAARRAAPARAAAVETLEAAATEALVEKSINTIRFLAIDAVEKANSGHPGLPMGCAPMGHILYDEVMRYNPKNPYWFNRDRFVLSAGHGCMLQYALLHLAGYDSVQMEDIKQFRQWGSRTPGHPENFETPGVEVTTGPLGQGVANAVGLALAERHLAARFNKPDNEIVDHYTYVILGDGCQMEGIANEACSIAGHWGLGKLIAFYDDNHISIDGDTEIAFTEDVSARFDALGWHTIWVKNGNTGYDDIRAAIREAKAVKDKPTLIKVTTTIGYGSPNKANSYSVHGSALGAKEVDATRQNLGWPYEPFHVPEDIKSHWSRHVAEGASLEAEWNAKFAEYEKKYKEDAAELKAIVSGELPAGWEKALPTYTPESPADATRNLSQQNLNALAKVLPGLLGGSADLASSNMTLLKMFGDFQKGTPEERNVRFGVREHGMGAICNGIALHSPGLLPYCATFFVFTDYMRAAIRISALCEAGVIYVMTHDSIGLGEDGPTHQPIEHLISFRAMPNILMLRPADGNETAGAYKVAVLNRKRPSVLALSRQKLPQLAGTSIEGVEKGGYIVSDNSSGNKPDLILMGTGSELEIAAKAADELRKTGKTVRVVSLVCWELFEEQSDEYKESVLPAAVTAKISIEAGATLGWEKYVGGKGKAIGIDRFGASAPAGRIYKEFGISADSIITAAKSL

SEQ ID NO: 22577 - protein, 743 aa, Chrysanthemum coronarium
MASLTLSQAALTRATVTRHGSSTTTPQQPTSLSTLQIPTFSGLKSTPPTSSRAPTRRHVSATRRRVVTNAAVETLEKTDTALVDKSVNTIRFLAIDAVEKANSGHPGLPMGCAPMGHILYDEVMRYNPKNPYWFNRDRFVLSAGHGCMLQYALLHLAGYDAVTTEDLKQFRQWGSKTPGHPENFETPGVEVTTGPLGQGIANAVGLALAEKHLAARYNKPDAEIVDHYTYCILGDGCQMEGIANEACSLAGHWGLGKLIAFYDDNHISIDGDTEIAFTESVDTRFEALGWHIIWVKNGNTGYDEIRAAIKEAKAVTDKPTLIKVTTTIGFGSPNKANSYSVHGAALGAKEVDATRQNLGWPYEPFHVPDDVKAHWSRHTPEGAALEAEWNAKFAEYEKKYAEDAAELKSIADGVLPAGWEKALPTYTPETPGDATRNLSQTMLNALAPVLPGLIGGSADLASSNMTLMKMFGDFQKATPEERNVRFGVREHGMGAICNGIALHSPGFIPYCATFFVFTDYMRGAIRISALSEAGVIYVMTHDSIGLGEDGPTHQPIEHLASFRAMPNILMFRPADGNETAGAYKVAVESRKRPSILALSRQKLPNLPGTSIEGTAKGGYTITDNSTGNKPDVILIATGSELEIAAKAGDELRKEGKTVRVVSFVSWELFDEQSADYQESVLPSSVTARVSIEAGSTFGWGKIVGTKGKAIGIDKFGASAPAPKIYKEYGITVEAVVAAAKEVI

SEQ ID NO: 22578 - protein, 738 aa, Echinacea purpurea
MASLTLSHAALSRSAVPRHGSSTPATATIPTFSGLKSTSSRAPTRQISATRRQVCSTRRRVIVNAAVETLEKTDTALVEKSINTIRFLAIDAVEKANSGHPGLPMGCAPMGHILYDEVMRYNPKNPYWFNRDRFVLSAGHGCMLQYALLHLAGYDSVQEEDLKQFRQWGSRTPGHPENFETPGVEVTTGPLGQGIANAVGLALAEKHLAARYNKPDAEIVDHYTYCILGDGCQMEGIANEACSLAGHWGLGKLIAFYDDNHISIDGDTEIAFTESVDKRFEALGWHVIWVKNGNTGYDEIRAAIQEAKSVTDKPTMIKVTTTIGFGSPNKANSYSVHGAALGAKEVDATRQNLGWPYEPFHVPDEVKKHWSRHTPDGAALEAEWNAKFAAYESKYPEEAAELKSIVTGVLPAGWEKALPTYTPESPGDATRNLSQTMLNALAPVLPGLIGGSADLASSNMTLMKMFGDFQKNTPEERNVRFGVREHGMGAISNGIALHSPGFVPYCATFFVFTDYMRGAMRISALSEAGVIYVMTHDSIGLGEDGPTHQPIEHLASFRAMPNILMFRPADGNETAGAYKVAVESRKRPSVLALSRQKLPNLPGTSIEGTSKGGYTITDNSTGNKPDVILIGTGSELEIAVKAADELRKEGKTVRVVSFVSWELFYEQSDEYKESVLPSGVTARVSIEAGSTFGWDRIVGSAGKAIGIDKWGSSAPAGKIYKEYGITVEAVIAAAKQVS

SEQ ID NO: 22579 - protein, 744 aa, Flaveria ramosissima
MATSASLTLSQPTISRSAVPRHGATTATATQQSTSLSIPTFSGLKSVATSSSRATTRRQVIHTRRRVISNAAVETLDKTDTALVEKSINTIRFLAIDAVEKANSGHPGLPMGCAPMGHILYDEVMRYNPKNPYWFNRDRFVLSAGHGCMLQYALLHLAGYDSVKEEDLKQFRQWGSKTPGHPENFETPGVEVTTGPLGQGIANAVGLALAEKHLAARYNKPDAEIVDHYTYCILGDGCQMEGIANEACSLAGHWGLGKLIALYDDNHISIDGDTEIAFTENVDQRFEALGWHIIWVKNGNTGYDEIRAAIKEAKAVTDKPTLIKVTTTIGFGSPNKANSYSVHGAALGAKEVDATRQNLGWPYEPFHVPDEVKKHWSRHTPDGAALEAEWNAKFAEYEKKYPEDAAELKSIATGVLPAGWEKALPTYTPETPGDATRNLSQTMLNALAPVLPGLIGGSADLASSNMTLMKMFGDFQKNTPEERNVRFGVREHGMGAICNGIALHSPGFVPYCATFFVFTDYMRGAMRISALSEAGVIYVMTHDSIGLGEDGPTHQPVEHLASFRAMPNMLMFRPADGNETAGAYKVAVESRKRPSILALSRQKLPNLPGTSIEGTGKGGYTITDNSTGNKPDVILMATGSELEIAVKAADELRKEGKTVRVVSFVSWELFDEQSDEYKESVLPSGVTARVSIEAASTFGWGKHVGSKGKAIGIDKFGASAPAGKIYKEYGITVEAVVAAAKEVC

SEQ ID NO: 22580 - protein, 669 aa, Rosmarinus officinalis
EKTTETELVEKSVNTIRFLAIDAVEKANSGHPGLPMGCAPMGHILYDEVMRYNPKNPYWFNRDRFVLSAGHGCMLQYALLHLAGYDSVKEDDLKNFRQWESRTPGHPENFETPGVEVTTGPLGQGIANAVGLALAEKHLAARYNKLDSEIVDHYTYVILGDGCQMEGISNEAASLAGHWGLGKLIAFYDDNHISIDGDTEIAFTESVDTRFEGLGWHIIWVKNGNTGYDEIRAAIKEAKAVTDKPTLIKVTTTIGFGSPNKANSYSVHGSALGAKEVEATRQNLGWPFEPFHVPEDVKSHWSRHTPEGAALEAEWNAKFAEYEKKYPEESAELKSIITGAFPAGWEKALPTYTPESAADATRNLSQQNLNSLAKVLPGLIGGSADLASSNMTLLKMFGDFQKNTPEERNVRFGVREHGMGAICNGIALHSPGFIPYCATFFVFTDYMRAAMRISALSEAGVIYVMTHDSIGLGEDGPTHQPIEHLASFRAMPNILMLRPADGNETAGSYKVAVLNRKRPSVLALSRQKLPQLPGTSIEGVEKGGYTISDNSSGNKPDIILIGTGSELEIAAKAADELRKEGKAVRVVSFVSWELFDDQSAEYKESVLPASVTARVSIEAGTTFGWEKIVGSKGKAIGIDRFGASAPAGKIYKEFGLTTEAVVAAAKELI

SEQ ID NO: 22581 - protein, 751 aa, Musa acuminata
MAASSSVNAARALVGLAVYDHGSSSNARPDRVALPAGGSALRSHAAWSLTSSPRFQQCASRRRPKPCSSRRAAPARAAAVETLEAAATDALVEKSVNTIRFLAIDAVEKANSGHPGLPMGCAPMGHILYDEVMNYNPKNPYWFNRDRFVLSAGHGCMLHYALLHLAGYDSVKMEDLKQFRQWGSKTPGHPENFETPGIEVTTGPLGQGVANAVGLALAERHLAARFNKPDNEIIDHYTYVMLGDGCQMEGIANEACSLAGHWGLGKLIAFYDDNHISIDGDTEIAFTEDVIDRFEALGWHTIWVKNGNTGYDDIRAAIKEAKAVKDKPTLIKVTTTIGYGSPNKANTYSVHGSALGAKEVDATRQSLEWPYEPFYVPEDVKSHWSRHAPEGAALEAEWNARFAEYEEKYKEDAAELKAIISGELPAGWEKALPRYTPESPADATRNLSQQNLNALAKVLPGLLGGSADLASSNMTLLKMFGNFQKGTPEERNVRFGVREHGMGAICNGIALHSPGLLPYCATFFVFTDYMRAAMRISALSEAGVIYVMTHDSIGLGEDGPTHQPIEHLISFRAMPNILMLRPADGNETAGAYKVAVLNRKRPSVLALSRQKLPQLPGTSIEDVEKGGYTISDNSTGNKPDLILIGTGSELEIAAKAADELRKEGKTVRVVSLVCWELFDEQPDEYKESVFPAAVTARISIEAGVTLGWEKYVGSKGKAIGIDRFGASAPAGRIYKEFGITAESIIAAAKSL

SEQ ID NO: 22582 - protein, 743 aa, Chrysanthemum coronarium
MASLTLSQAALTRATVTRHGSSTTTPQQPTSLSTLQIPTFSGLKSTPPTSSRAPTRRHVSATRRRVVTNAAVETLEKTDTALVDKSVNTIRFLAIDAVEKANSGHPGLPMGCAPMGHILYDEVMRYNPKNPYWFNRDRFVLSAGHGCMLQYALLHLAGYDAVTTEDLKQFRQWGSKTPGHPENFETPGVEVTTGPLGQGIANAVGLALAEKHLAARYNKPDAEIVDHYTYCILGDGCQMEGIANEACSLAGHWGLGKLIAFYDDNHISIDGDTEIAFTESVDTRFEALGWHIIWVKNGNTGYDEIRAAIKEAKAVTDKPTLIKVTTTIGFGSPNKANSYSVHGAALGAKEVDATRQNLGWPYEPFHVPDDVKAHWSRHTPEGAALEAEWNAKFAEYEKKYAEDAAELKSIADGVLPAGWEKALPTYTPETPGDATRNLSQTMLNALAPVLPGLIGGSADLASSNMTLMKMFGDFQKATPEERNVRFGVREHGMGAICNGIALHSPGFIPYCATFFVFTDYMRGAIRISALSEAGVIYVMTHDSIGLGEDGPTHQPIEHLASFRAMPNILMFRPADGNETAGAYKVAVESRKRPSILALSRQKLPNLPGTSIEGTAKGGYTITDNSTGNKPDVILIATGSELEIAAKAGDELRKEGKTVRVVSFVSWELFDEQSADYQESVLPSSVTARVSIEAASTFGWGKIVGTKGKAIGIDKFGASAPAPKIYKEYGITVEAVVAAAKEVI

SEQ ID NO: 22583 - protein, 736 aa, Eutrema halophilum
MASTSSSLAISQALLGRAISQNGSDKCVSIPAFSGLKSTSPRTTFSSRRIASTNSHSLRPLVRAAAVETKTESSLVEKSVNTIRFLAIDAVEKAKSGHPGLPMGCAPMSHILFDEVMRYNPKNPYWFNRDRFVLSAGHGCMLQYALLHLAGYDSVREEDLKSFRQWRSKTPGHPENFETPGVEVTTGPLGQGIANAVGLALAEKHLAARFNKPDNEIVDHYTYSILGDGCQMEGITNEVCSLAGHWGLGKLIAFYDDNHISIDGDTEIALTESVDKRFEALGWHVIWVKNGNNGYDDIRAAIKEAKAVTDKPSLIKITTTIGYGSPNKANSYSAHGAALGEKEVEATRQNLGWPYEPFQVPEDVKSHWSRHTPKGAALEADWNAKFAAYEKKYAEEARELKSIMSGELPAGWEKALPTYTPDSPGDATRNLSQQCLNALAKVVPGFLGGSADLASSNMTLLKAFGDFQKATPEERNLRFGVREHGMGAICNGIAHHSPGLIPYCATFFVFTDYMRAAMRIAALSEGGVIYVMTHDSIGLGEDGPTHQPVEHLSSFRAMPNILMFRPADGNETAGAYKIAVTKRKTPSVLALSRQKLQQLPGTSIESVEKGGYTISDNSTGNKPDVILIGTGSELEIAAQAAEELRKEGKTVRVVSFVCWELFDEQSDAYKESVLPSDVSARVSIEAGSTFGWEKIVGGKGKSIGIDSFGASAPAGKLYKEFGFTIEAVVAAAKSLI

SEQ ID NO: 22584 - protein, 741 aa, Arabidopsis thaliana
MASTSSLALSQALLTRAISHNGSENCVSIPAFSALKSTSPRTSGTISSRRRNASTISHSLRPLVRAAAVEAIVTSSDSSLVDKSVNTIRFLAIDAVEKAKSGHPGLPMGCAPMSHILYDEVMKYNPKNPYWFNRDRFVLSAGHGCMLQYALLHLAGYDSVREEDLKSFRQWGSKTPGHPENFETPGVEATTGPLGQGIANAVGLALAEKHLAARFNKPDNEIVDHYTYSILGDGCQMEGISNEVCSLAGHWGLGKLIAFYDDNHISIDGDTDIAFTESVDKRFEALGWHVIWVKNGNNGYDEIRAAIREAKAVTDKPTLIKVTTTIGYGSPNKANSYSVHGAALGEKEVEATRNNLGWPYEPFHVPEDVKSHWSRHTPEGAALEADWNAKFAAYERKYPEEAAELKSIISGELPVGWEKALPTYTPDSPGDATRNLSQQCLNALAKAVPGFLGGSADLASSNMTMLKAFGNFQKATPEERNLRFGVREHGMGAICNGIALHSPGFIPYCATFFVFTDYMRAAMRISALSEAGVIYVMTHDSIGLGEDGPTHQPIEHLSSFRAMPNIMMFRPADGNETAGAYKIAVTKRKTPSVLALSRQKLPQLPGTSIESVEKGGYTISDNSTGNKPDVILIGTGSELEIAAQAAEKLREQGKSVRVVSFVCWELFDEQSDAYKESVLPSDVSARVSIEAGSTFGWGKIVGGKGKSIGIDTFGASAPAGKLYKEFGITIEAMVEAAKSLI

SEQ ID NO: 22585 - protein, 736 aa, Brassica napus
MASTSSLALSQALLARAISHHGSDQRISLPSPFSRASASSRRRSNAATTKPRSLRPLVVRAAAVDTLEPTTDASIVDKSVNTIRFLAIDAVEKAKSGHPGLPMGCAPMAHILYDEVMRYNPKNPYWFNRDRFVLSAGHGCMLLYALLHLAGYDSVLEEDLKSFRQWGSKTPGHPENFETPGIEVTTGPLGQGIANAVGLALAEKHLAARFNKPDAEVVDHYTYVILGDGCQMEGISNEAASLAGHWGLGKLIAFYDDNHISIDGDTEIAFTENVDQRFEALGWHVIWVKNGNTGYDEIRAAIKEAKAVTDKPTLIKVTTTIGYGSPNKANSYSVHGAALGEKEVEATRNNLGWPYEPFKVPDEVKSHWSRHTPDGKALESDWNAAFSAYEKKYPEEAAELKSIITGELPAGWEKALPTYTPESPGDATRNLSQQCLNALAKVVPGFLGGSADLASSNMTLLKAFGDFQKATPEERNLRFGVREHGMGAICNGIALHSPGLIPYCATFFVFTDYMRGAMRISALSEAGVIYVMTHDSIGLGEDGPTHQPVEHLASFRAMPNTLMFRPADGNETAGAYKIAVTKRKTPSILALSRQKLPQLPGTSIEGVEKGGYTISDNSSGNKPDVILVGTGSELEIAAQAAEVLRKEGKTVRVVSFVCWELFDEQTDEYKESVLPSGVSARVSIEAASTFGWGKIVGGEGKSIGINSFGASAPAPLLYKEFGITVEAVVDAAKSFF

SEQ ID NO: 22586 - protein, 746 aa, Papaver somniferum
MAASSSLTVSQALVGRKISGINTSSRSQSLPGFSLSTLSGRTLKSSLISSIASSRSNRVNTPSLARSLVVRAAAVETLEKTDTALVDKSVNTIRFLAIDAVEKANSGHPGLPMGCAPMGHILYDETMRYNPKNPYWFNRDRFVLSAGHGCMLQYALLHLAGYDSVTTEDLKTFRQWGSKIPGHPENFETPGVEVTTGPLGQGIANAVGLALAEKHLAARFNKPDSEIVDHYTYCILGDGCQMEGIANEACSLAGHWGLGKLIAFYDDNHISIDGDTEIAFTESVDTRFEGLGWHVIWVKNGNNGYDEIRAAIKEAKAVTDKPTLIKVTTTIGFGSPNKANSYAVHGAALGSKEVDATRKNLDWPFEPFHVPEDVKSHWSRHTAEGAALEAEWTAKFAEYEKKYSEDAAEFKSIMTGEFPAGWEKALPTYTPEIPADATRNLSQTCLNALAPVLPGLIGGSADLASSNMTLMKMFGDFQKATPEERNVRFGVREHAMGAICNGIALHSPGFVPYCATFFVFTDYMRGAMRISALSEAGVIYVMTHDSIGLGEDGPTHQPIEHLASFRAMPNILMLRPADGNETAGSYKVAVENRKRPSILALSRQKLANLPGTSIEGVAKGGYTISDNSTGNKPDVILCATGSELEIAEKAAGELRKEGKAVRVVSFVSWELYDEQTDEYKESVLPAAVTARVSIEAGSTFGWHKIIGSKGKAIGVDGFGASAPAPIIYKEFGITSEAVIAAAKSVM

SEQ ID NO: 22587 - protein, 746 aa, Papaver somniferum
MAASSSLTVSQALVGRKISGINTSSRSQSLPGFSLSTLSGGALKSSLISSIASSRSNRVNTPSLSRSLVVRAAAVETLEKTDTALVDKSVNTIRFLAIDAVEKANSGHPGLPMGCAPMGHILYDETMRYNPKNPYWFNRDRFVLSAGHGCMLQYALLHLAGYDSVTTEDLKTFRQWGSKIPGHPENFETPGVEVTTGPLGQGIANAVGLALAEKHLAARFNKPDSEIVDHYTYCILGDGCQMEGIANEACSLAGHWGLGKLIAFYDDNHISIDGDTEIAFTESVDTRFEGLGWHVIWVKNGNNGYDEIRAAIKEAKAVTDKPTLIKVTTTIGFGSPNKANSYAVHGAALGSKEVDATRKNLDWSYEPFHVPEDVKSHWSRHTAEGAALEAEWTAKFAEYEKKYSEDAAEFKSIMTGEFPAGWEKALPTYTPEIPADATRNLSQTCLNALAPVLPGLIGGSADLASSNMTLMKMFGDFQKATPEERNVRFGVREHAMGAICNGIALHSPGFVPYCATFFVFTDYMRGAIRISALSEAGVIYVMTHDSIGLGEDGPTHQPIEHLASFRAMPNILMLRPADGNETAGSYKVAVENRKRPSILALSRQKLANLPGTSIEGVAKGGYTISDNSTGNKPDVILCATGSELEIAEKAAGELRKEGKTVRVVSFVSWELYDEQTDEYKESVLPAAVTARVSIEAGSTFGWHKIIGSKGKAIGVDGFGASAPAPIIYKEFGITSEAVIAAAKSVM

SEQ ID NO: 22588 - protein, 746 aa, Papaver somniferum
MAASSSLTVSQALVGRKISGINTSSRSQSLPGFSLSTLSGRTLKSSLISSIASSRSNRVNTPSLSRSLVVRAAAVETLEKTDTALVDKSVNTIRFLAIDAVEKANSGHPGLPMGCAPMGHILYDETMRYNPKNPYWFNRDRFVLSAGHGCMLQYALLHLAGYDSVTTEDLKTFRQWGSKIPGHPENFETPGVEVTTGPLGQGIANAVGLALAEKHLAARFNKPDSEIVDHYTYCILGDGCQMEGIANEACSLAGHWGLGKLIAFYDDNHISIDGDTEIAFTENVDTRFEGLGWHVIWVKNGNNGYDEIRAAIKEAKAVTDKPTLIKVTTTIGFGSPNKANSYAVHGAALGSKEVDATRKNLDWPFEPFHVPEDVKSHWSRHTAEGAALEAEWTAKFAEYEKKYSEDAAEFKSIITGEFPAGWEKALPTYTPEIPADATRNLSQTCLNALAPVLPGLIGGSADLASSNMTLMKMFGDFQKATPEERNVRFGVREHAMGAICNGIALHSPGFVPYCATFFVFTDYMRGAIRISALSEAGVIYVMTHDSIGLGEDGPTHQPIEHLASFRAMPNILMLRPADGNETAGSYKVAVENRKRPSILALSRQKLANLPGTSIEGVAKGGYTISDNSTGNKPGVILCATGSELEIAEKAAGELRKEGKTVRVVSFVSWELYDEQTDEYKESVLPAAVTARVSIEAGSTFGWHKIIGSKGKAIGVDSFGASAPAPIIYKEFGITSEAVIAAAKSVM

SEQ ID NO: 22589 - protein, 738 aa, Eutrema parvulum
MASTSSLALSQALLSRTISHNGSDKHVSFSAFSGLKSTSPRTTSSYRRSASRSSHSLRPLVRAAALETIGTTTDSTLVDKSVNTIRFLAIDAVEKAKSGHPGLPMGCAPMSHILYDEVMRYNPKNPYWFNRDRFVLSAGHGCMLHYALLHLAGYDSVREEDLKSFRQWGSKTPGHPENFETPGVEVTTGPLGQGIANAVGLALAEKHLAARFNKPDNEIVDHYTYSIIGDGCQMEGISNEVCSLAGHWGLGKLIAFYDDNHISIDGDTEIAFTENVDKRFEALGWHVIWVKNGNNGYDEIRAAIREAKAVTDKPTLIKVTTTIGYGSPNKANSYSVHGAALGEKEVEATRNNLGWSYEPFQVPEDVKSHWSRHIPEGAALEVDWNAKFAAYEKKYPEEAAELKSIISGELPAGWEKALPTFTPESAGDATRNLSQQCLNALAKVVPGFLGGSADLASSNMTLLKAFGDFQKATPEGRNLRFGVREHGMGAICNGIALHSPGFIPYCATFFVFTDYMRAAMRIAALSEGGVIYVMTHDSIGLGEDGPTHQPVEHLSSFRAMPNILMFRPADGNETAGAYKIAVTKRKTPSVLALSRQKLQQLPGTSIENVEKGGYTISDNSTGNKPDVVLIGTGSELEIAAQAAEKLRKEGKTVRVVSFVCWELFDEQSDAYKESVLPSDVSARVSIEAGSTFGWEKIVGGKGKSIGIDSFGASAPAGKLYKEFGFTIEAVVAAAKSLI

SEQ ID NO: 22590 - protein, 739 aa, Brassica oleracea
MASTSSLALSQALLARAISHHGSDQRISLPSPFSRASASSSRRRNNAAASTTKLRSLRPLAVRAAAVDTLEPTTDASIVDKSVNTIRFLAIDAVEKAKSGHPGLPMGCAPMAHILYDEVMRYNPKNPYWFNRDRFVLSAGHGCMLLYALLHLAGYDSVLEEDLKSFRQWGSKTPGHPENFETPGIEVTTGPLGQGIANAVGLALAEKHLAARFNKPDAEVVDHYTYVILGDGCQMEGISNEAASLAGHWGLGKLIAFYDDNHISIDGDTEIAFTENVDQRFEALGWHVIWVKNGNTGYDEIRAAIKEAKAVTDKPTLIKVTTTIGYGSPNKANSYSVHGAALGEKEVEATRNNLGWPYEPFKVPDEVKSHWSRHTPDGKALESDWNASFAAYEKKYPEEAAELKSIITGELPAGWEKALPTYTPESPGDATRNLSQQCLNALAKVVPGFLGGSADLASSNMTLLKAFGDFQKATPEERNLRFGVREHGMGGICNGIALHSPGLIPYCATFFVFTDYMRGAMRISALSEAGVIYVMTHDSIGLGEDGPTHQPVEHLASFRAMPNTLMFRPADGNETAGAYKIAVTKRKTPSILALSRQKLPQLPGTSIEGVEKGGYTISDNSSGNKPDVILVGTGSELEIAAQAAEVLRKEGKTVRVVSFVCWELFDEQTDEYKESVLPSGVSARVSIEAASTFGWGKIVGGEGKSIGINSFGASAPAPLLYKEFGITVEAVVDAAKSFF

SEQ ID NO: 22591 - protein, 744 aa, Panax ginseng
MAAASSSLSPSQSLISRSIPNNHGSTQQHSDRLALPGINLSSISATRTLSHVSRAVIQSRRVGLRASVRASVVAETLEKTDTALVEKSVNTIRFLAIDAVEKANSGHPGLPMGCAPMGHVLYDEVMRYNPKNPYWFNRDRFVLSAGHGCMLQYALLHLAGYDSVKEEDLKSFRQWGSKTPGHPENFETPGIEVTTGPLGQGVANAVGLALAEKHLAARYNKPGNEIVDHYTYVILGDGCQMEGISNEACSLASHWGLGKLIAFYDDNHISIDGNTGIAFTESVDKRFEGLGWHVIWVKNGNTGYDEIRAAIEEAKAVKDKPTLIKVTTTIGFGSPNKANSYSVHGSALGAKEVDATRKNLGWSHEPFHVPEDVRKHWSHHTTKGAALEAEWNAKFAEYEKNYKGEAKELKSLITGELPTGWEKALPTYTPESPADATRNLSQTNLNALAKVLPGLLGGSADLASSNMTLLKMFGDYQKDTPEERNVRFGVREHGMGAICNGIALHSPGLIPYCATFFVFTDYMRAAMRLSALCEAGVIYVMTHDSIGLGEDGPTHQPIEHLASFRAMPNILMLRPADGNETAGAYKVAVLNRKRPSVLALSRQKLPNLTGTSIEGVEKGGYIISDNSSGNKPEIILIGTGSELEIAAKAADELRKGGKTVRVVSFVSWELFDEQSDAYKESVLPAGVSARVSIEAGSTFGWDKIVGSEGKAIGIDHFGASAPADKIYKEFGLTVEAVITAAKAV

SEQ ID NO: 22592 - protein, 746 aa, Papaver somniferum
MAASSSLTVSQALVGRKISGINTSSRSQSLPGFSLSTLSGRTLKSSLISSIASSRSNRVNTPSLSRSLVVRAAAVETLEKTDTALVDKSVNTIRFLAIDAVEKANSGHPGLPMGCAPMGHILYDETMRYNPKNPYWFNRDRFVLSAGHGCMLQYALLHLAGYDSVTTEDLKTFRQWGSKIPGHPENFETPGVEVTTGPLGQGIANAVGLALAEKHLAARFNKPDSEIVDHYTYCILGDGCQMEGIANEACSLAGHWGLGKLIAFYDDNHISIDGDTEIAFTESVDTRFEGLGWHVIWVKNGNNGYDEIRAAIKEAKAVTDKPTLIKVTTTIGFGSPNKANSYAVHGAALGSKEVDATRKNLDWPFEPFHVPEDVKSHWSRHTAEGAALEAEWTAKFAEYEKKYSEDAAEFKSIMTGEFPAGWEKALPTYTPEIPADATRNLSQTCLNALAPVLPGLIGGSADLASSNMTLMKMFGDFQKATPEERNVRFGVREHAMGAICNGIALHSPGFVPYCATFFVFTDYMRGAMRISALSEAGVIYVMTHDSIGLGEDGPTHQPIEHLASFRAMPNILMLRPADGNETAGSYKVAVENRKRPSILALSRQKLANLPGTSIEGVAKGGYTISDNSTGNKPDVILCATGSELEIAEKAAGELRKEGKTVRVVSFVSWELYDEQTDEYKESVLPAAVTARVSIEAGSTFGWHKIIGSKGKAIGVDGFGASAPAPIIYKEFGITSEAVIAAAKSVM

SEQ ID NO: 22593 - protein, 736 aa, Helianthus annuus
MASLTLSHAALVPRHGSSTPTPTVSIPAFTGLKSTSARASTRGQVSATRRQVAPTRRRVIVNAAVETLQKTDTALVEKSINTIRFLAIDAVEKANSGHPGLPMGCAPMGHILYDEIMRYNPKNPYWFNRDRFVLSAGHGCMLQYALLHLAGYDAVKEEDLKQFRQWGSKTPGHPENFETPGVEVTTGPLGQGIANAVGLALAEKHLAARYNKPDAEIVDHYTYCILGDGCQMEGIANEACSLAGHWGLGKLIAFYDDNHISIDGDTEIAFTENVDKRFEALGWHVIWVKNGNTGYDEIRAAIQEAKAVTDKPTTIKVTTTIGFGSPNKANSYSVHGAALGAKEVDATRQNLGWPYEPFHVPDEVKKHWSRHTPDGAALEAEWNAKFAAYESKYPEEAAELKSIVTGVLPAGWEKALPTYTPETPGDATRNLSQTMLNALAPVLPGLIGGSADLASSNMTLMKMFGDFQKATPEERNVRFGVREHGMGAICNGIALHSPGFVPYCATFFVFTDYMRGAMRISALSEAGVIYVMTHDSIGLGEDGPTHQPIEHLASFRAMPNILMFRPADGNETAGAYKVAVESRKRPSVLALSRQKLPNLPGTSIEGTTKGGYTITDNSTGNKPDVILIGTGSELEIAVKAADELRKEGKTVRVVSFVSWELFYEQSDEYKESVLPSGVTARVSIEAGSTFGWDRIVGSAGKAIGIDKWGSSAPAGKIYKEYGITVEAVIAAAKQVC

SEQ ID NO: 22594 - protein, 738 aa, Brassica rapa
MASTSSLALSQALLARAISHHGSDQRISLPSPFSRASASASSRRRSNAATTKPRSLRPLVVRAAAVDTLEPTTDASIVDKSVNTIRFLAIDAVEKAKSGHPGLPMGCAPMAHILYDEVMRYNPKNPYWFNRDRFVLSAGHGCMLLYALLHLAGYDSVLEEDLKSFRQWGSKTPGHPENFETPGIEVTTGPLGQGIANAVGLALAEKHLAARFNKPDAEVVDHYTYVILGDGCQMEGISNEAASLAGHWGLGKLIAFYDDNHISIDGDTEIAFTENVDQRFEALGWHVIWVKNGNTGYDEIRAAIKEAKAVTDKPTLIKVTTTIGYGSPNKANSYSVHGAALGEKEVEATRNNLGWPYEPFKVPDEVKSHWSRHTPDGKALESDWNAAFSAYEKKYPEEAAELKSIITGELPAGWEKALPTYTPESPGDATRNLSQQCLNALAKVVPGFLGGSADLASSNMTLLKAFGDFQKATPEERNLRLGVREHGMGAICNGIALHSPGLIPYCATFFVFTDYMRGAMRISALSEAGVIYVMTHDSIGLGEDGPTHQPVEHLASFRAMPNTLMFRPADGNETAGAYKIAVTKRKTPSILALSRQKLPQLPGTSIEGVEKGGYTISDNSSGNKPDVILVGTGSELEIAAQAAEVLRKEGKTVRVVSFVCWELFDEQTDEYKESVLPSGVSARVSIEAASTFGWGKIVGGEGKSIGINSFGASAPAPLLYKEFGITVEAVVDAAKSFF

SEQ ID NO: 22595 - protein, 743 aa, Chrysanthemum coronarium
MASLTLSQAALTRATVTRHGSSSPTPHAPHSLSSLQIPTFSGLKSSTVATSRAPTRRHVSATRRRVVTNAAVETLEKTDTALVDKSVNTIRFLAIDAVEKANSGHPGLPMGCAPMGHILYDEVMRYNPKNPYWFNRDRFVLSAGHGCMLQYALLHLAGYDAVTTEDLKQFRQWGSKTPGHPENFETPGVEVTTGPLGQGIANAVGLALAEKHLAARYNKPDAEIVDHYTYCIVGDGCQMEGIANEACSLAGHWGLGKLIAFYDDNHISIDGDTEIAFTESVDTRFEALGWHIIWVKNGNTGYDEIRAAIQEAKAVTDKPTLIKVTTTIGFGSPNKANSYSVHGAALGAKEVDATRQNLGWPYEPFHVPDDVKAHWSRHTPEGAALEAEWNAKFAEYEKKYAEDAAELKSIADGVLPAGWEKALPTYTPETPGDATRNLSQTMLNALAPVLPGFIGGSADLASSNMTLMKMYGDFQKATPEERNVRFGVREHGMGAICNGIALHSPGFIPYCATFFVFTDYMRGAMRISALSEAGVIYVMTHDSIGLGEDGPTHQPIEHLASFRAMPNILMFRPADGNETAGAYKVAVESRKRPSVLALSRQKLPNLQGTSIEGTAKGGYTITDNSTGNKPDVILIGTGSELEIAAKAADELRKEGKTVRVVSFVSWELFDEQSADYQESVLPSSVTARVSIEAATTFGWAKIVGSKGKAIGIDKFGASAPAGKIYKEYGITVEAVVAAAKEVI

SEQ ID NO: 22596 - protein, 735 aa, Brassica rapa
MASTSSLALSQALLARAISLHGSDQRISLPSSFSRASASSRRRNAASMTKLRSIRPLVRAAAVETLETSTDSSIIDKSVNSIRFLAIDAVEKAKSGHPGLPMGCAPMAHILYDEVMRYNPKNPYWFNRDRFVLSAGHGCMLLYALLHLAGYDSVLEEDLKSFRQWGSKTPGHPENFETPGIEVTTGPLGQGIANAVGLALAEKHLAARFNKPDAEVVDHYTYVILGDGCQMEGISNEAASLAGHWGLGKLIAFYDDNHISIDGDTEIAFTENVDQRFEALGWHVIWVKNGNTGYDEIRAAIKEAKTVTDKPTLIKVTTTIGYGSPNKANSYSVHGAALGEKEVEATRNNLGWPYEPFQVPEEVKSHWSRHTPEGKALESDWNATFAAYEKKYPEEAAELKSIITGELPAGWEKALPTYTPESPGDATRNLSQQCLNAIAKVVPGFLGGSADLASSNMTLLKASGDFQKATPEERNLRFGVREHGMGAICNGIALHSPGLIPYCATFFVFTDYMRGAMRISALSEAGVIYVMTHDSIGLGEDGPTHQPIEHIASFRAMPNTLMFRPADGNETAGAYKIAVTKRKTPSILALSRQKLPQLPGTSIEGVAKGGYTISDDSTGNKPDVILIGTGSELEIAAQAAEVIRKEGKTVRVVSFVCWELFDEQTDEYKESVLPSGVSARVSIEAASTFGWGKIVGGKGKSIGINSFGASAPAPLLYKEFGITVEAVVDAAKSFF

SEQ ID NO: 22597 - protein, 735 aa, Helianthus annuus
AALARSAVPRHGSTTTTTQQSTSLSTLSIPTFSGLKSTTTSSSRAATRRQSFSTRRHVISNAAVETLAKTDTALVEKSVNTIRFLAIDAVEKANSGHPGLPMGCAPMGHILYDEVMRYNPKNPYWFNRDRFVLSAGHGCMLQYALLHLAGYDAVKEEDLKQFRQWGSKTPGHPENFETPGVEVTTGPLGQGIANAVGLALAEKHLAARYNKPDGENVDHYTYCILGDGCQMEGIANEACSLAGHWGLGKLIAFYDDNHISIDGDTEIAFTETVDQRFEALGWHIIWVKNGNNGYDEIRAAIKEAKAVTDKPTLIKVTTTIGFGSPNKANSYSVHGAALGAKEVDATRQNLGWPYEPFHVPDEVKKHWSRHTPEGAALEAEWNAKFAEYEKKYPEEAAEFKSIATGVLPAGWEKALPTYTPETPGDSTRNLSQTMLNALAPVLPGLIGGSADLASSNMTLMKMFGDFQKNTPEERNVRFGVREHGMGAICNGIALHSPGFIPYCATFFVFTDYMRGAMRISALSEAGVIYVMTHDSIGLGEDGPTHQPIEHLASFRAMPNILMFRPADGNETAGAYKVAVESRKRPSVLALSRQKLPNLPGTSIEGTAKGGYTITDNSTGNKPDVILMGTGSELEIAAKAADELRKEGKTVRVVSFVSWELFDEQSDEYKESVLPSGVTARVSIEAASTFGWGKLVGSKGKAIGIDKFGASAPAGKIYKEYGITVEAVVAAAKEVC

SEQ ID NO: 22598 - protein, 728 aa, Conyza canadensis
SATTTAAATQQPTSISTLSLPTFSGLKSSTTSSSRAATRSQIPSTRGRVAHTRRRVITNAAVETIEKTETALVDKSVNTIRFLAIDAVEKANSGHPGLPMGCAPMGHILYDEVMRYNPKNPYWFNRDRFVLSAGHGCMLQYALLHLAGYDSVLEEDLKQFRQWGSKTPGHPENFETPGIEVTTGPLGQGIANAVGLAVAEKHLAARYNKPDAEIVDHYTYCILGDGCQMEGIANEACSLAGHWGLGKLIAFYDDNHISIDGDTEIAFTENVDKRFEALGWHIIWVKNGNTGYDEIRAAIKEAKSVTDKPTLIKVTTTIGFGSPNKANSYSVHGAALGAKEVDATRQTLGWPYEPFHVPEDVKKHWSRHTPEGAALEAEWNAKFAEYEKKYAAEAAELKSIADGVLPAGWEKALPTYTPETPGDATRNLSQTMLNALAPVLPGLVGGSADLASSNMTLMKMFGDFQKATPEERNIRFGVREHGMGAICNGIALHSPGFVPYCATFFVFTDYMRGAMRISALSEAGVIYVMTHDSIGLGEDGPTHQPIEHLASFRAMPNILMFRPADGNETAGAYKVAVESRKRPSILALSRQKLPNLAGTSIEGTAKGGYTISDNSTGNKPDVILVGTGSELEIAAKAADELRKEGKTVRVVSFVSWELFDEQSDEYKESVLPSAVTARVSIEAGSTFGWGKIVGSKGKAIGIDKWGSSAPAGKIYKEYGITAEAVIAA

SEQ ID NO: 22599 - protein, 735 aa, Brassica oleracea
MASTSSLALSQALLARAISHHGSDQRISLPSSFSRASASSRRRNAASMTKLRSIRPLVRAAAVETLETSTDSSIIDKSVNSIRFLAIDAVEKAKSGHPGLPMGCAPMAHILYDEVMRYNPKNPYWFNRDRFVLSAGHGCMLLYALLHLAGYDSVLEEDLKSFRQWGSKTPGHPENFETPGIEVTTGPLGQGVANAVGLALAEKHLAARFNKPDAEVVDHYTYVILGDGCQMEGISNEAASLAGHWGLGKLIAFYDDNHISIDGDTEIAFTENVDQRFEALGWHVIWVKNGNTGYDEIRAAIKEAKTVTDKPTLIKVTTTIGYGSPNKANSYSVHGAALGEKEVEATRNNLGWPYEPFQVPDEVKSHWSRHTPEGKALESDWNATFAAYEKKYPEEAAELKSIITGELPAGWEKALPTYTPESPGDATRNLSQQCLNAIAKVVPGFLGGSADLASSNMTLLKASGDFQKATPEERNLRFGVREHGMGAICNGIALHSPGLIPYCATFFVFTDYMRGAMRISALSEAGVIYVMTHDSIGLGEDGPTHQPIEHIASFRAMPNTLMFRPADGNETAGAYKIAVNKRKTPSILALSRQKLPQLPGTSIEGVAKGGYTISDDSSGNKPDVILIGTGSELEIAAQAAEVIRKEGKTVRVVSFVCWELFDEQTDEYKESVLPSGVSARVSIEAASTFGWGKIVGGKGKSIGINSFGASAPAPLLYKEFGITVEAVVDAAKSLF

SEQ ID NO: 22600 - protein, 735 aa, Medicago truncatula
MSSSSSTSLYLTNPHLTRHTSSPSTTRLSSLPSTITLNRTPTPTTHLSQSHHLRHTAIHASVSAPPSTTTDSSLVEKSVNTIRFLAVDSVEKANSGHPGLPMGCAPMGHVLYDEVMRYNPKNPFWFNRDRFVLSAGHGCMLQYALLHLAGYDSVKVEDLKQFRQWESRTPGHPENFETPGIEVTTGPLGQGIANAVGLALAEKHLAARFNKPDNEIIDHYTYCILGDGCQMEGIANEACSLAGHWGLGKLIAFYDDNHISIDGDTEIAFTESVEKRFEGLGWHVIWVKNGNTGFDEIRAAIKEAKAVKDRPTLIKFTTTIGYGSPNKSNSYSVHGSALGAKEVDATRNNLGWPYEPFHVPEDVKKHWSRHIREGAALESEWNAKFADYEKKYKEEAAVLKSIISGDLPAGWEKALPTYTPEIPADATRNLSQQNLNALANVLPGLIGGSADLASSNMTLLKKFGDFQSDSPAERNVRFGVREHGMGAICNGIALHSRGLIPYCATFFVFTDYMRGAIRLSALSEAGVIYVMTHDSIGLGEDGPTHQPIEHLASFRAMPNILMLRPADGNETAGAYKVAVLNRKRPSILALSRQKLPNLAGTSIEGVEKGGYIVSDNSTGNKPDVILIGTGSELEIAYKAGEDLRKEGKAVRVVSFVSWELFDEQSQAYKESVLPTAVTARVSIEAGSTFGWEKIVGSKGKAIGIDRFGASAPAGTIYKEFGITKEAVIAAAKELI

SEQ ID NO: 22601 - protein, 697 aa, Arachis hypogaea
PAISLRRIPPISALKVSASSSSAVDTVDRTAADPAIVEKSVNTIRFLAIDAVEKANSGHPGLPMGCAPMGHVLYDEVMRYNPKNPKWFNRDRFVLSAGHGCMLQYALLHLAGYDSVKEEDLKQFRQWESRTPGHPENFETPGIEVTTGPLGQGIANAVGLALAEKHLAARFNKPDNEIVDHYTYAILGDGCQMEGIANEACSLAGHWGLGKLIAFYDDNHISIDGNTEIAFTESVDRRFEGLGWHVIWVKNGNNGYDEIRAAIKEAKAVKDRPTLIKVTTTIGYGSPNKANSYSVHGSALGAKEVEATRQNLGWAHEPFHVPEDVKKHWSRHIPEGAALEAEWNKKFAEYEKKYKEEAAELKCIINGEFPAGWEKALPTYTPETPGDATRNLSQHNLNALAKVLPGLLGGSADLASSNMTLLKMFGNFQKDTPAERNIRFGVREHGMGAISNGIALHSPGLIPYCATFFVFTDYMRAAIRLSALSQAGVIYVMTHDSIGLGEDGPTHQPIEHLASFRAMPNVLMLRPADGNETAGSYKVAVLNRKRPSILALSRQKLPNLPGTSIEGVGKGGYTISDNSTGNKPDVILIGTGSELEIAAKAADDLRKEGKAVRVVSFVSWELFNEQSEAYKESVLPAAVSARVSIEAGSTFGWERIIGSKGKAIGIDRFGASAPAGKIYKEFGITKEAVIAAAKSLI

SEQ ID NO: 22602 - protein, 717 aa, Capsicum annuum
MAPLPPPTPNSPLLPFPSPLSPASNPPPPPPPPPPRSPEIRASAAVETLEKTDNALVEKSVNTIRFLAIDAVEKANSGHPGLPMGCAPIGHILYDEIMRYNPKNPYWFNRDRFVLSAGHGCMLQYALLHLAGYDAVREEDLKSFRQWGSKTPGHPENFETPGVEVTTGPLGQGIANAVGLALSEKHLAARFNKPGAEIVDHYTYCILGDGCQMEGISQEAASLAGHWGLGKLIAFYDDNHISIDGDTEIAFTEDVGARFEALGWHVIWVKNGNTGYDEIRAAIKEAKAVTDKPTMIKVTTTIGFGSPNKANSYSVHGSALGAKEVEATRQNLGWPYEPFHVPEDVKSHWSRHVPEGAALEAGWNTKFAEYEKKYPEEAADLKSIITGELPAGWEKALPTYTPESPADATRNLSQQNLNALAKVLPGFLGGSADLASSNMTLMKMFGDFQKNTPEERNLRFGVREHGMGAICNGIALHSPGLIPYCATFFVFTDYMRAAIRISALSESRVIYVMTHDSIGLGEDGPTHQPIEHLASFRAMPNVLMLRPADGNETAGAYKVAILKSKTPSILALSRQKLPQLAGTSIEGTAKGGYVTSDNSSGNNPDVILIGTGSELEIAVKAADELRKEGKAVRVVSLVSWELFDEQSAEYKESVLPAAVTARVSIEAGSTFGWEKIVGSKGKAIGIDRFGASAPAGKIYKEYGITAEAVIAAAKQVS

SEQ ID NO: 22603 - protein, 715 aa, Vinca minor
TISLPSFSGLKSTLPSTTISRRRCSTPSSRRHQNPQFFAAATVETVEKITTDELVDKSVNTIRFLAIDAVEKANSGHPGLPMGCAPMGHILYDEVMKYNPKNPYWFNRDRFVLSAGHGCMLQYALLHLAGYDAVREEDLKEFRQWGSKSPGHPENFETPGVEVTTGPLGQGIANAVGLAVAEKHLAARYNKPGAEIVDHYTYVILGDGCQMEGISNEAASLAGHWGLGKLIAFYDDNHISIDGDTDIAFTESVDTRFEGLGWHVIWVKNGNTGYDEIRAAIKEAKTVKDKPTLIKVTTTIGFGSPNKANSYSVHGSALGAKEVEATRTNLGWPYEPFHVPEDVKAHWSRHIPNGAAYETEWNAKFAEYEKKYPQEAAEFKSIITGELPAGWEKALPTYTPESPADATRNLSQANLNALAKVLPGLLGGSADLASSNMTLLKMFGDFQKDTPEERNLRFGVREHGMGAICNGIALHSPGLIPYCATFFVFTDYMRAAIRISALSEAGVIYVMTHDSIGLGEDGPTHQPIEHLASFRAMPNILMLRPADGNETAGAYKVAVLNRKRPSVLALSRQKLPNLAGTSIEGVKKGGYILSDNSSGNKPDAILIGTGSELEIAVKAADELRKEGKAVRVVSFVSWELFDDQSAEYKESVLPASVTARVSIEAGSTFGWAKIVTSEGKAIGIDRFGASAPAGKIYKEFGITAEAVVAAAKEVM

SEQ ID NO: 22604 - protein, 737 aa, Ambrosia trifida
MASLTLSHAALSSSTVPRHGSSTTLSIPTFSGLKPTSSRALTRHQISSTRRTVTPTRRRVISNAAVETLQKTDTALVEKSINTIRFLAIDAVEKANSGHPGLPMGCAPMGHILYDEIMRYNPKNPYWFNRDRFVLSAGHGCMLQYALLHLAGYDAVKEEDLKQFRQWGSKTPGHPENFETPGVEVTTGPLGQGIANAVGLALAEKHLAARYNKPDAEIVDHYTYCILGDGCQMEGIANEACSLAGHWGLGKLIAFYDDNHISIDGDTEIAFTENVDKRFEALGWHVIWVKNGNTGYDEIRAAIQEAKSVTDKPTMIKVTTTIGFGSPNKANSYSVHGAALGAKEVDATRQNLGWPYEPFHVPDEVKKHWSRHTPDGAALEAEWNAKFAAYESKYPEEAAELKSIVTGVLPAGWEKALPTYTPETPGDATRNLSQTMLNALAPVLPGLVGGSADLASSNMTLMKMFGDFQKNTPEERNVRFGVREHGMGAICNGIALHSPGFVPYCATFFVFTDYMRGAMRISALSEAGVIYVMTHDSIGLGEDGPTHQPIEHLASFRAMPNILMFRPADGNETAGAYKVAVESRKRPSVLALSRQKLPNLPGTSIEGTSKGGYTITDNSTGNKPDVILIGTGSELEIAVKAADELRKEGKSVRVVSFVSWELFEEQSDEYKESVLPSGVTARVSIEAGSTFGWDRIVGSAGKAIGIDKWGSSAPAGKIYKEYGITVEAVVAAAKQVS

SEQ ID NO: 22605 - protein, 737 aa, Arnica chamissonis
SHAALSRSAVPRHGSSTTTAQQSTSLATLSIPTFSGLKSTSTSSSRAPTRRQVSSTRRRVISNAAVETLQKTDTALVEKSINTIRFLAIDAVEKANSGHPGLPMGCAPMGHILYDEIMRYNPKNPYWFNRDRFVLSAGHGCMLQYALLHLAGYDAVKEEDLKQFRQWGSKTPGHPENFETPGVEVTTGPLGQGIANAVGLALAEKHLAARYNKPDAEIVDHYTYCIVGDGCQMEGISNEACSLAGHWGLGKLIAFYDDNHISIDGDTEIAFTENVDKRFEALGWHIIWVKNGNTGYDEIRAAIKEAKAVTDKPTLIKVTTTIGFGSPNKANSYSVHGAALGAKEVDATRQNLGWPYEPFHVPDEVKKHWSRHTPDGAALEAEWNAKFAAYENKYPEDAAELKSIVTGVLPAGWEKALPTYTPETPGDATRNLSQTMLNALAPVLPGLVGGSADLASSNMTLMKMFGDFQKSTPEERNVRFGVREHGMGAICNGIALHSPGFIPYCATFFVFTDYMRGAMRISALSEAGVIYVMTHDSIGLGEDGPTHQPIEHLASFRAMPNILMFRPADGNETAGAYKVAVESRKRPSVLALSRQKLPNLPGTSIEGTAKGGYTITDNSTGNKPDVILIGTGSELEIAVKASDELKKEGKTVRVVSFVSWELFDEQSDEYKESVLPSGVTARVSIEAGSTFGWGKIVGSKGKSIGIDKWGSSAPAGKIYKEYGITVEAVIAAAKQVC

SEQ ID NO: 22606 - protein, 745 aa, Chrysanthemum coronarium
RAMASLTLSQAALTRATVTRHGSSTPTPHAPHSLSSLQIPTFSGLKSSTVSTSRAPTRRHVSATRRRVVTNAAVETLEKTDTALVDKSVNTIRFLAIDAVEKANSGHPGLPMGCAPMGHILYDEVMRYNPKNPYWFNRDRFVLSAGHGCMLQYALLHLAGYDAVTTEDLKQFRQWGSKTPGHPENFETPGVEVTTGPLGQGIANAVGLALAEKHLAARYNKPDAEIVDHYTYCIVGDGCQMEGIANEACSLAGHWGLGKLIAFYDDNHISIDGDTEIAFTESVDTRFEALGWHIIWVKNGNTGYDEIRAAIQEAKAVTDKPTLIKVTTTIGFGSPNKANSYSVHGAALGAKEVDATRQNLGWPYEPFHVPDDVKAHWSRHTPEGAALEAEWNAKFAEYEKKYAEDAAELKSIADGVLPAGWEKALPTYTPETPGDATRNLSQTMLNALAPVLPGFIGGSADLASSNMTLMKMYGDFQKATPEERNVRFGVREHGMGAICNGIALHSPGFIPYCATFFVFTDYMRGAMRISALSEAGVIYVMTHDSIGLGEDGPTHQPIEHLASFRAMPNILMFRPADGNETAGAYKVAVESRKRPSVLALSRQKLPNLQGTSIEGTTKGGYTITDNSTGNKPDVILIGTGSELEIAAKAADELRKEGKTVRVVSFVSWELFDEQSADYQESVLPSSVTARVSIEAATTFGWAKIVGSKGKAIGIDKFGASAPAGKIYKEYGITVEAVVAAAKEVI

SEQ ID NO: 22607 - protein, 736 aa, Chrysanthemum coronarium
QAALTRAAVTRHGSSTTTPQQPTSLSTLQIPTFSGLKSTPPTSSRAPTRRHVSATRRRVVTNAAVETLEKTDTALVDKSVNTIRFLAIDAVEKANSGHPGLPMGCAPMGHILYDEVMRYNPKNPYWFNRDRFVLSAGHGCMLQYALLHLAGYDAVTTEDLKQFRQWGSKTPGHPENFETPGVEVTTGPLGQGIANAVGLALAEKHLAARYNKPDAEIVDHYTYCILGDGCQMEGIANEACSLAGHWGLGKLIAFYDDNHISIDGDTEIAFTESVDTRFEALGWHIIWVKNGNTGYDEIRAAIKEAKAVTDKPTLIKVTTTIGFGSPNKANSYSVHGAALGAKEVDATRQNLGWPYEPFHVPDDVKAHWSRHTPEGAALEAEWNAKFAEYEKKYAEDAAELKSIADGVLPAGWEKALPTYTPETPGDATRNLSQTMLNALAPVLPGLIGGSADLASSNMTLMKMFGDFQKATPEERNVRFGVREHGMGAICNGIALHSPGFIPYCATFFVFTDYMRGAIRISALSEAGVIYVMTHDSIGLGEDGPTHQPIEHLASFRAMPNILMFRPADGNETAGAYKVAVESRKRPSILALSRQKLPNLPGTSIEGTAKGGYTITDNSTGNKPDVILIATGSELEIAAKAGDELRKEGKTVRVVSFVSWELFDEQSADYQESVLPSSVTARVSIEAASTFGWGKIVGTKGKAIGIDKFGASAPAPKIYKEYGITVEAVVAAAKEVI

SEQ ID NO: 22608 - protein, 746 aa, Cocos nucifera
MAASSSVTAAQALVGRAISGHSSPSPSHPDRLAFGISSIAGNALKSPAAPRLQNRRPQAASRPRRYAVTRAAAVETLEEKPATEALVEKSINTIRFLAIDAVEKANSGHPGLPMGCAPMGHILYDEVMRYNPKNPFWFNRDRFVLSAGHGCMLQYALLHLAGYDSVKMEDLKAFRQWGSKTPGHPENFETLGIEVTTGPLGQGVGNAVGLALAEKHLAARFNKPDMEIVDHYTYCILGDGCQMEGISNEVCSLAGHWGLGKLIAFYDDNHISIDGDTEIAFTEDVNARFEALGWHTIWVKNGNTGYDEIRAAIKEAKAVKDKPTLIKVTTTIGYGSPNKASTYSVHGSALGAKEVEATRQNLGWPYEPFFVPEDVKSHWSRHVLEGPALEAEWNAKFAQYEKKYKEDAAELKQIITGELPAGWEKALPTYTPESPADATRNLSQQCLNALAKVLPGFLGGSADLASSNMTLLKMFGDFQKDTPEERNVRFGVREHGMGAISNGIALHSPGLIPYCATFFVFTDYMRAAIRISALSEAGVIYVMTHDSIGLGEDGPTHQPIEHLISFRAMPNILMLRPADGNETAGAYKVAILNSKRPSILALSRQKLPQLAGTSAEGVAKGGYIISDNSSGNKPDLIIMSTGSELEIAAKAADELRKEGKAVRVVSLVSWELFDEQSDEYKESILPASVTARISIEAGATLGWEKFVGPYGRSIGIDRFGASAPGGRIYKEFGITAEKVIEAAKSL

SEQ ID NO: 22609 - protein, 735 aa, Brassica napus
MASTSSLALSQALLARAISHHGSDQRISLPSSFSRASASSRRRNAASMTKLRSIRPLVRAAAVETLETSTDSSIIDKSVNSIRFLAIDAVEKAKSGHPGLPMGCAPMAHILYDEVMRYNPKNPYWFNRDRFVLSAGHGCMLLYALLHLAGYDSVLEEDLKSFRQWGSKTPGHPENFETPGIEVTTGPLGQGVANAVGLALAEKHLAARFNKPDAEVVDHYTYVILGDGCQMEGISNEAASLAGHWGLGKLIAFYDDNHISIDGDTEIAFTENVDQRFEALGWHVIWVKNGNTGYDEIRAAIKEAKTVTDKPTLIKVTTTIGYGSPNKANSYSVHGAALGEKEVEATRNNLGWPYEPFQVPDEVKSHWSRHTPEGKALESDWNATFAAYEKKYPEEAAELKSIITGELPAGWEKALPTYTPESPGDATRNLSQQCLNAIAKVVPGFLGGSADLASSNMTLLKASGDFQKATPEERNLRFGVREHGMGAICNGIALHSPGLIPYCATFFVFTDYMRGAMRISALSEAGVIYVMTHDSIGLGEDGPTHQPIEHIASFRAMPNTLMFRPADGNETAGAYKIAVNKRKTPSILALSRQKLPQLPGTSMEGVAKGGYTISDDSSGNKPDVILIGTGSELEIAAQAAEVIRKEGKTVRVVSFVCWELFDEQTDEYKESVLPSGVSARVSIEAASTFGWGKIVGGKGKSIGINSFGASAPAPLLYKEFGITVEAVVDAAKSLF

SEQ ID NO: 22610 - protein, 736 aa, Chrysanthemum coronarium
QAALTRATVTRHGSSTTTPQQPTSLSTLQIPTFSGLKSTPPTSSRAPTRRHVSATRRRVVTNAAVETLEKTDTALVDKSVNTIRFLAIDAVEKANSGHPGLPMGCAPMGHILYDEVMRYNPKNPYWFNRDRFVLSAGHGCMLQYALLHLAGYDAVTTEDLKQFRQWGSKTPGHPENFETPGVEVTTGPLGQGIANAVGLALAEKHLAARYNKPDAEIVDHYTYCILGDGCQMEGIANEACSLAGHWGLGKLIAFYDDNHISIDGDTEIAFTESVDTRFEALGWHIIWVKNGNTGYDEIRAAIKEAKAVTDKPTLIKVTTTIGFGSPNKANSYSVHGAALGAKEVDATRQNLGWPYEPFRVPDDVKAHWSRHTPEGAALEAEWNAKFAEYEKKYAEDAAELKSIADGVLPAGWEKALPTYTPETPGDATRNLSQTMLNALAPVLPGLIGGSADLASSNMTLMKMFGDFQKATPEERNVRFGVREHGMGAICNGIALHSPGFIPYCATFFVFTDYMRGAIRISALSEAGVIYVMTHDSIGLGEDGPTHQPIEHLASFRAMPNILMFRPADGNETAGAYKVAVESRKRPSILALSRQKLPNLPGTSIEGTAKGGYTITDNSTGNKPDVILIATGSELEIAAKAGDELRKEGKTVRVVSFVSWELFDEQSADYQESVLPSSVTARVSIEAASTFGWGKIVGTKGKAIGIDKFGASAPAPKIYKEYGITVEAVVAAAKEVI

SEQ ID NO: 22611 - protein, 752 aa, Ananas comosus
MAASSSVAAAQALVGRAVAAHGAPHGSTPSDRLALPAAFHLSSLGGHGRALTSPARRLNAASPPPPRPRRRVGVRAAAVETVGQKVGATEEVLEKSVNTIRFLAIDAVEKANSGHPGLPMGCAPMGHILYDEVMRYNPKNPYWFNRDRFVLSAGHGCMLQYALLHLAGYDSIKDEDLRAFRQWGSRTPGHPENFETPGVEVTTGPLGQGIANAVGLALAERHLAARFNKPDNEIVDHYTYVIVGDGCQMEGISNEACSLAGHLGLGKLIAFYDDNHISIDGDTEIAFTEDVSARFEALGWHTIWVKDGNTGYDDIRAAIKEAKAVKDKPTLIKVTTTIGYGSPNKANTYSVHGSALGAKEVDATRKNLGWPYEPFHVPEDVKSHWSRHVPEGAALEAEWNAKFGEYEKKYPEDAADLKTIISGELPAGWADALPKYTPESSADATRNLSQQCLNALAKVLPGLIGGSADLASSNMTLLKMFGDFQKDTPEERNLRFGVREHGMGAICNGIALHSPGLIPYCATFFVFTDYMRAAIRISALCEAGVIYVMTHDSIGLGEDGPTHQPIEHLISFRAMPNILMLRPADGNETAGAYKVAVLNRKRPSILALSRQKLPQLAGSSIEGVEKGGYIISDNSTGNKPDLILIGTGSELEIAAKAADELRKEGKTVRVVSLVCWELFNEQSEEYKESVFPAAVTARVSIEAGATLGWEKFVGSKGKAIGIDRFGASAPAGRIYKEFGLTAEKVIEAAKSL

SEQ ID NO: 22612 - protein, 729 aa, Helianthus annuus
HAALVPRHGSSTTTPTVSIPAFTGLKSTSARASTRGQVSATRRQVAPTRRRVIVNAAVETLQKTDTALVEKSINTIRFLAIDAVEKANSGHPGLPMGCAPMGHILYDEVMRYNPKNPYWFNRDRFVLSAGHGCMLQYALLHLAGYDAVKEEDLKQFRQWGSKTPGHPENFETPGVEVTTGPLGQGIANAVGLALAEKHLAARYNKPDAEIVDHYTYCILGDGCQMEGIANEACSLAGHWGLGKLIAFYDDNHISIDGDTEIAFTENVDKRFEALGWHVIWVKNGNTGYDEIRAAIQEAKAVTDKPTMIKVTTTIGFGSPNKANSYSVHGTALGAKEVDATRQNLGWPYEPFHVPDEVKKHWSRHTPDGAALEAEWNAKFAAYESKYPEEAAELKSIVTGVLPAGWEKALPTYTPETPGDATRNLSQTMLNALAPVLPGLIGGSADLASSNMTLMKMFGDFQKATPEERNVRFGVREHGMGAICNGIALHSPGFVPYCATFFVFTDYMRGAMRISALSEAGVIYVMTHDSIGLGEDGPTHQPIEHLASFRAMPNILMFRPADGNETAGAYKVAVESRKRPSVLALSRQKLPNLPGTSIEGTTKGGYTITDNSTGNKPDVILIGTGSELEIAVKAADELRKEGKTVRVVSFVSWELFYEQSDEYKESVLPSSVTARVSIEAGSTFGWDRIVGSAGKAIGIDKWGSSAPAGKIYKEYGITVEAVIAAAKQVS

SEQ ID NO: 22613 - protein, 743 aa, Elaeis guineensis
MAASPSVTAAQALVGRAISGHPSPSPAQPDRLAFGLSSLAGRALKSPRLQNLRPQAAPRPRRAAVTRAARVETLEGKAATEALVDKSVNTIRFLAVDAVEKATSGHPGLPMGCAPLGHILYDEIMRYNPKNPYWFNRDRFVLSAGHGCMLHYALLHLAGYDSVKEDDLKAFRQWESKTPGHPENFETPGIEVTTGPLGQGIANAVGLALAERHLAARFNKPDMEIIDHYTYVVVGDGCQMEGISNEACSLAGHWGLGKLIAFYDDNHISIDGDTEIAFTEDVNARFEALGWHTIWVKNGNTGYDEIRAAIKEAKAVKDKPTLIKVTTTIGYGSPNKANTYSVHGSALGAKEVDATRQNLGWPYEPFFVPEDVKSHWSHHVPEGAALEAEWNAKFAEYEKKYKEDAAELKRIISGELPTGWEKALPTYTLESPADATRNLSQQCLNALAKVLPGFLGGSADLASSNMTLLKMFGNFQKDTPEERNVRFGVREHGMGAICNGIALHSLGLIPYCATFFVFTDYMRAAIRISALSEAGVIYVMTHDSIGLGEDGPTHQPIEHLISFRAMPNILMLRPADGTETAGAYKVAVLNRKRPSILALSRQKLPQLAGTSVEGVEKGGYIISDNSSGNKPDLIVMSTGSELEIAAKAADELRKEGKTVRVVSLVSWELFDEQSDEYKESVLPAAVTARISIEAGSTLGWEKFVGTKGKAIGIDRFGASAPAGRIYKEFGITAEKVIEAARSL

SEQ ID NO: 22614 - protein, 741 aa, Spinacia oleracea
MAASSSLSTLSHHQTLLSHPKTHLPTTPASSLLVPTTSSKVNGVLLKSTSSSRRLRVGSASAVVRAAAVEALESTDIDQLVEKSVNTIRFLAIDAVEKANSGHPGLPMGCAPMGHILYDEIMRYNPKNPYWFNRDRFVLSAGHGCMLQYALLHLAGYDSVLEEDLKTFRQWGSRIPGHPENFETPGVEVTTGPLGQGIANAVGLALAEKHLAARFNKPDAEIVDHYTYVILGDGCQMEGIAQEACSLAGHWGLGKLIAFYDDNHISIDGDTAIAFTESVDLRFEALGWHVIWVKNGNTGYDEIRAAIKEAKTVTDKPTLIKVTTTIGFGSPNKSNSYSVHGSALGSKEVEATRQNLGWPYEPFHVPEEVKKHWSRHTPEGASLEAEWNTKFAEYEKKYPEDATEFKSITTGEFPAGWEKALPTYTPETPGDATRNLSQQCLNALAKVIPGLLGGSADLASSNMTLLKMFGDFRRTHRKKETFRFGVREHGMGAICNGICLHSPGFVPYCATFFVFTDYMRGAMRISALSEAGVIYVMTHDSIGLGEDGPTHQPIEALSKFPAMPNILMLRPADGNETAGSYKVAVENRKTPSILALSRKKLPNLPGTSIEGVEKGGYTITDNSSGNKPDVILIGTGSELEIAAKAGDELRKEGKAVRVVSFVSWELFEKQSDEYKESVLPSDVTARVSIEAGSTFGWHKIVGSKGKAIGIDKFGASAPAGKIYQEYGITVEAVVEAAKSVC

SEQ ID NO: 22615 - protein, 747 aa, Aquilegia formosa
MATSSSLTVSQALVGRTISNNSTLHSDRLSLPGFNHSTRTLLKSSFTQTIRISRSLRKNNNLISRSSSSSIKAQAVETLEKTDTALVDKSVNTIRFLAIDAVEKANSGHPGLPMGCAPMGHILYDEIMRYNPKNPYWFNRDRFVLSAGHGCMLQYALLHLAGYDSVKEEDLKSFRQWGSKTPGHPENFETPGVEVTTGPLGQGIANAVGLALAEKHLAARFNKPDSEIVDHYTYCILGDGCQMEGIANEACSLAGHWGLGKLIAFYDDNHISIDGDTEIAFTESVDKRFEGLGWHVIWVKNGNTGYDEIRAAIAEAKSVTDKPTMIKVTTTIGFGSPNKANSYSVHGAALGAKEVDATRENLGWPYEPFHVPEDVKLHWSRHTTEGAALEAEWIGKFTEYEKKYKEDAAELKAIITGEQPTDWEKALPVYTPESPADATRNLSQQCLNALAKVIPGLIGGSADLASSNMTLMKMFGDFQKNTPEERNVRFGVREHAMGAICNGIALHSPGFVPYCATFFVFTDYMRGAMRISALSEAGVIYVMTHDSIGLGEDGPTHQPIEHIASFRAMPNILMLRPADGNETAGAYKVAVDNRKRPSVLALSRQKLAHLPGTSIAGVEKGGYIVSDNSSGNKPDVILMGTGSELEIASAAADELRKEGKAVRVVSLISWELYDEQSDEYKESVFPAAVTARVSIEAASTFGWGKFVGSLGISIGIDKFGASAPAPKIYKEYGITAEAVIAAAKSLI

SEQ ID NO: 22616 - protein, 743 aa, Cocos nucifera
MAASSSVAAAQALVGRAISGHPSPSPVQPDRLAFGVSSLAGRALKSPCLQNLRPQAAPRPRRAAIARSATVETLEGKAATEALVDKSVNTIRFLAVDAVEKANSGHPGLPMGCAPLGHILYDEIMRYNPKNPYWFNRDRFVLSAGHGCMLQYALLHLAGYDSVKEDDLKAFRQWESKTPGHPENFETPGIEVTSGPLGQGIANAVGLALAERHLAARFNKPDMEIIDHYTYVVVGDGCQMEGISNEACSLAGHWGLGKLIAFYDDNHISIDGDTEIAFTEDVNARFEALGWHTIWVKNGNTGYDEIRAAIKEAKAVKDKPTLIKFTTTIGYGSPNKANTYSVHGSALGAKEVEATRQNLGWPHEPFFVPEDVKSHWSHHVPEGAALEAEWNAKFAEYEKKYKEDAAELKRIISGELPAGWEKALPTYTLESPADATRNLSQQCLNALAKVLPGFLGGSADLASSNMTLLKMFGNFQKDAPEERNVRFGVREHGMGAICNGIALHSPGLIPYCATFFVFTDYMRAAIRISALSEAGVIYVMTHDSIGLGEDGPTHQPIEHLISFRAMPNILMLRPADGNETAGAYRVAVLNRKRPSILALSRQKLPQLAGTSVEGVEKGGYIISDNSSGNKPDLIVMSTGSELEIAAKAADELRKEGKTVRVVSLVSWELFDEQSDGYKESVLPAAVTARISIEAGSTLGWEKFLGTKGKAIGIDRFGASAPAGRIYKEFGITAEKVIEAARSL

SEQ ID NO: 22617 - protein, 745 aa, Vitis vinifera
MASSSSLSISQAIVAGALNHRGSTNSSDRLPLRSFTIPTFSGLKSTTSAASCPSRLGSARRRLCRRLAVQAASVETLEKTETTLIEKSVNTIRFLAVDSVEKANSGHPGLPMGCAPMGHVLYDEFMKFNPKNPYWFNRDRFVLSAGHGCMLQYALLHLAGYDSVREEDLKSFRQWGSTTPGHPENFETPGVEVTTGPLGQGIANAVGLALAERHLAARFNKPDNEIVDHYTYVILGDGCQMEGVAHEACSLAGHWGLGKLIALYDDNHISIDGDTEIAFTENVDLRFEALGWHVIWVKNGNTGYDEIRAAIKEAKTVKDKPTLIKVTTTIGYGSPNKSNSYSVHGSALGPKELDATRKNLRWPYEPFHVPEDVKKHWSRHVPEGAALEAEWNAQFAEYERKYKEEAAVLKSLINGELPAGWEKALPTYTPESPAEATRNSSQQCLNALANVLPGLLGGSADLASSNLSVMKQFGNFQKGTPEERNVRFGVREHGMGAICNGIVLHCPGLIPYCATFFVFTDYLRPAMRISALCEAGVIYVMTHDSIGLGEDGPTHQPIEHLASFRAMPNILMLRPADGTETAAAYKIAVLNRKRPSVLALGRRDVSQLRGTSIEGVEKGGYIVTDNSSGNKPDVILIGTGSELEIAAKAADELRKEGKAVRVVSLVCWALFDEQSDAYKESVLPAAVSARVSVEAASTFGWEKFVGSKGKSIGIDRFGASAPALKLYKELGVTAEAVIAAAKSIC

SEQ ID NO: 22618 - protein, 725 aa, Arnica chamissonis
GSSTTTAAQQSTSLATLSIPTFSGLKSTTTSSSRAPTRRQVSSTRRRVISNAAVETLEKTDTALVEKSINTIRFLAIDAVEKANSGHPGLPMGCAPMGHILYDEIMRYNPKNPYWFNRDRFVLSAGHGCMLQYALLHLAGYDAVKEEDLKQFRQWGSKTPGHPENFETPGVEVTTGPLGQGIANAVGLALAEKHLAARYNKPDAEIVDHYTYCIVGDGCQMEGISNEACSLAGHWGLGKLIAFYDDNHISIDGDTEIAFTENVDKRFEALGWHIIWVKNGNTGYDEIRAAIKEAKAVTDKPTLIKVTTTIGFGSPNKANSYSVHGAALGAKEVDATRQNLGWPYEPFHVPDEVKKHWSRHTPDGAALEAEWNAKFAAYENKYPEDAAELKSIVTGVFPAGWEKALPTYTPETPGDATRNLSQTMLNALAPVLPGLIGGSADLASSNMTLMKMFGDFQKNTPEERNVRFGVREHGMGAICNGIALHSPGFIPYCATFFVFTDYMRGAIRISALSEAGVIYVMTHDSIGLGEDGPTHQPIEHLASFRAMPNILMFRPADGNETAGAYKVAVESRKRPSILALSRQKLPNLPGTSIEGTAKGGYTITDNSTGNKPDVILIGTGSELEIAVKASDELKKEGKTVRVVSFVSWELFDEQSDEYKESVLPSGVTARVSIEAGSTFGWGKIVGSKGKSIGIDKWGSSAPAGKIYKEYGITVEAVIAAAKQVC

SEQ ID NO: 22619 - protein, 728 aa, Helianthus annuus
AALVPRHGSSTTTPTVSIPAFTGLKSTSARASTRGQVSATRRQVAPTRRRVIVNAAVETLQKTDTALVEKSINTIRFLAIDAVEKANSGHPGLPMGCAPMGHILYDEIMRYNPKNPYWFNRDRFVLSAGHGCMLQYALLHLAGYDAVKEEDLKQFRQWGSKTPGHPENFETPGVEVTTGPLGQGIANAVGLALAEKHLAARYNKPDAEIVDHYTYCILGDGCQMEGIANEACSLAGHWGLGKLIAFYDDNHISIDGDTEIAFTESVDKRFEALGWHVIWVKNGNTGYDEIRAAIQEAKAVTDKPTMIKVTTTIGFGSPNKANSYSVHGAALGAKEVDATRQNLGWPYEPFHVPDEVKKHWSRHTPDGAALEAEWNAKFAAYESKYPEEAAELKSIVTGVLPAGWEKALPTYTPETPGDATRNLSQTMLNALAPVLPGLIGGSADLASSNMTLMKMFGDFQKATPEERNVRFGVREHGMGAICNGIALHSPGFVPYCATFFVFTDYMRGAMRISALSEAGVIYVMTHDSIGLGEDGPTHQPIEHLASFRAMPNILMFRPADGNETAGAYKVAVESRKRPSVLALSRQKLPNLPGTSIEGTTKGGYTITDNSTGNKPDVILIGTGSELEIAVKAADELRKEGKTVRVVSFVSWELFYEQSDEYKESVLPSGVTARVSIEAGSTFGWDRIVGSAGKAIGIDKWGSSAPAGKIYKEYGITVEAVIAAAKQVC

SEQ ID NO: 22620 - protein, 740 aa, Beta vulgaris
MATSLSLSQAISARTSSSHHQSSLSHHLPSSLSLSSLSLLKSSSVSLKTSQRVVAPCATIRASSAVDSLDKSASTEVTLIEKSVNTIRFLAIDAVEKANSGHPGLPMGCAPMGHVLYDEVMRYNPKNPYWFNRDRFVLSAGHGCMLQYALLHLAGYDSVTEEDLKNFRQWESRTPGHPENFETPGVEVTTGPLGQGIANAVGLALAEKHLAARFNKPGAEIVDHYTYAIVGDGCQMEGVSQEACSLAGHWGLGKLIAFYDDNHISIDGNTDIAFTEDVDKRFEALGWHVIWVKNGNTGYDEIRAAIREAKAVTDKPTLIKVTTTIGYGSPNKANSYSVHGSALGAKEVEATRSNLGWPHEPFHVSEDVKKHWSRHTPEGAALEAEWNAKFAEYERKYKDEAAELKSIITGELPSGWENALPTYTTESPADATRNLSQQCLNALAKVLPGFLGGSADLASSNMTLLKMFGNFQKETPEERNLRFGVREHAMGSICNGIAHHSPGFIPYCATFFVFTDYMRASIKMAALSQAGVIFVMTHDSIGLGEDGPTHQPIEHLASFRAMPNVLMLRPADGTETAGAYKVAAIKRKTPAILALSRQKLPQLAGTSVERVEKGGYVISDNSKANKPDVILMGTGSELEIAAKAADELRKEGKAVRVVSFVSWELFDAQPDSYKESVLPSDVTARVSIEAGSTFGWLKYVGSKGKAIGIDRFGASAPAGKIYKEFGITKEAVVEAAKSLF

SEQ ID NO: 22621 - protein, 729 aa, Helianthus annuus
HAALVPRHGSSTPTPTVSIPAFTGLKSTSARASTRGQVSATRRQVAPTRRRVIVNAAVETLQKTDTALVEKSINTIRFLAIDAVEKANSGHPGLPMGCAPMGHILYDEIMRYNPKNPYWFNRDRFVLSAGHGCMLQYALLHLAGYDAVKEEDLKQFRQWGSKTPGHPENFETPGVEVTTGPLGQGIANAVGLALAEKHLAARYNKPDAEIVDHYTYCILGDGCQMEGIANEACSLAGHWGLGKLIAFYDDNHISIDGDTEIAFTESVDKRFEALGWHVIWVKNGNTGYDEIRAAIQEAKAVTDKPTMIKVTTTIGFGSPNKANSYSVHGAALGAKEVDATRQNLGWPYEPFHVPDEVKKHWSRHTPDGAALEAEWNAKFAAYESKYPEEAAELKSIVTGVLPAGWEKALPTYTPETPGDATRNLSQTMLNALAPVLPGLIGGSADLASSNMTLMKMFGDFQKATPEERNVRFGVREHGMGAICNGIALHSPGFVPYCATFFVFTDYMRGAMRISALSEAGVIYVMTHDSIGLGEDGPTHQPIEHLASFRAMPNILMFRPADGNETAGAYKGAVESRKRPSVLALSRQKLPNLPGTSIEGTTKGGYTITDNSTGNKPDVILIGTGSELEIAVKAADELRKEGKTVRVVSFVSWELFYEQSDEYKESVLPSGVTARVSIEAGSTFGWDRIVGSAGKAIGIDKWGSSAPAGKIYKEYGITVEAVIAAAKQVC

SEQ ID NO: 22622 - protein, 743 aa, Oryza sativa
MAAHSVAAAHATIAARAGAAAPAPAPPERLGFRLSALAGRGLRSPLPPRRGAPSASASRRRHNNRVRAAAVETLEGQAATGALLEKSVNTIRFLAIDAVEKANSGHPGLPMGCAPMGHILYDEVMRYNPKNPYWFNRDRFILSAGHGCMLQYALLHLAGYDAVLEEDLKQFRQWGSKTPGHPENFETPGVEVTTGPLGQGIANAVGLALAEKHLAARFNKPDSEIVDHYTYCILGDGCQMEGISNEACSLAGHWGLGKLIAFYDDNHISIDGDTEIAFTEDVSARFEALGWHTIWVKNGNDGYDEIRAAIKEAKAVTDKPTLIKVTTTIGFGSPNKANSYSVHGSALGTKEVEATRENLGWPYEPFFVPEDVKSHWSRHVPQGAAFEADWNAKFAEYEKKYPEDAATLKSIVSGELPAGWADALPKYTPESPADATRNLSQQCLNALAKVVPGLLGGSADLASSNMTLLKMFGDFQKDTPEERNVRFGVREHGMGAICNGIALHSPGLIPYCATFFVFTDYMRAAMRISALCEAGVIYVMTHDSIGLGEDGPTHQPIEHLVSFRAMPNILMLRPADGNETAGAYKIAVLNRKRPSVLALSRQKLAQLPGTSIEGVEKGGYIVSDNSTGNKPDFIVMSTGSELEIVAKAADELRKEGKTVRVVSFVCWELFDEQSAEYKESVLPEAVTARVSLEAGSTLGWQKYVGSKGKAIGIDKFGASAPAGKIYQEYGITAENVIATAKSL

SEQ ID NO: 22623 - protein, 746 aa, Elaeis guineensis
MAASSSVTAAQALVGRTISGHSSPSPCHPDCLAFGLSSVAGRALKTPPAPRLQNRRPQAASRPRRSAVTRAAAVETLEEKAATEALLEKSINTIRFLAVDAVEKANSGHPGLPMGCAPIGHILYDEVMRYNPKNPFWFNRDRFVLSAGHGCMLQYALLHLAGYDSVKEEDLKAFRQWGSKTPGHPENFETLGVEVTTGPLGQGIANAVGLALVEKHLASRFNKPDMEIVDHYTYVILGDGCQMEGISNEVCSLAGHWGLGKLIAFYDDNHISIDGDTEIAFTEDVNARFDALGWHTIWVKNGNTGYDEIRAAIKEAKAVKDKPTLIKVTTTIGFGSPNKANTYSVHGSALGAKEVEATRQNLGWPYEPFFVPEDVKSHWSRHVLEGPVLEAEWNAKFVQYEKKYKEEAAELKQIITGELPAGWQEAFPTYTPESPADATRNLSQQCLNALAKVLPGFLGGSADLASSNMTLLKMFGDFQKDTPEERNLRFGVREHGMGAICNGIALHSPGMIPYCATFFVFTDYMRAAIRISALSEAGVIYVMTHDSIGLGEDGPTHQPIEHLISFRAMPNILMLRPADGNETAGAYKVAILNRKRPSILALSRQKLPQLAGTSAERVAKGGYTISDNSSGNKPDLIIMSTGSELEIAAKAADELRKEGKTVRVVSLVSWELFDEQSDEYKESILPASVTARISIEAGATLGWEKFVGAGGKSIGIDRFGASAPGGRIYKEFGITAEKVIEAAKSL

SEQ ID NO: 22624 - protein, 751 aa, Amborella trichopoda
MASSSLGMYQAPLAGAPAAAERRSSSSATLPLPLPSKPNTPAILLNNNFLRGTKVVLSRRSRARKPSTSMQAVVRASAAVETLDQTSTTELIEKSINTIRFLAIDAVEKANSGHPGLPMGCAPMGHILYDEVMRYNPKNPYWFNRDRFVLSAGHGCMLQYALLHLAGYDSVKEEDLKSFRQWGSKTPGHPENFETPGIEVTTGPLGQGVANAVGLALAEKHLAARYNKPGFEIVDHYTFCILGDGCQMEGISNEACSLAGHWGLGKLIAFYDDNHISIDGDTEIAFTETVDTRFEGLGWHVIWVKNGNTGYDEIRAAIEEAKAVKDKPTLIKVTTTIGYGSPNKANSYSVHGSALGAKEVDATRQNLGWPYEPFHVPDDVKSHWSRHVSEGASLEAEWQAKLAEYEKKYKEEAVEFKELISGQLPDGWEKALPVYTAESPADATRNLSQQCLNALAKVLPGLLGGSADLASSNMTLLKMFGDFQKDTPEQRNVRFGVREHSMGAICNGIALHSGLIPYCATFFVFTDYMRAAMRISALCEAGVIYVMTHDSIGLGEDGPTHQPIEHIASFRAMPNILMLRPGDGNETAGAYKVAVLNRKRPSVLALSRQKLPQLAGTTIEGVEKGGYIVSDNSMRNKPDLILIGTGSELEIAVKAADEIRKEGKAVRVVSLVSWELFDEQSDDYKESVLPAEVTARVSVEAGSTFGWEKIVGSKGKSIGIDRFGASAPAGTLYKEFGITVDNVIAAAKSLL

SEQ ID NO: 22625 - protein, 728 aa, Arnica chamissonis
VPRHASSTTATQQSTSLSTLSIPAFSGLKSTTTSSSRAPTRRQVSTTRRHVISNAAVETLDKTDTALVEKSVNTIRFLAIDAVEKANSGHPGLPMGCAPMGHILYDEVMRYNPKNPYWFNRDRFVLSAGHGCMLQYALLHLAGYDAVKEEDLKQFRQWGSKTPGHPENFETPGIEVTTGPLGQGIANAVGLALAEKHLAARYNKPDAEIVDHYTYCILGDGCQMEGIANEACSLAGHWGLGKLIAFYDDNHISIDGDTEIAFTENVDQRFEALGWHIIWVKNGNTGYDEIRAAIKEAKTVTDKPTLIKVTTTIGFGSPNKANSYSVHGAALGAKEVDATRQNLGWPHEPFHVPDEVKKHWSRHTPDGAALEAEWNSKFAEYEKKYPEDAAELKSIATGALPAGWEKALPTYTPETPGDATRNLSQTMLNALAPVLPGLIGGSADLASSNMTLMKMFGDFQKNTPEERNVRFGVREHGMGAICNGIALHSPGFIPYCATFFVFTDYMRGAMRISALSEAGVIYVMTHDSIGLGEDGPTHQPIEHLASFRAMPNILMFRPADGNETAGAYKVAVESRKRPSVLALSRQKLPNLPGTSIEGTAKGGYTITDNSSGNKPDVILMGTGSELEIAVKAADELRKEGKSVRVVSFVSWELFDEQSDEYKESVLPSGVTARVSIEAGATFGWTKLVGSEGKAIGIDKFGASAPAGKTYKEYGITVEAVVTAAKEVS

SEQ ID NO: 22626 - protein, 752 aa, Musa acuminata
MAASSSVVAASASASAQALAVSTHCSPSSSHSHRLALPGGDALRSLVGRSLTSSPSALRFLRMRQPVFRSRRAGPARAAAVETLEAAATDALVEKSVNTIRFLAIDAVEKANSGHPGLPMGCAPMGHILYDEFMKYNPKNPYWFNRDRFVLSAGHGCMLHYALLHLAGYDSVKIEDIKEFRQWGSRTPGHPENFETPGIEVTTGPLGQGVANAVGLALAEKHLAARFNKPDNEIVDHYTYVILGDGCQMEGISNEACSLAGHWGLGKLIAFYDDNHISIDGDTEIAFTEDVMARFEALGWHTIWVKNGNNGYDDIRAAIKEAKAVKDKPTLIKVTTTIGYGSPNKANTYSVHGSALGAKEVDATRQNLGWPYEPFHVPEEVKSHWSRHVPEGASFEAEWNAKFAEYEKKYKEDAAQLKGIISGELPAGWETALPTYTSESPADATRNLSQQCLNALAKVLPGFLGGSADLASSNMTLLKTFGDFQKGTPEERNVRFGVREHGMGAICNGIALHSPGLLPYCATFFVFTDYMRAAMRISALSEARVIYVMTHDSIGLGEDGPTHQPIEHLISFRAMPNILMLRPADGNETAGAYKVAVLNKKRPSVLALSRQKLPQLAGTSVEGVEKGGYIISDNSSGNRPDLIFMGTGSELEIAAKAADELRKEGKTVRVVSLVSWELFDEQSDEYKESVFPASVTARISIEAGTTLGWEKFVGSKGKAIGIDRFGASAPAGRIYKEFGITAENIIATARSL

SEQ ID NO: 22627 - protein, 743 aa, Setaria italica
MAAHSVAAAHATIAARAGPAPGAAASAPAERLGFRRLSSLAGRGLRSPAPARRAPSAAASRRQRVVRAAAVEALEGKAATGELLEKSVNTIRFLAIDAVEKANSGHPGLPMGCAPMGHILYDEVMRYNPKNPYWFNRDRFVLSAGHGCMLQYALLHLAGYDSVKEEDLKQFRQWGSRTPGHPENFETPGVEVTTGPLGQGIANAVGLALAEKHLAARFNKPDSEIVDHYTYAILGDGCQMEGIANEACSLAGHWGLGKLIAFYDDNHISIDGDTEIAFTEDVSTRFEALGWHTIWVKNGNTGYDDIRAAIKEAKAVTDKPTLIKVTTTIGFGSPNKSNSYSVHGSALGTKEVEATRQNLGWPYEAFFVPEDVKSHWSRHTPEGAALEADWNAKFAEYEKKYPEDAATLKSIITGELPTGWADALPKYTPEIPGDATRNLSQQCLNALAKVVPGLIGGSADLASSNMTLLKMFGDFQKDTPEERNVRFGVREHGMGAICNGIALHSPGFVPYCATFFVFTDYMRGAMRISALSEAGVIYVMTHDSIGLGEDGPTHQPIEHLVSFRAMPNILMLRPADGNETAGAYKVAVLNRKRPSILALSRQKLPNLPGTSIEGVEKGGYTISDNSTGNKPDLIVMGTGSELEIAAKAADELRKEGKTVRVVSFVSWELFEEQSDEYKESVLPASVSARISIEAGSTLGWQKYVGAQGKAIGIDKFGASAPAGKIYQEYGITVESILAAAKSF

SEQ ID NO: 22628 - protein, 740 aa, Sorghum bicolor
MATHSVAAAHATIAARAAPAAGASAPAERLGFRLSSLAGRGLRSPLPARRAPSAAASRRQRVVRAAAVETLEGKAATGELLEKSVNTIRFLAIDAVEKANSGHPGLPMGCAPMGHILYDEVMRYNPKNPYWFNRDRFVLSAGHGCMLQYALLHLAGYDSVKEEDLKQFRQWGSKTPGHPENFETPGVEVTTGPLGQGIANAVGLALAEKHLAARFNKPDSEIVDHYTYVILGDGCQMEGIANEACSLAGHWGLGKLIAFYDDNHISIDGDTEIAFTEDVSTRFEALGWHTIWVKNGNNGYDDIRAAIKEAKAVTDKPTLIKVTTTIGFGSPNKANSYSVHGSALGAKEVEATRQNLGWPYEPFFVPEDVKSHWSRHTPEGAALEADWNAKFAEYEKKYADDAATLKSIITGEFPTGWADALPKYTPESPGDATRNLSQQCLNALANVVPGLIGGSADLASSNMTLLKMFGDFQKDTAEERNVRFGVREHGMGAICNGIALHSPGFVPYCATFFVFTDYMRGAMRISALSEAGVIYVMTHDSIGLGEDGPTHQPIEHLVSFRAMPNILMLRPADGNETAGAYKVAVLNRKRPSILALSRQKLPHLPGTSIEGVEKGGYTISDNSTGNKPDLIVLGTGSELEIAEKAADELRKEGKTVRVVSFVSWELFDEQSDEYKESVLPAAVTARISIEAGSTLGWQKYVGAQGKAIGIDKFGASAPAGTIYKEYGITVESVIAAAKSF

SEQ ID NO: 22629 - protein, 688 aa, Trifolium pratense
SQSQAHLRHITIPHASAAVTPTTETTLVEKSVNTIRFLAIDSVEKANSGHPGLPMGCAPMGHVLYDEVMRYNPKNPFWFNRDRFVLSAGHGCMLQYALLHLAGYDSVKEEDLKEFRQWGSRTPGHPENFETPGIEVTTGPLGQGIANAVGLALAEKHLAARFNKPDNEIIDHYTYCILGDGCQMEGIANEACSLAGHWGLGKLIAFYDDNHISIDGDTEIAFTESVEKRFEGLGWHVIWVKNGNTGFDEIRAAIKEAKAVKDRPTLIKFTTTIGYGSPNKSNSYSVHGSALGAKEVDATRNNLGWPYEPFHVPEDVKKHWSRHIPEGAALESEWNAKFSAYEKKYKEEAAVLKSIISGELPSGWEKALPTYTPEVPADATRNLSQTNLNALAKVLPGLLGGSADLASSNMTLLKAFGNFQSETPAERNVRFGVREHGMGAICNGIALHSPGLIPYCATFFVFTDYMRGAIRLSALSESGVIYVMTHDSIGLGEDGPTHQPIEHLASFRAMPNILMLRPADGNETAGAYKVAVLNRKRPSILALSRQKLPNLPGTSIEGVGKGGYIVSDNSTGNKPDVILIGTGSELEIAYYAAEDLRKEGKAVRVVSFVSWELFDEQSDAYKESVLPGAVSARVSIEAGSTFGWEKIVGSKGKAIGIDRFGASAPAGRIYKEFGITKEAVIAAAKELI

SEQ ID NO: 22630 - protein, 736 aa, Brassica oleracea
MASLAFSQALLSRAISHNGSNKNVSVPASSVLKSTSPRTTFFHSQRSASTSSHSLRPLVRAAAVETTDATTDSTLVDKSVNTIRFLAIDAVEKAKSGHPGLPMGCAPMSHILYDEVMRYNPKNPYWFNRDRFVLSAGHGCMLQYALLHLAGYDSVREEDLKSFRQWGSKTPGHPENFETPGVEVTTGPLGQGIANAVGLALAEKHLAARFNKPDNEIVDHYTYSIIGDGCQMEGITNEVCSLAAHWGLGKLIAFYDDNHISIDGDTEIAFTENVDKRFEALGWHVIWVKNGNNGYDEIRAAIKEAKAVTDKPTLIKVTTTIGYGSPNKANSYSVHGAALGEKEVEATRNNLGWPYEPFQVPEDVKSHWSRHTPEGAALEADWNAKFSAYEKKYPEEAEELKSIISGDLPAGWEKALPTYTPESPGDATRNLSQQCLNALAKTLPGFLGGSADLASSNMTLLKAFGDFQNATPEGRNLRFGVREHGMGAICNGVALHSPGFIPYCATFFVFTDYMRAAMRIAALSEAGVIYVMTHDSIGLGEDGPTHQPVEHLSSFRAMPNIMMFRPADGNETAGAYKIAVARRNTPSVLALSRQKLPQLPGTSIENVERGGYILSDNSNGNKPDVILVGTGSELEIAAKAGEELRKEGKSVRVVSFVCWELFDEQPDAYKESVLPSDVSARVSIEAGSTFGWGKVVGGKGKSIGIDSFGASAPAGKLYKEFGITIEAVVAAAKSLI

SEQ ID NO: 22631 - protein, 704 aa, Flaveria ramosissima
FSGLKSVATSSSRATTRRQVIPTRRRVISNAAVETLDKTDTALVEKSINTIRFLAIDAVEKANSGHPGLPMGCAPMGHILYDEVMRYNPKNPYWFNRDRFVLSAGHGCMLQYALLHLAGYDSVKEEDLKQFRQWGSKTPGHPENFETPGVEVTTGPLGQGIANAVGLALAEKHLAARYNKPDAEIVDHYTYCILGDGCQMEGIANEACSLAGHWGLGKLIALYDDNHISIDGDTEIAFTENVDQRFEALGWHIIWVKNGNTGYDEIRAAIKEAKAVTDKPTLIKVTTTIGFGSPNKANSYSVHGAALGAKEVDATRQNLGWPYEPFHVPDEVKKHWSRHTPDGAALEADWNAKFAAYESKYPEEAAELKSIITGVFPAGWEKALPTYTPESPGDATRNLSQTMLNALAPVLPGLIGGSADLASSNMTLMKMFGDFQKNTPEERNVRFGVREHGMGAICNGIALHSPGFVPYCATFFVFTDYMRGAMRISALSEAGVIYVMTHDSIGLGEDGPTHQPIEHLASFRAMPNILMFRPADGNETAGAYKVAVESRKRPSILALSRQKLPQLPGTSIEGAAKGGYTITDNSTGNKPDVILIGTGSELEIVVKAADELRKEGKSVRVVSFVSWELFEEQSDEYKESVLPSGVTARVSIEAGSTFGWEKIVGSKGKAIGIDKWGSSAPAGKIYKEYGITVEAVIAAAKQVA

SEQ ID NO: 22632 - protein, 747 aa, Lactuca sativa
MAASSFALSQAATTLSPSAALRHESSTNITQPPSSISTLSIPTFSGLKSTSTPSSRAVTPRRVSASRRRIISSAAVESLQKTDTSLVDKSVNTIRFLAIDAVEKANSGHPGLPMGCAPMGHILYDEVMRYNPKNPYWFNRDRFVLSAGHGCMLHYALLHLAGYDSVKEEDLKQFRQWGSKTPGHPENFETPGIEVTTGPLGQGIANAVGLAVAEKHLAARFNKPDAKIVDHYTYCILGDGCQMEGIANEACSLAGHWGLGKLIAFYDDNHISIDGDTEIAFTESVEKRFEALGWHIVWVKNGNNGYDDIRAAIKEAKAVTDKPTLIKVTTTIGFGSPNKANSYSVHGAALGAKEVDATRQNLGWPYEPFHVPEDVKKHWSRHTAEGAALEAEWNVKFGEYEKKYAEDAAELKSIADGVFPTGWEKALPKYTPDIPGDATRNLSQSCLNALAPVLPGLLGGSADLASSNMTLMKMFGDFQKNAPEERNVRFGVREHGMAAICNGIALHSPGFIPYCATFFVFTDYMRGAMRLSALSETGVIYVMTHDSIGLGEDGPTHQPIEHIASFRAMPNILMLRPADGNETAGAYKVAVENRKRPSVLALSRQKLPNLPGTSIEGVAKGGYIVSDDSSGNKPDVILIGTGSELEIAVKAADELRKDGKSVRVVSFVSWELFDEQSNEYKESVLPDSVTGRVSIEAGSTFGWERIVGSKGKAIGIDKFGASAPAGKIYKEYGITVEAVIAAAKEVC

SEQ ID NO: 22633 - protein, 734 aa, Arabidopsis lyrata
MASLTSSSQASILARPSSNRSSPPLPPTDLHVSLSLPSFSALRASFTRSSSPTLRRRRRLLLPISAAATDVSLVDKSVNTIRFLAIDAVEKAKSGHPGLPMGCAPMGHILFDEVMQYNPKNPYWFNRDRFILSAGHGCMLQYALLHLAGYDSVREDDLKNFRQWGSRTPGHPENFETPGVEVTTGPLGQGIANAVGLALAEKHLAARFNKPGNQIVDHYTYAILGDGCQMEGIANEACSLAGHWGLGKLIAFYDDNHISIDGDTEIAFTENVETRFQGLGWHVIWVKNGNTAYDEIRAAIKEAKAVKDKPTLIKITTTIGYGSPNKANSYSVHGSALGEKEVDATRKNLGWPYGPFHVPEDVKSHWSRHIPKGAALETEWNAKFADYENKYPQEAAELKSIVTVNLPTGWEKSLPTYTPESPADATRNLSQQCLNALAKVLPGFLGGSADLASSNMTLLKMFGDFQKNAPEERNLRFGVREHSMGAICNGITCHSPGLIPYCATFFVFTDYMRAAIRLSALSQAGVIYVMTHDSIGLGEDGPTHQPIEHVASFRAMPNILMLRPADGTETAGAYKVAVENRKRPSILALSRQKLLHLPGTSVEGVEKGGYVISDNSTGNKPDVILMGTGSELEIAAKAGEKLREEGRAVRVVSLVSWELFDEQSEEYKESVLPSEVSARVSIEAGSTFGWEKMVGSKGKAIGVDSFGASAPADVLYKKFGLTVDAVVAAAKDLC

SEQ ID NO: 22634 - protein, 722 aa, Brassica napus
LARAISLHGSDQRISLPSSFSRASASSRRRNAASMTKLRSIRPLVRAAAVETLETSTDSSIIDKSVNSIRFLAIDAVEKAKSGHPGLPMGCAPMAHILYDEVMRYNPKNPYWFNRDRFVLSAGHGCMLLYALLHLAGYDSVLEEDLKSFRQWGSKTPGHPENFETPGIEVTTGPLGQGIANAVGLALAEKHLAARFNKPDAEVVDHYTYVILGDGCQMEGISNEAASLAGHWGLGKLIAFYDDNHISIDGDTEIAFTENVDQRFEALGWHVIWVKNGNTGYDEIRAAIKEAKTVTDKPTLIKVTTTIGYGSPNKANSYSVHGAALGEKEVEATRNNLGWPYEPFQVPEEVKSHWSRHTPEGKALESDWNATFAAYEKKYPEEAAELKSIITGELPAGWEKALPTYTPESPGDATRNLSQQCLNAIAKVVPGFLGGSADLASSNMTLLKASGDFQKATPEERNLRFGVREHGMGAICNGIALHSPGLIPYCATFFVFTDYMRGAMRISALSEAGVIYVMTHDSIGLGEDGPTHQPIEHIASFRAMPNTLMFRPADGNETAGAYKIAVTKRKTPSILALSRQKLPQLPGTSIEGVAKGGYTISDDSTGNKPDVILIGTGSELEIAAQAAEVIRKEGKTVRVVSFVCWELFDEQTDEYKESVLPSGVSARVSIEAASTFGWGKIVGGKGKSIGINSFGASAPAPLLYKEFGITVEAVVDAAKSFF

SEQ ID NO: 22635 - protein, 747 aa, Zostera marina
MAASSSLTVQTFAANFISGNGSASSQCPSNRLLSTSRTSSFSGKPLRFSSSSSSCRTKKVYLQRRGLGVTRASAVETLKKKTATDELVEKSVNTIRFLSIDAVEKANSGHPGLPMGCAPMGHILYDEVMRYNPKNPYWFNRDRFVLSAGHGCMLHYSLLHLAGYDSVKEEDLKVFRQWGSCTPGHPENFETPGIEVTTGPLGQGIANAVGLALAEKHLAARFNKPDCEIVDHYTYVILGDGCQMEGISNEACSLAGHWGLGKLIAFYDDNHISIDGDTEIAFTEDVSSRFDALGWHTIWVKNGNNGYDEIRAAIEEAKTVKDKPTMIKVTTTIGYGSPNKANSYAVHGSALGGKEVDATRENLGWSYDPFFVPEDVKSHWSQHTPDGAALEAEWNAKFSKYEKKYSEDAAELKQIASGEFPAGWENALPTYTPDSPADATRNLSQQCLNALANVLPGFLGGSADLASSNMTLMKTFGDFQKDTPEERNLRFGVREHGMGGISNGICLHSPGFIPYCATFFVFTDYMRGAMRISALSEAGVIYVMTHDSIGLGEDGPTHQPIEHLISFRAMPNIVMFRPADGNETAGCYKIGVINRKRPSILALSRQKLPQLPGTSIEGVEKGGYAISDNSTGNKPDIILIGTGSELEIAAKAGDELRKEGKTVRVVSLVSWELFEEQSDEYKESVFPAASTARVSIEAGSTFGWERYTGSKGKAIGIDRFGASAPAGKIYKEFGLTVENVIATAKSL

SEQ ID NO: 22636 - protein, 725 aa, Brassica napus
ARAISHHGSDQRISLPSPFSRAPASSSRRRNNAAASTTKLRSLRPLAVRAAAVDTLEPTTDASIVDKSVNTIRFLAIDAVEKAKSGHPGLPMGCAPMAHILYDEVMRYNPKNPYWFNRDRFVLSAGHGCMLLYALLHLAGYDSVLEEDLKSFRQWGSKTPGHPENFETPGIEVTTGPLGQGIANAVGLALVEKHLAARFNKPDAEVVDHYTYVILGDGCQMEGISNEAASLAGHWGLGKLIAFYDDNHISIDGDTEIAFTENVDQRFEALGWHVIWVKNGNTGYDEIRAAIKEAKAVTDKPTLIKVTTTIGYGSPNKANSYSVHGAALGEKEVEATRNNLGWPYEPFKVPDEVKSHWSRHTPDGKALESDWNASFAAYEKKYPEEAAELKSIITGELPAGWEKALPTYTPESPGDATRNLSQQCLNALAKVVPGFLGGSADLASSNMTLLKAFGDFQKATPEERNLRFGVREHGMGGICNGIALHSPGLIPYCATFFVFTDYMRGAMRISALSEAGVIYVMTHDSIGLGEDGPTHQPVEHLASFRAMPNTLMFRPADGNETAGAYKIAVTKRKTPSILALSRQKLPQLPGTSIEGVEKGGYTISDNSSGNKPDVILVGTGSELEIAAQAAEVLRKEGKTVRVVSFVCWELFDEQTDEYKESVLPSGVSARVSIEAASTFGWGKIVGGEGKSIGINSFGASAPAPLLYKEFGITVEAVVDAAKSFF

SEQ ID NO: 22637 - protein, 705 aa, Spinacia oleracea
SSSSSLLKPSSFSLKTTQRVAPRATVRASAVESLDKSVTSEDTLVDKSVNTIRFLAIDAVEKANSGHPGLPMGCAPMGHILYDEVMRYNPKNPYWFNRDRFVLSAGHGCMLQYALLHLAGYDSVTVEDLKSFRQWESRTPGHPENFETPGIEVTTGPLGQGIANAVGLALAEKHLAARFNKPDMEIVDHYTYAILGDGCQMEGVSQEACSLAGHWGLGKLIAFYDDNHISIDGSTDIAFTEDVDKRFEALGWHVIWVKNGNTGYDEIRAAIREAKAVKDKPTLIKVTTTIGYGSPNKSNSYSVHGSALGAKEVEATRSNLVWPHEPFHVPEDVKKHWSRHTPEGASLETEWNAKFAEYEKKYTDEAAELKCIITGELPSGWEKALPTYTPESPADATRNLSQQCLNALAPVLPGFLGGSADLASSNMTLLKMFGNFQKDTPEERNLRFGVREHGMGSICNGIALHCPGFIPYCATFFVFTDYMRASIRMAALSQAGVIFVMTHDSIGLGEDGPTHQPIEHLASFRAMPNVFMFRPADGTETAGAYRVAVLNKKTPSILALSRQKLPQLPGTSIEGVEKGGYIISDNSKGNTPDVILMGTGSELEIAAKAADDLRKEGKAVRVVSFVSWELFDAQPDSYKESVLPADVTARVSIEAGTTFGWLKYVGCKGKAIGIDRFGASAPADKIYKELGITKEAVIEAAKSLC

SEQ ID NO: 22638 - protein, 698 aa, Petroselinum crispum
SLSASSLKCCRRVGSRAAAVKASSSAVDVVDKTETGLVEKSVNTIRFLAIDAVEKANSGHPGLPMGCAPMGHILYDEIMKYNPKNPFWFNRDRFVLSAGHGCMLQYALLHLAGYDSVKEEDLKSFRQWGSKTPGHPENFETPGIEVTTGPLGQGVANAVGLALAEKHLAARFNKPGSEIVDHYTYVILGDGCQMEGISNEACSLASHWGLGKLIAFYDDNHISIDGDTAIAFTESVDQRFEGLGWHVIWVKNGNTGYDEIRAAIEEAKAVTDKPTLIKVTTTIGFGSPNKANSYSVHGSALGAKEVDATRKNLGWPHEPFYVPEDVKKHWSRHTPEGAALEAEWNTKFAEYEKKYKEEAQELKSLISGELPVGWEKALPNYTPETPGDSTRNLSQTNLNALAKVLPGLLGGSADLASSNMTLLKMFGDFQKDTPEERNVRFGVREHGMGAICNGIALHSPGLIPYCATFFVFTDYMRAAMRLSALCEAGVIYVMTHDSIGLGEDGPTHQPIEHIASFRAMPNILMLRPADGNETAGAYKVAVLNRKRPSVLALSRQKLPNLPGTSIEGVEKGGYIITDNSSGNKPDIILIGTGSELEIAAKAADELRKSGKTVRVVSFVSWELFDEQSAAYKESVLPDDVSARVSIEAGTTFGWEKIVGSKGKAIGIDHFGASAPADKIYKEFGLTVEAVIAAAKALC

SEQ ID NO: 22639 - protein, 712 aa, Panax ginseng
RLALPGINLSSISATRTLSHASRAVVQSRGVGLRASVRASAETLEKTDTALVEKSVNTIRFLAIDAVEKANSGHPGLPMGCAPMGHVLYDEFMRYNPKNPYWFNRDRFVLSAGHGCMLQYALLHLAGYDSVKEEDLKSFRQWGSKTPGHPENFETPGIEVTTGPLGQGVANAVGLALAEKHLAARYNKPGNEIVDHYTYVILGDGCQMEGISNEACSLASHWGLGKLIAFYDDNHISIDGNTGIAFTESVDKRFEGLGWHVIWVKNGNTGYDEIRAAIEEAKAVKDKPTLIKVTTTIGFGSPNKANSYSVHGSALGAKEVDATRKNLGWSHEPFHVPEDVRKHWSHHTTKGAALEAEWNAKFAEYEKNYKDEAEELKCLITGELPTGWEKVLPTYTPESSADATRNLSQTNLNALAKVLPGLLGGSADLASSNMTLLKMFGDYQKDTPEERNVRFGVREHGMGAICNGIALHSPGLIPYCATFFVFTDYMRAAMRLSALCEAGVIYVMTHDSIGLGEDGPTHQPIEHLASFRAMPNIITLRPADGNETAGAYKVAVLNRKRPSVLALSRQKLPNLTGTSIEGVEKGGYIISDNSSGNKPEIILIGTGSELEIAAKAADELRKGGKTVRVVSFVSWELFDEQSDAYKESVLPAGVSARVSIEAGSTFGWDKIVGSKGKAIGIDHFGASAPADKIYKEFGLTVEAVITAGKAVC

SEQ ID NO: 22640 - protein, 709 aa, Helianthus annuus
AFTGLKSTSARASTRGQVSATRRQVAPTRRRVIVNAAVETLQKTDTALVEKSINTIRFLAIDAVEKANSGHPGLPMGCAPMGHILYDEVMRYNPKNPYWFNRDRFVLSAGHGCMLQYALLHLAGYDAVKEEDLKQFRQWGSKTPGHPENFETPGVEVTTGPLGQGIANAVGLALAEKHLAARYNKPDAEIVDHYTYCILGDGCQMEGIANEACSLAGHWGLGKLIAFYDDNHISIDGDTEIAFTESVDKRFEALGWHVIWVKNGNTGYDEIRAAIQEAKAVTDKPTMIKVTTTIGFGSPNKANSYSVHGAALGAKEVDATRQNLGWPYEPFHVPDEVKKHWSRHTPDGAALEAEWNAKFAAYESKYPEEAAELKSIVTGVLPAGWEKALPTYTPETPGDATRNLSQTMLNALAPVLPGLIGGSADLASSNMTLMKMFGDFQKATPEERNVRFGVREHGMGAICNGIALHSPGFVPYCATFFVFTDYMRGAMRISALSEAGVIYVMTHDSIGLGEDGPTHQPIEHLASFRAMPNILMFRPADGNETAGAYKVAVESRKRPSVLALSRQKLPNLPGTSIEGTTKGGYTITDNSTGNKPDVILIGTGSELEIAVKAADELRKEGKTVRVVSFVSWELFYEQSDEYKESVLPSGVTARVSIEAGSTFGWDRIVGSAGKAIGIDKWGSSAPAGKIYKEYGITVEAVIAAAKQVC

SEQ ID NO: 22641 - protein, 736 aa, Brassica rapa
MASLAFSQALLSRATSHNGSNKHVSVPASSVLKTTSPRTNFFHSQRSASTSNHTLRPLVRASAIETTDTTTDSTLVDKSVNTIRFLAIDAVEKAKSGHPGLPMGCAPMSHILYDEVMRYNPKNPYWFNRDRFVLSAGHGCMLQYALLHLAGYDSVREEDLKSFRQWGSKTPGHPENFETPGVEVTTGPLGQGIANAVGLALAEKHLAARFNKPDNEIVDHYTYSIIGDGCQMEGITNEVCSLAAHWGLGKLIAFYDDNHISIDGDTEIAFTENVDKRFEALGWHVIWVKNGNNGYDEIRAAIKEAKAVKDKPTLIKVTTTIGYGSPNKANSYSVHGAALGEKEVEATRNNLGWAYEPFQVPEDVKSHWSRHTPEGAALEADWNAKFSAYEKKYPEEAEELKSIISGDLPAGWEKALPTYTPESPGDATRNLSQQCLNALAKSLPGFLGGSADLASSNMTLLKAFGDFQNATPEGRNLRFGVREHGMGAICNGVALHSPGFIPYCATFFVFTDYMRAAMRIAALSEAGVIYVMTHDSIGLGEDGPTHQPVEHLSSFRAMPNIMMFRPADGNETAGAYKIAVARRNTPSVLALSRQKLPQLRGTSIENVERGGYIITDNSNGNKPDVILVGTGSELEIAAKAGEELRKEGKSVRVVSFVCWELFDEQTDAYKESVLPSEGSARVSIEAGSTFGWGKVVGGKGKSIGIDSFGASAPAGKLYKEFGITVEAVVAAAKSLI

SEQ ID NO: 22642 - protein, 664 aa, Trifolium pratense
TTLVEKSVNTIRFLAIDSVEKANSGHPGLPMGCAPMGHVLYDEVMRYNPKNPFWFNRDRFVLSAGHGCMLQYALLHLAGYDSVKEQDLKEFRQWGSRTPGHPENFETPGIEVTTGPLGQGIANAVGLALAEKHLAARFNKPDNEIIDHYTYCILGDGCQMEGIANEAASLAGHWGLGKLIAFYDDNHISIDGDTEIAFTESVEKRFEGLGWHVIWVQNGNTGFDEIRAAIKEAKAVKDRPTLIKFTTTIGYGSPNKSNSYSVHGSALGAKEVDATRNNLGWPYEPFHVPEDVKKHWSRHIPEGAALESEWNAKFAAYEKKYMEEAAVLKSIISGELPSGWEKALPTYTPEIPADATRNLSQTNLNALAKVLPGLLGGSADLASSNMTLLKAFGNFQSGTPEERNVRFGVREHGMGAICNGIALHSPGLIPYCATFFVFTDYMRGAIRLSALSEAGVIYVMTHDSIGLGEDGPTHQPIEHLASFRAMPNILMLRPADGNETAGAYKVAVLNRKRPSILALSRQKLPNLPGTSIEGVGKGGYIVSDNSTGNKPDVILIGTGSELEIAYYAAEDLRKEGKAVRVVSFVSWELFDEQSDAYKESVLPGAVSARVSIEAGSTFGWEKIVGSKGKAIGIDRFGASAPAGRIYKEFGITKEAVIAAAKELI

SEQ ID NO: 22643 - protein, 766 aa, Flaveria ramosissima
NTNNTHSPVLSRPHQHPWRTSASLTLSQPTISQPTISRSAVPRHGSTTATATQQSTSLSIPTFSGLKSVATSSSRATTRRQVIPTRRRVISNAAVETLDKTDTALVEKSINTIRFLAIDAVEKANSGHPGLPMGCAPMGHILYDEVMRYNPKNPYWFNRDRFVLSAGHGCMLQYALLHLAGYDSVKEEDLKQFRQWGSKTPGHPENFETPGVEVTTGPLGQGIANAVGLALAEKHLAARYNKPDAEIVDHYTYCILGDGCQMEGIANEACSLAGHWGLGKLIALYDDNHISIDGDTEIAFTENVDQRFEALGWHIIWVKNGNTGYDEIRAAIKEAKAVTDKPTLIKVTTTIGFGSPNKANSYSVHGAALGAKEVDATRQNLGWPYEPFHVPDEVKKHWSRHTPDGAALEAEWNAKFAEYEKKYPEDAAELKSIATGVLPAGWEKALPTYTPETPGDATRNLSQTMLNALAPVLPGLVGGSADLASSNMTLMKMFGDFQKNTPEERNVRFGVREHGMGAICNGIALHSPGFVPYCATFFVFTDYMRGAMRISALSEAGVIYVMTHDSIGLGEDGPTHQPVEHLASFRAMPNMLMFRPADGNETAGAYKVAVESRKRPSILALSRQKLPNLPGTSIEGTGKGGYTITDNSTGNKPDVILMATGSELEIAVKAADELRKEGKTVRVVSFVSWELFDEQSDEYKESVLPSGVTARVSIEAASTFGWGKHVGSKGKAIGIDKFGASAPAGKIYKEYGITVEAVVAAAKEVC

SEQ ID NO: 22644 - protein, 424 aa, Panicum virgatum
MASPLLLLVFLFLTHASAAEYGEELLRRAWGEREWMVSARRRIHAHPELAFREHRTSALVREELERLGIRNRAVAGTGVVADVGSGAPPFVALRADMDALPLQELVEWEHKSKVDGVMHACGHDVHTAMLLGAAKLLSQRKDQLKGTVRLLFQPAEEGGAGASHMIKEGALDGVGAIFAMHVDYRIPTGVIAAHPGPTQAAVCFFEAKIEGKTGLAETPHLNVDPIVAASFTILSLQQLISREDDPLHSQVVSVTYVKAGNALDATPAIVNFGGTLRSITTEGLYRLQKRVKEVVEGQAAVHRCKGAVEIKSEDYPMYPAVVNDEELHRHVEDVGRRLLGPDKVKPGEKIMAGEDFAFYQQLAPGVMFGIGIRNEEAGSIHPAHNSHFFVDEDVIPIGAALHTAIAELYLSEASTLNGGDLQSH

SEQ ID NO: 22645 - protein, 419 aa, Sorghum bicolor
MAIPLLLLLLVLSSASADEYGDELLQRAWGEREWMVSVRRRIHAHPELAFREHRTAALVREELERLGLSTRAVAGTGVVADVGSGALPFVALRADMDALPLQELVEWEHKSKVDGVMHACGHDVHTAMLLGAAKLLSQRKDQLKGTVRLLFQPAEEGGAGASHMIREGVLDGVKAIFAMHVDYQIPTGVIAAHPGPTQAAVCFFAAKIEGNTGPSETPHLNVDPIVAASLAILSLQQLISREDDPLHSQVVSVTYVKAGKALDATPDVVEFGGTLRSLTTEGLYRLQRRVKEVVEGQAAVHRCKGAVDMKAEDYPMYPAVVNDERLHRHVEDVGRGLLGPGNVRPGEKIMAGEDFAFYQQLVPGVMFGIGIRNEKAGSVYSVHNPYFFVDEDVIPVGAALHAAIAELYFTEGSSLNKDS

SEQ ID NO: 22646 - protein, 426 aa, Oryza sativa
MAAPLFLLLLLLLVSSASAGYEEEALLRRAEEERDWMVGVRRRIHAHPELAFREHHTSALVRDELERLGLTARAVAGTGVVADVGSGLPPVVALRADMDALPVQELVEWEHKSKVDGVMHACGHDVHTAMLLGAAKLLSERKEQIKGTVRLLFQPAEEGGAGASYMIKDGVLDGVEAIFGMHVDYRMPTGVIAAHAGPTQAAVCFYEAKIEGKTGKAETPHLNVDPIVAASFVILSLQQLISREDDPLHSQVLSVTYVKGGNTIDATPPVIEFGGTLRSLTTEGLYRLQKRVKEVVEGQAAVHRCKGVVQIKRDDYPMYPAVFNDEKLHHHVETVGRRLLGPDKVKPGEKIMAGEDFAFYQQLVPGVMFGIGIRNGEVGSVHTVHNPKFFVDEDVIPIGAALHTALAEMYLTERSTEGEDGSQHSH

SEQ ID NO: 22647 - protein, 428 aa, Secale cereale
MATPRLPCLFLLLLLLSTASAEYAQELLRRAEGEREWIIGVRRRIHAHPELAFQEHRTSALVREELERLGVTARAVAGTGVVADVGSGMPPIVALRADMDALPIQELVEWEHKSRVDGVMHACGHDVHTAMLLGAAKLLHERKDQLKGTVRLLFQPAEEGGAGASHMIKEGVLDGVEAIFAMHVDYRMPTGVIAAHAGPTQAAVCFFVVKIEGKTGKAETPHLNVDPIVAAAFTILSLQQLISREGDPLHSHVLSVTYIKGGKSIDATPPVVEFGGTLRSLTTEGLYRLQKRLKEVVEGQAAVHRCTGVAEILGAPSHPMYPAVVNDERLHQHVENVGRSLLGPDKVKPGEKIMAGEDFAFYQQLVPGVMFGIGIGNEKVGSVHSAHNPHFFVDEDVLPIGAALHTATAEMYLSVRSSQNEDGSVHSR

SEQ ID NO: 22648 - protein, 425 aa, Leymus cinereus x Leymus triticoides
STPRPCLFVLLLLSTASAEYAQELLRRAEGEREWIIGVRRRIHAHPELAFHEHRTSALVREELERLGVTARAVAGTGVVADVGSGMPPIVALRADMDALPIQELVEWEHKSRVDGVMHACGHDVHTAMLLGAAKLLHERKDQLKGTVRLLFQPAEEGGAGASHMIKEGVLDGVEAIFAMHIDYRMPTGVIAAHAGPTQAAVCLYVVKIEGKTGKAETPHLNVDPIVAAAFTILSLQQLTSREDDPLHSQVLSVTYIEGGKSMDATPPVVEFGGTLRSLTTEGLYRLQKRLKEVVEGQAAVHRCMGVTEILGAPSHPMYPAVVNDERLHQHVENVGRGLLGPDKVKPGEKIMAGEDFAFYQQLVPGVMFGIGIRNEKVGSVHSAHNPHFFVDEDVLPIGAALHTATAEMYLSGRSTQNEEGSVHSR

SEQ ID NO: 22649 - protein, 417 aa, Triticum aestivum
MATPRLPCLFVLLLLSTVSAEYAQELLRRAEGEREWIIGVRRRIHAHPELAFQEHRTSALVREELERLGVTARAVAGTGVVADVGLGMPPIVALRADMDALPIQELVEWEHKSRVDGVMHACGHDVHTAMLLGAAKLLHERKDQLKGTVRLLFQPAEEGGAGASHMIKEGVLDGVEAIFAMHIDYRMPTGVIAAHAGPTQAAVCFYVVKIEGKTGKAETPHLNVDPIVAAAFTVLSLQQLTSREDDPLHSQVLSVTYIKGGNSVDATPPVVEFGGTLRSLTTEGLYRLQKRLKEVVEGQAAVHRCTGVTEILGAPSHPMYPAVVNDERLHEHVENVGRSLLGPDKVKPGEKIMAGEDFAFYQQLVPGVMFGIGIRNEKVGSVHSAHNPHFFVDEDVLPIGAALHTATAEMYLSGRSA

SEQ ID NO: 22650 - protein, 631 aa, Panicum virgatum
MGPMEPRYRPAGAPEDTTKRRTSKSKSFKDVENFEVLVIEKNCGCKFKSLKIMIIAIISATVLTLITPTLYEHQLQSASRFVDVGWMWDKTSSDPRYASSVDVQWDDVHRALRNLKSGNQDLKVGLLNFNSTEYGSWTQLLPDSHVSIIRLEYAKDSITWQTLYPEWIDEEEETEIPSCPSLPEPNVRKGVRFDVIAVKLPCTRVAGWSRDVARLHLQLSAAKLAVASSKLNHKVHVLFVSDCFPIPNLFPCKNLVRHEGNAWLYSPDSKALREKLRLPVGSCELAVPLKAKSRLFSVDRRREAYATILHSASEYVCGAISAAQSIRQSGSTRDLVILVDETISDHHRRGLESAGWKVRIIQRIRNPKAVRDAYNEWNYSKFRLWQLTDYDKIIFIDADLLILRNVDFLFAMPEITATGNNATLFNSGVMIIEPSNCTFQLLMDHINEITSYNGGDQGYLNEIFTWWHRIPKHMNFLKHFWEGDSEEMKAKKTQLFGADPPVLYVLHYLGLKPWLCFRDYDCNWNNPPMREFASDVAHARWWKVHDRMPRKLQSYCLLRSRQKAGLEWDRRQAEKANSEDGHWRRNITDPRLKTCFEKFCFWESMLWHWGENNNRTKGSPATVTTASLASS

SEQ ID NO: 22651 - protein, 631 aa, Echinochloa colona
MGPMEPRYRPTGVPSEDTTKRRASKSKSFKDVENFEVLVLEKNCGCKFKSLKILIIAIISATVLTLITPTLYEHQLQTASRYVDVGWMWDKTSSDPRYVSSVDVQWEDVYRALRNLKSGNQNLKVGLLNFNSTEYGSWTQLLPDSHVSIIRLEHAKDSITWQTLYPEWIDEEEETEIPSCPSLPEPNVRRGIRFDVIAVKLLVPCSGWSRDVARLHLQLSAAKLAVAASKRNHNVHVLFVSECFPIPNLFPCKNLVRHEGNAWLYSPDSKALREKLRLPVGSCELAVPLKAKSRLFSVDRRREAYATILHSASEYVCGAITAAQSIRQAGSTRDLVILVDETISDHHRRGLEAAGWKVRIIQRIRNPKATRDAYNEWNYSKFRLWQLTDYDKIIFIDADLLILRNVDFLFTMPEISATGNNATLFNSGVMVIEPSNCTFQLLMDHINEITSYNGGDQGYLNEIFTWWHRIPKHMNFLKHFWEGDSEEMKAKKTQLFGADPPILYILHYLGLKPWLCFKDYDCNWNNAGMREFASDVAHARWWKVHDKMPRKLQSYCHLRTRQKAGLEWDRRQAEKAKSEDGHWRRNITDPRLKTCSEKFCFWESMLLHWGENNNRTKSSPATVKTASLASS

SEQ ID NO: 22652 - protein, 631 aa, Sorghum bicolor
MGPLEPRYRPAGAPEDTTKRRASKSKSFKDVENFEVIVLEKSCGCKFKSLRILLIAIISGTVLTLVTPTLYEHQLQSASRYVDVGWMWDKTSSDPRYVSSVDVRWEDVYKALGNLRSGNQNLKVGLLNFNSTEYGSWTQLLSDSHVSIIRLEHAKDSITWQTLYPEWIDEEEETEIPSCPSLPEPDVRRDVRFDVIAVKLPCTHVAGWSRDVARLHLQLSAAKLAVTSSKRNHKVHVLFVTECFPIPNLFPCKNLVRHEGNAWLYSPDSKALREKLRLPVGSCELAVPLKAKSRLFSVDRRREAYATILHSASEYVCGAITAAQSIRQAGSTRDLVILVDETISDHHRRGLEAAGWKVRIIQRIRNPKAERDAYNEWNYSKFRLWQLTDYDKIIFIDADLLILRNVDFLFAMPEITATGNNATLFNSGVMVIEPSNCTFQLLMDHINEITSYNGGDQGYLNEIFTWWHRIPKHMNFLKHFWEGDSQAMKAKKTQLFGADPPILYVLHYLGLKPWLCFKDYDCNWNNAGMREFASDVAHARWWKVHDKMPRKLQSYCLLRSRQKASLEWDRRQAEKANSEDGHWRRNITDTRLKTCFEKFCFWESMLWHWGENNNRTKSIPMAVKTASLARS

SEQ ID NO: 22653 - protein, 632 aa, Zea mays
MGPLEPRYRPGGAPEDTTKRRASKSKSFKDAENFEVLVLEKSCGCKFKSLRILLIAIISATVLTLVTPTLYERQLQSASRYVDVGWMWDRASSDPRYASSADVGWEDVYKALGNLRSGNRQSHLRVGLLNFNSTEYGSWTQLLPADSHVISTVRLEHAKDSVTWQTLYPEWIDEEEETEIPSCPSLPEPNVPRGARFDVVAVKLPCTRVAGWSRDVARLHLQLSAAKLAVASSKRNHDVHVLFVTDCFPIPNLFPCKNLVTREGSAWLYSPDSKALREKLRLPVGSCELAVPLKAKSRLFSVDRRREAYATILHSASEYVCGAISAAQSIRQAGSTRDLVILVDETISDHHRRGLEAAGWKVRVIQRIRNPKAERDAYNEWNYSKFRLWQLTDYDKVIFIDADLLILRNVDFLFAMPEIAATGNNATLFNSGVMVVEPSNCTFRLLMDHIDEITSYNGGDQGYLNEIFTWWHRVPRHMNFLKHFWEGDSEAMKAKKTQLFGADPPVLYVLHYLGLKPWLCFRDYDCNWNNAGMREFASDVAHARWWKVHDRMPRKLQSYCLLRSRQKARLEWDRRQAEKANSQDGHWRLNVTDTRLKTCFEKFCFWESMLWHWGENSNRTKSVPMAATTARS

SEQ ID NO: 22654 - protein, 628 aa, Hordeum vulgare
MEQRYRPGGAADDTTKRRTTKTKSFKDVESYEVLVLEKNCGCKFKSLRYLLIAIVSATFLTLLTPTLYERQLQSSSRYVDVDWIWDKTSADPRYVSSADVQWADVYTAIEDLSAGNQKLKIGLLNFNSTEYGSWSQILPESHVSIIRLEHAKDSITWPTLYPEWIDEEEESEIPSCPSFPEPNVRRGAWFDVIAVKLPCTRVAGWSRDVARLHLQLSAAKLAVSSSRGNRMVHVLFVTDCFPIPNLFPCKNLVKHEGNAWLYRPDLKAVREKLRLPVGSCELAIPLKAKARLFSVDRRREAYATILHSASEYVCGAITAAQSIRQAGSTRDLVILVDNTISDHHRRGLEAAGWKVRIIERIRNPKAERDAYNEWNYSKFRLWQLTDYDKIIFIDADLLILRNVDFLFAMPEITATGNNATLFNSGVMVIEPSNCTFQLLMEHINEITSYNGGDQGYLNEIFTWWHRIPKHMNFLKHFWEGDSEAAKAKKTQLFGADPPNLYVLHYLGLKPWLCFRDYDCNWNNFIMREFASDVAHNRWWKVHDKMPRKLQSYCLLRTRQKAGLEWDRRQAEKANLEDGHWRRNITDPRLKTCFEKFCFWESMLWHWGEAKNQTKSIPAPTTTSLSSTS

SEQ ID NO: 22655 - protein, 630 aa, Secale cereale
MEQRHRPAAAADDTTKRRATKSKSFKDVENYEVLVLEKNCGCKFKSLRYLLIAIVSATFLTLLTPTLYERQLQSSSRYVDVDWIWDKTSVDPRYVSSADVQWADVYTAIEDLSAGNRELKIGLLNFNSTEYGSWSRILPESHVSIIRLEHAKDSITWPKLYPEWIDEEEDSEIPSCPSFPEPNVRRGAWFDVIAVKLPCTRVAGWSRDVARLHLQLSAAKLAVASSRGNRKVHVLFVTDCFPIPNLFPCKNLVKHEGNAWLYRPDLKAVREKLRLPVGSCELAIPLKAKARLFSVDRRREAYATILHSASEYVCGAITAAQSIRQAGSTRDLVILVDNTISDHHRRGLEAAGWKVRIIERIRNPKAERDAYNEWNYSKFRLWQLTDYDKIIFIDADLLILRNVDFLFAMPEITATGNNATLFNSGVMVIEPSNCTFQLLMEHINEITSYNGGDQGYLNEIFTWWHRIPKHMNFLKHFWEGDSEAAKAKKTQLFGADPPSLYVLHYLGLKPWLCFRDYDCNWNNFMMREFASDVAHRRWWKTHDKMPRKLQSYCLLRTRQKAGLEWDRRQAEKANLEDGHWRRNITDPRLKTCFEKFCFWESMLWHWGEAKNQTKSIPAPATPATMSLSSS

SEQ ID NO: 22656 - protein, 630 aa, Secale cereale
MEQRHRPAAAADDTTKRRATKSKSFKDVENYEVLVLEKNCGCKFKSLRYLLIAIVSATFLTLLTPTLYERQLQSSSRYVDVDWIWDKTSANPRYVSSADVQWADVYTAIEDLSAGNQELKIGLLNFNSTEYGSWSRILPESHVSIIRLEHAKDSITWPKLYPEWIDEEEDSEIPSCPSFPEPNVRRGAWFDVIAVKLPCTRVAGWSRDVARLHLQLSAAKLAVTSSRGNRKVHVLFVTDCFPIPNLFPCKNLVKHEGNAWLYRPDLKAVREKLRLPVGSCELAIPLKAKARLFSVDRRREAYATILHSASEYVCGAITAAQSIRQAGSTRDLVILVDNTISDHHRRGLEAAGWKVRIIERIRNPKAERDAYNEWNYSKFRLWQLTDYDKIIFIDADLLILRNVDFLFAMPEITATGNNATLFNSGVMVIEPSNCTFQLLMEHINEITSYNGGDQGYLNEIFTWWHRIPKHMNFLKHFWEGDSEAAKAKKTQLFGADPPSLYVLHYLGLKPWLCFRDYDCNWNNFMMREFASDVAHRRWWKTHDKMPRKLQSYCLLRTRQKAGLEWDRRQAEKANLEDGHWRRNITDPRLKTCFEKFCFWESMLWHWGEAKNQTKSIPAPATPATMSLSSS

SEQ ID NO: 22657 - protein, 628 aa, Avena sativa
MEQRYRPAGAPDDTTKRRATKSKSFKDVENYEVLVLEKNCGCKFKSLRYLLIAIVSATFVTLLTPTLYERQLQSNSVYVDVDWIWDKTSADPRYASSVDVQWDDVYSAVEDLNDGNQKLKVGLLNFNSTELGSWSRILPESHVSIIRLEHAKESVTWPALYPEWIDEEEDSEIPSCPSFPEPNVRKGVFFDVIAVKLPCTRVAGWSRDVARLHLQLSAAKLAVTSSRANRKVHVLFVTDCFPIPNLFPCKNLVKHEGNTWLYRPDLKAIREKLRLPVGSCELAVPLKAKARLYSVDRRREAYATILHSASEYVCGAITAAQSIRQAGSTRDLVILVDDTISDHHRRGLEAAGWKVRIIERIRNPKAERDAYNEWNYSKFRLWQLTDYDKIIFIDADLLILRNVDFLFAMPEITATGNNATLFNSGVMVIEPSNCTFQLLMEHINEITSYNGGDQGYLNEIFTWWHRIPKHMNFLKHFWEGDNEAAKAKKTQLFGADPPSLYVLHYLGVKPWLCFRDYDCNWNNLMMRGFASDVAHNRWWKVHDKMSPKLQSYCLLRTRQKAGLEWDRRQAEKANMEDGHWRRNITDPRLKTCFEKFCFWESMLWHWGETNRTKSAPVLATPTVSLSSS

SEQ ID NO: 22658 - protein, 619 aa, Triticum aestivum
DDTTKRRTTKSKSFKDVENYEVLVLEKNCGCKFKSLRYLLIAIVSATFLTLLTPTLYERQLQSSSRYVDVDWIWDKTSADPRYVSSADVQWADVYTAIEDLSAGNQELKIGLLNFNSTEYGSWSRILPESHVSIIRLEHAKDSITWPKLYPEWIDEEEESEIPSCPSFPEPNVRRGAWFDVIAVKLPCTRVAGWSRDVARLHLQLSAAKLAVTSSRGNRKVHVLFVTDCFPIPNLFPCKNLVKHEGNAWLYRPDLKAVREKLRLPVGSCELAIPLKAKARLFSVDRRREAYATILHSASEYVCGAITAAQSIRQAGSTRDLVILVDNTISDHHRRGLEAAGWKVRIIERIRNPKAERDAYNEWNYSKFRLWQLTDYDKIIFIDADLLILRNVDFLFAMPEITATGNNATLFNSGVMVIEPSNCTFQLLMEHINEITSYNGGDQGYLNEIFTWWHRIPKHMNFLKHFWEGDSEEAKAKKTQLFGADPPNLYVLHYLGLKPWLCFRDYDCNWNNFMMREFASDVAHSRWWKTHDKMPRKLQSYCLLRTRQKAGLEWDRRQAEKANLEDGHWRRNITDPRLKTCFEKFCFWESMLWHWGEAKNQTKSNPAPATPATMSLSSS

SEQ ID NO: 22659 - protein, 628 aa, Brachypodium distachyon
MEQRYRPSGVADDTTKRRTTKSKSFKDVENFEVLVLEKNCGCKFKSLRYLLIAIVSATFVTLLTPTLYEHQLQSSSLYVDVDWIWDKTSTDPRYVSSVNVQWMDVYKAIEDLNGGDQKLKVGLLNFNSTEYGSWSQLLPESHVSIIRLEHAKDSITWPVLYPEWIDEEEETEIPSCPSLPEPNVRKGVWFDVIAVKLPCTRVGGWSRDVARLHLQLSAAKLAVISSRGNRNVHVLFVTDCFPIPNLFPCKNLVKHEGNAWLYRPDLKALKEKLKLPVGSCELAVPLKAKARLYSVDRRREAYATILHSASEYVCGAITAAQSIRQAGSTRDLVILVDDSISDHHRKGLEAAGWKVRIIQRIRNPKAERDAYNEWNYSKFRLWQLTDYDKIIFIDADLLILRNVDFLFAMPEITATGNNATLFNSGVMVIEPSNCTFQLLMEHINEITSYNGGDQGYLNEIFTWWHRIPRHMNFLKHFWEGDSEAAKAKKTQLFGADPPNLYVLHFLGLKPWLCFRDYDCNWNSLVMRDFASDVAHNRWWKVHDKMPRKLQSYCLLRSRQKAGLEWDRRRAEKANFEDGHWQRKITDPRLKICIDKFCFWESMLWHWGETNQTKSLPVPVTPAVSLSSS

SEQ ID NO: 22660 - protein, 627 aa, Oryza sativa
MGSLETRYRPAGAPSDDTTKRRTPKSRIYKDVENFGVLVLEKNSGCKFKTLRYLLLAITSATFLTLLTPTFYEHQLQSSRYVDVGWIWDKPSYDPRYVSSVDVQWEDVYKALENLNDGSQKLKVGLLNFNSTEYGSWAQLLPGSAVSIVRLEHAKDSITWDTLYPEWIDEEEETDIPACPSLPDPNVRKGSHFDVIAVKLPCTRVGGWSRDVARLHLQLSAAKLAVASSKGNQKVHVLFVTDCFPIPNLFPCKNLVKHEGNAWLYSPDLKALREKLRLPVGSCELAVPLKAKARLYSVDRRREAYATILHSASEYVCGAISAAQSIRQAGSTRDLVILVDDTISDHHRKGLEAAGWKVRVIQRIRNPKAERDAYNEWNYSKFRLWQLTDYDKIIFIDADLLILRNVDFLFAMPEITATGNNATLFNSGVMVIEPSNCTFQLLMDHINEITSYNGGDQGYLNEIFTWWHRIPKHMNFLKHFWEGDDDSAKAKKTELFGADPPILYVLHYLGMKPWLCFRDYDCNWNIPLMREFASDVAHARWWKVHDNMPEKLQSYCLLRSKLKAGLEWERRQAEKANLEDGHWRRNITDPRLTICYEKFCYWESMLLHWGEKNPTNNNPVPATISSS

SEQ ID NO: 22661 - protein, 627 aa, Oryza sativa
MGSLETRYRPAGAPSDDTTKRRTPKSRIYKDVENFGVLVLEKNSGCKFKTLRYLLLAITSATFLTLLTPTFYEHQLQSSRYVDVGWIWDKPSYDPRYVSSVDVQWEDVYKALENLNDGSQKLKVGLLNFNSTEYGSWAQLLPGSAVSIVRLEHAKDSISWDTLYPEWIDEEEETDIPACPSLPDPNVRKGSHFDVIAVKLPCTRVGGWSRDVARLHLQLSAAKLAVASSKGNQKVHVLFVTDCFPIPNLFPCKNLVKHEGNAWLYSPDLKALREKLRLPVGSCELAVPLKAKARLYSVDRRREAYATILHSASEYVCGAISAAQSIRQAGSTRDLVILVDDTISDHHRKGLEAAGWKVRVIQRIRNPKAERDAYNEWNYSKFRLWQLTDYDKIIFIDADLLILRNVDFLFAMPEITATGNNATLFNSGVMVIEPSNCTFQLLMDHINEITSYNGGDQGYLNEIFTWWHRIPKHMNFLKHFWEGDDDSAKAKKTELFGADPPILYVLHYLGMKPWLCFRDYDCNWNIPLMREFASDVAHARWWKVHDNMPEKLQSYCLLRSKLKAGLEWERRQAEKANLEDGHWRRNITDPRLTICYEKFCYWESMLLHWGEKNPTNNNPVPATISSS

SEQ ID NO: 22662 - protein, 635 aa, Oryza sativa
MGSLETTNTRYRPAGAADDTAKRRTQKSKSFKEVEKFDVFVLEKSSGCKFRSLQLLLFAIMSAAFLTLLYTPSVYDHQMQSSSRFVSGWIWDKTIPDPRYVSSLGVQWEDVYKTVENLNDGERKLKVGLLNFNSTEIGSWTQLLPDSDFSIIRLEHAKESITWQTLYPEWIDEEEETEIPSCPSLPDPIFPRGTHFDVVAVKLPCTRAGGWSRDVARLHLQLSAAKVAVTASRGNRGIHVLFVTDCFPIPNLFSCKNLVKHEGNAWMYKPDLKALREKLRLPVGSCELAVPLKAKARLYSVDRRREAYATILHSASEYVCGAITAAQSIRQAGSTRDFVILVDETISNHHRKGLEAAGWKVRIIQRIRNPKAERDAYNEWNYSKFRLWQLTDYDKIIFIDADLLILRNVDFLFAMPEITATGNNATLFNSGVMVIEPSNCTFQLLMDHINEITSYNGGDQGYLNEIFTWWHRIPKHMNFLKHFWEGDEEEVKVKKTRLFGADPPILYVLHYLGLKPWLCFRDYDCNWNNPILREFASDVAHARWWKVHDKMPKKLQHYCLLRSRQKAGLEWDRRQAEKANFTDGHWRRNITDPRLKTCFEKFCFWESMLWHWGESKNSTKENPVPATPTASLTSS

SEQ ID NO: 22663 - protein, 635 aa, Oryza sativa
MGSLETTNTRYRPAGAADDTAKRRTQKSKSFKEVEKFDVFVLEKSSGCKFRSLQLLLFAIMSAAFLTLLYTPSVYDHQMQSSSRFVSGWIWDKTIPDPRYVSLLGVQWEDVYKTVENLNDGERKLKVGLLNFNSTEIGSWTQLLPDSDFSIIRLEHAKESTTWQTLYPEWIDEEEETEIPSCPSLPDPIFPRGTHFDVVAVKLPCTRAGGWSRDVARLHLQLSAAKVAVTASRGNRGIHVLFVTDCFPIPNLFSCKNLVKHEGNAWMYKPDLKALREKLRLPVGSCELAVPLKAKARLYSVDRRREAYATILHSASEYVCGAITAAQSIRQAGSTRDFVILVDETISNHHRKGLEAAGWKVRIIQRIRNPKAERDAYNEWNYSKFRLWQLTDYDKIIFIDADLLILRNVDFLFAMPEITATGNNATLFNSGVMVIEPSNCTFQLLMDHINEITSYNGGDQGYLNEIFTWWHRIPKHMNFLKHFWEGDEEEVKVKKTRLFGADPPILYVLHYLGLKPWLCFRDYDCNWNNPILREFASDVAHARWWKVHDKMPKKLQHYCLLRSRQKAGLEWDRRQAEKANFTDGHWRRNITDPRLKTCFEKFCFWESMLWHWGESKNSTKENPVPATPTASLTSS

SEQ ID NO: 22664 - protein, 546 aa, Panicum virgatum
MWDKTSSDPRYASSVDVQWDDVYRALRNLKSGNPDLKVGLLNFNSTEYGSWTQLLPDSHVSIIILENAQDSITWQTLYPEWIDEEEETEIPSCPSLPEPNVRKGVRFDVIAVKLPCTRVAGWSRDVARLHLQLSAAKLAVASSKRNHKVHVLFVSDCFPIPNLFPCKNLVRHEGNAWLYSPDSKALREKLRLPVGSCELAVPLKAKSRLFSVDRRREAYATILHSASEYVCGAISAAQSIRQAGSTRDLVILVDETISDHHRRGLESAGWKVRIIQRIRNPKAARDAYNEWNYSKFRLWQLTDYDKIIFIDADLLILRNVDFLFAMPEITATSNNATLFNSGVMIIEPSNCTFQLLMDHINEITSYNGGDQGYLNEIFTWWHRIPKHMNFLKHFWEGDSEEMKAKKTQLFGADPPVLYVLHYLGLKPWLCFRDYDCNWNNPSMREFASDVAHARWWKVHDKMPRELQSHCLLRSRQKAGLEWDRRQAEKANSEDGHWRRNITDSRLKTCFEKFCFWESMLWHWGENSNRTKSSPATVTTTASLASS

SEQ ID NO: 22665 - protein, 632 aa, Brachypodium distachyon
MGSLEARYRPAGAADDTAKRRTQKSKSFKEVEKFDVFVLEKSSGCKFRSLQLLLFAIMSAAFLTLLYTPSVYEHQLQSNSRFVNVGWIWDKTTPDPRYVSSLGVQWEDVYRSIENLNGGEHKLKVGLLNFNSTEFGSWTQLLPESEFSIIRLEHAKESITWQTLYPEWIDEEEETEIPSCPSLPDPNFPRGAHFDVIAVKLPCTRVGGWSRDVARLHLQLSAAKLAVTAARGNRGVHVMFVTDCFPLPNLFSCKNLKKHQGNAWLYKPDLKALKEKLRLPVGSCELAVPLKAKSRLYSVDRRREAYATILHSASEYVCGAITAAQSIRQAGSTRDFVILVDDTISEHHRKGLEAAGWKVRIIERIRNPKAERDAYNEWNYSKFRLWQLTDYDKIIFIDADLLILRNIDFLFAMPEITATGNNATLFNSGVMVIEPSNCTFQLLMEHINEITSYNGGDQGYLNEIFTWWHRIPKHMNFLKHFWEGDEEEVKVKKTRLFGSDPPILYVLHYLGRKPWLCFRDYDCNWNVPILREFASDIAHTRWWKVHDKMPKKLQSYCLLRSRLKAGLEWERRQAEKANFTDGHWRRNITDRRLKTCFEKFCFWESMLWHWGETTNSTKKTLPAVQALPAESL

SEQ ID NO: 22666 - protein, 583 aa, Secale cereale
MEQRHRPAAAADDTTKRRATKSKSFKDVENYEVLVLEKNCGCKFKSLRYLLIAIVSATFLTLLTPTLYERQLQSSSRYVDVDWIWDKTSADPRYVSSADVQWADVYTAIEDLSAGNQELKIGLLNFNSTEYGSWSRILPESHVSIIRLEHAKDSITWPKLYPEWIDEEEDSEIPSCPSFPEPNVRRGAWFDVIAVKLPCTRVAGWSRDVARLHLQLSAAKLAVASSRGNRKVHVLFVTDCFPIPNLFPCKNLVKHEGNAWLYRPDLKAVREKLRLPVGSCELAIPLKAKARLFSVDRRREAYATILHSASEYVCGAITAAQSIRQAGSTRDLVILVDNTISDHHRRGLEAAGWKVRIIERIRNPKAERDAYNEWNYSKFRLWQLTDYDKIIFIDADLLILRNVDFLFAMPEITATGNNATLFNSGVMVIEPSNCTFQLLMEHINEITSYNGGDQGYLNEIFTWWHRIPKHMNFLKHFWEGDSEAAKAKKTQLFGADPPSLYVLHYLGLKPWLCFRDYDCNWNNFMMREFASDVAHRRWWKTHDKMPRKLQSYCLLRTRQKAGLEWDRRQAEKANLEDGHWRRN

SEQ ID NO: 22667 - protein, 633 aa, Hordeum vulgare
MGSLEARYRPAGAADDTAKRRTQKSKSFKEVEKFDVFVLEKSSGCKFRSLQLLLFAIMSAAFLTLLYTPSVYEHQLQSNSRFVNVGWIWDKTIPDPRYVSSMAVQWDDVYKTIESLNGGEQKLKVGLLNFNSTEFGSWTQLLPESEFSIIRLEHANESITWQTLYPEWIDEEEETEIPSCPSLSEPNFPRGTHFDVIAVKLPCTRVGGWSRDVARLHLQLSAAKLAVSAARGNRGVHVMFVTECFPLPNLFSCKNLKKHEGNAWLYKPDPKALKEKLRLPIGSCELAVPLKAKSRLFSVDRRREAYATILHSASEYVCGAIAAAQSIRQAGSTRDFVILVDDTISDHHRKGLESAGWKVRIIERIRNPKAERDAYNEWNYSKFRLWQLTDYDKIIFIDADLLILRNIDFLFTMPEISATGNNATLFNSGVMVIEPSNCTFQLLMEHINEITSYNGGDQGYLNEIFTWWHRIPKHMNFLKHFWEGDEEEVKAKKTQLFGANPPILYVLHYLGRKPWLCFRDYDCNWNVPILREFASDIAHTRWWKVHDKMPKKLQSYCLLRSRLKAGLEWERRQAEKANFTDGHWKRNITDKRLKICFEKFCFWESMLWHWGEAPNSTKKASTPALPTATLSSS

SEQ ID NO: 22668 - protein, 634 aa, Triticum aestivum
MGSLEARYRPAGAADDTAKRRTQKSKSFKEVEKFDVFVLEKSSGCKFRSLQLLLFAIMSAAFLTLLYTPSVYEHQLQSNSRFVNVGWIWDKTIPDPRYVSTMPVQWDDVYKTIESLNGGEQKLKVGLLNFNSTEFGSWTQLLPESEFSIIRLEHANESITWQTLYPEWIDEEEETEIPSCPSLPEPNFPRGTHFDVIAVKLPCTRVGGWSRDVARLHLQLSAAKLAVTAARGNRGVHVMFVTECFPLPNLFSCKNLKKHEGNAWLYKPDSKALKEKLRLPIGSCELAVPLKAKSRLFSVDRRREAYATILHSASEYVCGAIAAAQSIRQAGSTRDFVILVDDTISDHHRKGLESAGWKVRIIERIRNPKAERDAYNEWNYSKFRLWQLTDYDKIIFIDADLLILRNIDFLFTMPEISATGNNATLFNSGVMVIEPSNCTFQLLMNHINEITSYNGGDQGYLNEIFTWWHRIPKHMNFLKHFWEGDEEEVKAKKTQLFGANPPILYVLHYLGRKPWLCFRDYDCNWNVPILREFASDIAHTRWWKVHDKMPKKLQSYCLLRSRLKAGLEWERRQAEKANFTDGHWKRNITDKRLKICFEKFCFWESMLWHWGEAPNNATKKASTPALPAATLSSS

SEQ ID NO: 22669 - protein, 637 aa, Avena sativa
MGSLEARYRPAPAGAAAADDTAKRRTQKSKSFKEVEKFDVFVLEKSSGCKFRSLQLLLFAIMSAAFLTLLYTPSVYEHQLQSNSGFVNVGWIWDKTIPDPRYVSSMGVQWEDVYKTIENLNGGEQKLKVGLLNFNSTEFGSWTQLLPESEFSIIRLEHAKESITWQTLYPEWIDEEEETDIPSCPSLPEPNFPRGTHFDVIAVKLPCTRVGGWSRDVARLHLQLSAAKLAVTAARGNRGVHVMFVTDCFPLPNLFSCKNLKKHEGNAWLYKPDLKALREKLRLPIGSCELAVPLKAKSRLYSVDRRREAYATILHSASEYVCGAIAAAQSIRQAGSTRDFVILVDDTISDHHRKGLEAAGWKVRIIERIRNPKAERDAYNEWNYSKFRLWQLTDYDKIIFIDADLLILRNIDFLFAMPEISATGNNATLFNSGVMVIEPSNCTFQLLMNHINEITSYNGGDQGYLNEIFTWWHRIPKHMNFLKHFWEGDEDSVKAKKTQLFGADPPILYVLHYLGRKPWLCFRDYDCNWNVPILREFASDIAHTRWWKVHDKMPKKLQSYCLLRSRLKAGLEWERRQAEKANFVDGHWKRNITDKRLKICFEKFCFWESMLWHWGEAPNSTKKTATQALPTAKLSSS

SEQ ID NO: 22670 - protein, 635 aa, Secale cereale
MGSLEARYRPAGAADDTAKRRTQKSKSFKEVEKFDVFVLEKSSGCKFRSLQLLLFAIMSAAFLTLLYTPSVYEHQLQSNSRFVNVGWIWDKTIPDPRYVSSMPVQWDDVYKTIESLNGGEQKLKVGLLNFNSTEFGSWTQLLPESEFSIIRLEHANESITWQTLYPEWIDEEEETEIPTCPSLPEPNFPRGTHFDVIAVKLPCTRVGGWSRDVARLHLQLSAAKLAVTAPRGSRGVHVMFVTECFPLPNLFSCKNLKKHEGNAWLYKPDSKALKEKLRLPIGSCELAVPLKAKSRLYSVDRRREAYATILHSASEYVCGAIAAAQSIRQAGSTRDFVILVDDTISDHHRKGLESAGWKVRIIERIRNPKAERDAYNEWNYSKFRLWQLTDYDKIIFIDADLLILRNIDFLFTMPEISATGNNATLFNSGVMVIEPSNCTFQLLMEHINEITSYNGGDQGYLNEIFTWWHRIPKHMNFLKHFWEGDEEEVKAKKTQLFGANPPILYVLHYLGRKPWLCFRDYDCNWNVPILREFASDIAHTRWWKVHDKMPKKLQSYCLLRSRLKAGLEWERRQAEKANFTDGHWKRNITDKRLKICFEKFCFWESMLWHWGEAPNNATKKASTPALPAAATLSSS

SEQ ID NO: 22671 - protein, 634 aa, Secale cereale
MGSLEARYRPAGAADDTAKRRTQKSKSFKEVEKFDVFVLEKSSGCKFRSLQLLLFAIMSAAFLTLLYTPSVYEHQLQSNSRFVNVGWIWDKSIPDPRYVSSMPVQWDDVYKTIESLNGGEQKLKVGLLNFNSTEFGSWTQLLPESEFSIIRLEHANESITWQTLYPEWIDEEEETEIPTCPSLPEPNFPRGTHFDVIAVKLPCTRVGGWSRDVARLHLQLSAAKLAVTAPRGSRGVHVMFVTECFPLPNLFSCKNLKKHEGNAWLYKPDSKALKEKLRLPIGSCELAVPLKAKSRLYSVDRRREAYATILHSASEYVCGAIAAAQSIRQAGSTRDFVILVDDTISDHHRKGLESAGWKVRIIERIRNPKAERDAYNEWNYSKFRLWQLTDYDKIIFIDADLLILRNIDFLFTMPEISATGNNATLFNSGVMVIEPSNCTFQLLMEHINEITSYNGGDQGYLNEIFTWWHRIPKHMNFLKHFWEGDEEEVKAKKTQLFGANPPILYVLHYLGRKPWLCFRDYDCNWNVPILREFASDIAHTRWWKVHDKMPKKLQSYCLLRSRLKAGLEWERRQAEKANFTDGHWKRNITDKRLKICFEKFCFWESMLWHWGEAPNNATKKASTPALPAVTLSSS

SEQ ID NO: 22672 - protein, 630 aa, Setaria italica
MGSLEARYRPAGAAEDTAKRRTQKSKSFKEVEKFDVFVLEKSSGCKFRSLQLLLFAIMSAAFLTLLYTPSVYEHQLQSSSRLVNGWIWDKRSSDPRYVSSASIQWEDVYKSIQNLNGGEQKLKVGLLNFNRTEFGAWTNMLPDSDFSVIRLEHANESITWQTLYPEWIDEEEETEIPSCPSLPDPNFPRATHFDVVAVKLPCTRVAGWSRDVARLHLQLSAAKIAATTARGNGGVHVLFVTDCFPIPNLFSCKNLVKREGNAWLYKPDVKALKEKLRLPVGSCELAVPLNAKARLYTVDRRREAYATILHSASEYVCGAITAAQSIRQAGSTRDLVILVDDTISDHHRKGLESAGWKVRIIQRIRNPKAERDAYNEWNYSKFRLWQLTDYDKVIFIDADLLILRNIDFLFAMPEITATGNNATLFNSGVMVIEPSNCTFSLLMEHINEITSYNGGDQGYLNEIFTWWHRIPKHMNFLKHFWEGDEEEVKAKKTRLFGANPPILYVLHYLGRKPWLCFRDYDCNWNVEILREFASDVAHARWWKVHNKMPKKLQSYCLLRSRLKAGLEWERRQAEKANFTDGHWKRNITDPRLKTCFEKFCFWESMLWHWGENKTNSTKNNAVPVPPTASL

SEQ ID NO: 22673 - protein, 633 aa, Pennisetum glaucum
MGSLEARYRPAGAAEDTAKRRTQKSKSFKEVEKFDVFVLEKSSGCKFRSLQLLLFAIMSAAFLTLLYTPSVYEHQLQSSSRLVNGWIWDKRSSDPRYVSSASIQWENVYKSIQNLNGGEQKLKVGLLNFNRTEFGTWTNMLPDSDFSVIRLEHANESITWQTLYPEWIDEEEETEIPSCPSLPDPNFPRATHFDVVAVKLPCTRVAGWSRDVARLHLQLSAAKIAATTARGNGGVHVLFVTDCFPIPNLFSCKNLVKREGNAWLYKPDVKALKEKLRLPVGSCELAVPLNAKARLYTVDRRREAYATILHSASEYVCGAITAAQSIRQAGSTRDLVILVDDTISDHHRKGLESAGWKVRIIERIRNPKAERDAYNEWNYSKFRLWQLTDYDKVIFIDADLLILRNIDFLFAMPEITATGNNATLFNSGVMVIEPSNCTFSLLMEHINEITSYNGGDQGYLNEIFTWWHRIPKHMNFLKHFWEGDEEEVKAKKTRLFGANPPILYVLHYLGRKPWLCFRDYDCNWNVEILREFASDVAHARWWKVHNKMPKKLQSYCLLRSRLKAGLEWERRQAEKANFTDGHWKRNITDPRLKTCFEKFCFWESMLWHWGENKTNSTKNNAVPAPPTVSLSSS

SEQ ID NO: 22674 - protein, 634 aa, Secale cereale
MGSLEARYRPAGAADDTAKRRTQKSKSFKEVEKFDVFVLEKSSGCKFRSLQLLLFAIMSAAFLTLLYTPSVYEHQLQSNSRFVNVGWIWDKSIPDPRYVSSMPVQWDDVYKTIESLNGGEQKLKVGLLNFNSTEFGSWTQLLPEGEFSIIRLEHANESITWQTLYPEWIDEEEETEIPTCPSLPEPNFPRGTHFDVIAVKLPCTRVGGWSRDVARLHLQLSAAKLAVTAPRGSRGVHVMFVTECFPLPNLFSCKNLKKHEGNAWLYKPDSKALKEKLRLPIGSCELAVPLKAKSRLYSVDRRREAYATILHSASEYVCGAIAAAQSIRQAGSTRDFVILVDDTISDHHRKGLESAGWKVRIIERIRNPKAERDAYNEWNYSKFRLWQLTDYDKIIFIDADLLILRNIDFLFTMPEISATGNNATLFNSGVMVIEPSNCTFQLLMEHINEITSYNGGDQGYLNEIFTWWHRIPKHMNFLKHFWEGDEEEVKAKKTQLFGANPPILYVLHYLGRKPWLCFRDYDCNWNVPILREFASDIAHTRWWKVHDKMPKKLQSYCLLRSRLKAGLEWERRQAEKANFTDGHWKRNITDKRLKICFEKFCFWESMLWHWGEAPNNATKKASTPALPAVTLSSS

SEQ ID NO: 22675 - protein, 633 aa, Sorghum bicolor
MGSLEARYRPAGAAEDTAKRRTQKSKSFKEVEKFDVFVLEKSSGCKFRSLQLLLFAIMSAAFLTLLYTPSVYEHQLQSSSRLVNGWIWDKRSSDPRYVSSASIQWEDVYKSIQNLNVGEQKLSVGLLNFNRTEFGAWTHMLPESDFSIIRLEHANESITWQTLYPEWIDEEEETEIPSCPSLPDPSFPRATHFDVVAVKLPCSRVAGWSRDVARLHLQLSAAKLAAATTRGNSGIHVLFVTDCFPIPNLFSCKDLVKREGNAWLYKPDVKALKEKLRLPVGSCELAVPLNAKARLYTVDRRREAYATILHSASEYVCGAITAAQSIRQAGSTRDLVILVDDTISDHHRKGLESAGWKVRIIERIRNPKAERDAYNEWNYSKFRLWQLTDYDKVIFIDADLLILRNIDFLFAMPEITATGNNATLFNSGVMVIEPSNCTFQLLMEHINEITSYNGGDQGYLNEIFTWWHRIPKHMNFLKHFWEGDEEEVKAKKTRLFGANPPILYVLHYLGRKPWLCFRDYDCNWNVEILREFASDVAHARWWKVHNKMPKKLQSYCLLRSRLKAGLEWERRQAEKANFTDGHWKRNITDPRLKTCFEKFCFWESMLWHWGENKNNSTQNSAVPATPTASLSSS

SEQ ID NO: 22676 - protein, 633 aa, Echinochloa colona
MGSLEARYRPAGAAEDTAKRRTQKSKSFKEVEKFDVFVLEKSSGCKFRSLQLLLFAIMSAAFLTLLYTPSVYEHQLQSSSRLVNGWIWDKRSSDPRYVSSASVQWEDVYKSIQNLNGGEQKLKVGLLNFNRTEFGAWTNMLPESDFSIIRLEHANESITWQTLYPEWIDEEEETEIPSCPSLPDPNFPRETHFDVIAVKLPCTRVAGWSRDVARLHLQLSAAKLAAATARGNGGAHVLFVTDCFPIPNLFSCKDLVKREGNAWLYKPDVKALKDKVRLPVGSCELAVPLNAKARLYTVDRRREAYATILHSASEYVCGAITAAQSIRQAGSTRDLVILVDDTISDHHRKGLESAGWKVRIIQRIRNPKAERDAYNEWNYSKFRLWQLTDYDKVIFIDADLLILRNIDFLFAMPEITATGNNATLFNSGVMVIEPSNCTFQLLMEHINEITSYNGGDQGYLNEIFTWWHRIPKHMNFLKHFWEGDEDAVKAKKTRLFGANPPILYVLHYLGRKPWLCFRDYDCNWNVEILREFASDVAHARWWKVHNKMPKKLQSYCLLRSRLKAGLEWERRQAEKANFTDGHWKRNITDPRLKICFEKFCFWESMLWHWGENKTNSTKNNAVPAPPTASLSSS

SEQ ID NO: 22677 - protein, 634 aa, Zea mays
MGSLEARYRPTGAAEDTAKRRTQKSKSFKEVEKFDVFVLEKSSGCKFRSLQLLLFAIMSAAFLTLLYTPSVYEHQLQSSSRLVNGWIWDKRSSDPRYISSASIQWEDVYKSMQNLNVGEQKLSVGLLNFNRTEFSAWTHMLPESDFSVIRLEHANESITWQTLYPEWIDEEEETEIPSCPSLPDPSFSRATHFDVVAVKLPCTRVAGWSRDVARLHLQLSAAKLAAATARGNRGIHVLFVTDCFPIPNLFSCKDLVKREGNAWMYKPDVKALKEKLRLPVGSCELAVPLNAKARLYTVDRRREAYATILHSASEYVCGAITAAQSIRQAGSTRDLVILVDDTISDHHRKGLESAGWKVRIIQRIRNPKAERDAYNEWNYSKFRLWQLTDYDKVIFIDADLLILRNIDFLFAMPEITATGNNATLFNSGVMVIEPSNCTFQLLMEHINEITSYNGGDQGYLNEIFTWWHRIPKHMNFLKHFWEGDEDEVKAKKTRLFGANPPILYVLHYLGRKPWLCFRDYDCNWNVEILREFATDVAHARWWKVHNKMPKKLQSYCLLRSRLKAGLEWERRQAEKANFTDGHWKRNITDPRLKTCFEKFCFWESMLWHWGENKNNSTQSSAVPATPAATSLSSS

SEQ ID NO: 22678 - protein, 277 aa, Glycine max
MANGPAPFSEIGKRAKDLLYKDYNFDHKFSLSIPNSTGLGLIATGLKKDKLFVGDISTLYKSGNTTVDVKVDTYSNIYTKVTVNDILHGTKAALSFNIPDHKSGKLDVQYLHPHAAVDSSIGLNPSPLLELSAAIGSKDLCLGAEVGFNTTSASFTKYNAGVAFNKPDFSVALMLADKGQTLKASYIHYVDRPDGFTVAAEISHRFSSLENRFTIGSSQSIDPKTVLKTRFSDDGKAAFQCQRAWRPNSLITLSAEYDSTKIFGSSTKFGLALALKP

SEQ ID NO: 22679 - protein, 277 aa, Phaseolus vulgaris
MANGPAPFSDIGKRAKELLYKDYNFDHKFSLSIPNSTGLGLIATGLKKDQVFVGDISTLYKSGNTTVDVKVDTYSNVSTKVTVNDVLHGTKAALSFSIPDHKSGKLDVQYLHPHAAIDSSIGLNPSPLLELSAAIGSKDLCLGAEVGFNTTSASFTKYNAGVAFNKPDFSAALMLADKGQTLKTSYIHYVDRPDGFTVAAEMTHRFSSFENRFTIGSSQFIDPKTVLKTRFSDDGKAAFQCQRAWRPNSLITLSAEYDSTKIFSSSTKFGLALSLKP

SEQ ID NO: 22680 - protein, 277 aa, Vigna unguiculata
MGNGPAPFSDIGKRARDLLYKDYNFDHKFSLSIPNSTGLGLIATGLKKDQVFVGDISTLYKSGNTTVDVKVDTYSNVSTKVTVNDILHGTKAALSFNIPDHKSGKLDVQYLHPHAAIDSSIGLNPSPLLELSAAIGSKDLCLGAEIGFNTTSASFTKYNAGVTFNKPDFSAALMLADKGQTVKTSYIHYVDRPDAFTVAAEMTHRFSTFENRFTIGSSQLIDPKTVLKTRFSDDGKAAFQCQRAWRPNSLITLSAEYDSTKIFSSSTKFGLALSLKP

SEQ ID NO: 22681 - protein, 277 aa, Cajanus cajan
MANGPAPYSEIGKRARDLLYKDYNFDHKFTLSIPNSTGLGLVATGLKKDQLFVGDISTLYKSGNTTVDVKVDTYSNVSTKVTVNDILHSTKATLSFNIPDHKSGKLDVQYLHPHAAIDSSIGLNPSPLLELSAAIGSKDLCLGGEVGFNTTSASFTKYNAGVAFNKSDFSASLMLADKGQTLKASYIHYVDRPDGFTVAAEISHRFSSYENRFTIGSSQLIDPKTVLKTRFSDDGKAAFQCQRAWRPNSLVTLSAEYDSTKIFSSSTKFGLALSLKP

SEQ ID NO: 22682 - protein, 277 aa, Arachis hypogaea
MGNGPAPFSDIGKRAKDLLYKDYNFDQKFSLSIPSTTGLGLIATGLKKDQIFVGDINTLYKSGNTIVDVKVDTYSNVTTKITVNDILHGTKAALSFNIPDHKSGKLYVHYVHPHAAIDSSIGLNPSPQLEVSAAIGSKDLCLGAEVGFNTTSASFTKYNAGIAFNRPDFSAALMLADKGQNLKASYIHYVDRPDGLTVAAEITHRFSSFENRFTIGSSQSIDPITVLKTRFSDDGKAALQVQRAWRPNSLITLSAEYDSTKIFGSSTRLGLGLALKP

SEQ ID NO: 22683 - protein, 277 aa, Lupinus angustifolius
MTSSPAPFSDIGKRARDLLYKDYNFDQKFTLQIPSSTGLGLVATGLKKDQIFVGDINTLYKSGNTTVDVKVDTYSNVSTKVTVNDIFHSTKAALSFNIPDHKSGKLDVQYVHPHAAIDSSIGLNPSPQLQLSAAIGSKDVCLGAEVGFNTASATFTKYNAGIAFNKPDFSAALLLADRGEALKVSYIHHVDRPDGFTVAAEITHKFSSFDNRFTIGSSNSIDPRTVLKTRFSDDGKAAFQVQRVWRPNSLITLSGEYDSTKIFNSSTKLGLSLALKP

SEQ ID NO: 22684 - protein, 277 aa, Lotus japonicus
MANGPALYPEIGKRARDLLYKDYNFDQKFNLSIPSSTGLGLIATGLKKDQIFIGDINTLYKSGNLTVDVKVDTYSNVSTKVTLNDIFRCKKVALSFNIPDHKSGKLDVQYLHPHAAIDSSIGLNPSPQLELSTAIGSKDLCMGAEVGFNTTSASFTKYNAGITFNRPDFSAALMLVDKGKSLKASYIHHVDRPDGFTVAAEINHRFSSFENRFTIGSSQLIDPNTVLKTRFSDDGKAAFLCQRAWRPKSLITLSAEYDSTKIFGSSTKLGLALALQP

SEQ ID NO: 22685 - protein, 277 aa, Lupinus angustifolius
MANNPAPFSDIGKRARDLLYKDYNFDQKFTLHIPSSTGLGLVATGSKKDQFFVGDINTLYKSGNTTVDVKVDTYSNVSTKVTVNDIFHSTKAALSFNVPDHKSGKLDVQYLHPHAAIDSSIGLNPSPQLELSAAIGSKDLCLGAEVGFNTTSASFTKYNAGIAFNKPDFSAALLLVDRGQALKASYIHYVDRPDGFTIATEITHRFSSFENRFTIGSSKSIDPHTILKTRFSNDGKAAFQVQRAWRPNSLVILSGEYDPTRIFSSSTKLGLSLALKP

SEQ ID NO: 22686 - protein, 277 aa, Trifolium pratense
MANGPAPFSEIGKRARDLLYKDYNFDHKFIFSVPNSTGLGLTATGLKKDQFFVGDISGLYKSGNVAVDVKVDTHNNVSTKVTLNDVFHSKKVALSFNIPDHKSGKLDVQYLHPHAAIDSSIDLNPAPRLELSAAIGSKDISMGAEVGFNTTSASFTKYNAGIAFNKPDFSATLMLADKGEALKASYIHYVDRPDELTVAAELAHKLSSSENRFTIGTSQLIDPKTVLKTRFSDDGKAAFQCQRAWRPNSLITLSAEYDSTKIFGSPAKFGLALSLKP

SEQ ID NO: 22687 - protein, 277 aa, Trifolium pratense
MANGPAPFSEIGKRARDLLYKDYNYDHKFIFSVPNSTGLGLTATGLKKDQFFVGDISGLYKSGNVAVDVKVDTHNNVSTKVTLNDVFHSKKVALSFNIPDHKSGKLDVQYLHPHAAIDSSIGLNPAPRLELSAAVGSKDISMGAEVGFNTTSASFTKYNAGIAFNKPDFSATLMLADKGEALKASYIHYVDRPDGLTVAAELAHRLSSSENRFTIGTSQLIDPKTVLKTRFSDDGKAAFQCQRAWRPNSLITLSAEYDSTKIFGSPAKFGLALSLKP

SEQ ID NO: 22688 - protein, 277 aa, Trifolium pratense
MANGPAPFSEIGKRARDLLYKDYNYDHKFIFSVPNSTGLGLTATGLKKDQFFVGDISGLYKSGNVAVDVKVDTHNNVSTKVTLNDVFHSKKVALSFNIPDHKSGKLDVQYLHPHAAIDSSIGLNPAPRLELSAAIGSKDISMGAEVGFNTTSASFTKYNAGIAFNKPDFSATLMLADKGEALKASYIHYVNRPDGLTVAAELAHKLSSSENRFTIGTSQLIDPKTVLKTRFSDDGKAAFQCQRAWRPNSLITLSAEYDSTKIFGSPAKFGLALSLKP

SEQ ID NO: 22689 - protein, 279 aa, Medicago truncatula
MANGPAPFSEIGKRARDLLYKDYNFDHKFSLSIPSSTGLGLTATGLKRDKFFVGDLNTLYKSGNVTVDVKVNTDSNVSTKVTLNDVSLSHSKKVALSFNIPDHKSGKLDVQYLHPHAAIDSSIGLNPAPKLELSAAIGSKDISMGAEVGFDTTSASFSTYNAGIAFNKPDFSATLMLADKGQSLKASYIHYVDRPDGLTVAAELAHKLSSSENRFTFGTSQSIDPKTVLKTRFSDDGKAAFQCQRAWRPNSLITLSAEYDSKKIIGSPAKFGLALSLKP

SEQ ID NO: 22690 - protein, 262 aa, Leymus cinereus x Leymus triticoides
MAQPAELSREENVYMAKLAEQAERYDEMVEFMEKVAKTVDSEELTVEERNLLSVAYKNVIGARRASWRIISSIEQKEESRGNEDRVTLIKDYRGKIEVELTKICDGILKLLDSHLVPSSTAPESKVFYLKMKGDYYRYLAEFKSGTERKDAAENTMVAYKAAQEIALAELPPTHPIRLGLALNFSVFYYEILNSPDRACDLAKQAFDEAISELDSLSEESYKDSTLIMQLLRDNLTLWTSDISEDAAEEMKDAPKGESGDGQ

SEQ ID NO: 22691 - protein, 262 aa, Pseudoroegneria spicata
MAQPAELSREENVYMAKLAEQAERYEEMVEFMEKVAKTVDSEELTVEERNLLSVAYKNVIGARRASWRIISSIEQKEESRGNEDRVTLIKDYRGKIEVELTKICDGILKLLDSHLVPSSTAPESKVFYLKMKGDYYRYLAEFKSETERKDAAENTMVAYKAAQEIALAELPPTHPIRLGLALNFSVFYYEILNSPDRACDLAKQAFDEAISELDSLSEESYKDSTLIMQLLRDNLTLWTSDISEDAAEEMKDAPKGESGDGQ

SEQ ID NO: 22692 - protein, 262 aa, Secale cereale
  Sequence also found in Organisms: Triticum aestivum
MAQPAELSREENVYMAKLAEQAERYEEMVEFMEKVAKTVDSEELTVEERNLLSVAYKNVIGARRASWRIISSIEQKEESRGNEDRVTLIKDYRGKIEVELTKICDGILKLLDSHLVPSSTAPESKVFYLKMKGDYYRYLAEFKSGTERKDAAENTMVAYKAAQEIALKELPPTHPIRLGLALNFSVFYYEILNSPDRACDLAKQAFDEAISELDSLSEESYKDSTLIMQLLRDNLTLWTSDISEDAAEEMKDAPKGESGDGQ

SEQ ID NO: 22693 - protein, 262 aa, Triticum aestivum
MAQPAKLSREENVYMAKLAEQAERYEEMVEFMEKVAKTVDSEELTVEERNLLSVAYKNVIGARRASWRIISSIEQKEESRGNEDRVTLIKDYRGKIEVELTKICDGILKLLDSHLVPSSTAPESKVFYLKMKGDYYRYLAEFKSGTERKDAAENTMVAYKAAQEIALKELPPTHPIRLGLALNFSVFYYEILNSPDRACDLAKQAFDEAISELDSLSEESYKDSTLIMQLLRDNLTLWTSDISEDAAEEMKDAPKGESGDGQ

SEQ ID NO: 22694 - protein, 262 aa, Avena sativa
MTQSAELSREENVYMAKLAEQAERYEEMVEFMEKVAKTVDSEELTVEERNLLSVAYKNVIGARRASWRIISSIEQKEESRGNEDRVTLIKDYRGKIETELTKICDGILKLLDSHLVPSSTAPESKVFYLKMKGDYYRYLAEFKSGAERKDAAENTMVAYKAAQDIALAELPPTHPIRLGLALNFSVFYYEILNSPDRACNLAKQAFDEAISELDTLSEESYKDSTLIMQLLRDNLTLWTSDISEDAAEEIKDAPKGESGDGQ

SEQ ID NO: 22695 - protein, 259 aa, Festuca arundinacea
MAELSREENVYMAKLAEQAERYEEMVEFMEKVAKTVDSEELTVEERNLLSVAYKNVIGARRASWRIISSIEQKEESRGNEDRVTLIKDYRGKIETELTKICDGILKLLDSHLVPSSTAPESKVFYLKMKGDYYRYLAEFKSGAERKDAAENTMVAYKAAQDIALAELPPTHPIRLGLALNFSVFYYEILNSPDRACNLAKQAFDEAISELDTLSEESYKDSTLIMQLLRDNLTLWTSDISEDAAEEIKDAPKGESGDGQ

SEQ ID NO: 22696 - protein, 259 aa, Festuca arundinacea
  Sequence also found in Organisms: Lolium multiflorum
MAELSREENVYMAKLAEQAERYEEMVEFMEKVAKTVDSEELTVEERNLLSVAYKNVIGARRASWRIISSIEQKEESRGNEDRVTLIKDYRGKIETELTKICDGILKLLDSHLVPSSTAPESKVFYLKMKGDYYRYLAEFKSGSERKDAAENTMVAYKAAQDIALAELPPTHPIRLGLALNFSVFYYEILNSPDRACNLAKQAFDEAISELDTLSEESYKDSTLIMQLLRDNLTLWTSDISEDAAEEIKDAPKGESGDGQ

SEQ ID NO: 22697 - protein, 259 aa, Festuca arundinacea
MAELSREENVYMAKLAEQAERYEEMVEFMEKVAKTVDSEELTVEERNLLSVAYKNVIGARRASWRIISSIEQKEESRGNEDRVTLIKDYRGKIETELTKICDGILKLLDSHLVPSSTAPESKVFYLKMKGDYYRYLAEFKSGAERKDAAENTMVAYKAAQDFALAELPPTHPIRLGLALNFSVFYYEILNSPDRACNLAKQAFDEAISELDTLSEESYKDSTLIMQLLRDNLTLWTSDISEDAAEEIKDAPKGESGDGQ

SEQ ID NO: 22698 - protein, 262 aa, Oryza sativa
MSQPAELSREENVYMAKLAEQAERYEEMVEFMEKVAKTVDSEELTVEERNLLSVAYKNVIGARRASWRIISSIEQKEESRGNEDRCTLIKEYRGKIETELSKICDGILKLLDSHLVPSSTAPESKVFYLKMKGDYYRYLAEFKTGAERKDAAENTMVAYKAAQDIALAELPPTHPIRLGLALNFSVFYYEILNSPDRACNLAKQAFDEAISELDTLSEESYKDSTLIMQLLRDNLTLWTSDISEDAAEEIKEAPKGESGDGQ

SEQ ID NO: 22699 - protein, 262 aa, Pennisetum glaucum
  Sequence also found in Organisms: Cenchrus ciliaris
MSQPAELSREENVYMAKLAEQAERYEEMVEFMEKVAKTVDSEELTVEERNLLSVAYKNVIGARRASWRIISSIEQKEEGRGNEDRVTLIKDYRSKIEVELTKICDGILKLLDSHLVPSSTAPESKVFYLKMKGDYYRYLAEFKTGSERKDAAENTMVAYKAAQDIALAELAPTHPIRLGLALNFSVFYYEILNSPDRACNLAKQAFDEAISELDTLSEESYKDSTLIMQLLRDNLTLWTSDITEDAAEEIKEAPKGESGDGQ

SEQ ID NO: 22700 - protein, 262 aa, Cenchrus ciliaris
MSQPAELSREENVYMAKLAEQAERYEEMVEFMEKVAKAVDSEELTVEERNLLSVAYKNVIGARRASWRIISSIEQKEEGRGNEDRVTLIKDYRSKIEVELTKICDGILKLLDSHLVPSSTAPESKVFYLKMKGDYYRYLAEFKTGSERKDAAENTMVAYKAAQDIALAELAPTHPIRLGLALNFSVFYYEILNSPDRACNLAKQAFDEAISELDTLSEESYKDSTLIMQLLRDNLTLWTSDITEDAAEEIKEAPKGESGDGQ

SEQ ID NO: 22701 - protein, 262 aa, Echinochloa colona
MALPAELSREENVYMAKLAEQAERYEEMVEFMEKVAKTVDSEELTVEERNLLSVAYKNVIGARRASWRIISSIEQKEEGRGNEDRVTLIKDYRSKIEVELTKICDGILKLLDSHLVPSSTAPESKVFYLKMKGDYYRYLAEFKTGSERKDAAENTMVAYKAAQDIALAELAPTHPIRLGLALNFSVFYYEILNSPDRACNLAKQAFDEAISELDTLSEESYKDSTLIMQLLRDNLTLWTSDITEDATEEIKEAPKGESGDGQ

SEQ ID NO: 22702 - protein, 262 aa, Panicum virgatum
MSLPAELSREENVYMAKLAEQAERYEEMVEFMEKVAKAVDSEELTVEERNLLSVAYKNVIGARRASWRIISSIEQKEEGRGNEDRVTLIKDYRSKIEVELTKICDGILKLLDSHLVPSSTAPESKVFYLKMKGDYYRYLAEFKTGSERKDAAENTMVAYKAAQDIALAELAPTHPIRLGLALNFSVFYYEILNSPDRACSLAKQAFDEAISELDTLSEESYKDSTLIMQLLRDNLTLWTSDISEDAAEEIKEAPKGESGDGQ

SEQ ID NO: 22703 - protein, 262 aa, Setaria italica
MSQPAELSREENIYMAKLAEQAERYEEMVEFMEKVAKAVDSEELTVEERNLLSVAYKNVIGARRASWRIISSIEQKEEGRGNEDRVTLIKDYRSKIEVELTKICDGILKLLDSHLVPSSTAPESKVFYLKMKGDYYRYLAEFKTGSERKDAAENTMVAYKAAQDIALAELSPTHPIRLGLALNFSVFYYEILNSPDRACNLAKQAFDEAISELDTLSEESYKDSTLIMQLLRDNLTLWTSDITEDAAEEIKEAPKGESGDGQ

SEQ ID NO: 22704 - protein, 262 aa, Echinochloa colona
MSLPAELSREENVYMAKLAEQAERYEEMVEFMEKVAKAVDSEELTVEERNLLSVAYKNVIGARRASWRIISSIEQKEEGRGNEDRVTLIKDYRSKIEVELTKICDGILKLLDSHLVPSSTAPESKVFYLKMKGDYYRYLAEFKTGSERKDAAENTMVAYKAAQDIALAELAPTHPIRLGLALNFSVFYYEILNSPDRACNLAKQAFDEAISELDTLSEESYKDSTLIMQLLRDNLTLWTSDITEDATEEIKEAPKGESGDGQ

SEQ ID NO: 22705 - protein, 262 aa, Brachypodium distachyon
MSAPAELSREENVYMAKLAEQAERYEEMVEFMEKVAKTVDSEELTVEERNLLSVAYKNVIGARRASWRIISSIEQKEESRGNEDRVTLIKDYRGKIETELTKICDGILKLLETHLVPSSTAPESKVFYLKMKGDYYRYLAEFKSGAERKDAAENTMVAYKAAQDIALAELAPTHPIRLGLALNFSVFYYEILNSPDRACNLAKQAFDEAISELDTLSEESYKDSTLIMQLLRDNLTLWTSDITEDTAEEIREAPKGDSGDGQ

SEQ ID NO: 22706 - protein, 262 aa, Eragrostis curvula
MSQPAELSREENVYMAKLAEQAERYEEMVEFMEKVAKAVDSEELTVEERNLLSVAYKNVIGARRASWRIISSIEQKEEGRGNEDRVTLIKDYRSKIETELTKICDGILKLLDSHLVPSSTAPESKVFYLKMKGDYYRYLAEFKTGSERKDAAENTMVAYKAAQDIALTELAPTHPIRLGLALNFSVFYYEILNSPDRACSLAKQAFDEAISELDTLSEESYKDSTLIMQLLRDNLTLWTSDISEDTAEEIKEAPKGESGHGQ

SEQ ID NO: 22707 - protein, 262 aa, Oryza sativa
MSAQAELSREENVYMAKLAEQAERYEEMVEFMEKVAKTVDSEELTVEERNLLSVAYKNVIGARRASWRIISSIEQKEESRGNEDRVTLIKDYRGKIETELTKICDGILKLLESHLVPSSTAPESKVFYLKMKGDYYRYLAEFKTGAERKDAAENTMVAYKAAQDIALAELPPTHPIRLGLALNFSVFYYEILNSPDRACNLAKQAFDEAISELDTLSEESYKDSTLIMQLLRDNLTLWTSDISEDTAEEIREAPKRDSSEGQ

SEQ ID NO: 22708 - protein, 262 aa, Brachypodium distachyon
MAQTVELSREENVYMAKLAEQAERYEEMVKFMEKVAKTVDSEELTVEERNLLSVAYKNVIGARRASWRIISSIEQKEESHGNDDRVTLIKDYRGKIETELTKICDGILKLLDSHLVPSSTAPESKVFYLKMKGDYYRYVAEFKSGAERKDAAENTMVAYKAAQDIALAELAPTHPIRLGLALNFSVFYYEILNSPDHACNLAKQAFDEAISELDTPSEESYKDSTLIMQLLRDNLTLWISDISEDAAEHIKEAPKGESGDGQ

SEQ ID NO: 22709 - protein, 261 aa, Setaria italica
MASAELSREENVYMAKLAEQAERYEEMVEFMEKVAKTVDSEELTVEERNLLSVAYKNVIGARRASWRIISSIEQKEEGRGNEDRVTLIKDYRGKIETELTKICDGILKLLESHLVPSSTAPESKVFYLKMKGDYYRYLAEFKTGAERKDAAENTMVAYKAAQDIALAELPPTHPIRLGLALNFSVFYYEILNSPDRACSLAKQAFDEAISELDTLSEESYKDSTLIMQLLRDNLTLWTSDISEDPAEEIREAPKHDSSEGQ

SEQ ID NO: 22710 - protein, 260 aa, Cynodon dactylon
MASAELSREENVYMAKLAEQAERYEEMVEYMEKVAKTVDSEELTVEERNLLSVAYKNVIGARRASWRIISSIEQKEEGRGNEDRVTLIKDYRGKIETELTKICDGILKLLESHLVPSSTAPESKVFYLKMKGDYYRYLAEFKTGTERKDAAENTMVAYKAAQDIALAELAPTHPIRLGLALNFSVFYYEILNSPDRACSLAKQAFDEAISELDTLSEESYKDSTLIMQLLRDNLTLWTSDISEDPAEEIREAAPKSGEGQ

SEQ ID NO: 22711 - protein, 261 aa, Echinochloa colona
MASAELSREENVYMAKLAEQAERYEEMVEFMEKVAKTVDSEELTVEERNLLSVAYKNVIGARRASWRIISSIEQKEEGRGNEDRVTLIKDYRGKIETELTKICDGILKLLESHLVPSSTAPESKVFYLKMKGDYYRYLAEFKTGAERKDAAENTMVAYKAAQDIALAELPPTHPIRLGLALNFSVFFYEILNSPDRACSLAKQAFDEAISELDTLSEESYKDSTLIMQLLRDNLTLWTSDISEDPAEEIREAPKRDSSEGQ

SEQ ID NO: 22712 - protein, 261 aa, Zea mays
MASAELSREENVYMAKLAEQAERYEEMVEFMEKVAKTVDSEELTVEERNLLSVAYKNVIGARRASWRIISSIEQKEEGRGNEDRVTLIKDYRGKIETELTKICDGILKLLESHLVPSSTAPESKVFYLKMKGDYYRYLAEFKTGAERKDAAENTMVAYKAAQDIALAELAPTHPIRLGLALNFSVFYYEILNSPDRACSLAKQAFDEAISELDTLSEESYKDSTLIMQLLRDNLTLWTSDISEDPAEEIREAPKHDSSEGQ

SEQ ID NO: 22713 - protein, 261 aa, Pennisetum glaucum
  Sequence also found in Organisms: Sorghum bicolor, Saccharum officinarum
MASAELSREENVYMAKLAEQAERYEEMVEFMEKVAKTVDSEELTVEERNLLSVAYKNVIGARRASWRIISSIEQKEEGRGNEDRVTLIKDYRGKIETELTKICDGILKLLESHLVPSSTAPESKVFYLKMKGDYYRYLAEFKTGAERKDAAENTMVAYKAAQDIALAELAPTHPIRLGLALNFSVFYYEILNSPDRACSLAKQAFDEAISELDTLSEESYKDSTLIMQLLRDNLTLWTSDISEDPAEEIREAPKRDSSEGQ

SEQ ID NO: 22714 - protein, 261 aa, Zea mays
MASAELSREENVYMAKLAEQAERYEEMVEFMEKVAKTVDSEELTVEERNLLSVAYKNVIGARRASWRIISSIEQKEEGRGNEDRVTLIKDYRGKIETELTKICDGILKLLETHLVPSSTAPESKVFYLKMKGDYYRYLAEFKTGAERKDAAENTMVAYKAAQDIALAELAPTHPIRLGLALNFSVFYYEILNSPDRACSLAKQAFDEAISELDTLSEESYKDSTLIMQLLRDNLTLWTSDISEDPAEEIREAPKRDSSEGQ

SEQ ID NO: 22715 - protein, 260 aa, Avena sativa
MSAPVELSREENVYMAKLAEQAERYEEMVEFMEKVAKTVDSEELTVEERNLLSVAYKNVIGARRASWRIISSIEQKEESRGNEDRVTLIKDYRGKIETELTKICDGILKLLETHLVPSSTAPESKVFYLKMKGDYYRYLAEFKSGAERKDAAENTMVAYKAAQDIALAELAPTHPIRLGLALNFSVFYYEILNSPDRACNLAKQAFDEAISELDTLSEESYKDSTLIMQLLRDNLTLWTSDITEDTAEEEIREAPKGEGQ

SEQ ID NO: 22716 - protein, 261 aa, Panicum virgatum
MASAELSREENVYMAKLAEQAERYEEMVEFMEKVAKTVDSEELTVEERNLLSVAYKNVIGARRASWRIISSIEQKEEGRGNEDRVTLIKDYRGKIETELTKICDGILKLLESHLVPSSTAPESKVFYLKMKGDYYRYLAEFKTGAERKDAAENTMVAYKAAQDIALAELPPTHPIRLGLALNFSVFYYEILNSPDRACSLAKQAFDEAISELDTLSEESYKDSTLIMQLLRDNLTLWTSDISEDPAEEIREPLKHDSSEGQ

SEQ ID NO: 22717 - protein, 260 aa, Festuca arundinacea
MSAPAELSREENVYMAKLAEQAERYEEMVEFMEKVAKTVDSEELTVEERNLLSVAYKNVIGARRASWRIISSIEQKEESRGNEDRVTLIKDYRGKIETELTKICDGILKLLETHLVPSSTAPESKVFYLKMKGDYYRYLAEFKSGAERKDAAENTMVAYKAAQDIALAELAPTHPIRLGLALNFSVFYYEILNSPDRACNLAKQAFDEAISELDTLSEESYKDSTLIMQLLRDNLTLWTSDITEDTAEEEIREAPKGAAE

SEQ ID NO: 22718 - protein, 263 aa, Leymus cinereus x Leymus triticoides
MSAPAELSREENVYMAKLAEQAERYEEMVEFMEKVAKTVDSEELTVEERNLLSVAYKNVIGARRASWRIISSIEQKEESRGNEDRVTLIKEYRGKIETELSKICDGILKLLETHLVPSSTAPESKVFYLKMKGDYYRYLAEFKSGPERKDAAENTMVAYKAAQDIALAELAPTHPIRLGLALNFSVFYYEILNSPDRACNLAKQAFDEAISELDTLSEESYKDSTLIMQLLRDNLTLWTSDITEDTAEEEIREAPKHDSSEGQ

SEQ ID NO: 22719 - protein, 263 aa, Secale cereale
MSAPAELSREENVYMAKLAEQAERYEEMVEFMEKVAKTVDSEELTVEERNLLSVAYKNVIGARRASWRIISSIEQKEESRGNEDRVTLIKEYRGKIETELSKICDGILKLLETHLVPSSTAPESKVFYLKMKGDYYRYLAEFKSGPERKDAAENTMVAYKAAQDIALAELAPTHPIRLGLALNFSVFYYEILNSPDRACNLAKQAFDEAISELDTLSEESYKDSTLIMQLLRDNLTLWTSDITEDTAEEEIREAPKNDSSEGQ

SEQ ID NO: 22720 - protein, 263 aa, Triticum aestivum
MTAPAELSREENVYMAKLAEQAERYEEMVEFMEKVAKTVDSEELTVEERNLLSVAYKNVIGARRASWRIISSIEQKEESRGNEDRVTLIKEYRGKIETELSKICDGILKLLETHLVPSSTAPESKVFYLKMKGDYYRYLAEFKSGPERKDAAENTMVAYKAAQDIALAELAPTHPIRLGLALNFSVFYYEILNSPDRACNLAKQAFDEAISELDTLSEESYKDSTLIMQLLRDNLTLWTSDITEDTAEEEIREAPKNDSSEGQ

SEQ ID NO: 22721 - protein, 263 aa, Hordeum vulgare
MSAPGELSREENVYMAKLAEQAERYEEMVEFMEKVAKTVDSEELTVEERNLLSVAYKNVIGARRASWRIISSIEQKEESRGNEDRVTLIKEYRGKIETELSKICDGILKLLETHLVPSSTAPESKVFYLKMKGDYYRYLAEFKSGPERKDAAENTMVAYKAAQDIALAELAPTHPIRLGLALNFSVFYYEILNSPDRACNLAKQAFDEAISELDTLSEESYKDSTLIMQLLRDNLTLWTSDITEDTAEEEIREAPKHDSSEGQ

SEQ ID NO: 22722 - protein, 260 aa, Festuca arundinacea
MSAPAELSREENVYMAKLAEQAERYEEMVDFMEKVAKTVDSEELTVEERNLLSVAYKNVIGARRASWRIISSIEQKEESRGNEDRVTLIKDYRGKIETELTKICDGILKLLETHLVPSSTAPESKVFYLKMKGDYYRYLAEFKSGAERKDAAENTMVAYKAAQDIALAELAPTHPIRLGLALNFSVFYYEILNSPDRACNLAKQAFDEAISELDTLSEESYKDSTLIMQLLRDNLTLWTSDITEDTAEEEIREAPKGAAE

SEQ ID NO: 22723 - protein, 263 aa, Secale cereale
MSAPAELSREENVYMAKLAEQAERYEEMVEFMEKVAKTVDSEELTVEERNLLSVAYKNVIGARRASWRIISSIEQKEESRGNEDRVTLIKEYRGKIETELSKICDGILKLLETHLVPSSTAPESKVFYLKMKGDYYRYLAEFKSGPERKDAAENTMVAYKAAQDIAMAELAPTHPIRLGLALNFSVFYYEILNSPDRACNLAKQAFDEAISELDTLSEESYKDSTLIMQLLRDNLTLWTSDITEDTAEEEIREAPKNDSSEGQ

SEQ ID NO: 22724 - protein, 260 aa, Lolium multiflorum
MSAPAELSREEMVYMAKLAEQAERYEEMVEFMEKVAKTVDSEELTVEERNLLSVAYKNVIGARRASWRIVSSIEQKEESRGNEDRVTLIKDYRGKIETELTKICDGILKLLETHLVPSSTAPESKVFYLKMKGDYYRYLAEFKSGAERKDAAENTMVAYKAAQDIALAELAPTHPIRLGLALNFSVFYYEILNSPDRACNLAKQAFDEAISELDTLSEESYKDSTLIMQLLRDNLTLWTSDITEDTAEEEIREAPKGAAE

SEQ ID NO: 22725 - protein, 262 aa, Cynodon dactylon
MSQPAELSREENVYMAKLAEQAERYEEMVEFMEKVAKAVDSEELTVEERNLLSVAYKNVIGARRASWRIISSIEQKEEGRGNEDRVTLIKDYRSKIETELTKICDGILKLLDSHLITSSTAPESKVFYLKMKGDYYRYLAEFKTDSEKKDAADNTMVAYTAAQEIAVAELAPTHPIRLGLALNFSVFYYEILNSPDRACNLAKQAFDDAIAELDTLSEESYKDSTLIMQLLRDNLTLWTSDITEDTVDEIKEAPKGESGDGQ

SEQ ID NO: 22726 - protein, 255 aa, Festuca arundinacea
ELSREENVYMAKLAEQAERYEEMVEFMEKVAKTVDSEELTVEERNLLSVAYKNVIGARRASWRIISSIEQKEESRGNEDRVTLIKDYRGKIETELTKICEGILKLLDTHLVPSSTAPESKVFYLKMKGDYYRYLAEFKSGAERKDAAENTMVAYKAAQDIALAELAPTHPIRLGLALNFSVFYYEILNSPDRACNLAKQAFDEAISELDTLSEESYKDSTLIMQLLRDNLTLWTSDITEDTAEEEIREAPKGAAE

SEQ ID NO: 22727 - protein, 262 aa, Pennisetum glaucum
MSQPAELSREENVYMAKLAEQAERYEEMVEFMEKVAKTVDSEELTVEERNLLSVAYKNVIGARRASWRIISSIEQKEEGRGNEDRVTLIKDYRSKIEVELTKICDGILKLLDSHLVPSSTAPESKVFYLKMKGDYHRYLAEFKTGAERKESAESTMVAYKAAQDIALAELAPTHPIRLGLALNFSVFYYEILNSPDKACNLAKQAFDEAISELDTLGEESYKDSTLIMQLLRDNLTLWTSDLTEDGAEDGKEATKGDAGEGQ

SEQ ID NO: 22728 - protein, 250 aa, Cenchrus ciliaris
VYMAKLAEQAERYEEMVEFMEKVAKTVDSEELTVEERNLLSVAYKNVIGARRASWRIISSIEQKEEGRGNEDRVTLIKDYRGKIETELTKICDGILKLLESHLVPSSTAPESKVFYLKMKGDYYRYLAEFKTGAERKDAAENTMVAYKAAQDIALAELAPTHPIRLGLALNFSVFYYEILNSPDRACSLAKQAFDEAISELDTLSEESYKDSTLIMQLLRDNLTLWTSDISEDPAEEIREAPKRDSSEGQ

SEQ ID NO: 22729 - protein, 261 aa, Cocos nucifera
MSPAESSREENVYMAKLAEQAERYEEMVEFMEKVVKTVDVEELTVEERNLLSVAYKNVIGARRASWRIISSIEQKEESRGNEDRVALIKEYRGKIEAELSKICDGILKLLDSHLIPSATAVESKVFYLKMKGDYHRYLAEFKTGAERKEAAESTLLAYKSAQDIALAELAPTHPIRLGLALNFSVFYYEILNSPDRACSLAKQAFDEAISELDSLGEESYKDSTLIMQLLRDNLTLWTSDITEDGGDEIKEAPKRESGDGQ

SEQ ID NO: 22730 - protein, 261 aa, Elaeis guineensis
MSPAESSREENVYMAKLAEQAERYEEMVEFMEKVVKTVDVEELTVEERNLLSVAYKNVIGARRASWRIISSIEQKEESRGNEDRVTLIKEYRGKIEAELSKICDGILKLLESHLIPSATAVESKVFYLKMKGDYHRYLAEFKTGAERKEAAESTLLAYKSAQDIALAELAPTHPIRLGLALNFSVFYYEILNSPDRACSLAKQAFDEAISELDSLGEESYKDSTLIMQLLRDNLTLWTSDITEDGGDEIKEAPKRESGDGQ

SEQ ID NO: 22731 - protein, 261 aa, Elaeis guineensis
MSSAESTREENVYMAKLAEQAERYEEMVEFMEKVAKTVDVEELSVEERNLLSVAYKNVIGARRASWRIISSIEQKEESRGNEDRVSLIKEYRGKIEAELSNICDGILKLLDSHLIPSSTVAESKVFYLKMKGDYHRYLAEFKAGAERKEAAESTLVAYKAAQDIALAELAPTHPIRLGLALNFSVFYYEILNSPDRACSLAKQAFDEAISELDSLGEESYKDSTLIMQLLRDNLTLWTSDITEDAGDEIKAAPKKEPGEGQ

SEQ ID NO: 22732 - protein, 261 aa, Musa acuminata
MSPADSSREDNVYMAKLAEQAERYEEMVEFMEKVAKTVDVEELTVEERNLLSVAYKNVIGARRASWRIISSIEQKEESRGNEDHVSVIKEYRGKIETELSKICDGILKLLDSHLIPSSAAAESKVFYLKMKGDYHRYLAEFKTGAERKEAAESTLVSYKSAQDIALAELAPTHPIRLGLALNFSVFYYEIVNSPDRACSLAKQAFDEAISELDTLSEESYKDSTLIMQLLRDNLTLWTSDITEDAGEEIKEAPKRESEEGQ

SEQ ID NO: 22733 - protein, 261 aa, Cocos nucifera
MSSAESTREENVYMAKLAEQAERYEEMVEFMEKVAKTVDVEELSVEERNLLSVAYKNVIGARRASWRIISSIEQKEESRGNEDRVALIKEYRGKIEAELSNICDGILKLLDSHLIPSSTAAESKVFYLKMKGDYHRYLAEFKTGAEKKEAAESTLVAYKAAQDIALAELAPTHPIRLGLALNFSVFYYEILNSPDRACSLAKQAFDEAISELDSLGEESYKDSTLIMQLLRDNLTLWTSDITEDAGDEIKAASKKEAGEGP

SEQ ID NO: 22734 - protein, 261 aa, Elaeis guineensis
MSPAESSREENVYMAKLAEQAERYEEMVEFMEKVAKTVDVEELTVEERNLLSVAYKNVIGARRASWRIISSIEQKEESRGNEDHVAMIKEYRGKIEAELSKICDGILKLLDSHLIPSATAAESKVFYLKMKGDYHRYLAEFKTGAERKEAAESTLLAYKSAQDIALAELAPTHPIRLGLALNFSVFYYEILNSPDRACSLAKQAFDEAISELDTLGEESYKDSTLIMQLLRDNLTLWTSDITEDGGDEIKEATKRESGEGQ

SEQ ID NO: 22735 - protein, 260 aa, Ananas comosus
MAPAESSREENVYMAKLAEQAERYEEMVEFMEKVVKAVDAEELTVEERNLLSVAYKNVIGARRASWRIISSIEQKEESRGNEDHVSMIKEYRGKIEAELSKICDGILKLLDSHLVPSATAPESKVFYLKMKGDYHRYLAEFKTGAERKEAAESTLLAYKSAQDIALAELAPTHPIRLGLALNFSVFYYEILNSPDRACNLAKQAFDEAISELDTLGEESYKDSTLIMQLLRDNLTLWTSDIRDDGGDEIKEAPKKEGEDQ

SEQ ID NO: 22736 - protein, 261 aa, Amorphophallus konjac
MSLAESSREENVYMAKLAEQAERYEEMVEFMEKVVKIVDTEELTVEERNLLSVAYKNVIGARRASWRIISSIEQKEESRGNEDHVALIKEYRGKIEAELSKICDGILKLLESHLIPSASAAESKVFYLKMKGDYHRYLAEFKTGAERKDAAESTLLAYKAAQDIALADLAPTHPIRLGLALNFSVFYYEILNSPDRACNLAKQAFDEAISELDTLGEESYKDSTLIMQLLRDNLTLWTSDITEDAGDEIKEAPKRESGEGQ

SEQ ID NO: 22737 - protein, 261 aa, Aristolochia fimbriata
MSPAESSREENVYMAKLAEQAERYEEMVEFMENVAKTVDVEELTVEERNLLSVAYKNVIGARRASWRIISSIEQKEESRGNEDHVTAIKEYRGKIEAELSKICDGILKLLESHLIPSSTAAESKVFYLKMKGDYHRYLAEFKTGAERKEAAESTLLAYKSAQDIALAELTPTHPIRLGLALNFSVFYYEILNSPDRACNLAKQAFDEAISELDTLGEESYKDSTLIMQLLRDNLTLWTSDIQEDPEDSMKESSKRESGEGQ

SEQ ID NO: 22738 - protein, 261 aa, Eschscholzia californica
MSPSESSREENVYMAKLAEQAERYEEMVEFMEKVAKTVDVEELTVEERNLLSVAYKNVIGARRASWRIISSIEQKEESRGNEDHVSIIKEYRAKIETELSKICDGILGLLDSHLVPSSTAAESKVFYLKMKGDYHRYLAEFKSGADRKEAAESTLLAYKSAQDIALAELSPTHPIRLGLALNFSVFYYEILNSPDRACNLAKQAFDEAISELDTLGEESYKDSTLIMQLLRDNLTLWTSDITEDGGDEIKEASKPESGEGQ

SEQ ID NO: 22739 - protein, 258 aa, Allium cepa
MSPVEATREENIYMAKLAEQAERYEEMVEFMEKVAKTVNSEELSVEERNLLSVAYKNVIGARRASWRIISSIEQKEESRGNEDHVKMIKEYRGNVEVELSKICDGILKLLETHLVPSSTAAESKVFYLKMKGDYYRYLAEFKSGDERKEAAENTLTAYKSAQDIALTEMPPTHPIRLGLALNFSVFYYEILNSPDRACNLAKQAFDEAISELDSLGEESYKDSTLIMQLLRDNLTLWTSDITEDAGDEIKDASKGEGQ

SEQ ID NO: 22740 - protein, 258 aa, Allium cepa
MSPAEATREENIYMAKLAEQAERYEEMVEFMEKVAKTVSSEELSVEERNLLSVAYKNVIGARRASWRIISSIEQKEESRGNEDHVKMIKEYRGNVEAELSKICDGILKLLETHLIPSSTAAESKVFYLKMKGDYYRYLAEFKSGDERKEAAENTLTAYKSAQDIALAEMPPTHPIRLGLALNFSVFYYEILNSPDRACNLAKQAFDEAISELDSLGEESYKDSTLIMQLLRDNLTLWTSDITEDAGDEIKDASKGEGQ

SEQ ID NO: 22741 - protein, 261 aa, Ananas comosus
MSAVEPSREENVYMAKLAEQAERYEEMVEFMEKVAKTVDVEELTVEERNLLSVAYKNVIGARRASWRIISSIEQKEESRGNENHVSLIKDYRSRVEAELTKICGGILALLDSHLVPASSTAESKVFYLKMKGDYHRYLAEFKTGAERKEAAENTMSAYKAAQDIALAELAPTHPIRLGLALNFSVFYYEILNSPDRACTLAKQAFDEAISELDSLGEESYKDSTLIMQLLRDNLTLWTSDITEDAADDIKEAPKREPGEGQ

SEQ ID NO: 22742 - protein, 256 aa, Panicum virgatum
MSREENVYMAKLAEQAERYEEMVEYMEKVAKTVDVEELTVEERNLLSVAYKNVIGARRASWRIVSSIEQKEESRKNEEHVTLIKEYRGKIEAELSNICDGILKLLDSHLVPSSTAAESKVFYLKMKGDYHRYLAEFKTGAERKESAESTMVAYKAAQDIALAELAPTHPIRLGLALNFSVFYYEILNSPDKACNLAKQAFDEAISELDTLGEESYKDSTLIMQLLRDNLTLWTSDLTEDGAEEGKEAPKGDAGDGQ

SEQ ID NO: 22743 - protein, 261 aa, Musa acuminata
MSPVESSREENVYMAKLAEQAERYEEMVEFMEKVVKTISGEELTVEERNLLSVAYKNVIGARRASWRIVSSIEQKEESRGNEEHVALIKEYRGRIEAELSKICDGILKLLDSHLVPSASAAESKVFYLKMKGDYHRYLAEFKTGAERKEAAESTLVAYKSAQDIALAELAPTHPIRLGLALNFSVFYYEILNSPDRACSLAKQAFDEAISELDTLGEESYKDSTLIMQLLRDNLTLWTSDITEDGADEIKEAPKKESGDGQ

SEQ ID NO: 22744 - protein, 260 aa, Musa acuminata
MSPAESSREDNVYMAKLAEQAERYEEMVEFMEKVAKTVDVEELTVEERNLLSVAYKNVIGARRASWRIISSIEQKEESRGNEDHVSLIKEYRGKIEAELSKICDGILKLLDSHLISSSTTAESKVFYLKMKGDYHRYLAEFKTGAERKEAAESTLSAYKSAQDIALAELAPTHPIRLGLALNFSVFYYEIVNSPDRACSLAKQAFDEAISELDTLSEESYKDSTLIMQLLRDNLTLWTSDITEDAGDEIKEPLVRESGGQ

SEQ ID NO: 22745 - protein, 261 aa, Musa acuminata
MSPAESSRADNVYMAKLAEQAERYEEMVEFMEKVAKTVDVEELTVEERNLLSVAYKNVIGARRASWRIISSIEQKEESRGNEDHVSVIKEYRGKIEAELSKICDGILKLLESHLIPSSTAAESKVFYLKMKGDYHRYLAEFKTGNERKEAAESTLVAYNSAQDIALAELAPTHPIRLGLALNFSVFYYEIVNSPDRACSLAKQAFDEAISELDTLSEESYKDSTLIMQLLRDNLTLWTSDINDDVGDEIKEAPKQESGEGQ

SEQ ID NO: 22746 - protein, 256 aa, Brachypodium distachyon
MSREDNVYMAKLAEQAERYEEMVEYMEKVAKTVDVEELTVEERNLLSVAYKNVIGARRASWRIVSSIEQKEEGRGNEDHVTLIKDYRGKIEAELSKICDGILKLLDSHLVPMSTAAESKVFYLKMKGDYHRYLAEFKASAERKEAAESTMVAYKAAQDIALAELAPTHPIRLGLALNFSVFYYEILNSPDKACNLAKQAFDEAISELDTLGEESYKDSTLIMQLLRDNLTLWTSDLTEEGAEEGKEASKGEAGEGQ

SEQ ID NO: 22747 - protein, 261 aa, Cocos nucifera
MSSAESTREENVYMAKLAEQAERYEEMIESMEKVVKTVDTEELTVEERNLLSVAYKNVIGARRASWRIISSIEQKEESRGNEDRVALIKEYRGKIEAELSNICDGILKLLDSHLIPSSTAAESKVFYLKMKGDYHRYLAEFKTGAEKKEAAESTLVAYKAAQDIALAELAPTHPIRLGLALNFSVFYYEILNSPDRACSLAKQAFDEAISELDSLGEESYKDSTLIMQLLRDNLTLWTSDITEDAGDEIKAASKKEAGEGP

SEQ ID NO: 22748 - protein, 256 aa, Zea mays
MSREENVYMAKLAEQAERYEEMVEYMEKVAKTVDVEELTVEERNLLSVAYKNVIGARRASWRIVSSIEQKEESRKNEEHVNLIKEYRGKIEAELSNICDGILKLLDSHLVPSSTAAESKVFYLKMKGDYHRYLAEFKTGAERKESAESTMVAYKAAQDIALAELAPTHPIRLGLALNFSVFYYEILNSPDKACNLAKQAFDEAISELDSLGEESYKDSTLIMQLLRDNLTLWTSDLTEDGADEGKDAPKGDAGEGQ

SEQ ID NO: 22749 - protein, 257 aa, Phalaenopsis aphrodite
MSSAESSREENVYLAKLAEQAERYEEMVEFMEKVAKTVDVEELTVEERNLLSVAYKNVIGARRASWRIISSIEQKEESRGNEDHVAIIKDYRGKIEAELSKICDGILKLLDSHLIPSATAAESKVFYLKMKGDYHRYLAEFKTGAERKEAAENTLLAYKSAQDIALADLTPTHPIRLGLALNFSVFYYEILNSPDRACNLAKQAFDEAISELDTLGEESYKDSTLIMQLLRDNLTLWTSDINEDAGDEIKEAPKQES

SEQ ID NO: 22750 - protein, 264 aa, Amborella trichopoda
MSPAESSREENVYMAKLAEQAERYEEMVEFMENVAKTVDVEELTVEERNLLSVAYKNVIGARRASWRIISSIEQKEESRGNEDHVAIIKEYRGKIESELSKICDGILRLLDSHLIPSSTAAESKVFYLKMKGDYHRYLAEFKTGAERKEAAESTLVAYKSAQDIALAELTPTHPIRLGLALNFSVFYYEILNSPDRACNLAKQAFDEAISELDTLGEESYKDSTLIMQLLRDNLTLWTSDLQDQEDGGDEIKEASTKRESGDGQ

SEQ ID NO: 22751 - protein, 261 aa, Platanus occidentalis
MSSAEYSREENVYMAKLAEQAERYEEMVEFMEKVAKTDVEELTVEERNLLSVAYKNVIGARRASWRIISSIEQKEESRGNEDHVVAIKEYRAKIESELSKICDGILGLLDSHLIPSSTAAESKVFYLKMKGDYHRYLAEFKTGAERKEAAESTLLAYKSAQDIALAELAPTHPIRLGLALNFSVFYYEILNSPDRACNLAKQAFDEAISELDTLGEESYKDSTLIMQLLRDNLTLWTSDITEDTGDEIKEAPKRESGEGQQ

SEQ ID NO: 22752 - protein, 261 aa, Amorphophallus konjac
MSSAESSREENVYMAKLAEQAERYEEMVEFMEKVVKVVDTEELTVEERNLLSVAYKNVIGARRASWRIISSIEQKEESRGNEDHVALIKEYRGKIEAELSKICDGILKLLESHLIPSASAAESKVFYLKMKGDYHRYLAEFKTGAERKDAAESTLLAYKSAQDIALADLAPTHPIRLGLALNFSVFYYEILNSPDRACNLAKQAFDEAISELDTLGEESYKDSTLIMQLLRDNLTLWTSDITEDAGDEIKEAPKREAGEGQ

SEQ ID NO: 22753 - protein, 256 aa, Cenchrus ciliaris
MSREENVYMAKLAEQAERYEEMVEYMEKVAKTVDVEELTVEERNLLSVAYKNVIGARRASWRIVSSIEQKEESRKNEEHVNLIKEYRGKIEAELSNICDGILKLLDSHLVPSSTAAESKVFYLKMKGDYHRYLAEFKTGAERKESAESTMVAYKAAQDIALAELAPTHPIRLGLALNFSVFYYEILNSPDKACNLAKQAFDEAISELDTLGEESYKDSTLIMQLLRDNLTLWTSDLTEDGAEEVKEAPKGDAGEGQ

SEQ ID NO: 22754 - protein, 255 aa, Echinochloa colona
MSREENVYMAKLAEQAERYEEMVEYMEKVAKTVDVEELTVEERNLLSVAYKNVIGARRASWRIVSSIEQKEESRKNEEHVNLIKEYRGKIEAELSNICDGILKLLDSHLVPSSTAAESKVFYLKMKGDYHRYLAEFKTGAERKESAESTMVAYKAAQDIALAELAPTHPIRLGLALNFSVFYYEILNSPDKACNLAKQAFDEAISELDTLGEESYKDSTLIMQLLRDNLTLWTSDLTEDGAEEGKEAPKGDGEGQ

SEQ ID NO: 22755 - protein, 256 aa, Panicum virgatum
MSREENVYMAKLAEQAERYEEMVEYMEKVAKTVDVEELTVEERNLLSVAYKNVIGARRASWRIVSSIEQKEESRKNEEHVTLIKEYRGKIEAELSNICDGILKLLDSHLVPSSTAAESKVFYLKMKGDYHRYLAEFKTGAERKESAESTMVAYKAAQDIALAELAPTHPIRLGLALNFSVFYYEILNSPDKACNLAKQAFDEAISELDTLGEESYKDSTLIMQLLRDNLTLWTSDLTEDGAEEGKEAPKGDAVEGQ

SEQ ID NO: 22756 - protein, 261 aa, Musa acuminata
MSPVESPREENVYLAKLAEQAERYEEMVEFMEKVVKTINKEELTVEERNLLSVAYKNVIGARRASWRIISSIEQKEESRGNEDHVALIKEYRGKVEAELSKICDGILKLLDSHLVPSATSAESKVFYLKMKGDYHRYLAEFKTGAERKEAAESTLVAYKSAQDIALAELAPTHPIRLGLALNFSVFYYEILNSPDRACSLAKQAFDEAISELDTLGEESYKDSTLIMQLLRDNLTLWTSDITEDGADEIKETPKKESGEGQ

SEQ ID NO: 22757 - protein, 256 aa, Cenchrus ciliaris
MSREENVYMAKLAEQAERYEEMVEYMEKVAKTVDVEELTVEERNLLSVAYKNVIGARRASWRILSSIEQKEESRKNEEHVNLIKEYRGKIEAELSNICDGILKLLDSHLVPSSTAAESKVFYLKMKGDYHRYLAEFKTGAERKESAESTMAAYKAAQDIALAELAPTHPIRLGLALNFSVFYYEILNSPDKACNLAKQAFDEAISELDTLGEESYKDSTLIMQLLRDNLTLWTSDLTEDGAEEVKEAPKGDAGEGQ

SEQ ID NO: 22758 - protein, 255 aa, Echinochloa colona
MSREENVYMAKLAEQAERYEEMVEYMEKVAKTVDVEELTVEERNLLSVAYKNVIGARRASWRIVSSIEQKEESRKNEEHVNLIKEYRGKIEAELSNICDGILKLLDSHLVPSSTAAESKVFYLKMKGDYHRYLAEFKTGAERRESAESTMVAYKAAQDIALAELAPTHPIRLGLALNFSVFYYEILNSPDKACNLAKQAFDEAISELDTLGEESYKDSTLIMQLLRDNLTLWTSDLTEDGAEEGKEAPKGDGEGQ

SEQ ID NO: 22759 - protein, 256 aa, Setaria italica
MSREENVYMAKLAEQAERYEEMVEYMEKVAKTVDVEELTVEERNLLSVAYKNVIGARRASWRIVSSIEQKEESRKNEEHVSLIKEYRGKIEAELSNICDGILKLLDSHLVPSSSAAESKVFYLKMKGDYHRYLAEFKTGAERKESAESTMVAYKAAQDIALAELAPTHPIRLGLALNFSVFYYEILNSPDKACNLAKQAFDEAISELDTLGEESYKDSTLIMQLLRDNLTLWTSDLTEDGAEEGKEAPKGDAGEGQ

SEQ ID NO: 22760 - protein, 260 aa, Panax ginseng
MVSTESSREDNVYMAKLAEQAERYEEMVEFMEKVAKTVDVEELTVEERNLLSVAYKNVIGARRASWRIISSIEQKEESRGNEDHVTIIKEYRGKIEAELSKICDGILNLLESHLVPSASSAESKVFYLKMKGDYHRYLAEFKTGAERKEAAESTLVAYKSAQDIALAELAPTHPIRLGLALNFSVFYYEILNSPDRACNLAKQAFDEAISELDTLGEESYKDSTLIMQLLRDNLTLWTSDIMDEAGDEIKEAPKQSGEGQ

SEQ ID NO: 22761 - protein, 260 aa, Panax ginseng
MVSTESSREDNVYMAKLAEQAERYEEMVEFMEKVAKTVDIEELTVEERNLLSVAYKNVIGARRASWRIISSIEQKEESRGNEDHVTIIKEYRGKIETELSKICDGILNLLESHLVPSASSAESKVFYLKMKGDYHRYLAEFKTGAERKEAAESTLVAYKSAQDIALAELAPTHPIRLGLALNFSVFYYEILNSPDRACNLAKQAFDEAISELDTLGEESYKDSTLIMQLLRDNLTLWTSDIMDEAGDEIKEAPKQSGEGQ

SEQ ID NO: 22762 - protein, 256 aa, Oryza sativa
MSREENVYMAKLAEQAERYEEMVEYMEKVAKTVDVEELTVEERNLLSVAYKNVIGARRASWRIVSSIEQKEEGRGNEEHVTLIKEYRGKIEAELSKICDGILKLLDSHLVPSSTAAESKVFYLKMKGDYHRYLAEFKTGAERKEAAESTMVAYKAAQDIALADLAPTHPIRLGLALNFSVFYYEILNSPDKACNLAKQAFDEAISELDTLGEESYKDSTLIMQLLRDNLTLWTSDLTEDGGDEVKEASKGDAGEGQ

SEQ ID NO: 22763 - protein, 256 aa, Oryza sativa
MSREENVYMAKLAEQAERYEEMVEYMEKVAKTVDVEELTVEERNLLSVAYKNVIGARRASWRIVSSIEQKEEGRGNEEHVTLIKEYRGKIEAELSKICDGILKLLDSHLVPSSTAAESKVFYLKMKGDYHRYLAEFKTGAERKEAAESTMVAYKAAQDIALADLAPTHPIRLGLALNFSVFYYEILNSPDKACNLAKQAFDEAISELDTLGEESYKDSTLIMQLLRDNLTLWTSDLTEDGGDEVKEASKGDACEGQ

SEQ ID NO: 22764 - protein, 262 aa, Amorphophallus konjac
MSPAESSREENVYMAKLAEQAERYEEMVEFMENVVKTVESDELTVEERNLLSVAYKNVIGARRASWRIISSIEQKEESRGNEDHVATIKEYRGRIEAELSKICDGILKLLESHLIPSATAAESKVFYLKMKGDYHRYLAEFKTGADRKDSAENTLLAYKSAQDIALADLAPTHPIRLGLALNFSVFYYEILNSPDRACNLAKQAFDEAISELDTLGEESYKDSTLIMQLLRDNLTLWTSDITEDAGDEIKEAPPKRESGEGQ

SEQ ID NO: 22765 - protein, 256 aa, Pennisetum glaucum
  Sequence also found in Organisms: Cenchrus ciliaris
MSREENVYMAKLAEQAERYEEMVEYMEKVAKTVDVEELTVEERNLLSVAYKNVIGARRASWRIVSSIEQKEESRKNEEHVNLIKEYRGKIEAELSNICDGILKLLDSHLVPSSTAAESKVFYLKMKGDYHRYLAEFKTGAERKESAESTMVAYKAAQDIALAELAPTHPIRLGLALNFSVFYYEILNSPDKACNLAKQAFDEAISELDTLGEESYKDSTLIMQLLRDNLTLWTSDLTEDGAEDGKEATKGDAGEGQ

SEQ ID NO: 22766 - protein, 256 aa, Cynodon dactylon
MSREENVYMAKLAEQAERYEEMVEYMEKVAKTVDVEELTVEERNLLSVAYKNVIGARRASWRIVSSIEQKEESRKNEDHVNLIKEYRGKIEAELSNICDGILKLLDSHLVPSSTVAESKVFYLKMKGDYHRYLAEFKTDAERKESAESTMVAYKAAQDIALAELAPTHPIRLGLALNFSVFYYEILNSPDKACNLAKQAFDEAISELDTLGEESYKDSTLIMQLLRDNLTLWTSDLTEEGAEEGKEAPKGDAGEGQ

SEQ ID NO: 22767 - protein, 256 aa, Setaria italica
MSREENVYMAKLAEQAERYEEMVEYMEKVAKTVDVEELTVEERNLLSVAYKNVIGARRASWRIVSSIEQKEESRKNEEHVNLIKEYRGKIEAELSNICDGILKLLDSHLVPSSTAAESKVFYLKMKGDYHRYLAEFKTGTERKESAESTMVAYKAAQDIALAEMAPTHPIRLGLALNFSVFYYEILNSPDKACNLAKQAFDEAISELDTLGEESYKDSTLIMQLLRDNLTLWTSDLTEDGADEGKEASKGDAGEGQ

SEQ ID NO: 22768 - protein, 260 aa, Panax ginseng
MVSTESSREDNVYMAKLAEQAERYEEMVEFMEKVAKTVDVEELTVEERNLLSVAYKNVIGARRASWRIISSIEQKEESRGNEDHVIIIKEYRGKIEAELSKICDGILNLLESHLVPSASSAESKVFYLKMKGDYHRYLAEFKTGAERKEAAESTLVAYKSAQDIALAELAPTHPIRLGLALNFSVFYYEILNSPDRACNLAKQAFDEAISELDTLGEESYKDSTLIMQLLRDNLTLWTSDIMDEAGDEIKEAPKQSGEGQ

SEQ ID NO: 22769 - protein, 256 aa, Ananas comosus
MSREENVYMAKLAEQAERYEEMVEFMEKVAKSADTEELTVEERNLLSVAYKNVIGARRASWRIISSIEQKEESRGNEDHVALIKEYRGKIEAELSKICDGILKLLDSHLVPSATTAESKVFYLKMKGDYHRYLAEFKTGAERKEAAESTLLAYKSAQDIALAELAPTHPIRLGLALNFSVFYYEILNSPDRACNLAKQAFDEAISELDTLGEESYKDSTLIMQLLRDNLTLWTSDITDEAGDEIKEAPKRESAEGQ

SEQ ID NO: 22770 - protein, 256 aa, Sorghum bicolor
MSREENVYMAKLAEQAERYEEMVEYMEKVAKTVDVEELTVEERNLLSVAYKNVIGARRASWRIVSSIEQKEESRKNEEHVNLIKEYRGKIEAELSNICDGILKLLDSHLVPSSTAAESKVFYLKMKGDYHRYLAEFKTGAERKESAESTMVAYKAAQDIALAELAPTHPIRLGLALNFSVFYYEILNSPDKACNLAKQAFDEAISELDTLGEESYKDSTLIMQLLRDNLTLWTSDLTEDGADECKEASKGDAGEGQ

SEQ ID NO: 22771 - protein, 256 aa, Saccharum officinarum
MSREENVYMAKLAEQAERYEEMVEYMEKVAKTVDVEELTVEERNLLSVAYKNVIGARRASWRIVSSIEQKEESRKNEEHVNLIKEYRGKIEAELSNICDGILKLLDSHLVPSSTAAESKVFYLKMKGDYHRYLAEFKTGAERKESAESTMVAYKAAQDIALAELAPTHPIRLGLALNFSVFYYEILNSPDKACNLAKQAFDEAISELDTLGEESYKDSTLIMQLLRDNLTLWTSDLTEDGADEGKEASKGDAGEGQ

SEQ ID NO: 22772 - protein, 256 aa, Saccharum officinarum
MSREENVYMAKLAEQAERYEEMVEYMEKVAKTVDVEELTVEERNLLSVAYKNVIGARRASWRIVSSIEQKEESRKNEEHVAQIKEYRGKIEAELSNICDGILKLLDSHLVPSSTAAESKVFYLKMKGDYHRYLAEFKTGTERKESAESTMVAYKAAQDIALAELAPTHPIRLGLALNFSVFYYEILNSPDKACNLAKQAFDEAISELDTLGEESYKDSTLIMQLLRDNLTLWTSDITEEGIEEGKEATKGDAGEGQ

SEQ ID NO: 22773 - protein, 260 aa, Tabernaemontana elegans
MVPPESREENVYMAKLAEQAERYEEMVEFMEKVAKTVDVEELTVEERNLLSVAYKNVIGARRASWRIISSIEQKEESRGNEDHVNTIKEYRGKIEAELSKICDGILSLLESHLIPSASAAESKVFYLKMKGDYHRYLAEFKTGAERKEAAESTLLAYKSAQDIALSELPPTHPIRLGLALNFSVFYYEILNSPDRACNLAKQAFDEAIAELDTLGEESYKDSTLIMQLLRDNLTLWTSDVTEDAGDEIKEASKTEKGDGQ

SEQ ID NO: 22774 - protein, 261 aa, Spinacia oleracea
MLAVEGSREENVYLAKLAEQAERYEEMVEFMEKVAKTADVELTVEERNLLSVAYKNVIGARRASWRITSSIEQKEESRGNEDHVTIIKEYRGKIEAELSKICEGILKLLDSHLVPSATASESKVFYLKMKGDYHRYLAEFKSGTERKDAAEHTLLAYKSAQDIALTELPPTHPIRLGLALNFSVFYYEILNSPDRACALAKQAFDEAISELDTLGEESYKDSTLIMQLLRDNLTLWTSDNAEDVGDEIKEASKDEAAPGQQ

SEQ ID NO: 22775 - protein, 260 aa, Amaranthus tuberculatus
MSPAEGSRDENVYLAKLAEQAERYEEMVEFMEKVAKTVDVEELTVEERNLLSVAYKNVIGARRASWRIISSIEQKEETRGNDDHVAIIKEYRGKIEAELSKICDGILKLLDSHLVPSATAAESKVFYLKMKGDYHRYLAEFKAGAERKEAAEHTLLAYKSAQDIALAELPPTHPIRLGLALNFSVFYYEILNSPDRACALAKQAFDEAISELDTLGEESYKDSTLIMQLLRDNLTLWTSDNTDDVDEIKEASKDEAAPGQ

SEQ ID NO: 22776 - protein, 261 aa, Amsonia hubrichtii
MMPPESREENVYIAKLAEQAERYEEMVEFMEKVAKTVDVEELTVEERNLLSVAYKNVIGARRASWRIISSIEQKEESRGNEDHVNIIKEYRGKIEAELSKICDGILSLLESHLIPSASAAESKVFYLKMKGDYHRYLAEFKTGAERKEAAESTLLAYKSAQDIALADLAPTHPIRLGLALNFSVFYYEILNSPDRACNLAKQAFDEAISELDTLGEESYKDSTLIMQLLRDNLTLWTSDISEEAGDEIKEAPKTEKGEGQQ

SEQ ID NO: 22777 - protein, 262 aa, Amsonia hubrichtii
MVPTESSREENVYMAKLAEQAERYEEMVEFMEKVAKGADAEELTVEERNLLSVAYKNVIGARRASWRIISSIEQKEESRGNEDHVVIIKDYRGKIEAELTKICDGILRLLDTHLIPSANTAESKVFYLKMKGDYHRYLAEFKTGAERKEAAENTLVAYKSAQDIALTELPPTHPIRLGLALNFSVFYYEILNSPDRACALAKQAFDEAISELDTLGEESYKDSTLIMQLLRDNLTLWTSDVPEDAGAEIKEASTTEPVDGQK

SEQ ID NO: 22778 - protein, 261 aa, Musa acuminata
MSPVESPREENVYMAKLAEQAERYEEMVEFMETVVKTINGEELTVEERNLLSVAYKNVIGARRASWRIISSIEQKEESRGNEDHVTLIKEYRSKVEAELSKICDGILKLLDTHLVPSATTAESKVFYLKMKGDYHRYLAEFKTGAERKEAAESTLLAYKSAQDIALADLAPTHPIRLGLALNFSVFYYEILNSPDRACSLAKQAFDEAISELDTLGEESYKDSTLIMQLLRDNLTLWTSDITEDGADEIKEAPKKESGEGQ

SEQ ID NO: 22779 - protein, 261 aa, Musa acuminata
MSPVESSREGNVYMAKLAEQAERYEEMVEFMEKVVKTINGEELTVEERNLLSVAYKNVIGARRASWRIVSSIEQKEESRGNEDHVALIKEYRGKVEAELSKICDGILKLLDSHLVPSATATESKVFYLKMNGDYHRYLAEFKTGAERKEAAESTLSAYKSAQDIALAELASTHPIRLGLALNFSVFYYEILNSPDRACSLAKQAFDEAISELDTLGEESYKDSTLIMQLLRDNLTLWTSDITEDGADEIKEAPKKESGEDQ

SEQ ID NO: 22780 - protein, 261 aa, Cocos nucifera
MSSAESTREENVYMAKLAEQAERYEEMIESMEKVVKTVDTEELTVEERNLLSVAYKNVIGARRASWRIISSIEQKEESRGNEDHVAMIKEYRGKIEAELSKICDSILKLLDSHLIPSAAAAESKVFYLKMKGDYHRYLAEFKTGVERKEAAENTLMAYKSAQDIALAELAPTHPIRLGLALNFSVFYYEILNSPDRACSLAKQAFDEAISELDTLGEESYKDSTLIMQLLRDNLTLWTSDITEDAGVEIKEAPKKEAGERQ

SEQ ID NO: 22781 - protein, 257 aa, Festuca arundinacea
MSREENVYMAKLAEQAERYEEMVEYMEKVAKTVDVEELTVEERNLLSVAYKNVIGARRASWRIVSSIEQKEEGRGNEEHVTLIKEYRGKIEAELSKICDGILKLLDLHLVPMSTAAESKVFYLKMKGDYHRYLAEFKASAERKEAAESTMVAYKAAQDIALAELAPTHPIRLGLALNFSVFYYEILNSPDKACNLAKQAFDEAISELDTLGEESYKDSTLIMQLLRDNLTLWTSDLTEEGGAEDGKEASKGEGGEGQ

SEQ ID NO: 22782 - protein, 257 aa, Festuca arundinacea
MSREENVYMAKLAEQAERYEEMVEYMEKVAKTVDVEELTVEERNLLSVAYKNVIGARRASWRIVSSIEQKEEGRGNEEHVTLIKEYRGKIEAELSKICDGILKLLDSHLVPMSTAAESKVFYLKMKGDYHRYLAEFKASAERKEAAESTMVAYKAAQDIALAELAPTHPIRLGLALNFSVFYYEILNSPDKACNLAKQAFDEAISELDTLGEESYKDSTLIMQLLRDNLTLWTSDLTEEGGAEDGKEASKGEGAEGQ

SEQ ID NO: 22783 - protein, 255 aa, Setaria italica
MSREENVYMAKLAEQAERYEEMVEYMEKVAKTVDVEELTVEERNLLSVAYKNVIGARRASWRIVSSIEQKEESRKNEEHVAQIKEYRGKIEAELSNICDGILKLLDSHLVPSSTAAESKVFYLKMKGDYHRYLAEFKTGTERKESAESTMVAYKAAQDIALAELAPTHPIRLGLALNFSVFYYEILSSPDKACNLAKQAFDEAISELDTLGEESYKDSTLIMQLLRDNLTLWTSDLTEDGAEEGKEAPKGDAGEA

SEQ ID NO: 22784 - protein, 256 aa, Zea mays
MAREENVYMAKLAEQAERYEEMVEYMEKVAKTVDVEELTVEERNLLSVAYKNVIGARRASWRIVSSIEQKEESRKNEEHVNLIKEYRAKIEAELSNICDGILKLLDSHLVPSSTAAESKVFYLKMKGDYHRYLAEFKTGPERKESAESTMMAYKAAQDIALAELAPTHPIRLGLALNFSVFYYEILNSPDKACNLAKQAFDEAISQLDTLGEESYKDSTLIMQLLRDNLTLWTSDLTEDGADEGKEAPKGEAGDGQ

SEQ ID NO: 22785 - protein, 261 aa, Elaeis guineensis
MSSAESTREENVYMAKLAEQAERYEEMIESMEKVVKTVDTEELTVEERNLLSVAYKNVIGARRASWRIISSIEQKEESRGNEDHVAVIKEYRGKIEAELSKICDGILKLLDSHVIPSAAAAESKVFYLKMKGDYHRYLAEFKTGAERKEAAENTLMAYKSAQDIALAELAPTHPIRLGLALNFSVFYYEILNSPDRACSLAKQAFDEAISELDTLGEESYKDGTLIMQLLRDNLTLWTSDITEDAGDEIKEAPKKEAGEGQ

SEQ ID NO: 22786 - protein, 260 aa, Phalaenopsis aphrodite
MSPAEPSREDNVYLAKLSEQAERYEEMVEFMEKVAKTVDEEELTVEERNLLSVAYKNVIGARRASWRIISSIEQKEESRGNEDHVALIKEYRSKIEHELSKICDGILKLLDSNLIPSAKAAESKVFYLKMKGDYHRYLAEFKTGAERKDAAENTLLAYKSAQDIALADLAPTHPIRLGLALNFSVFYYEILNSPDRACNLAKQAFDEAISELDTLGEESYKDSTLIMQLLRDNLTLWTSDINEDTGDELKDAPKVEAAEP

SEQ ID NO: 22787 - protein, 262 aa, Platanus occidentalis
MSPAESSREENVYLAKLAEQAERYEEMVEFMENVAKTVDVEELTVEERNLLSVAYKNVIGARRASWRIISSIEQKEESRGNEDHVVAIKEYRGKIESELSNICDGILRLLDSHLIPSSTAAESKVFYLKMKGDYHRYLAEFKTGPDRKEAAESTLLAYKSAQDIALADLTPTHPIRLGLALNFSVFYYEILNSPDRACNLAKQAFDEAISELDTLGEESYKDSTLIMQLLRDNLTLWTSDITEDNGDEIKEAPKRDSGEGQQ

SEQ ID NO: 22788 - protein, 262 aa, Podocarpus macrophillus
MAPVESSREENVYMAKLAEQAERYEEMVEFMEKVAKTVDVEELTVEERNLLSVAYKNVIGARRASWRIISSIEQKEESRGNDEHVVMIKEYRAKVESELSNICDGILGLLDSHLIPSSTSGESKVFYLKMKGDYHRYLAEFKTGAERKEAAESTLLAYKSAQDIALAELAPTHPIRLGLALNFSVFYYEILNSPDRACTLAKQAFDEAIAELDTLGEESYKDSTLIMQLLRDNLTLWTSDMNEDTADEIKEAPSKREEGDGQ

SEQ ID NO: 22789 - protein, 256 aa, Valeriana officinalis
MSREENVYMAKLAEQAERYEEMVEFMEKVAKTVDVEELTVEERNLLSVAYKNVIGARRASWRIISSIEQKEESRGNDDHVALIKDYRGKIETELSKICDGILLLLDSHLVPSASSAESKVFYLKMKGDYHRYLAEFKTGAERKDAAESTLVAYKSAQDIALADLAPTHPIRLGLALNFSVFYYEILNSPDRACNLAKQAFDEAISELDTLGEESYKDSTLIMQLLRDNLTLWTSDLTDEAGDEIKESSKPESGDAQ

SEQ ID NO: 22790 - protein, 261 aa, Citrullus lanatus
MSPVDSSREENVYMAKLAEQAERYEEMVEFMEKVAKTVDVEELTVEERNLLSVAYKNVIGARRASWRIISSIEQKEESRGNEDHVAIIKDYRGKIETELSKICDGILSLLESHLIPSASSAESKVFYLKMKGDYHRYLAEFKTGAERKEAAESTLLAYKSAQDIALAELAPTHPIRLGLALNFSVFYYEILNSPDRACNLAKQAFDEAISELDTLGEESYKDSTLIMQLLRDNLTLWTSDIGDEAGDEIKEASKRESGEGQ

SEQ ID NO: 22791 - protein, 263 aa, Euonymus alatus
MSSDSSREENVYMAKLAEQAERYEEMVEFMEKVAKTVDVEELTVEERNLLSVAYKNVIGARRASWRIISSIEQKEESRGNEDHVTIIKEYRGKIESELSKICDGILNLLESHLVPSASAAESKVFYLKMKGDYHRYLAEFKTGAERKEAAESTLLAYKSAQDIALAELAPTHPIRLGLALNFSVFYYEILNSPDRACNLAKQAFDEAISELDTLGEESYKDSTLIMQLLRDNLTLWTSDITDDAGDEIKEASSKRESGEGQQS

SEQ ID NO: 22792 - protein, 262 aa, Catharanthus roseus
MLPTELSREENVYMAKLAEQAERYEEMVEFMEKVAKGADSDELTVEERNLLSVAYKNVIGARRASWRIISSIEQKEESRGNEDHVSIIKDYRGKIEAELTNICNGILRLLDTHLIPSANISESKVFYLKMKGDYHRYLAEFKTGAERKEAAENTLVAYKSAQDIALAELPPTHPIRLGLALNFSVFYYEILNSPDRACALAKQAFDEAISELDTLGEESYKDSTLIMQLLRDNLTLWTSDVPEDAGAEIKEASTAEAGNVQK

SEQ ID NO: 22793 - protein, 257 aa, Avena sativa
MSREENVYMAKLAEQAERYEEMVEYMEKVAKTVDVEELTVEERNLLSVAYKNVIGARRASWRIVSSIEQKEEGRGNEEHVTLIKEYRGKIEAELSKICDGILKLLDSHLVPMSAAAESKVFYLKMKGDYHRYLAEFKASAERKEAAESTMVAYKAAQDIALAELAPTHPIRLGLALNFSVFYYEILNSPDKACNLAKQAFDEAISELDTLGEESYKDSTLIMQLLRDNLTLWTSDLTEEGGAEDGKEALKGDAGEGQ

SEQ ID NO: 22794 - protein, 256 aa, Allium cepa
MSATRDENVYMAKLAEQAERYEEMVEFMEKVAKTVDADELTVEERNLLSVAYKNVIGARRASWRIISSIEQKEESRGNEDHVVMIKEYRGKIEAELSKICDGILNLLDTHLVPSSTAAESKVFYLKMKGDYHRYLAEFKTGAERKEAAESTLIAYKSAQDIALAELPPTHPIRLGLALNFSVFYYEILNSPDRACSLAKQAFDEAISELDTLGEESYKDSTLIMQLLRDNLTLWTSDLTEDAGDEIKEAVPKQEGQ

SEQ ID NO: 22795 - protein, 261 aa, Populus trichocarpa
MSPTESSREEHVYMAKLAEQAERYEEMVEFMEKVAKTVDSEELTVEERNLLSVAYKNVIGARRASWRIISSIEQKEESRGNEDHVTIIKEYRGKIEAELSKICDGILNLLESHLIPSASSAESKVFYLKMKGDYHRYLAEFKTGAERKEAAESTLLAYKSAQDIALTELAPTHPIRLGLALNFSVFYYEILNSPDRACNLAKLAFDEAISELDTLGEESYKDSTLIMQLLRDNLTLWTSDITDDADEIKEASKRESGDGLQ

SEQ ID NO: 22796 - protein, 262 aa, Pteridium aquilinum
MSPTESSREENVYMAKLAEQAERYEEMVEFMEKVAKTVDVEELTVEERNLLSVAYKNVIGARRASWRIISSIEQKEESRGNEDHVAIIKEYRGKIEAELSKICDGILSLLESHLIPSASSAESKVFYLKMKGDYHRYLAEFKTGVERKEAAESTLLAYKPAQDIALAELAPTHPIRLGLALNFSVFYYEILNSPDRACNLAKQAFDEAISELDTLGEESYKDSTLIMQLLRDNLTLWTSDITDEAGDEIKEASKRESGEGQQ

SEQ ID NO: 22797 - protein, 261 aa, Tripterygium wilfordii
MSPDSSREENVYMAKLAEQAERYEEMVEFMEKVAKTVDVEELTVEERNLLSVAYKNVIGARRASWRIISSIEQKEESRGNEDHVTIIKEYRGKIESELSKICDGILNLLESHLIPSASAAESKVFYLKMKGDYHRYLAEFKAGAERKEAAESTLLAYKSAQDIALAELAPTHPIRLGLALNFSVFYYEILNSPDRACNLAKQAFDEAIAELDTLGEESYKDSTLIMQLLRDNLTLWTSDITDDAGDEIKEASSKRESGEGQ

SEQ ID NO: 22798 - protein, 260 aa, Oryza sativa
MSPAEASREENVYMAKLAEQAERYEEMVEFMEKVAKTTDVGELTVEERNLLSVAYKNVIGARRASWRIISSIEQKEESRGNEAYVASIKEYRSRIETELSKICDGILKLLDSHLVPSATAAESKVFYLKMKGDYHRYLAEFKSGAERKEAAENTLVAYKSAQDIALADLPTTHPIRLGLALNFSVFYYEILNSPDRACNLAKQAFDDAIAELDTLGEESYKDSTLIMQLLRDNLTLWTSDNAEDGGDEIKEAAKPEGEGH

SEQ ID NO: 22799 - protein, 260 aa, Amaranthus tuberculatus
MSPAEGSRDENVYLAKLAEQAERYEEMVEFMEKVAKTVDVEELTVEERNLLSVAYKNVIGARRASWRIISSIEQKEETRGNDDHVAIIKEYRGKIEAELSKICDGILKLLDSHLVPSATAAETKVFYLKMKGDYHRYLAEFKAGAERKEAAEHTLLAYKSAQDIALAELPPTHPIRLGLALNFSVFYYEILNSPDRACALAKQAFDEAISELDTLGEESYKDSTLIMQLLRDNLTLWTSDNTDDIDEIKEASKDEAAPGQ

SEQ ID NO: 22800 - protein, 256 aa, Cenchrus ciliaris
MSREENVYMAKLAEQAERYEEMVEYMEKVAKTVDVEELTIEERNLLSVAYKNVIGARRASWRIVSSIEQKEESRKNEEHVAQIKEYRGKIEAELSNICDGILKLLDSHLVPSSTAAESKVFYLKMKGDYHRYLAEFKTGTERKEAAESTMVAYKAAQDIALAELAPTHPIRLGLALNFSVFYYEILSSPDKACNLAKQAFDEAISELDTLGEESYKDSTLIMQLLRDNLTLWTSDLTEDGAEDGKEASKGGDGEAQ

SEQ ID NO: 22801 - protein, 260 aa, Fagopyrum esculentum
MAAEGSREENVYLAKLAEQAERYEEMVEFMEKVAKTVDVEELTVEERNLLSVAYKNVIGARRAAWRIISSIEQKEESRGNEDHVSTIKEYRAKIEAELSKICDGILKLLDTHLVPAAGAAESKVFYLKMKGDYHRYLAEFKTGAERKEAAESTLVAYKAAQDIALADLAPTHPIRLGLALNFSVFYYEILNSPDRACNLAKQAFDEAISELDTLGEESYKDSTLIMQLLRDNLTLWTSDNADDAGEEIKEAAPGEGADGK

SEQ ID NO: 22802 - protein, 256 aa, Pennisetum glaucum
MSREENVYMAKLAEQAERYEEMVEYMEKVAKTVDVEELTIEERNLLSVAYKNVIGARRASWRIVSSIEQKEESRKNEEHVAQIKEYRGKIEAELSNICDGILKLLDSHLVPSSTAAESKVFYLKMKGDYHRYLAEFKTGTERKESAESTMVAYKAAQDIALAELAPTHPIRLGLALNFSVFYYEILSSPDKACNLAKQAFDEAISELDTLGEESYKDSTLIMQLLRDNLTLWTSDLTEDGTEEGKEAPKGGDGEAQ

SEQ ID NO: 22803 - protein, 265 aa, Euphorbia peplus
MSPTELSREEYVYMAKLAEQAERYEEMVEFMEKVAKTVDVEELTVEERNLLSVAYKNVIGARRASWRIISSIEQKEESRGNEDHVTIIKDYRSKIETELSKICDGILNLLESHLVPSASSAESKVFYLKMKGDYHRYLAEFKTGAERKEAAESTLLAYKSAQDIALAELAPTHPIRLGLALNFSVFYYEILNSPDRACNLAKQAFDEAISELDTLGEESYKDSTLIMQLLRDNLTLWTSDITDEAGDEIKEASKRESGEGQPPQQ

SEQ ID NO: 22804 - protein, 261 aa, Brassica rapa
MSSPREENVYLAKLAEQAERYEEMVEFMEKVAKTVDSEELTVEERNLLSVAYKNVIGARRASWRIISSIEQKEESRGNEDHVAIIKDYRGKIETELSKICDGILNLLDSHLVPAASLAESKVFYLKMKGDYHRYLAEFKTGAERKDAAENTLVAYKSAQDIALADLPPTHPIRLGLALNFSVFYYEILNSPDRACNLAKQAFDEAISELDTLGEESYKDSTLIMQLLRDNLTLWTSDINDEAGGDEIKEASKDEPEEGKQA

SEQ ID NO: 22805 - protein, 264 aa, Eucalyptus grandis
MAAADSSREENVYMAKLAEQAERYEEMVEFMEKVAKTVDVEELTVEERNLLSVAYKNVIGARRASWRIISSIEQKEESRGNEDHVVIIKEYRGKIETELSKICDGILNLLESHLVPSASSAESKVFYLKMKGDYHRYLAEFKAGTERKEAAESTLLAYKSAQDIALAELAPTHPIRLGLALNFSVFYYEILNSPDRACSLAKQAFDEAISELDTLGEESYKDSTLIMQLLRDNLTLWTSDVTDEAGDEIKESSKRESGEGQPPQ

SEQ ID NO: 22806 - protein, 263 aa, Euonymus alatus
MSPEASREENVYMAKLAEQAERYEEMVEFMEKVAKTVDVEELTVEERNLLSVAYKNVIGARRASWRIISSIEQKEESRGNEDRVNIIKEYRGKIESELSKICDGILNLLEAHLIPSVSAAESKVFYLKMKGDYHRYLAEFKTGAERKEAAESTLLAYKSAQDIALAELAPTHPIRLGLALNFSVFYYEILNSPDRACNLAKQAFDEAISELDTLGEESYKDSTLIMQLLRDNLTLWTSDITDDAGDEIKEASSKRESGEGQQS

SEQ ID NO: 22807 - protein, 257 aa, Coffea canephora
MSREENVYMAKLAEQAERYEEMVEFMEKVAKTVDSEELTVEERNLLSVAYKNVIGARRASWRIISSIEQKEESRGNEEHVTIIKDYRGKIEAELSKICDGILRLLDTHLIPAASTAESKVFYLKMKGDYHRYLAEFKTGAERKEAAENTLFAYKSAQDIALSELAPTHPIRLGLALNFSVFYYEILNSPDRACSLAKQAFDEAISELDTLGEESYKDSTLIMQLLRDNLTLWTSDVPEDAAGEIKEAPTQETGDITK

SEQ ID NO: 22808 - protein, 263 aa, Cucumis sativus
  Sequence also found in Organisms: Cucumis melo
MSPADSSREENVYMAKLAEQAERYEEMVEFMEKVAKTVDVEELTVEERNLLSVAYKNVIGARRASWRIISSIEQKEESRGNEDHVSIIKDYRGKIETELSKICDGILSLLESHLIPSASSAESKVFYLKMKGDYHRYLAEFKTGAERKEAAESTLLAYKSAQDIALAELAPTHPIRLGLALNFSVFYYEILNSPDRACNLAKQAFDEAISELDTLGEESYKDSTLIMQLLRDNLTLWTSDIGDEAGDEIKEASKRESGEGHGQ

SEQ ID NO: 22809 - protein, 263 aa, Tropaeolum majus
MSQTDSPREENVYLAKLAEQAERYEEMVEFMEKVAKTVDVEELTVEERNLLSVAYKNVIGARRASWRIISSIEQKEESRGNADHVSIIKDYRGKIEAELSKICDGILSLLESHLVPSASSAESKVFYLKMKGDYHRYLAEFKTGSERKEAAESTLLAYKSAQDIALAELAPTHPIRLGLALNFSVFYYEILNSPDRACNLAKQAFDEAISELDTLGEESYKDSTLIMQLLRDNLTLWTSDITDDAGDEIKEASKNDSGDGQQQ

SEQ ID NO: 22810 - protein, 259 aa, Papaver somniferum
MSTSREENVYLAKLAEQAERYEEMVEFMENVAKTVDSEELTVEERNLLSVAYKNVIGARRASWRIISSIEQKEESRGNEDHVSIIKEYRGKIESELHKICQGILGLLDSHLIPSSTAAESKVFYLKMKGDYHRYLAEFKSGSDRKEAAESTLLAYKSAQDIALAELSPTHPIRLGLALNFSVFYYEILNSPDRACTLAKQAFDEAISELDSLGEESYKDSTLIMQLLRDNLTLWTSDIGEDADNEIKEASKHDESKGPE

SEQ ID NO: 22811 - protein, 257 aa, Scabiosa columbaria
MSREENVYMAKLAEQAERYEEMVDFMEKVAKTVDVEELTVEERNLLSVAYKNVIGARRASWRIISSIEQKEESRGNEDHVTLIKDYRGKIETELSKICDGILNLLDSHLVPSASSAESKVFYLKMKGDYHRYLAEFKTGAERKEAAESTLLAYKSAQDIALADLAPTHPIRLGLALNFSVFYYEILNSPDRACNLAKQAFDEAISELDTLGEESYKDSTLIMQLLRDNLTLWTSDLTDEAGDEIKESSKPESGEGQQ

SEQ ID NO: 22812 - protein, 262 aa, Sciadopitys verticillata
MAPMESSREENVYMAKLAEQAERYEEMVEFMEKVAKTVDVEELSVEERNLLSVAYKNVIGARRASWRIISSIEQKEESRGNDEHVTMIREYRAKVESELSNICDGILRLLDSHLVPSSTTGESKVFYLKMKGDYHRYLAEFKTGAERKEAAESTLLAYKSAQDIALAELAPTHPIRLGLALNFSVFYYEILNSPDRACSLAKQAFDEAIAELDTLGEESYKDSTLIMQLLRDNLTLWTSDMNEDTGDEIKEAPSKREEGEGQ

SEQ ID NO: 22813 - protein, 261 aa, Vinca minor
MVVPEAREENVYMAKLAEQAERYEEMVEFMEKVAKTVDVDELTVEERNLLSVAYKNVIGARRASWRIISSIEQKEESRGNEEHVSIIKDYRSKIEAELSKICDGILSLLESHLIPSASTAESKVFYLKMKGDYHRYLAEFKTGAERKEAAESTLLAYKSAQDIALAELPPTHPIRLGLALNFSVFYYEILNSPDRACNLAKQAFDEAISELDTLGEESYKDSTLIMQLLRDNLTLWTSDISEEAGDEIKEAPKTDKGEGQQ

SEQ ID NO: 22814 - protein, 260 aa, Musa acuminata
MSPVESTREENVYLAKLAEQAERYEEMVEFMEKVVKTANVEELTVEERNLLSVAYKNVIGARRASWRIISSIEQKEESRGNEEHVVLIKEYRGKVEAELSKICDGILKLLDSHLVPSASAAESKVFYLKMKGDYHRYLAEFKTGAERKEAAESTLLAYKSSQDIALAELAPTHPIRLGLALNFSVFYYEILNSPDRACSLAKQAFDEAISELDTLGEESYKDSTLIMQLLRDNLTLWTSDMTEDVDEIKEAPKKESGDDQ

SEQ ID NO: 22815 - protein, 261 aa, Musa acuminata
MPPVESPREENVYMAKLAEQAERYEEMVEFMEKVVKTINGEELTVEERNLLSVAYKNVIGARRASWRIISSIEQKEESRGNEDHVALIKEYSGKVEAELSKICDGILKLLDSHLTPSATSAESKVFYLKMKGDYHRYLAEFKTGAERKEAAESTLLAYKSAQDIALAELASTHPIRLGLALNFSVFYYEILNSPDRACSLAKQAFDEAISELDTLGEESYKDSTLIMQLLRDNLTLWTSDITEDGADEINEAPKKESEEGQ

SEQ ID NO: 22816 - protein, 261 aa, Brassica napus
MSSPREENVYLAKLAEQAERYEEMVEFMEKVAKTVDSEELTVEERNLLSVAYKNVIGARRASWRIISSIEQKEESRGNEDHVAIIKDYRGKIETELSKICDGILNLLDSHLVPAASLAESKVFYLKMKGDYHRYLAEFKTGAERKDAAENTLVAYKSAQDIALADLPPTHPIRLGLALNFSVFYYEILNSPDRACNLAKQAFDEAISELDTLGEESYKDSTLIMQLLRDNLTLWTSDINDEAGGDGIKEASKDEPEEGKQA

SEQ ID NO: 22817 - protein, 261 aa, Brassica napus
MSSPREENVYLAKLAEQAERYEEMVEFMEKVAKTVDSEELTVEERNLLSVAYKNVIGARRASWRIISSIEQKEESRGNEDHVAIIKDYRGKIETELSKICDGILNLLDSHLVPAASLAESKVFYLKMKGDYHRYLAEFKTGAERKDAAENTLVAYKSAQDIALSDLPPTHPIRLGLALNFSVFYYEILNSPDRACNLAKQAFDEAISELDTLGEESYKDSTLIMQLLRDNLTLWTSDINDEAGGDEIKEASKDEPEEGKQA

SEQ ID NO: 22818 - protein, 264 aa, Euphorbia esula
MSPTELSPPEYVYMAKLAEQAERYEEMVEFMEKVAKTVDVEELTVEERNLLSVAYKNVIGARRASWRIISSIEQKEESRGNEDHVTIIKDYRSKIETELSKICDGILNLLESHLVPSASSAESKVFYLKMKGDYHRYLAEFKTGAERKEAAESTLLAYKSAQDIALAELAPTHPIRLGLALNFSVFYYEILNSPDRACNLAKQAFDEAISELDTLGEESYKDSTLIMQLLRDNLTLWTSDITDEAGDEIKEASKRESGEGQPPQ

SEQ ID NO: 22819 - protein, 262 aa, Cycas rumphii
MSPVESSREENVYMAKLAEQAERYEEMVEFMEKVAKTVDVEELSVEERNLLSVAYKNVIGARRASWRIISSIEQKEESRGNEDHVVMIREYRGKIESELSSICDSILRLLDSHLIPSSTTGESKVFYLKMKGDYHRYLAEFKTGAERKEAAESTLLAYKSAQDIALAELAPTHPIRLGLALNFSVFYYEILNSPDKACSLAKQAFDEAIAELDTLGEESYKDSTLIMQLLRDNLTLWTSDMQEDAGDEIKEAPSKREEGDSQ

SEQ ID NO: 22820 - protein, 262 aa, Vaccinium corymbosum
MVPTEASREDNVYMAKLAEQAERYEEMVEFMEKVAKTVDAEELTVEERNLLSVAYKNVIGARRASWRIISSIEQKEESRGNEEHVSIIKEYRGKIEAELSKICDGILGLLDSHLIPLASNAESKVFYLKMKGDYHRYLAEFKAGAERKEAAENTLLAYKSAQDIALTELPPTHPIRLGLALNFSVFYYEILNSPDRACNLAKQAFDEAISELDTLGEESYKDSTLIMQLLRDNLTLWTSDITDEAGDEIKEASKGVSGEGPQ

SEQ ID NO: 22821 - protein, 261 aa, Catharanthus roseus
MVPPESREENVYMAKLAEQAERYEEMVEFMEKVAKTVDVEELTVEERNLLSVAYKNVIGARRASWRIISSIEQKEESRGNEEHVNIIKEYRGKIEAELSKICDGILSLLESHLIPSASTAESKVFYLKMKGDYHRYLAEFKTGAERKEAAESTLLAYKSAQDIALAELAPTHPIRLGLALNFSVFYYEILNSPDRACNLAKQAFDEAISELDTLGEESYKDSTLIMQLLRDNLTLWTSDISEEAGDEIKEAAKTDKAEGQQ

SEQ ID NO: 22822 - protein, 262 aa, Gossypium hirsutum
  Sequence also found in Organisms: Gossypium raimondii
MSPTESSREENVYMAKLAEQAERYEEMVEFMEKVAKTVDVEELTVEERNLLSVAYKNVIGARRASWRIISSIEQKEESRGNEDHVAQLKEYRGKIEAELSKICDGILSLLESHLIPLASSAESKVFYLKMKGDYHRYLAEFKTGAERKEAAESTLLAYKSAQDIALAELAPTHPIRLGLALNFSVFYYEILNSPDRACNLAKQAFDEAISELDTLGEESYKDSTLIMQLLRDNLTLWTSDITDEAGDEIKEASKHESGEGQQ

SEQ ID NO: 22823 - protein, 257 aa, Echinochloa colona
MSREENVYMAKLAEQAERYEEMVEYMEKVAKTVDVEELTVEERNLLSVAYKNVIGARRASWRIVSSIEQKEESRKNEEHVAQIKEYRGKIEAELSNICDGILKLLDSHLVPSSTAAESKVFYLKMKGDYHRYLAEFKTGAERKESAESTMVAYKAAQDIALAELAPTHPIRLGLALNFSVFHYEILNSPDKACNLAKQAFDEAISELDTLGEESYKDSTLIMQLLRDNLTLWTSDLTEDGIEEGKEASKGDAGEGAN

SEQ ID NO: 22824 - protein, 256 aa, Allium cepa
MSVTREENVYMAKLAEQAERYEEMVEFMEKVAKSVDAEELTVEERNLLSVAYKNVIGARRASWRIISSIEQKEESRGNENHVVMIKEYRGKIEAELSKICDGILNLLDTHLVPSSTAAESKVFYLKMKGDYHRYLAEFKTGAERKEAAESTLIAYKSAQDIALSDLPPTHPIRLGLALNFSVFYYEILNSPDRACSLAKQAFDEAISELDTLGEESYKDSTLIMQLLRDNLTLWTSDLTEDAGDEIKEAAPKQEGQ

SEQ ID NO: 22825 - protein, 262 aa, Populus trichocarpa
MSPTEPSREESVYMAKLAEQAERYEEMVEFMEKVAKTVDNEELTMEERNLLSVAYKNVIGARRASWRIISSIEQKEESRGNEDHVTIIKEYRGKIEAELSKICDGILSLLETHLVPSASAAESKVFYLKMKGDYHRYLAEFKTGAERKEAAESTLLSYKSAQDIALSELAPTHPIRLGLALNFSVFYYEILNSPDRACSLAKQAFDEAISELDTLGEESYKDSTLIMQLLRDNLTLWTSDITDEAGDEIKEASKRESGDGPQ

SEQ ID NO: 22826 - protein, 262 aa, Tabernaemontana elegans
MVPTESSREENVYMAKLAEQAERYEEMVEFMEKVAKGADAEELTVEERNLLSVAYKNVIGARRASWRIISSIEQKEESRGNEDHVAIIKDYRGKIEAELTRICDGILQLLETHLVPSADTAESKVFYLKMKGDYHRYLAEFKTGAERKEAAENTLVAYKSAQDIALTDLPPTHPIRLGLALNFSVFYYEILNSPDRACALAKQAFDEAISELDTLGEESYKDSTLIMQLLRDNLTLWTSDVPEDSGAEIKEASTNEPRDGQK

SEQ ID NO: 22827 - protein, 260 aa, Nicotiana tabacum
MAESSREENVYMAKLAEQAERYEEMIEFMEKVAKTGDVEELTVEERNLLSVAYKNVIGARRASWRIISSIEQKEESRGNEDHVKTIKEYRAKIEAELSKICDGILGLLESHLIPSASTAESKVFYLKMKGDYHRYLAEFKTGSERKEAAENTLLAYKSAQDIALTELAPTHPIRLGLALNFSVFYYEILNSPDRACNLAKQAFDEAISELDTLGEESYKDSTLIMQLLRDNLTLWTSDNAEDAEDDIKEAPKHESGEGQQ

SEQ ID NO: 22828 - protein, 256 aa, Aquilegia formosa
MSPTESSREENVYLAKLAEQAERYEEMVEFMENVAKTVDVEELTVEERNLLSVAYKNVIGARRASWRIISSIEQKEENRGNEEHVVVIKEYRGKIETELSKICDGILNLLDSHLVPSATAAESKVFYLKMKGDYHRYLAEFKTGADRKEAAESTLLAYKSAQDIAVAELPPTHPIRLGLALNFSVFYYEILNSPDRACSLAKQAFDEAISELDTLGEESYKDSTLIMQLLRDNLTLWTSDITDDAGDEIKEAPKPE

SEQ ID NO: 22829 - protein, 266 aa, Castanea mollissima
  Sequence also found in Organisms: Quercus alba
MSPTDSSREENVYMAKLAEQAERYEEMVEFMEKVAKTVDVEELTVEERNLLSVAYKNVIGARRASWRIISSIEQKEESRGNEDHVVIIKEYRGKIENELSKICDGILGLLETHLIPSASAAESKVFYLKMKGDYHRYLAEFKTGAERKEAAESTLLAYKSAQDIALAELPPTHPIRLGLALNFSVFYYEILNSPDRACNLAKQAFDEAISELDTLGEESYKDSTLIMQLLRDNLTLWTSDITDDAGDEIKEASKRESGEGQPPQQQ

SEQ ID NO: 22830 - protein, 260 aa, Cyclamen graecum
MVQAEASREDSVYMAKLAEQAERYEEMVEFMEKVVKTVDVEELTVEERNLLSVAYKNVIGARRASWRIISSIEQKEESRGNEDHVAIIKEYRGKIETELSKICDGILGLLESHLVPSASTAESKVFYLKMKGDYYRYLAEFKTGAERKEAAENTLLAYKSAQDIALADLAPTHPIRLGLALNFSVFYYEILNSPDRACNLAKQAFDEAISELDTLGEESYKDSTLIMQLLRDNLTLWTSDVADEGGDEIKEASKREMGDE

SEQ ID NO: 22831 - protein, 260 aa, Distylium racemosum
MAPVESSREENVYMAKLAEQAERYEEMVEFMEKVAKTVDVEELTVEERNLLSVAYKNVIGARRASWRIISSIEQKEESRGNDEHVAMIREYRAKVESELSNICDGILRLLDSHLIPSSTTGESKVFYLKMKGDYHRYLAEFKTGAERKEAAESTLLAYKSAQDIALAELAPTHPIRLGLALNFSVFYYEILNSPDRACTLAKQAFDEAIAELDTLGEESYKDSTLIMQLLRDNLTLWTSDMNEDTGDEIKEAPSKEGEGQ

SEQ ID NO: 22832 - protein, 266 aa, Carpinus betulus
MSPADSSREENVYMAKLAEQAERYEEMVEFMEKVAKTVDVEELSVEERNLLSVAYKNVIGARRASWRIISSIEQKEESRGNEDHVAVIKDYRGKIESELSKICDGILSLLESHLIPSASSAESKVFYLKMKGDYHRYLAEFKTGSERKEAAESTLLAYKSAQDIALAELAPTHPIRLGLALNFSVFYYEILNSPDRACNLAKQAFDEAISELDTLGEESYKDSTLIMQLLRDNLTLWTSDITDDAGDEIKEASKRESADGQQPPSQ

SEQ ID NO: 22833 - protein, 260 aa, Orobanche aegyptiaca
MSPADSSREENVYMAKLAEQAERYEEMVEFMEKVVKTVDTDELTVEERNLLSVAYKNVIGARRASWRIISSIEQKEEGRGNEDHVNIIKDYRSKIEAELSKICDGILKLLESHLIPSASSAESKVFYLKMKGDYYRYLAEFKTGSERKEAAESTLLAYKSAQDIALAELAPTHPIRLGLALNFSVFYYEILNSPDRACALAKQAFDEAISELDTLGEESYKDSTLIMQLLRDNLTLWTSDIADDGDDIKEATKRDSGEGQ

SEQ ID NO: 22834 - protein, 257 aa, Phalaenopsis aphrodite
MSSSESSREDNVYMAKLAEQAERYEEMVEFMEKVAKTGSVNELSVEERNLLSVAYKNVIGARRASWRIISSIEQKEEGRGNEDRVTIIKDYRGKIENELSKICDGILKLLDSHLIPSASAAESKVFYLKMKGDYHRYLAEFKTGAERKEAAESTLLAYKSAQDIALAELAPTHPIRLGLALNFSVFYYEILNSPDRACNLAKQAFDEAISELDTLGEESYKDSTLIMQLLRDNLTLWTSDITEDAGDEIKESSKHES

SEQ ID NO: 22835 - protein, 253 aa, Sorghum bicolor
MSREENVYMAKLAEQAERYEEMVEYMEKVAKTVDVEELTVEERNLLSVAYKNVIGARRASWRIVSSIEQKEESRKNEEHVAQIKEYRGKIEAELSNICDGILKLLDSHLVPSSTAAESKVFYLKMKGDYHRYLAEFKTGAERKESAESTMVAYKAAQDIALAELAPTHPIRLGLALNFSVFYYEILNSPDKACNLAKQAFDEAISELDTLGEESYKDSTLIMQLLRDNLTLWTSDITEEGTEEGKEASKGDAE

SEQ ID NO: 22836 - protein, 264 aa, Cannabis sativa
MSPTESSREENVYMAKLAEQAERYEEMVEFMEKVAKTVDVEELTVEERNLLSVAYKNVIGARRASWRIISSIEQKEESRGNEDHVKIIKEYRGKIESELSKICEGILNLLESHLIPSASSAESKVFYLKMKGDYHRYLAEFKTGSERKEAAESTLLAYKSAQDIALAELAPTHPIRLGLALNFSVFYYEILNSPDRACNLAKQAFDEAISELDTLGEDSYKDSTLIMQLLRDNLTLWTSDITDDAGEEIKEASKRETGESTGQQ

SEQ ID NO: 22837 - protein, 264 aa, Manihot esculenta
MLPTESSREENVYMAKLAEQAERYEEMVEFMEKVAKTVDVEELTVEERNLLSVAYKNVIGARRASWRIISSIEQKEESRGNEDHVSIIKEYRGKIEAELSKICDGILSLLESHLIPSASSAESKVFYLKMKGDYHRYLAEFKTAAERKEAAESTLLAYKSAQDIALADLAPTHPIRLGLALNFSVFYYEILNSPDRACNLAKQAFDEAISELDTLGEESYKDSTLIMQLLRDNLTLWTSDITDEAGDEIKDASKRESGEGQPQQ

SEQ ID NO: 22838 - protein, 263 aa, Citrus clementina
  Sequence also found in Organisms: Citrus sinensis
MSPTDSSREENVYMAKLAEQAERYEEMVEFMEKVAKTVDVEELTVEERNLLSVAYKNVIGARRASWRIISSIEQKEESRGNEDHVSVIKEYRSKIENELSKICDGILSLLESHLIPSASSAESKVFYLKMKGDYHRYLAEFKTGAERKEAAESTLLAYKSAQDIALAELAPTHPIRLGLALNFSVFYYEILNSPDRACNLAKQAFDEAISELDTLGEESYKDSTLIMQLLRDNLTLWTSDITDDAGDEIKEAASKRESGETQQ

SEQ ID NO: 22839 - protein, 264 aa, Hevea brasiliensis
MSPTESSREENVYMAKLAEQAERYEEMVEFMEKVAKTVDVEELTVEERNLLSVAYKNVIGARRASWRIISSIEQKEESRGNEDHVTIIKEYRGKIESELSKICDGILSLLESHLIPSASSAESKVFYLKMKGDYHRYLAEFKTAGERKEAAESTLLAYKSAQDIALADLAPTHPIRLGLALNFSVFYYEILNSPDRACNLAKQAFDEAISELDTLGEESYKDSTLIMQLLRDNLTLWTSDITDEAGDEIKEASKRESGEGQPQQ

SEQ ID NO: 22840 - protein, 257 aa, Allium cepa
MTTREENVYLAKLAEQAERYEEMVEFMEKVVKAADTEELTVEERNLLSVAYKNVIGARRASWRIISSIEQKEESRGNDDHVSKIKDYRGKVEVELSKICDGILKLLDSHLVPSSTTAETKVFYLKMKGDYHRYLAEFKTGAERKDAAESTLMAYKSAQDIALAELASTHPIRLGLALNFSVFYYEILNSPDRACSLAKQAFDEAISELDTLGEESYKDSTLIMQLLRDNLTLWTSDLNEAGDEIKEAAPSKGESEGQ

SEQ ID NO: 22841 - protein, 261 aa, Raphanus sativus
MSSTREENVYLAKLAEQAERYEEMVEFMEKVAKTVDSEELTVEERNLLSVAYKNVIGARRASWRIISSIEQKEESRGNEDHVSIIKDYRGKIETELSKICDGILNLLDSHLVPAASLAESKVFYLKMKGDYHRYLAEFKTGAERKDAAENTLVAYKSAQDIALADLPPTHPIRLGLALNFSVFYYEILNSPDRACNLAKQAFDEAISELDTLGEESYKDSTLIMQLLRDNLTLWTSDINDEAGGDEIKEASKDEPEEGKQA

SEQ ID NO: 22842 - protein, 263 aa, Fragaria vesca
MSPTESTREENVYMAKLAEQAERYEEMVEFMEKVAKTVDVEELTVEERNLLSVAYKNVIGARRASWRIISSIEQKEESRGNEDHVSIIKEYRSKIETELSKICDGILNLLESHLIPSASSAESKVFYLKMKGDYHRYLAEFKTGGERKEAAESTLLAYKSAQDIALAELAPTHPIRLGLALNFSVFYYEILNSPDRACNLAKQAFDEAISELDTLGEESYKDSTLIMQLLRDNLTLWTSDITDDAGDEIKEASKRESGDAPAQ

SEQ ID NO: 22843 - protein, 262 aa, Malus domestica
MSPTDSSREENVYMAKLAEQAERYEEMVEFMEKVAKTVDVEELTVEERNLLSVAYKNVIGARRASWRIISSIEQKEESRGNEDHVAIIKEYRSKIETELSKICDGILNLLESHLIPSASSAESKVFYLKMKGDYHRYLAEFKTGGERKEAAESTLLAYKSAQDIALAELAPTHPIRLGLALNFSVFYYEILNSPDRACNLAKQAFDEAISELDTLGEESYKDSTLIMQLLRDNLTLWTSDITDDAGDEIKEASKRESSEAQQ

SEQ ID NO: 22844 - protein, 262 aa, Cryptomeria japonica
MPPVESSREENVYMAKLAEQAERYEEMVEFMEKVAKTVDVEELSVEERNLLSVAYKNVIGARRASWRIISSIEQKEESRGNDDHVTMIRDYRAKVESELSNICDGILRLLDSHLVPSSTTGESKVFYLKMKGDYHRYLAEFKTGADRKEAAESTLLAYKSAQDIAMAELASTHPIRLGLALNFSVFYYEILNSPDRACALAKQAFDEAIAELDTLGEESYKDSTLIMQLLRDNLTLWTSDMNEDTGDEIKEAPSKREEGDGQ

SEQ ID NO: 22845 - protein, 260 aa, Nicotiana benthamiana
MTESSREENVYMAKLAEQAERYEEMIEFMEKVAKTGDVEELTVEERNLLSVAYKNVIGARRASWRIISSIEQKEESRGNEDHVKTIKEYRAKIEAELSKICDGILGLLESHLIPSASTAESKVFYLKMKGDYHRYLAEFKTGSERKEAAENTLLAYKSAQDIALTELAPTHPIRLGLALNFSVFYYEILNSPDRACNLAKQAFDEAISELDTLGEESYKDSTLIMQLLRDNLTLWTSDNAEDAGDDIKEAPKHESGEGQQ

SEQ ID NO: 22846 - protein, 262 aa, Olea europaea
MSPADLSREENVYMAKLAEQAERYEEMVEFMEKVAKAVNTEELSVEERNLLSVAYKNVIGARRASWRIISSIEQKEESRGNEDHVNVIKEYRGKIEAELSKICDGILSLLESHLVPSASSAETKVFYLKMKGDYHRYLAEFKTGAERKEAAESTLVAYKSAQDIALADLAPTHPIRLGLALNFSVFYYEILNSPDRACNLAKQAFDEAIAELDTLGEESYKDSTLIMQLLRDNLTLWTSDITDDAGDEIKEAPKADPGEGQQ

SEQ ID NO: 22847 - protein, 256 aa, Allium cepa
MSATRDENVYMAKLAEQAERYEEMVEFMEKVAKTVDADELTVEERNLLSVAYKNVIGARRASWRIISSIEQKEESRGNENHVVMIKEYRGKIEAELSKICDGILNLLDTHLVPSSTAAESKVFYLKMKGDYHRYLAEFKTGPERKEAAESTLIAYKSAQDIALSDLPPTHPIRLGLALNFSVFYYEILNSPDRACSLAKQAFDEAISELDTLGEESYKDSTLIMQLLRDNLTLWTSDLTEDAGDEIKEAAPKQEGQ

SEQ ID NO: 22848 - protein, 259 aa, Capsicum annuum
MADSREENVYMAKLAEQAERYEEMVEFMEKVAKTVDVEELTVEERNLISVAYKNVIGARRASWRIISSIEQKEESRGNEDHVNTIKEYRGKIEAELSKICDGILSLLESHLVPSASTAESKVFYLKMKGDYHRYLAEFKTGAERKEAAENTLLAYKSAQDIALAELAPTHPIRLGLALNFSVFYYEILNSPDRACNLAKQAFDDAIAELDTLGEESYKDSTLIMQLLRDNLTLWTSDATDDVGDEITEASKQESGDGQQ

SEQ ID NO: 22849 - protein, 262 aa, Lippia dulcis
MSPADSSREESVYMAKLAEQAERYEEMVEFMEKVVKTVDTDELTVEERNLLSVAYKNVIGARRASWRIISSIEQKEESRGNEDHVNIIKEYRGKIEAELSKICDGILKLLESHLIPSAASGESKVFYLKMKGDYYRYLAEFKTGAERKEAAESTLLAYKSAQDIALAELAPTHPIRLGLALNFSVFYYEILNSPDRACALAKQAFDEAIAELDTLGEESYKDSTLIMQLLRDNLTLWTSDIADDAGDEIKETTKRESGEGAQ

SEQ ID NO: 22850 - protein, 259 aa, Papaver somniferum
MSTSREENVYLAKLAEQAERYEEMVEFMENVAKTVDVEELTVEERNLLSVAYKNVIGARRASWRIISSIEQKEESRGNEDHVSIIKEYRGKIESELHKICQGILGLLDSHLIPLSTAAESKVFYLKMKGDYHRYLAEFKSGSDRKEAAESTLLAYKSAQDIALAELSPTHPIRLGLALNFSVFYYEILNSPDRACTLAKQAFDEAISELDSLGEESYKDSTLIMQLLRDNLTLWTSDIGEDADNEIKEASKHDESKGPE

SEQ ID NO: 22851 - protein, 258 aa, Solanum phureja
MADSREENVYMAKLAEQAERYEEMVEFMEKVAKVDVEELTVEERNLLSVAYKNVIGARRASWRIISSIEQKEESRGNEDHVSSIKEYRAKIEAELSKICDGILSLLESHLVPSASTAESKVFYLKMKGDYHRYLAEFKTGAERKEAAENTLLAYKSAQDIALAELTPTHPIRLGLALNFSVFYYEILNSPDRACNLAKQAFDDAIAELDTLGEESYKDSTLIMQLLRDNLTLWTSDTTDDAEDEIREASKQESGDGQQ

SEQ ID NO: 22852 - protein, 260 aa, Nicotiana tabacum
MADSSREENVYMAKLAEQAERYEEMIEFMEKVAKTGDVEELTVEERNLLSVAYKNVIGARRASWRIISSIEQKEESRGNEDHVKTIKEYRAKIEAELSKICDGILGLLESHLIPSASAAESKVFYLKMKGDYHRYLAEFKTGSERKEAAENTLLAYKSAQDIALTELAPTHPIRLGLALNFSVFYYEILNSPDRACNLAKQAFDEAISELDTLGEESYKDSTLIMQLLRDNLTLWTSDNAEDAGDDIKEAPKHESSEGQQ

SEQ ID NO: 22853 - protein, 258 aa, Solanum lycopersicum
MADSREENVYMAKLAEQAERYEEMVEFMEKVAKVDVEELTVEERNLLSVAYKNVIGARRASWRIISSIEQKEESRGNEDHVSSIKEYRAKIEAELSKICDGILSLLESHLVPSASTAESKVFYLKMKGDYHRYLAEFKTGAERKEAAENTLLAYKSAQDIALAELAPTHPIRLGLALNFSVFYYEILNSPDRACNLAKQAFDDAIAELDTLGEESYKDSTLIMQLLRDNLTLWTSDTTDDAGDEIREASKQESGDGQQ

SEQ ID NO: 22854 - protein, 262 aa, Vinca minor
MVPTDSPREENVYMAKLAEQAERYEEMVEFMEKVAKGADAEELTVEERNLLSVAYKNVIGARRASWRIISSIEQKEESRGNEDHVAIIKDYRGKIEAELTKICNGILQLLEGHLVPSANTGESKVFYLKMKGDYHRYLAEFKTGAEKKEAAENTLVAYKAAQDIALAELAPTHPIRLGLALNFSVFYYEILNSPDRACTLAKQAFDEAISELDTLGEESYKDSTLIMQLLRDNLTLWTSDVPEDAGAEIKEASANEPGNGEK

SEQ ID NO: 22855 - protein, 254 aa, Amaranthus tuberculatus
MSTAEGSRDENVYLAKLAEQAERYEEMVEFMEKVAKTVDVEELTVEERNLLSVAYKNVIGARRASWRIISSIEQKEESRGNDDHVANIKQYRAKIETELSKICDGILKLLDSHLVPSATAAESKVFYLKMKGDYHRYLAEFKAGAERKEAAEHTLLAYKSAQDIALAELPPTHPIRLGLALNFSVFYYEILNSPDRACALAKQAFDEAISELDTLGEESYKDSTLIMQLLRDNLTLWTSDNTDDVDEIKEAYKR

SEQ ID NO: 22856 - protein, 260 aa, Persea americana
MSPVGSSREEYVYLAKLAEQAERYEEMVEYMGKVATTGDSEELTVEERNLFSVAYKNAIGARRASWRIISSIEQKEESRGNDDHVAIIKEYRGKIEAELSKICDGILQLLESHLIPSSNSAESKVFYLKMKGDYHRYLAEFKAGAERKEAAENTLLAYKSAQDIALAELAPTHPIRLGLALNFSVFYYEILNSPDRACSLAKQAFDEAISELDTLGEESYKDSTLIMQLLRDNLTLWTSDITEDAGDEIKEAPKREGDGQ

SEQ ID NO: 22857 - protein, 260 aa, Brachypodium distachyon
  Sequence also found in Organisms: Festuca arundinacea, Lolium multiflorum
MSTAEATREENVYMAKLAEQAERYEEMVEFMEKVAKTADVGELTVEERNLLSVAYKNVIGARRASWRIISSIEQKEESRGNEAYVASIKEYRTRIETELSKICDGILKLLDSHLVPSATAAESKVFYLKMKGDYHRYLAEFKAGAERKEAAENTLVAYKSAQDIALADLPTTHPIRLGLALNFSVFYYEILNSPDRACNLAKQAFDEAIAELDSLGEESYKDSTLIMQLLRDNLTLWTSDNADEGGDEIKEASKPEGEGH

SEQ ID NO: 22858 - protein, 258 aa, Avena sativa
MSAEATREENVYMAKLAEQAERYEEMVEFMEKVAKTADVGELTVEERNLLSVAYKNVIGARRASWRIISSIEQKEESRGNEAYVASIKEYRTRIETELSKICDGILKLLDSHLVPSATAAESKVFYLKMKGDYHRYLAEFKAGAERKEAAENTLVAYKAAQDIALADLPTTHPIRLGLALNFSVFYYEILNSPDRACNLAKQAFDEAIAELDSLGEESYKDSTLIMQLLRDNLTLWTSDNADEGGDEIKEASKPEEGH

SEQ ID NO: 22859 - protein, 258 aa, Avena sativa
MAAEATREENVYMAKLAEQAERYEEMVEFMEKVAKTADVGELTVEERNLLSVAYKNVIGARRASWRIISSIEQKEESRGNEAYVASIKEYRTRIETELSKICDGILKLLDSHLVPSATAAESKVFYLKMKGDYHRYLAEFKAGAERKEAAENTLVAYKAAQDIALADLPTTHPIRLGLALNFSVFYYEILNSPDRACNLAKQAFDEAIAELDSLGEESYKDSTLIMQLLRDNLTLWTSDNADEGGDEIKEASKPEEGH

SEQ ID NO: 22860 - protein, 257 aa, Allium cepa
MSSSREENIYMAKLAEQAERYEEMVEFMEKVVKTVDTEELSVEERNLLSVAYKNVIGARRASWRIISSIEQKEESRGNEDHVNIIKEYRAKIEAELTKICDGILKLLDSHLVPSSTTAESKVFYLKMKGDYHRYLAEFMTGDARKEAAESTLTAYKSAQDIALAEMTSTHPIRLGLALNFSVFYYEILNSPDRACSLAKQAFDDAISELDSLGEESYKDSTLIMQLLRDNLTLWTSDITDEAGDEIKEAPKKEGEGQ

SEQ ID NO: 22861 - protein, 263 aa, Linum usitatissimum
MSPSEASREDNVYMAKLAEQAERYEEMVEFMEKVAKTVDVEELTVEERNLLSVAYKNVIGARRASWRIISSIEQKEESRGNEDHVSIIKEYRSKIETELSKICDGILNLLESHLIPATSAAESKVFYLKMKGDYHRYLAEFKTGAERKEAAESTLLAYKSAQDIALADLAPTHPIRLGLALNFSVFYYEILNSPDRACNLAKQAFDEAISELDTLGEESYKDSTLIMQLLRDNLTLWTSDITDDAGDEIKEASTKRDSGEGQQ

SEQ ID NO: 22862 - protein, 263 aa, Tropaeolum majus
MSPADAPREDNVYMAKLAEQAERYEEMVEFMEKVAKTVDVEELTVEERNLLSVAYKNVIGARRASWRIISSIEQKEESRGNEDHVSIIKEYRGKIEAELSKICEGILSLLESHLVPSASSAESKVFYLKMKGDYHRYLAEFKTGAERKEAAESTLLAYKSAQDIALAELAPTHPIRLGLALNFSVFYYEILNSPDRACNLAKQAFDEAISELDTLGGESYKDSTLIMQLLRDNLTLWTSDITDDAGDEIKEASKRDSGEGQPQ

SEQ ID NO: 22863 - protein, 263 aa, Lippia dulcis
MSPAESSREENVYMAKLAEQAERYEEMVEFMEKVAKAVDSDELTVEERNLLSVAYKNVIGARRASWRIISSIEQKEESRGNEDHVSIIKEYRGKIEAELSKICDGILGLLETHLIPSASSAESKVFYLKMKGDYHRYLAEFKTGAERKEAAESTLLAYKSAQDIALAELAPTHPIRLGLALNFSVFYYEILNSPDRACNLAKQAFDEAIAELDTLGEESYKDSTLIMQLLRDNLTLWTSDIADEAGDEIKETAKGESGEGGQQ

SEQ ID NO: 22864 - protein, 261 aa, Hordeum vulgare
  Sequence also found in Organisms: Leymus cinereus x Leymus triticoides, Pseudoroegneria spicata, Secale cereale, Triticum aestivum
MSTAEATREENVYMAKLAEQAERYEEMVEFMEKVAKTADVGELTVEERNLLSVAYKNVIGARRASWRIISSIEQKEESRGNEAYVASIKEYRTRIETELSKICDGILKLLDSHLVPSATAAESKVFYLKMKGDYHRYLAEFKAGAERKEAAENTLVAYKSAQDIALADLPTTHPIRLGLALNFSVFYYEILNSPDRACNLAKQAFDEAIAELDSLGEESYKDSTLIMQLLRDNLTLWTSDNAEEGGDEIKEAASKPEGEGH

SEQ ID NO: 22865 - protein, 262 aa, Pinus pinaster
  Sequence also found in Organisms: Pinus taeda
MSPAESSREESVYMAKLAEQAERYEEMVEYMEKVAKTVDVEELTVEERNLLSVAYKNVIGARRASWRIISSIEQKEESRGNEEHVTMIREYRGKVESELSNICDGILRLLDTHLIPSSTSGESKVFYLKMKGDYHRYLAEFKTGAERKEAAESTLLAYKAAQDIATAELAPTHPIRLGLALNFSVFYYEILNSPDRACTLAKQAFDEAIAELDTLGEESYKDSTLIMQLLRDNLTLWTSDMQEETGGDEIKEAPKKEEGDGH

SEQ ID NO: 22866 - protein, 261 aa, Amaranthus tuberculatus
MSTAEGSRDENVYLAKLAEQAERYEEMVEFMEKVAKTVDGEELTVEERNLLSVAYKNVIGARRASWRIISSIEQKEESRGNDDHVANIKQYRAKIETELSKICDGILKLLDSHLVPSATAAESKVFYLKMKGDYHRYLAEFKTGTERSEAGEHTLLAYKSAQDVALAELAPTHPIRLGLALNFSVFYYEILNSPDRACALAKQAFDEAISELDTLGEESYKDSTLIMQLLRDNLTLWTSDTTDDVGDEIKEASKDEAAPVQ

SEQ ID NO: 22867 - protein, 257 aa, Cucurbita pepo
MSREENVYMAKLAEQAERYEEMVEFMEKVAKTVDVEEMTVEERNLLSVAYKNVIGARRASWRIISSIEQKEESRGNEDHVAIIKDYRSKIETELSKICDGILSLLESHLIPSASSAESKVFYLKMKGDYHRYLAEFKTGAERKEAAESTLLAYKSAQDIALAELAPTHPIRLGLALNFSVFYYEILNSPDRACNLAKQAFDEAISELDTLGEESYKDSTLIMQLLRDNLTLWTSDIGDEAGDEIKEASKRESGEGGQ

SEQ ID NO: 22868 - protein, 261 aa, Curcuma longa
MPPMESSRENNVYLAKLAEQAERYEEMVEFMEKVVRTINGEELSVEERNLLSVAYKNVIGARRASWRIISSIEQKEESRGNEEHVTVIKEYRGKVEAELGKICDGILKLLDSHLVPSASSAESKVFYLKMKGDYHRYLAEFKTGAERKEAAESTMLAYKSAQDTALADLAPTHPIRLGLALNFSVFYYEILNSPDRACSLAKQAFDEAISELDTLGEESYKDSTLIMQLLRDNLTLWTSDIMEDGGDEIKEGPKKESGDDQ

SEQ ID NO: 22869 - protein, 260 aa, Fagopyrum esculentum
MSAEGSREENVYLAKLAEQAERYEEMVEFMEKVAKTVDVEELTIEERNLLSVAYKNVIGARRAAWRIISSIEQKEESRGNDDHVSTIRDYRAKIEDELSKICEGILKLLDSHLVPAATAAESKVFYLKMKGDYHRYLAEFKTGAERKEAAESTLVAYKAAQDIALGDLAPTHPIRLGLALNFSVFYYEILNSPDRACNLAKQAFDEAISELDTLGEESYKDSTLIMQLLRDNLTLWTSDTADETGEEIKEAAPGEGADGK

SEQ ID NO: 22870 - protein, 262 aa, Vitis vinifera
MLLTESSREENVYMAKLAEQAERYEEMVEFMEKVAKTVEVEELTVEERNLLSVAYKNVIGARRASWRIISSIEQKEESRGNEDHVAIIKDYRATIEAELSKICDGILSLLESHLIPSAVIAESKVFYLKMKGDYHRYLAEFKTGPGRKEAAESTLLAYKSAQDIALAELAPTHPIRLGLALNFSVFYYEILNSPDRACNLAKQAFDEAISELDTLGEESYKDSTLIMQLLRDNLTLWTSDITDDAGDDIKEASKRESGEGQP

SEQ ID NO: 22871 - protein, 262 aa, Heritiera littoralis
MSPTESTREENVYMAKLAEQTERYEEMVEFMEKVAKTVDVEELTVEERNLLSVAYKNVIGARRASWRIISSIEQKEESRGNEDHVAIIKEYRGKIEAELSKICDGILSLIESHLIPSASSAESKVFYLKMKGDYHRYLAEFKTGAERKEAAESTLLAYKSAQDIALAELAPTHPIRLGLALNFSVFYYEILNSPDRACNLAKQAFDEAISELDTLGEESYKDSTLIMQLLRDNLTLWTSDITDEGGDEIKEASKRESGEGQQ

SEQ ID NO: 22872 - protein, 260 aa, Avena sativa
MSAEATREENVYMAKLAEQAERYEEMVEFMEKVAKTADVGELTVEERNLLSVAYKNVIGARRASWRIISSIEQKEESRGNEAYVASIKEYRTRIETELSKICDGILKLLDSHLVPSATAAESKVFYLKMKGDYHRYLAEFKAGAERKEAAENTLVAYKSAQDIALADLPTTHPIRLGLALNFSVFYYEILNSPDRACNLAKQAFDEAIAELDSLGEESYKDSTLIMQLLRDNLTLWTSDNAEEGGDEIKEAASKPEGEGH

SEQ ID NO: 22873 - protein, 258 aa, Allium cepa
MSPAELTREENIFMAKLAEQAERYEEMVEFMEHVVKSVNAEELSVEERNLLSVAYKNVIGARRASWRIISSIEQKEESRGNDDHVKLIKEYRANVEAELSKICGGILNLLESHLIPSSVAAESKVFYYKMKGDYYRYLAEFKSGDERKEAAENTLTAYKTAQDIALAEMPPTHPIRLGLALNFSVFYYEILNSPDRACNLAKQAFDEAISELDNLGEESYKDSTLIMQLLRDNLTLWTSDLTEDAGDEIKEAPKGEGQ

SEQ ID NO: 22874 - protein, 259 aa, Papaver somniferum
MSTSREENVYLAKLAEQAERYEEMVEFMENVAKTVNVQELTVEERNLLSVAYKNVIGARRASWRIISSIEQKEESRGNEDHVSIIKEYRGKIESELHKICQGILGLLDSHLIPSSTAAESKVFYLKMKGDYHRYLAEFKSGSDRKEAAESTLLAYKSAQDIALAELSPTHPIRLGLALNFSVFYYEILNSPDRACTLAKQAFDEAISELDSLGEESYKDSTLIMQLLRDNLTLWTSDIGEDADNEIKEASKHDESKGPE

SEQ ID NO: 22875 - protein, 258 aa, Solanum tuberosum
MADSREENVYMAKLAEQAERYEEMVEFMEKVAKVDVEELTVEERNLLSVAYKNVIGARRASWRIISSIEQKEESRGNEDHVSSIKEYRAKIEAELSKICDGILSLLESHLVPSASTAESKVFYLKMKGDYHRYLAEFKTGAERKEAAENTLLAYKSAQDIALAELTPTHPIRLGLALNFSVFYYEILNSPDRACNLAKQAFDDAIAELDTLGEESYKDSTLIMQLLRDNLTLWTSDTTDDAEDEIREGSKQESGDGQQ

SEQ ID NO: 22876 - protein, 259 aa, Primula obconica
MVSTEASREDNVYMAKLAEQAERYEEMVEFMEKVAKTVDVEELTVEERNLLSVAYKNVIGARRASWRIISSIEQKEESRGNDDHVAIIKDYRGKIETELSKICEGILSLLDKHLVPCASSGESKVFYLKMKGDYHRYLAEFKTGAERKEAAENTLLAYKSAQDIALADLAPTHPIRLGLALNFSVFYYEILNSPDRACNLAKQAFDEAISELDTLGEESYKDSTLIMQLLRDNLTLWTSDVADDGDEIKEASKKEAGDE

SEQ ID NO: 22877 - protein, 262 aa, Prunus persica
  Sequence also found in Organisms: Prunus mume
MSPTDSSREDNVYMAKLAEQAERYEEMVEFMEKVAKTVDVEELTVEERNLLSVAYKNVIGARRASWRIISSIEQKEESRGNEDHVAIIKEYRSKIETELSKICDGILNLLESHLIPSASSAESKVFYLKMKGDYHRYLAEFKTGGERKEAAESTLLAYKSAQDIALAELAPTHPIRLGLALNFSVFYYEILNSPDRACNLAKQAFDEAISELDTLGEESYKDSTLIMQLLRDNLTLWTSDITDDAGDEIKEASKRESAEAQQ

SEQ ID NO: 22878 - protein, 260 aa, Secale cereale
MSTAEATREENVYMAKLAEQAERYEEMVEFMEKVAKTADVGELTVEERNLLSVAYKNVIGARRASWRIISSIEQKEESRGNEAYVASIKEYRTRIETELSKICDGILKLLDSHLVPSATAAESKVFYLKMKGDYHRYLAEFKAGAERKEAAENTLVAYKSAQDIALADLPTTHPIRLGLALNFSVFYYEILNSPDRACNLAKQAFDEAIAELDSLGEESYKDSTLIMQLLRDNLTLWTSDNAEEGGDEIKEAASKPEGEG

SEQ ID NO: 22879 - protein, 262 aa, Sequoia sempervirens
MPPVESSREENVYMAKLAEQAERYEEMVEFMEKVAKTVDVEELSVEERNLLSVAYKNVIGARRASWRIISSIEQKEESRGNDEHVTMIRDYRAKVESELSNICDGILRLLDSHLVPSSTTGESKVFYLKMKGDYHRYLAEFKTGADRKEAAESTLLAYKSAQDIAMAELASTHPIRLGLALNFSVFYYEILNSPDRACALAKQAFDEAIAELDTLGEESYKDSTLIMQLLRDNLTLWTSDMNEDTGDEIKEAPSKREEGDGQ

SEQ ID NO: 22880 - protein, 262 aa, Picea glauca
MSPAESSREESVYMAKLAEQAERYEEMVEYMEKVAKTVDVEELTVEERNLLSVAYKNVIGARRASWRIISSIEQKEESRGNEEHVTMIREYRGKVESELSNICDGILRLLDTHLIPSSTSGESKVFYLKMKGDYHRYLAEFKTGAERKEAAESTLLAYKAAQDIAIAELAPTHPIRLGLALNFSVFYYEILNSPDRACTLAKQAFDEAIAELDTLGEESYKDSTLIMQLLRDNLTLWTSDMQEETGGDEIKEAPKKEEGDGH

SEQ ID NO: 22881 - protein, 265 aa, Fagus grandifolia
MSPADSSREENVYMAKLAEQAERYEEMVEFMEKVAKTVDVEELTVEERNLLSVAYKNVIGARRASWRIISSIEQKEESRGNEDHVVIIKEYRGKIESELSKICDGILGLLETHLIPSASSAESKVFYLKMKGDYHRYLAEFKTGAERKEAAESTLLAYKSAQDIALADLPPTHPIRLGLALNFSVFYYEILNSPDRACNLAKQAFDEAISELDTLGEESYKDSTLIMQLLRDNLTLWTSDITDDAGDEIKEASKRESGEAPPPQQ

SEQ ID NO: 22882 - protein, 265 aa, Beta vulgaris
MSAEASREENVYMAKLAEQAERYEEMVEFMEKVAKMTDAEELTVEERNLLSVAYKNVIGARRASWRIISSIEQKEESRGNEDHVATIKEYRSKIETELSKICDGILNLLESHLIPSASAAESKVFYLKMKGDYYRYLAEFKTGPERKEAAENTLLAYKSAQDIALAELAPTHPIRLGLALNFSVFYYEILNSPDRACNLAKQAFDEAISELDTLGEESYKDSTLIMQLLRDNLTLWTSDNAEEGGDEIKEAPGGKRESSEGQPQQ

SEQ ID NO: 22883 - protein, 264 aa, Manihot esculenta
MSPSEPSREEHVYMAKLAEQAERYEEMVEFMEKVAKTVDVEELTVEERNLLSVAYKNVVGARRASWRIISSIEQKEESRGNEDHVTIIKEYRGKIEAELSKICGGILSLLDSHLIPAASSAESKVFYLKMKGDYYRYLAEFKTASERKEAAESTLLAYKSAQDIAIAELAPTHPIRLGLALNFSVFYYEILNSPDRACNLAKQAFDEAISELDTLGEESYKDSTLIMQLLRDNLTLWTSDITDEAGDEIKEASKRESGEGQPQQ

SEQ ID NO: 22884 - protein, 262 aa, Panax ginseng
MLPPESSREDNVYMAKLAEQAERYEEMVEFMEKVAKTVDVEELTVEERNLLSVAYKNVIGARRASWRIISSIEQKEESRGNEDHVTIIKEYRGKIEAELSKICDGILNLLESHLVPSASSAESKVFYLKMKGDYHRYLAEFKTGSERKEAAESTLLAYKSAQDIALAELASTHPIRLGLALNFSVFYYEILNSPDRACNLAKQAFDEAISELDTLGEESYKDSTLIMQLLRDNLTLWTSDITDEAGDEIKEAAPKPSGEIIE

SEQ ID NO: 22885 - protein, 264 aa, Humulus lupulus
MSPTESSREENVYMAKLAEQAERYEEMVEFMEKVAKAVDVEELTVEERNLLSVAYKNVIGARRASWRIISSIEQKEESRGNEDHVKIIKEYRGKIESELSKICEGILNLLESHLIPSASSAESKVFYLKMKGDYHRYLAEFKTGAERKEAAESTLLAYKSAQDIALAELAPTHPIRLGLALNFSVFYYEILNSPDRACNLAKQAFDEAISELDTLGEDSYKDSTLIMQLLRDNLTLWTSDITDDAGDEIKEASKRETGESTGQQ

SEQ ID NO: 22886 - protein, 263 aa, Tripterygium wilfordii
MSPDSSREENVYMAKLAEQAERYEEMVEFMEKVAKTVDVEELTVEERNLLSVAYKNVIGARRASWRIISSIEQKEESKGNEDHVNIIKEYRSKIESELSKICDGILNLLESHLVPSASAAESKVFYLKMKGDYHRYLAEFKTGPERKEAAESTLLAYKSAQDIALAELAPTHPIRLGLALNFSVFYYEILNSPDRACNLAKQAFDEAISELDTLGEESYKDSTLIMQLLRDNLTLWTSDITDDAGDEIKEASSKRESSEGPQS

SEQ ID NO: 22887 - protein, 263 aa, Tripterygium wilfordii
MSPDSSREENVYMAKLAEQAERYEEMVEFMEKVAKTVDVDELTVEERNLLSVAYKNVIGARRASWRIISSIEQKEESRGNEDHVNIIKEYRGKIESELSKICDGILNILESHLIPSVSSAESKVFYLKMKGDYHRYLAEFKTGAERKEAAESTLLAYKSAQDIALAELAPTHPIRLGLALNFSVFYYEILNSPDRACNLAKQAFDEAISELDTLGEESYKDSTLIMQLLRDNLTLWTSDITDDAGDEIKEASSKRESGEGQQS

SEQ ID NO: 22888 - protein, 256 aa, Phaseolus vulgaris
MADSSREENVYMAKLAEQAERYEEMVEFMEKVAKTVEVEELTVEERNLLSVAYKNVIGARRASWRIISSIEQKEESRGNEDHVAIIKEYRGKIETELSKICDGILNLLESNLIPSAASPESKVFYLKMKGDYHRYLAEFKTGTERKDAAESTLLAYKSAQDIALADLAPTHPIRLGLALNFSVFYYEILNSPDRACNLAKQAFDEAISELDTLGEESYKDSTLIMQLLRDNLTLWTSDITDDAGDEIKETTKQPGE

SEQ ID NO: 22889 - protein, 263 aa, Rosa hybrid cultivar
MSPTDSTREENVYMAKLAEQAERYEEMVEFMEKVAKTVDVEELTVEERNLLSVAYKNVIGARRASWRIISSIEQKEESRGNEDHVSIIKEYRSKIETELSKICDGILNLLESHLIPSASSAESKVFYLKMKGDYHRYLAEFKTGGERKEAAESTLLAYKSAQDIALAELAPTHPIRLGLALNFSVFYYEILNSPDRACNLAKQAFDEAISELDTLGEESYKDSTLIMQLLRDNLTLWTSDITDDAGDEIKEASKRESGEAPAQ

SEQ ID NO: 22890 - protein, 261 aa, Cycas rumphii
MSPVESSREENVYMAKLAEQAERYEEMVEFMEKVTKTVDVEELTVEERNLLSVAYKNVIGARRASWRIISSIEQKEESRGNDDHVATIREYRAKVESELTNICDSILRLLDSHLIPSSTTGESKVFYLKMKGDYHRYLAEFKTGAERKEAAENTLLAYKSAQDIAASDLAPTHPIRLGLALNFSVFYYEILNSPDRACTLAKQAFDEAIAELDTLGEESYKDSTLIMQLLRDNLTLWTSDMQEDAGDEIREAPKREEGDEQ

SEQ ID NO: 22891 - protein, 262 aa, Abies balsamea
MSPVETSREESVYMAKLAEQAERYEEMVEYMEKVAKTVDVEELTVEERNLLSVAYKNVIGARRASWRIISSIEQKEESRGNEDHVTMIREYRGKVESELSNICDGILRLLDTHLIPSSTSGESKVFYLKMKGDYHRYLAEFKTGAERKEAAESTLLAYKAAQDIAIAELAPTHPIRLGLALNFSVFYYEILNSPDRACALAKQAFDEAIAELDTLGEESYKDSTLIMQLLRDNLTLWTSDMQEETGGDEIKEAPKKEEVDGH

SEQ ID NO: 22892 - protein, 254 aa, Antirrhinum majus
MASADSSRDESVYMAKLAEQAERYEEMVEFMEKVAKTVDTDELTVEERNLLSVAYKNVIGARRASWRIISSIEQKEESRGNEDHVKIIKDYRAKIETELSKICDGILGLLDSHLVPSASSAETKVFYLKMKGDYFRYLAEFKTGAERKEAAESTLVAYKAAQDIALAELAPTHPIRLGLALNFSVFYYEILSSPDRACNLAKQAFDEAIAELDTLGEESYKDSTLIMQLLRDNLTLWTSDLADDAGDENKEPPK

SEQ ID NO: 22893 - protein, 259 aa, Arnica chamissonis
MVQTEASREENVYMAKLAEQAERYEEMVEFMEKVVKIVDSEELTVEERNLLSVAYKNVIGARRASWRIISSIEQKEESRGNEDHVTIIKNYRGKIEIELSKICDGILSLLESHLVPSASSAESKVFYLKMKGDYYRYLAEFKTGAERKEAAENTLLGYKSAQDIALVDLAPTHPIRLGLALNFSVFYYEILNSPDRACSLAKQAFDEAISELDTLGEDSYKDSTLIMQLLRDNLTLWTSDAADEAGDEIKEASNPEAKQ

SEQ ID NO: 22894 - protein, 262 aa, Cedrus atlantica
MSPVETSREESVYMAKLAEQAERYEEMVEYMEKVAKTVDVEELTVEERNLLSVAYKNVIGARRASWRIISSIEQKEESRGNEEHVTMIREYRGKVESELSNICDGILRLLDTHLIPSSTSGESKVFYLKMKGDYHRYLAEFKTGAERKEAAESTLLAYKAAQDIAVAELAPTHPIRLGLALNFSVFYYEILNSPDRACALAKQAFDEAIAELDTLGEESYKDSTLIMQLLRDNLTLWTSDMQEETGGDEIKEAPKKEEGDGH

SEQ ID NO: 22895 - protein, 262 aa, Cephalotaxus harringtonia
MPPMESSREENVYMAKLAEQAERYEEMVEFMEKVAKTVDVEELSVEERNLLSVAYKNVIGARRASWRIISSIEQKEESRGNDEHVTLIRDYRAKVESELSNICDGILRLLDSHLVPSSTTGESRVFYLKMKGDYHRYLAEFKTGADRKEAAESTLLAYKSAQDIAMAELASTHPIRLGLALNFSVFYYEILNSPDRACALAKQAFDEAIAELDTLGEESYKDSTLIMQLLRDNLTLWTSDMNEDTGDEIKEAPSKREDGEGQ

SEQ ID NO: 22896 - protein, 259 aa, Chelidonium majus
MSPVEASREENVYMAKLAEQAERYEEMVEFMENVAKTVDVEELTVEERNLLSVAYKNVIGARRASWRIISSIEQKEESRGNEDNVKVIKEYRAKIETELSKICEGILGLLDAHLIPSSSAAESKVFYLKMKGDYHRYLAEFKTGSDRKEAAESTLLAYKSAQDIAMTELTPTHPIRLGLALNFSVFYYEILNSPDRACNLAKQAFDEAISELDTLGEESYKDSTLIMQLLRDNLTLWTSDITEDAGDEIKEASKREGAA

SEQ ID NO: 22897 - protein, 261 aa, Cicer arietinum
MAASDSSREENVYMAKLAEQAERYEEMVEFMEKVAKTVEVDELTVEERNLLSVAYKNVIGARRASWRIISSIEQKEESRGNEDHVAVIKEYRSKIETELSKICDGILSLLESNLVPSAGTPESKVFYLKMKGDYHRYLAEFKTGVERKDAAESTLLAYKSAQDIALADLAPTHPIRLGLALNFSVFYYEILNSPDRACNLAKQAFDEAISELDTLGEESYKDSTLIMQLLRDNLTLWTSDITDEAGDEIKETSKQQSGEQE

SEQ ID NO: 22898 - protein, 261 aa, Coffea canephora
MLPPASRDENVYMAKLAEQAERYEEMVEFMEKVAKAVDTEELTVEERNLLSVAYKNVIGSRRASWRIISSTEQKEESRGNEDHVNMIKEYRGKIEAELTKICDGILGLLESHLIPSASAAESQVFYLKMKGDYHRYLAEFKTGADRKEAAENTLVAYKSAQDIALAELPPTHPIRLGLALNFSVFYYEILSAPDRACNLAKQAFDEAISELDTLGEETYKDSTLIMQLLRDNLTLWTSDIQEDAGDEIKEPSRLDTGEGQQ

SEQ ID NO: 22899 - protein, 262 aa, Gossypium hirsutum
MSPTESSREENVYMAKLAEQAERYEEMVEFMENVAKTVDVGELTVEERNLLSVAYKNVIGARRASWRIISSIEQKEESRGNEDHVATIKEYRSKIEAELSKICDGILSLLESHLIPSASSAESKVFYLKMKGDYHRYLAEFKTGAERKEAAESTLLAYKSAQDIALGDLAPTHPIRLGLALNFSVFYYEILNSPDRACNLAKQAFDEAISELDTLGEESYKDSTLIMQLLRDNLTLWTSDITDEAGDEIKEASKPESGEGQQ

SEQ ID NO: 22900 - protein, 256 aa, Vigna unguiculata
MADSSREENVYMAKLAEQAERYEEMVEFMEKVAKTVEVEELTVEERNLLSVAYKNVIGARRASWRIISSIEQKEESRGNEDHVAIIKEYRGKIETELSKICDGILNLLESNLIPSAQSPESKVFYLKMKGDYHRYLAEFKTGAERKDAAESTLLAYKSAQDIALADLAPTHPIRLGLALNFSVFYYEILNSPDRACNLAKQAFDEAISELDTLGEESYKDSTLIMQLLRDNLTLWTSDITDDAGEEIKETTKQPAE

SEQ ID NO: 22901 - protein, 260 aa, Solanum melongena
MAESLREENVYLAKLAEQAERYEEMIEFMEKVAKTVDVEELTVEERNLLSVAYKNVIGARRASWRIISSIEQKEESRGNEDHVNTIKEYRSKIEAELSKICDGILSLLDSNLILSASTAESKVFYLKMKGDYHRYLAEFKTGAERKEAAENTLLAYKSAQDIALAELAPTHPIRLGLALNFSVFYYEILNSPDRACNLAKQAFDEAISELDTLGEESYKDSTLIMQLLRDNLTLWTSDNADDAGDDIKEASKPESGEGQQ

SEQ ID NO: 22902 - protein, 262 aa, Ipomoea nil
MVSTESSREENVYMAKLAEQAERYEEMVEFMEKVAKTVDVDELTVEERNLLSVAYKNVIGARRASWRIISSIEQKEESRGNEELVKTIKEYRGRIEAELSKICDGILSLLESHLVPSASTAESKVFYLKMKGDYHRYLAEFKTGAERKEAAESTLLAYKSAQDIALGELAPTHPIRLGLALNFSVFYYEILNSPDRACNLAKQAFDEAISELDTLGEESYKDSTLIMQLLRDNLTLWTSDTADDGGDEIKEASKRESGEGPQ

SEQ ID NO: 22903 - protein, 258 aa, Allium cepa
MSPAELTREENIFMAKLAEQAERYEEMVEFMEHVVKSVNAEELSVEERNLLSVAYKNVIGARRASWRIISSIEQKEESRGNDDHVKMIKEYRANVEAELSKICGGILNLLESHLIPSSVAAESKVFYYKMKGDYYRYLAEFKSGDERKEAAENTLTAYKTAQDIALAEMPPTHPIRLGLALNFSVFYYEILNSPDRACNLAKQAFDEAISELDNLGEESYKDSTLIMQLLRDNLTLWTSDLTEDAGDEIKEAPKGEGQ

SEQ ID NO: 22904 - protein, 260 aa, Arachis hypogaea
MAESSREENVYMAKLAEQAERYEEMVEFMEKVAKSSDNEELTVEERNLLSVAYKNVIGARRASWRIISSIEQKEESRGNEDHVATIKEYRGKIEAELSKICDGILNLLESNLVPSATTPESKVFYLKMKGDYHRYLAEFKTAAERKEAAESTLLAYKSAQDIALADLPPTHPIRLGLALNFSVFYYEILNSPDRACNLAKQAFDEAIAELDTLGEESYKDSTLIMQLLRDNLTLWTSDITDEAGDEIKETSKQQPGEGQQ

SEQ ID NO: 22905 - protein, 262 aa, Pinus taeda
MSPAESSREESVYMAKLAEQAERYEEMVEYMEKVAKTVDVEELTVEERNLLSVAYKNVIGARRASWRIISSIEQKEESRGNEEHVTMIREYRGKVESELSNICDGILRLLDTHLIPSSTSGESKVFYLKMKGDYHRYLAEFKTGAERKEAAESTLLAYKAAQDIATTELAPTHPIRLGLALNFSVFYYEILNSPDRACTLAKQAFDEAIAELDTLGEESYKDSTLIMQLLRDNLTLWTSDMQEETGGDEIKEAPKKEEGDGH

SEQ ID NO: 22906 - protein, 260 aa, Solanum lycopersicum
  Sequence also found in Organisms: Solanum tuberosum, Solanum phureja
MADSSREENVYLAKLAEQAERYEEMIEFMEKVAKTADVEELTVEERNLLSVAYKNVIGARRASWRIISSIEQKEESRGNEDHVNTIKEYRSKIEAELSKICDGILSLLESNLIPSASTAESKVFYLKMKGDYHRYLAEFKTGTERKEAAENTLLAYKSAQDIALAELAPTHPIRLGLALNFSVFYYEILNSPDRACNLAKQAFDEAISELDTLGEESYKDSTLIMQLLRDNLTLWTSDNADDAGDDIKEASKPESGEGQQ

SEQ ID NO: 22907 - protein, 262 aa, Pseudotsuga menziesii
MSPVESSREESVYMAKLAEQAERYEEMVEYMEKVAKTVDVEELTVEERNLLSVAYKNVIGARRASWRIISSIEQKEESRGNEEHVTMIRDYRGKVESELSNICDGILRLLDTHLIPSSTSGESKVFYLKMKGDYHRYLAEFKTGAERKEAAESTLLAYKAAQDIAISELAPTHPIRLGLALNFSVFYYEILNSPDRACALAKQAFDEAIAELDTLGEESYKDSTLIMQLLRDNLTLWTSDMQEETGGDEIKEAPKKEEGDGH

SEQ ID NO: 22908 - protein, 262 aa, Sequoia sempervirens
MSPVESSRDESVYMAKLAEQAERYEEMVEYMEKVAKTVDVEELTVEERNLLSVAYKNVIGARRASWRIISSIEQKEESRGNEEHVTMIRDYRAKVEAELTKICDGILRLLDTHLIPSSTSGESKVFYLKMKGDYHRYLAEFKTGAERKEAAENTLLAYKAAQDIALAELASTHPIRLGLALNFSVFYYEILNSPDRACALAKQAFDEAIAELDTLGEESYKDSTLIMQLLRDNLTLWTSDLQDEVGGDEIKEAPKKEEGDSH

SEQ ID NO: 22909 - protein, 260 aa, Nicotiana tabacum
MAESTREENVYMAKLAEQAERYEEMVEFMEKVAKTVDVEELTVEERNLLSVAYKNVIGARRASWRIISSIEQKEESRGNEDHVSSIKEYRGKIEAELSKICDGILNLLESHLIPVASTAESKVFYLKMKGDYHRYLAEFKTGAERKEAAENTLLAYKSAQDIALAELAPTHPIRLGLALNFSVFYYEILNSSDRACNLAKQAFDDAIAELDTLGEESYKDSTLIMQLLRDNLTLWTSDTTDDAGDEIKEASKRDSGDGEQ

SEQ ID NO: 22910 - protein, 260 aa, Triphysaria pusilla
MSPADSSREENVYMAKLSEQAERYEEMVEFMEKVVKTVDNDELTVEERNLLSVAYKNVIGARRASWRIISSIEQKEEGRGNEDHVNIIKEYRGKIETELSKICDGILKLLESHLIPSASTAESKVFYLKMKGDYYRYLAEFKTGAERKEAAESTLLAYKSAQDIALAELAPTHPIRLGLALNFSVFYYEILNSPDRACALAKQAFDEAISELDTLGEESYKDSTLIMQLLRDNLTLWTSDIADDGDDIKETKRDSGEGQQ

SEQ ID NO: 22911 - protein, 262 aa, Panax ginseng
MLPPESSREDNVYMAKLAEQAERYEEMVEFMEKVAKTVDVEELTVEERNLLSVAYKNVIGARRASWRIISSIEQKEDSRGNEDHVTIIKEYRGKIEAELSKICDGILNLLESHLVPSASSAESKVFYLKMKGDYHRYLAEFKTGSERKEAAESTLLAYKSAQDIALAELASTHPIRLGLALNFSVFYYEILNSPDRACNLAKQAFDEAISELDTLGEESYKDSTLIMQLLRDNLTLWTSDITDEAGDEIKEAAPKPSGEIIE

SEQ ID NO: 22912 - protein, 262 aa, Cycas rumphii
MSPLESSREESVYMAKLAEQAERYEEMVEYMEKVAKTVDVEELTVEERNLLSVAYKNVIGARRASWRIISSIEQKEESRGNEEHVTMIREYRAKVESELNNICDSILRLLDTHLIPSSTSGESKVFYLKMKGDYHRYLAEFKTGAERKEAAENTLLAYKSAQDIALADLAPTHPIRLGLALNFSVFYYEILNSPDRACSLAKQAFDEAIAELDTLGEESYKDSTLIMQLLRDNLTLWTSDMQEDAGGDEIKEAPKREEGEGR

SEQ ID NO: 22913 - protein, 263 aa, Rosmarinus officinalis
MSPADSSREENVYMAKLAEQAERYEEMVEFMEKVAKASDSDELTVEERNLLSVAYKNVIGARRASWRIISSIEQKEESRGNEDHVNIIKEYRGKIEAELSKICDGILGLLETHLIPSASTGESKVFYLKMKGDYHRYLAEFKTGAERKEAAESTLLAYKSAQDIALAELAPTHPIRLGLALNFSVFYYEILNSPDRACNLAKQAFDEAISELDTLGEESYKDSTLIMQLLRDNLTLWTSDVADEAGDEIKEAPKRESGEAAQQ

SEQ ID NO: 22914 - protein, 261 aa, Spinacia oleracea
MAAESSREDNVYMAKLAEQAERYEEMVEFMEKVAKMTDAEELTVEERNLLSVAYKNVIGARRASWRIISSIEQKEESRGNEDHVATIKEYRGKIETELSKICDGILNLLESHLIPSASSAESKVFYQKMKGDYHRYLAEFKTGAERKEAAENTLLAYKSAQDIALAELAPTHPIRLGLALNFSVFYYEILNSPDRACNLAKQAFDEAISELDTLGEESYKDSTLIMQLLRDNLTLWTSDNAEEGGDEIKEAAGKRESSEQQ

SEQ ID NO: 22915 - protein, 262 aa, Gossypium raimondii
MSPTESSREENVYMAKLAEQAERYEEMVEFMENVAKTVDVGELTVEERNLLSVAYKNVIGARRASWRIISSIEQKEESRGNEDHVATIKEYRSKIEAELSKICDGILSLLESHLIPSASSAESKVFYLKMKGDYHRYLAEFKTAAERKEAAESTLLAYKSAQDIALGDLAPTHPIRLGLALNFSVFYYEILNSPDRACNLAKQAFDEAISELDTLGEESYKDSTLIMQLLRDNLTLWTSDITDEAGDEIKEASKPESGEGQQ

SEQ ID NO: 22916 - protein, 257 aa, Mimulus guttatus
MSREENVYMAKLAEQAERYEEMVEFMEKVAKSVDSDELTVEERNLLSVAYKNVIGARRASWRIISSIEQKEESRGNEDHVKIIKEYRGKIEMELSKICDGILGLLESHLIPSASSAESKVFYLKMKGDYHRYLAEFKTGSERKEAAESTLLAYKSAQDIAVGELAPTHPIRLGLALNFSVFYYEILNSPDRACTLAKQAFDEAISELDTLGEESYKDSTLIMQLLRDNLTLWTSDAADDAGDEIKEASKRDSGEGQQ

SEQ ID NO: 22917 - protein, 260 aa, Nicotiana benthamiana
MAESTREVNVYMAKLAEQAERYEEMVEFMEKVAKTVDVEELTVEERNLLSVAYKNVIGARRASWRIISSIEQKEESRGNEDHVSSIKEYRGKIEAELSKICDGILNLLESHLIPVASTAESKVFYLKMKGDYHRYLAEFKTGAERKEAAENTLLAYKSAQDIALDELAPTHPIRLGLALNFSVFYYEILNSSDRACNLAKQAFDDAIAELDTLGEESYKDSTLIMQLLRDNLTLWTSDTTDDAGDEIKEASKRESGDGEQ

SEQ ID NO: 22918 - protein, 262 aa, Olea europaea
MSPADSSREENVYMAKLAEQAERYEEMVEFMEKVAKTVNAEEFSVEERNLLSVAYKNVIGARRASWRIISSIEQKEESRGNEDHVNVIKEYRGKIEAELCKICDGILSLLESHLIPSASSAESKVFYLKMKGDYHRYLAEFKTGAERKEVAESTLLAYKSAQDIALADLSPTHPIRLGLALNFSVFYYEILNSPDRACNLAKQAFDEAIAELDTLGEESYKDSTLIMQLLRDNLTLWTSDITDDAGDEIKDTSKPESGEEQQ

SEQ ID NO: 22919 - protein, 262 aa, Podocarpus macrophillus
MSPTESSREESVYMAKLAEQAERYEEMVEYMEKVAKTVDVEELTVEERNLLSVAYKNVIGARRASWRIISSIEQKEESRGNEEHVSLIRDYRAKVEAELTKICDGILRLLDTHLIPSSTTGESKVFYLKMKGDYHRYLAEFKTGAERKEAAESTLLAYKSAQDIALSELASTHPIRLGLALNFSVFYYEILNSPDRACALAKQAFDEAIAELDTLGEESYKDSTLIMQLLRDNLTLWTSDLQDDVGGDEIKEPPKKEEGDGH

SEQ ID NO: 22920 - protein, 262 aa, Zamia vazquezii
MSPLESSREESVYMAKLAEQAERYEEMVEYMEKVAKTVDVEELTVEERNLLSVAYKNVIGARRASWRIISSIEQKEESRGNEEHVTMIREYRAKVESELSNICDSILRLLDSHLIPSSTSGESKVFYLKMKGDYHRYLAEFKTGAERKEAAENTLLAYKSAQDIALADLAPTHPIRRGLALNFSVFYYEILNSPDRACSLAKQAFDEAIAELDTLGEESYKDSTLIMQLLRDNLTLWTSDMQEDAGGDEIKEATKREEGEGQ

SEQ ID NO: 22921 - protein, 257 aa, Glycine max
MADSSREENVYMAKLAEQAERYEEMVEFMEKVAKTVEVEELTVEERNLLSVAYKNVIGARRASWRIISSIEQKEESRGNEDHVAIIKEYRGKIEAELSKICDGILNLLESNLIPSAASPESKVFYLKMKGDYHRYLAEFKTGAERKEAAESTLLAYKSAQDIALADLAPTHPIRLGLALNFSVFYYEILNSPDRACNLAKQAFDEAISELDTLGEESYKDSTLIMQLLRDNLTLWTSDITDDAGDEIKETSKQQPGE

SEQ ID NO: 22922 - protein, 261 aa, Cyclamen graecum
MVPTEASREDNVYMAKLAEQAERYEEMVEFMEKVAKTVDVEELTVEERNLLSVAYKNVIGARRASWRIISSIEQKEESRGNEDHVAIIKEYRGKIETELSKICSGILSLLESHLVPSASSAESKVFYLKMKGDYYRYLAEFKTGAERKEAAENTLLAYKSAQDIALVDLASTHPIRLGLALNFSVFYYEILNSPDRACNLAKQAFDEAISELDTLGEESYKDSTLIMQLLRDNLTLWTSDVADEGGDDIKETSKRESGEEQ

SEQ ID NO: 22923 - protein, 261 aa, Zingiber officinale
MSPAESSREDNVYLAKLAEQAERYEEMVEYMELVAKPINTEELTVEERNLLSVAYKNVIGARRASRRIISSIEQKEEGRGNENHVTLIKEYRSKVEAELGKICDGILKLLDSHLVPSASTAESKVFYLKMKGDYHRYLAEFKTGAERKEAAESTLLAYKSAQDIALADLAPTHPIRLGLALNFSVFYYEILNSPDRACSLAKQAFDEAISELDTLGEDSYKDSTLIMQLIRDNLTLWTSDITEDGADEIKEASKKESGEGQ

SEQ ID NO: 22924 - protein, 260 aa, Gnetum gnemon
MAAAASLREENVYMAKLAEQAERYEEMVEFMEKVTKAVEAEDLTVEERNLLSVAYKNVIGARRASWRIISSIEQKEESRGNEEHVVMIKEYRAKVETELSKICDSILKLLDTHLIPSSTAGESKVFYLKMKGDYHRYLAEFKTGADRKEAAEHTLLAYKSAQDIANAELAPTHPIRLGLALNFSVFYYEILNSPDRACALAKQAFDEAIAELDTLGEDSYKDSTLIMQLLRDNLTLWTSDMQEDAGDEIKEASKHEGDEQ

SEQ ID NO: 22925 - protein, 261 aa, Sequoia sempervirens
MSPVEASREENVYMAKLAEQAERYEEMVEFMEKVTKGVEVEELTVEERNLLSVAYKNVIGARRASWRIISSIEQKEESRGNDEHVVSIREYRAKVEAELTKICDSILRLLDSHLIPSSTTGESKVFYLKMKGDYHRYLAEFKTGAERKEAAESTLLAYKAAQDIAVAELTPTHPIRLGLALNFSVFYYEILNSPDRACALAKTAFDEAIAELDTLGEDSYKDSTLIMQLLRDNLTLWTSDMQEDAGEEIKDASKIEEGGDQ

SEQ ID NO: 22926 - protein, 261 aa, Taxus baccata
MRPMESSREENVYMAKLAEQAERYEEMVEFMEKVAKTVDVEELSVEERNLLSVAYKNVIGARRASWRIISSIEQKEESRGNDEHVTLIRDYRAKVESELSNICEGILSLLDSHLVPSSTTGESKVFYLKMKGDYHRYLAEFKTGADRKEAAESTLLAYKSAQDIAMAELASTHPIRLGLALNFSVFYYEILNSPDRACALAKQAFDEAIAELDTLGEESYKDSTLIMQLLRDNLTLWTSDMNEDTGDEIKEAPSKREGEGQ

SEQ ID NO: 22927 - protein, 247 aa, Camellia sinensis
MASTESSREENVYMAKLAEQAERYEEMVEFMEKVAKTVDVEELTVEERNLLSVAYENVIGARRASWRIISSIEQKEESRGNEDHVSIIKEYRGKIEAELSKICDGILSLLDSHLVPSASSAESKVFYLKMKGDYHRYLAEFKTGAERKEAAENTLLAYKSAQDIALAELAPTHPIRLGLALNFSVFYYEILNSPDRACNLAKQAFDEAISELDTLGEESYKDSTLIMQLLRDNLTLWTSDITDEGGG

SEQ ID NO: 22928 - protein, 257 aa, Thalictrum flavum
MSPTESSSRDDNVYLAKLAEQAERYEEMVEFMENVAKTVEVEELTVEERNLLSVAYKNVIGARRASWRIISSIEQKEENRGNEDHVVAIKEYRGKIETELCKICDGILSLLDSHLVPSATAAESKVFYLKMKGDYHRYLAEFKTGADRKEAAESTLLAYKSAQDIAVAELAPTHPIRLGLALNFSVFYYEILNSPDRACSLAKQAFDEAISELDTLGEESYKDSTLIMQLLRDNLTLWTSDITDDAGDEIKEAPKPE

SEQ ID NO: 22929 - protein, 256 aa, Triticum aestivum
MSTAEATREENVYMAKLAEQAERYEEMVEFMEKVAKTADVGELTVEERNLLSVAYKNVIGARRASWRIISSIEQKEESRGNEAYVASIKEYRTRIETELSKICDGILKLLDSHLVPSATAAESKVFYLKMKGDYHRYLAEFKAGAERKEAAENTLVAYKSAQDIALADLPTTHPIRLGLALNFSVFYYEILNSPDRACNLAKQAFDEAIAELDSLGEESYKDSTLIMQLLRDNLTLWTSDNAEEGGDEIKEAASKP

SEQ ID NO: 22930 - protein, 264 aa, Pinus taeda
MAAAAMVESSREENVYMAKLAEQAERYEEMVEFMEKVTKGVEVEELTVEERNLLSVAYKNVIGARRASWRIISSIEQKEESRGNDEHVVTIREYRAKVEAELSKICEGILRLLDSHLIPSSTAAESKVFYLKMKGDYHRYLAEFKTGAERKEAAENTLLAYKSAQDIAAAELAPTHPIRLGLALNFSVFYYEILNSPDRACNLAKQAFDEAIAELDTLGEDSYKDSTLIMQLLRDNLTLWTSDMQEDAGEEIKETSKREDGEEQ

SEQ ID NO: 22931 - protein, 261 aa, Brassica rapa
MSSTREENVYLAKLAEQAERYEEMVEFMEKVAKTVDSEELTVEERNLLSVAYKNVIGARRASWRIISSIEQKEESRGNEDHVALIKDYRVKIETELGKICDGILNLLDSHLVPAASLAESKVFYLKMKGDYHRYLAEFKTGAERKDAAESTLLAYKSAQDIALADLPPTHPIRLGLALNFSVFYYEILNSPDRACSLAKQAFDEAISELDTLGEESYKDSTLIMQLLRDNLTLWTSDLNDEVGGDEIKEASKDEPEEGKQA

SEQ ID NO: 22932 - protein, 263 aa, Cucurbita pepo
MSTVDSSREENVYLAKLAEQAERYEEMVEFMEKVAKTVDVEELTVEERNLLSVAYKNVIGARRASWRIISSIEQKEESRGNEDHVAIIKEYRSKIETELSKICDGILSLLESHLIPSASSAESKVFYLKMKGDYHRYLAEFKTGAERKEAAESTLLAYKSAQDIALAELAPTHPIRLGLALNFSVFYYEILNSPDRACNLAKQAFDEAISELDTLGEESYKDSTLIMQLLRDNLTLWTSDVGDEAGDEIKEASKRESGEGHGQ

SEQ ID NO: 22933 - protein, 263 aa, Euonymus alatus
MSPDSSREENVYMAKLAEQAERYEEMVEFMEKVAKTVEVEELTVEERNLLSVAYKNVIGARRASWRIISSIEQKEESRGNEDHVNIIKEYRSKIESELSKICDGILNLLESNLVPSASAAESKVFYLKMKGDYHRYLAEFKTGAERKEAAESTLLAYKSAQDIALAELASTHPIRLGLALNFSVFYYEILNSPDRACNLAKQAFDEAISELDTLGEESYKDSTLIMQLLRDNLTLWTSDIADDAGDEIKEASSKHESSEVQQS

SEQ ID NO: 22934 - protein, 260 aa, Fagopyrum esculentum
MSASREENVYLAKLAEQAERYEEMVEFMEKVAKMVDVDIEELTIEERNLLSVAYKNVIGARRAAWRIISSIEQKEESRGNEDHVFTIKDYRAKIEDELSKICEGILKLLDSHLVPAASSAESKVFYLKMKGDYHRYLAEFKTGAERKEAAESTLLAYKAAQDIALVELPPTHPIRLGLALNFSVFYYEILNSPDRACNLAKQAFDEAISELDTLGEESYKDSTLIMQLLRDNLTLWTSDTADEAGEEIKEAAPGEGADGK

SEQ ID NO: 22935 - protein, 261 aa, Raphanus sativus
MSCTREENVYLAKLAEQAERYEEMVEFMEKVAKTVDTEELTVEERNLLSVAYKNVIGARRASWRIISSIEQKEESRGNEDHVSLIKDYRGKIETELGKICDGILNLLDSHLVPAASLAESKVFYLKMKGDYHRYLAEFKTGAERKDAAESTLLAYKSAQDIALADLPPTHPIRLGLALNFSVFYYEILNSPDRACSLAKQAFDEAISELDTLGEESYKDSTLIMQLLRDNLTLWTSDLNDEVGGDEIKEASKDEPEEGKQA

SEQ ID NO: 22936 - protein, 261 aa, Raphanus sativus
MSSTREENVYLAKLAEQAERYEEMVEFMEKVAKTVDTEELTVEERNLLSVAYKNVIGARRASWRIISSIEQKEESRGNEDHVSLIKDYRGKIETELGKICDGILNLLDSHLVPAASLAESKVFYLKMKGDYHRYLAEFKTGAERKDAAESTLLAYKSAQDIALADLPPTHPIRLGLALNFSVFYYEILNSPDRACSLAKQAFDEAISELDTLGEESYKDSTLIMQLLRDNLTLWTSDLNDEVGGDEIKEASKDEPEEGKQA

SEQ ID NO: 22937 - protein, 262 aa, Cephalotaxus harringtonia
MSHLESSRDESVYMAKLAEQAERYEEMVEYMEKVAKTVDVEELTVEERNLLSVAYKNVIGARRASWRIISSIEQKEESRGNEEHVSMIRDYRGKVEAELTKICDGILRLLDTHLIPSSTSGESKVFYLKMKGDYHRYLAEFKTGAERKEAAENTLLAYKSAQDIALAELASTHPIRLGLALNFSVFYYEILNSPDRACALAKQAFDEAIAELDTLGEESYKDSTLIMQLLRDNLTLWTSDLQDEVGVDEIKEAPKKEEGNSH

SEQ ID NO: 22938 - protein, 262 aa, Gossypium hirsutum
MSPTESSREENVYMAKLAEQAERYEEMVEFMENVAKTVDVGELTVEERNLLSVAYKNVIGARRASWRIISSIEQKEESRGNEDHVATIKKYRSKIEAELSKICDGILSLLESHLIPSASSAESKVFYLKMKGDYHRYLAEFRTAAERKEAAESTLLAYKSAQDIALGDLAPTHPIRLGLALNFSVFYYEILNSPDRACNLAKQAFDEAISELDTLGEESYKDSTLIMQLLRDNLTLWTSDITDEAGDEIKEASKPESGEGQQ

SEQ ID NO: 22939 - protein, 262 aa, Plantago ovata
MSPADSSREDYVYLAKLAEQAERYEEMVEFMEKVAKSTESDELTVEERNLLSVAYKNVIGARRASWRIISSIEQKEEGRGNEDHVRVIKEYRGKIETELSKICDGILGLLDSNLVPAAGSAESKVFYLKMKGDYYRYLAEFKIGAERKEAAENTLAAYKSAQDIALADLAPTHPIRLGLALNFSVFYYEILNSPDRACNLAKQAFDEAISELDTLGEESYKDSTLIMQLLRDNLTLWTSDTTDDAGDEIKESGKNESGEGQE

SEQ ID NO: 22940 - protein, 262 aa, Secale cereale
MSTAEATREENVYMAKLAEQAERYEEMVEFMEKVAKTADVGELTVEERNLLSVAYKNVIGARRASWRIISSIEQKEESRGNEAYVASIKEYRTRIETELSKICDGILKLLDSHLVPSATAAESKVFYLKMKGRPTDRYLAEFKAGAERKEAAENTLVAYKSAQDIALADLPTTHPIRLGLALNFSVFYYEILNSPDRACNLAKQAFDEAIAELDSLGEESYKDSTLIMQLLRDNLTLWTSDNAEEGGDEIKEAASKPEGEGH

SEQ ID NO: 22941 - protein, 260 aa, Sesamum indicum
MSPADSSCEENVYMAKLAEQAERYEEMVEFMEKVVKAVDTDELTVEERNLLSVAYKNVIGARRASWRIISSIEQKEESRGNEDHVNTIKEYRSKIEAELSKICDGILKLLETHLIPSAASAESKVFYLKMKGDYHRYLAEFKTGAERKEAAESTLLAYKSAQDIALAELAPTHPIRLGLALNFSVFYYEILNSPDRACNLAKQAFDEAIAELDTLGEESYKDSTLIMQLLRDNLTLWTSDIADDAGDEIKETAKSGEGQQ

SEQ ID NO: 22942 - protein, 261 aa, Taxus baccata
MSPVEASREENVYMAKLAEQAERYEEMVEFMEKVTKGVEVEELTVEERNLLSVAYKNVIGARRASWRIISSIEQKEESRGNDDHVVTIREYRAKVESELTKICDSILRLLDSHLIPSSTTGESKVFYLKMKGDYHRYLAEFKTGAERKEAAESTLLAYKSAQDIAVAELTPTHPIRLGLALNFSVFYYEILNSPDRACALAKTAFDEAIAELDTLGEDSYKDSTLIMQLLRDNLTLWTSDMQEDAGEEIKEAPKLLEGGDQ

SEQ ID NO: 22943 - protein, 262 aa, Vinca minor
MVLTDSPREENVYMAKLAEQAERYEEMVEFMEKVAKGADAEELTMEERNLFSVAYKNVIGARRASWRIISSIEQKEESRGNEDHVAIIKEYRGKIEAELTKICDGILQLLEGHLIPSANAGESKVFYLKMKGDYHRYLAEFKTGAEKKEAAENTLVAYKSAQDISLAELPPTHPIRLGLALNFSVFYYEILNSPERACALAKQAFDEAISELDTLGEESYKDSTLIMQLLRDNLTLWTSDVPEDAGAEIKEASVNEPGNGEK

SEQ ID NO: 22944 - protein, 259 aa, Conyza canadensis
MASAEPSREENVYMAKLAEQAERYEEMVEFMEKVAKTVDVEELTVEERNLLSVAYKNVIGARRASWRIISSIEQKEESRGNEDHVKLIKDYRATIETELSKICDGILGLLESHLVPSASSAESKIFYLKMKGDYFRYLAEFKTGADRKEAAESTLLAYKSAQDIALSDLAPTHPIRLGLALNFSVFYYEILNSPDRACNLAKQAFDEAIAELDTLGEDSYKDSTLIMQLLRDNLTLWTSDIADEAGDEIKESSKPEETQ

SEQ ID NO: 22945 - protein, 257 aa, Glycine max
MSDSSREENVYMAKLAEQAERYEEMVEFMEKVAKTVEVEELTVEERNLLSVAYKNVIGARRASWRIISSIEQKEESRGNEDHVAIIKEYRGKIEAELSKICDGILNLLESNLIPSAASPESKVFYLKMKGDYHRYLAEFKTGAERKEAAESTLLAYKSAQDIALADLAPTHPIRLGLALNFSVFYYEILNSPDRACNLAKQAFDEAISELDTLGEESYKDSTLIMQLLRDNLTLWTSDITDDAGDEIKETSKQQPGE

SEQ ID NO: 22946 - protein, 259 aa, Arnica chamissonis
MASTEASREENVYMAKLAEQAERYEEMVEFMEKVAKTVDVEELTVEERNLLSVAYKNVIGARRASWRIISSIEQKEESRGNEDHVKLIKDYRATIETELSKICDGILGLLESHIVPSASSAESKIFYLKMKGDYYRYLAEFKTGADRKEAAESTLLAYKSAQDIALSDLAPTHPIRLGLALNFSVFYYEILNSPDRACNLAKQAFDEAIAELDTLGEDSYKDSTLIMQLLRDNLTLWTSDIADDAGDEIKESSKPEETQ

SEQ ID NO: 22947 - protein, 266 aa, Brachypodium distachyon
MSPAEPTREESVYMAKLAEQAERYEEMVEFMERVAKATGGAGPGEELSVEERNLLSVAYKNVIGARRASWRIISSIEQKEEGRGNESHAATIRTYRSKIEAELAKICDGILALLDSHLVPSAGAAESKVFYLKMKGDYHRYLAEFKSGAERKEAAESTMNAYKAAQDIALADLAPTHPIRLGLALNFSVFYYEILNSPDRACNLAKQAFDEAISELDSLGEESYKDSTLIMQLLRDNLTLWTSDTNEDGGDEIKEAPAPKESGDGQ

SEQ ID NO: 22948 - protein, 258 aa, Daucus carota
MVASDASREDNVYNAKLAEQAERYEEMVEFMEKVAKTVDVEELTVEERNLLSVAYKNVIGARRASWRIISSIEQKEESRGNDDHVNIIKEYRGKIEAELSKICDGILNLLDSHLVPSASSAESKVFYMKMKGDYHRYLAEFKVGAERKEAAESTLLAYKSAQDIALAELASTHPIRLGLALNFSVFYYEILNSPDRACNLAKQAFDEAISELDTLGEESYKDSTLIMQLLRDNLTLWTSDIADEAGDEIKEDPKPSDD

SEQ ID NO: 22949 - protein, 256 aa, Chelidonium majus
MASPREEFVYMAKLAEQAERYEEMVEFMEKVTTNVESEELTVEERNLLSVAYKNVIGARRASWRIISSIEQKEESRGNEDNVSTIRDYRSKIETELSSICDGILKLLDSRLIPSATTGDSKVFYLKMKGDYHRYLAEFKTGAERKEAAESTLNAYKSAQDIATAELAPTHPIRLGLALNFSVFYYEILNSPDRACSLAKQAFDEAIAELDTLGEESYKDSTLIMQLLRDNLTLWTSDMQDDGADEIKEAPKREDEQ

SEQ ID NO: 22950 - protein, 259 aa, Cirsium arvense
MASAEASREENVYMAKLAEQAERYEEMVEFMEKVAKTVDVEELTVEERNLLSVAYKNVIGARRASWRIISSIEQKEESRGNEDHVKLIKDYRGSIETELSKICDGILGLLESHLIPSASTAESKIFYLKMKGDYYRYLAEFKTGADRKEAAESTLLAYKSAQDIALSDLAPTHPIRLGLALNFSVFYYEILNSPDRACNLAKQAFDEAIAELDTLGEDSYKDSTLIMQLLRDNLTLWTSDIADEGGDEIKESSKAEESQ

SEQ ID NO: 22951 - protein, 259 aa, Flaveria ramosissima
MAQTEASREENVYMAKLAEQAERYEEMVEFMEKVVKIVDSEELTVEERNLLSVAYKNVIGARRASWRIVSSIEQKEESRGNEDHVTTIKNYRGKIEVELSKICDGILGLLESHLIPSASSAESKVFYLKMKGDYYRYLAEFKTGADRKEAAENTLLGYKSAQDIALADLAPTHPIRLGLALNFSVFYYEILNSPDHACSLAKQAFDEAISELDTLGEDSYKDSTLIMQLLRDNLTLWTSDAADETGDEIKEASNPEEKQ

SEQ ID NO: 22952 - protein, 259 aa, Flaveria ramosissima
MASTEASREENVYMAKLAEQAERYEEMVEFMEKVVKIVDNEELTVEERNLLSVAYKNVIGARRASWRIISSIEQKEESRGNEDHVKLIKDYRATIESELSKICDGILGLLDSHLVPSASSAESKIFYLKMKGDYFRYLAEFKTGADRKEAAESTLLAYKSAQDIALSDLAPTHPIRLGLALNFSVFYYEILNSPDRACNLAKQAFDEAIAELDTLGEESYKDSTLIMQLLRDNLTLWTSDITDEAGDETKEPPKAEETH

SEQ ID NO: 22953 - protein, 261 aa, Zingiber officinale
MPPVEPPREENVYLAKLAEQAERYEEMVESMDKVVKTINGEELTVEERNLLSVAYKNVIGARRASWRIISSIEQKEESRGNEDHVSLIKHYRAEVEAELSKICYGILKLLDSHLVPSATSAESKVFYHKMKGDYHRYLAEFKTGAERKEAAENTLLAYKSAQDIALADLAPTHPIRLGLALNFSVFYYEILNSPDRACSLAKQAFDEAISELDSLGEESYKDSTLIIQLLRDNLTLWTSDITEDGTDEIKEATKKETGEGL

SEQ ID NO: 22954 - protein, 260 aa, Actinidia deliciosa
MVPPELREENVYMAKLAEQAERYEEMVEFMEKVVKSLTSGELTVEERNLLSVAYKNVIGARRASWRIISSIEQKEESRGNEDHVAIIKEYRGKIEAELSKICDGILSLLESNLIPSASSAESKVFYFKMKGDYHRYLAEFKTGAERKEAAESTLLAYKSAQDIAEADLAPTHPIRLGLALNFSVFYYEILNSPDRACDLAKQAFDEAISELDTLGEESYKDSTLIMQLLRDNLTLWTSDITDEGADEIKEASKREPGEGQ

SEQ ID NO: 22955 - protein, 256 aa, Liriodendron tulipifera
MASPREENVYMAKLAEQAERYEEMVEFMEKVTAAVESEELTVEERNLLSVAYKNVIGARRASWRIISSIEQKEESRGNEDHVATIRDYRAKIESELTSICDGILRLLDTRLIPSASAGDSKVFYLKMKGDYHRYLAEFKTGAERKEAAESTLAAYKSAQDIAVAELAPTHPIRLGLALNFSVFYYEILNSPDRACTLAKQAFDEAIAELDTLGEESYKDSTLIMQLLRDNLTLWTSDMQDDGADEIKEAPKREDEQ

SEQ ID NO: 22956 - protein, 257 aa, Mimulus guttatus
MSPSADPSREENVYLAKLSEQAERYEEMVEFMEKVVKTIHGDELTVEERNLLSVAYKNVIGARRASWRIISSIEQKEESRGNEDHVNIIKEYRGKIEAELSKICDGILSLLNSHLVPSAASAESKVFYLKMKGDYYRYLAEFKTGAERKEAAESTLLAYKSAQDIALAELAPTHPIRLGLALNFSVFYYEILNSPDRACALAKQAFDEAISELDTLGEESYKDSTLIMQLLRDNLTLWTSDIADDGGDEIKETSKGE

SEQ ID NO: 22957 - protein, 257 aa, Allium cepa
MSSSREENIYMAKLAEQAERYEEMVEFMEKVVKAADTEELSVEERNLLSVAYKNVIGARRASWRIISSIEQKEESRGNEDHVNMIKEYRAKVEAELSKICDGILKLLDSHLIPSSSGAESKVFYLKMKGDYHRYLAEFLTGDARKDAAEDTLTAYKSAQDIALAEMPPTHPIRLGLALNFSVFYYEILNSPDRACSLAKQAFDEAISELDSLGEESYKDSTLIMQLLRDNLTLWTSDITDDAGDENKEASKKEAEDQ

SEQ ID NO: 22958 - protein, 258 aa, Allium cepa
MSPAELTREENIFMAKLAEQAERYEEMVEYMEHVVKSVNAEELSVEERNLLSVAYKNVIGARRASWRIISSIEQKEESRGNDEHVKMIKEYRANVEAELSKICGGILNLLESHLIPSSVAAESKVFYYKMKGDYYRYLAEFKSGDERKEAAENTLTAYKSAQDIALAEMPPTHPIRLGLALNFSVFYYEILNSPDRACNLAKQAFDEAISELDNLGEESYKDSTLIMQLLRDNLTLWTSDLTEDAGDEIKEAPKGEGQ

SEQ ID NO: 22959 - protein, 257 aa, Allium cepa
MSSSREENIYMAKLAEQAERYEEMVEFMEKVVKAADTEELSVEERNLLSVAYKNVIGARRASWRIISSIEQKEESRGNEEHVNMIKEYRAKVEAELSKICDGILKLLDSHLIPSSSGAESKVFYLKMKGDYHRYLAEFLTGDARKDAAEDTLTAYKSAQDIALAEMPPTHPIRLGLALNFSVFYYEILNSPDRACSLAKQAFDEAISELDSLGEESYKDSTLIMQLLRDNLTLWTSDITDDAGDENKEAPKKEAEDQ

SEQ ID NO: 22960 - protein, 259 aa, Cajanus cajan
MAATDYSREENVYMAKLAEQAERYEEMVEFMEKVAKTVEVEELTVEERNLLSVAYKNVIGARRASWRIISSIEQKEEGRGNEDHVTVIKEYRGKIEAELSKICDGILNLLETNLIPSAATPESKVFYLKMKGDYHRYLAEFKTGAERKEAAESTLLAYKSAQDIALADLAPTHPIRLGLALNFSVFYYEILNSPDRACNLAKQAFDEAISELDTLGEESYKDSTLIMQLLRDNLTLWTSDITDDAGDEIKETSKQQPAE

SEQ ID NO: 22961 - protein, 261 aa, Zostera marina
MSPAESPREENVYLAKVSEQAERYEEMVEFMEKVVKSVDAEELTVEERNLLSVAYKNVIGARRASWRIISSIEQKEESRGNEDHVSLIKTYRGKIEIELSKICDGILKLLETHLIPSASAAESKVFYLKMKGDYYRYLAEFKTGAERKEAAESTLVAYKSAQDTAITDLAPTHPIRLGLALNFSVFYYEILNSPDRACSLAKQAFDEAISELDTLGEESYKDSTLIMQLLRDNLTLWSSDINEEGGDEIKEASKAEGGDEK

SEQ ID NO: 22962 - protein, 264 aa, Amaranthus tuberculatus
MAADSSREENVYLAKLAEQAERYEEMVEFMEKVAKMADAEELTVEERNLLSVAYKNVIGARRASWRIISSIEQKEESRGNEDHVATIKEYRGKIETELSKICDGILNILESHLIPSASTAESKVFYLKMKGDYHRYLAEFKTGAERKEAAENTLLAYKSAQDIALAELAPTHPIRLGLALNFSVFYYEILNSPDRACNLAKQAFDEAISELDTLGEESYKDSTLIMQLLRDNLTLWTSDNAEEGGDEIKEAAGKRESGEGQPQQ

SEQ ID NO: 22963 - protein, 261 aa, Brassica oleracea
MSSTREENVYLAKLAEQAERYEEMVEFMEKVAKTVDSEELTVEERNLLSVAYKNVIGARRASWRIISSIEQKEESRGNEDHVALIKDYRVKIETELGKICDGILNLLDTHLVPAASLAESKVFYLKMKGDYHRYLAEFKTGAERKDAAESTLLAYKSAQDIALADLPPTHPIRLGLALNFSVFYYEILNSPDRACSLAKQAFDEAISELDTLGEESYKDSTLIMQLLRDNLTLWTSDLNDEVGGDEIKEASKDEPEEGKQA

SEQ ID NO: 22964 - protein, 261 aa, Brassica napus
MSSTREENVYLAKLAEQAERYEEMVEFMEKVAKTVDSEELTVEERNLLSVAYKNVIGARRASWRIISSIEQKEESRGNDDHVALIKDYRVKIETELGKICDGILNLLDSHLVPAASLAESKVFYLKMKGDYHRYLAEFKTGAERKDAAESTLLAYKSAQDIALADLPPTHPIRLGLALNFSVFYYEILNSPDRACSLAKQAFDEAISELDTLGEESYKDSTLIMQLLRDNLTLWTSDLNDEVGGDEIKEASKDEPEEGKQA

SEQ ID NO: 22965 - protein, 261 aa, Brassica napus
MSSTREENVYLAKLAEQAERYEEMVEFMEKVAKTVDSEELTVEERNLLSVAYKNVIGARRASWRIISSIEQKEESRGNEDHVALIKDYRGKVETELGKICDGILNLLDTHLVPAASLAESKVFYLKMKGDYHRYLAEFKTGAERKDAAESTLLAYKSAQDIALADLPPTHPIRLGLALNFSVFYYEILNSPDRACSLAKQAFDEAISELDTLGEESYKDSTLIMQLLRDNLTLWTSDLNDEVGGDEIKEASKDEPEEGKQA

SEQ ID NO: 22966 - protein, 260 aa, Panax ginseng
MLPPESSREDNVYMAKLAEQAERYEEMVEFMEKVAKTVDVEELTVEERNLLSVAYKNVIGARRASWRIISSIEQKEESRGNEDHVNIIKEYRGKIEAELSKICDGILNLLESHLVPSASSAESKVFYLKMKGDYHRYLAEFKTGSERKEAAESTLLAYKSAQDIALAELASTHPIRLGLALNFSVFYYEILNSPDRACNLAKQAFDEAISELDTLGGESYKDSTLIMQLLRDNLTLWTSDITDEAGDEIKEAAPSRRVKS

SEQ ID NO: 22967 - protein, 261 aa, Eutrema halophilum
  Sequence also found in Organisms: Eutrema parvulum
MSSTREENVYLAKLAEQAERYEEMVEFMEKVAKTVDTEELTVEERNLLSVAYKNVIGARRASWRIISSIEQKEESRGNGDHVSIIKDYRGKIETELNKICDGILNLLDSHLIPTASLAESKVFYLKMKGDYHRYLAEFKTGSERKEAAESTLLAYKSAQDIALADLPPTHPIRLGLALNFSVFYYEILNSPDRACNLAKQAFDEAISELDTLGEESYKDSTLIMQLLRDNLTLWTSDINDEAGGDEIKEASKPESEEGKQT

SEQ ID NO: 22968 - protein, 261 aa, Silene vulgaris
MADASREDNVYMAKLAEQAERYEEMVEFMEKVAKMADAEELTVEERNLLSVAYKNVIGARRASWRIISSIEQKEESRGNEDHVATIKEYRAKIETELSKICDGILNLLEAHLVPKASSAESKVFYLKMKGDYHRYLAEFKTGAERKEAAENTLLAYKSAQDIALADLAPTHPIRLGLALNFSVFYYEILNSPDRACNLAKQAFDEAISELDTLGEESYKDSTLIMQLLRDNLTLWTSDNAEEGSEEIKEATKGESAEAQPQ

SEQ ID NO: 22969 - protein, 262 aa, Distylium racemosum
MSPVEASREESVYMAKLAEQAERYEEMVEYMEKVAKTVDVEELTVEERNLLSVAYKNVIGARRASWRIISSIEQKEESRGNEEHVSMIREYRAKVEAELSKICDGILRLLDTHLIPSSTSGESKVFYLKMKGDYHRYLAEFKTGAERKEAAESTLLAYKSAQDIAVSELPSTHPIRLGLALNFSVFYYEILNSPDRACTLAKQAFDEAIAELDTLGEESYKDSTLIMQLLRDNLTLWTSDLQDEAGGDEIKEAPKREEGDGH

SEQ ID NO: 22970 - protein, 260 aa, Echinacea purpurea
MASTEASREENVYMAKLAEQAERYEEMVEFMEKVAKTVDVEELTVEERNLLSVAYKNVIGARRASWRIISSIEQKEESRGNEDHVKLIKDYRATIETELSKICDGILGLLESHLVPSASSAESKIFYLKMKGDYYRYLAEFKTGADRKEAAESTLLAYKSAQDIALSDLAPTHPIRLGLALNFSVFYYEILNSPDRACNLAKQAFDEAIAELDTLGEDSYKDSTLIMQLLRDNLTLWTSDIADEAGDEIKESSSKPEETQ

SEQ ID NO: 22971 - protein, 260 aa, Vitis vinifera
MAAAPSAREENVYMAKLAEQAERYEEMVEFMEKVSAAVDSEELTVEERNLLSVAYKNVIGARRASWRIISSIEQKEESRGNEDHVAMIRDYRSKIESELSSICDGILKLLDSRLIPSASSGDSKVFYLKMKGDYHRYLAEFKTGAERKEAAESTLTAYKSAQDIANAELAPTHPIRLGLALNFSVFYYEILNSPDRACNLAKQAFDEAIAELDTLGEESYKDSTLIMQLLRDNLTLWTSDMQDDGADEIKEAPKRDDEQQ

SEQ ID NO: 22972 - protein, 262 aa, Taxus baccata
MSHVESSRDESVYMAKLAEQAERYEEMVEYMEKVAKTVDVEELTVEERNLLSVAYKNVIGARRASWRIISSIEQKEESRGNEEHVSMIRDYRAKVEAELTKICEGILRLLDTHLIPSSTSGESKVFYLKMKGDYHRYLAEFKTGAERKEAAENTLLAYKAAQDIALAELASTHPIRLGLALNFSVFYYEILNSPDRACALAKQAFDEAIAELDTLGEESYKDSTLIMQLLRDNLTLWTSDLQDEVGGDEIKEAPKKEEGNSH

SEQ ID NO: 22973 - protein, 266 aa, Hordeum vulgare
MSPAEPTRDESVYMAKLAEQAERYEEMVEFMERVAKATGGAGPGEELSVEERNLLSVAYKNVIGARRASWRIISSIEQKEEGRGNEAHAATIRSYRTKIEAELAKICDGILALLDSHLVPSAGAAESKVFYLKMKGDYHRYLAEFKSGAERKEAAESTMNAYKAAQDIALADLAPTHPIRLGLALNFSVFYYEILNSPDRACNLAKQAFDEAISELDSLGEESYKDSTLIMQLLRDNLTLWTSDTNEDDVDEIKEAPAPKESGDGQ

SEQ ID NO: 22974 - protein, 259 aa, Ambrosia trifida
MASTEASREENVYMAKLAEQAERYEEMVEFMEKVAKTVDVEELTVEERNLLSVAYKNVIGARRASWRIISSIEQKEESRGNEDHVKQIKDYRATIETELSKICDGILGLLESHLVPSASSAESKIFYLKMKGDYYRYLAEFKTGADRKEAAESTLLAYKSAQDIALSDLAPTHPIRLGLALNFSVFYYEILNSPDRACNLAKQAFDEAIAELDTLGEDSYKDSTLIMQLLRDNLTLWTSDIADEAGDEIKESSKPEETQ

SEQ ID NO: 22975 - protein, 253 aa, Ambrosia trifida
MVQTEASREENVYMAKLAEQAERYEEMVEFMEKVVKNVESEELTVEERNLLSVAYKNVIGARRASWRIISSIEQKEESRGNEDHVTTIKSYRGKIETELSKICDGILALLESHLIPSASSAESKVFYLKMKGDYYRYLAEFKTGADRKEAAENTLLGYKSAQDIALADLAPTHPIRLGLALNFSVFYYEILNSPDRACSLAKQAFDEAISELDTLGEDSYKDSTLIMQLLRDNLTLWTSDVADEAGDEIKEAT

SEQ ID NO: 22976 - protein, 259 aa, Ambrosia trifida
MAQTEASREENVYMAKLAEQAERYEEMVEFMEKVVKNVESEELTVEERNLLSVAYKNVIGARRASWRIISSIEQKEESRGNEDHVATIKNYRSKIETELSKICDGILALLESHLIPSASSAESKVFYLKMKGDYYRYLAEFKTGADRKEAAENTLLGYKSAQDIALADLAPTHPIRLGLALNFSVFYYEILNSPDRACSLAKQAFDEAISELDTLGEDSYKDSTLIMQLLRDNLTLWTSDVADEAGDEIKEASNPEEKQ

SEQ ID NO: 22977 - protein, 257 aa, Brassica napus
MSSREENVYMAKLAEQAERYEEMVEFMEKVAKTVDSEELTVEERNLLSVAYKNVIGARRASWRIISSIEQKEESKGNEEHVAIIKEYRGKIETELSKICDGILNVLEAHLIPSASPAESKVFYLKMKGDYHRYLAEFKAGDERKDAAESTLVAYKSAQDIATAELAPTHPIRLGLALNFSVFYYEILNSPDRACTLAKQAFDEAIAELDTLGEESYKDSTLIMQLLRDNLTLWTSDMTDEAGDEIKEASKPEGGAAE

SEQ ID NO: 22978 - protein, 259 aa, Centaurea maculosa
  Sequence also found in Organisms: Cirsium arvense, Carthamus tinctorius
MASAEASREENVYMAKLAEQAERYEEMVEFMEKVAKTVDVEELTVEERNLLSVAYKNVIGARRASWRIISSIEQKEESRGNEDHVKLIKDYRASIETELSKICDGILGLLESHLIPSASSAESKIFYLKMKGDYYRYLAEFKTGADRKEAAESTLLAYKSAQDIALSDLAPTHPIRLGLALNFSVFYYEILNSPDRACNLAKQAFDEAIAELDTLGEDSYKDSTLIMQLLRDNLTLWTSDIADEGGDEIKESSKAEESQ

SEQ ID NO: 22979 - protein, 271 aa, Cleome spinosa
MSPADLTREENVYMAKLAEQAERYEEMVEFMENVAKTVDTEELTVEERNLLSVAYKNVIGARRASWRIISSIEQKEESRGNEDHVSTIKEYRGKIEAELSKICDGILNLLETHLIPCASSAESKVFYLKMKGDYHRYLAEFKTGTERKEAAENTLLAYKSAQDIALAELAPTHPIRLGLALNFSVFYYEILNSPDRACNLAKQAFDEAISELDTLGEESYKDSTLIMQLLRDNLTLWTSDINDEAGDEIKDASKQESEEGQEAQTAAPPAH

SEQ ID NO: 22980 - protein, 265 aa, Zingiber officinale
MSAVESSREENVYLAKLAEQTERYEEMVEFMEKVVKTLIGEELTVEERNLLSVAYKNVIGARRASWRIISSIEQNEETRGNEDHVSLIKEYRGKVEAELSKICDGILKLLDSHLVPSASSAESKVFYLKMKGDYHRYLAEFKTGAERKEAAENTLLSYKSAQDIALADLASTHPIRLGLALNFSVFYYEILNSPDRACSLAKQAFDEAISELDTLGEESYKDSTLIMQLLRDNLTLWTSDITEDGADEIKEATKKESGEEQRSND

SEQ ID NO: 22981 - protein, 258 aa, Zingiber officinale
MHSSRENNVYLAKLAEQAERYEEMVEFMEKVVRTINGEELSVEERNLLSVAYKNVIGARRASWRIISSIEQKEERRGNEEHVTVIKEYRGKVEAELGKICDGILKLLDSHLVPSASSAESKVFYPKMKGDYHRYLAEFKTGAERKEAAESTMLAYKSAQDIAIADLAPTHPIRLGLALNFSVFYYEILNSPDRACSLAKQAFDEAISELDTLGEESYKDSTLIMQLLRDNLTLWTSDIMEDGGDEIKEGPKKESGDDQ

SEQ ID NO: 22982 - protein, 264 aa, Mesembryanthemum crystallinum
MSSESSREENVYMAKLAEQAERYEEMVEFMEKVAKMTDTEELSVEERNLLSVAYKNVIGARRASWRIISSIEQKEESRGNEDHVSTIKEYRGKIETELSKICDGILNLLESHLIPSASTAESKVFYLKMKGDYHRYLAEFKTGAERKEAAENTLLAYKSAQDIALAELAPTHPIRLGLALNFSVFYYEILNSPDRACNLAKQAFDEAISELDTLGEESYKDSTLIMQLLRDNLTLWTSDNAEEGGDEIKEAAAKRESGEEKPQQ

SEQ ID NO: 22983 - protein, 260 aa, Actinidia deliciosa
MVPPESREENVYMAKLAEQAERYEEMVEFMEKVVKSLTSDELTVEERNLLSVAYKNVIGARRASWRIISSIEQKEESRGNEDHVVIIKEYRGKIEAELSKICDGILSLLESNLIPSASSAESKVFYFKMKGDYHRYLAEFKTGAERKEAAESTLLAYKSAQDIALTDLAPTHPIRLGLALNFSVFYYEILNSPDRACSLAKQAFDEAISELDTLGEESYKDSTLIMQLLRDNLTLWTSDITDEGVDEIKEASKRESGEGQ

SEQ ID NO: 22984 - protein, 266 aa, Leymus cinereus x Leymus triticoides
MSPAEPTRDESVYMAKLAEQAERYEEMVEFMERVAKATGGAGPGEELSVEERNLLSVAYKNVIGARRASWRIISSIEQKEEGRGNEAHAATIRSYRSKIEAELAKICDGILALLDSHLVPSAGAAESKVFYLKMKGDYHRYLAEFKSGAERKEAAESTMNAYKAAQDIALADLAPTHPIRLGLALNFSVFYYEILNSPDRACNLAKQAFDEAISELDSLGEESYKDSTLIMQLLRDNLTLWTSDTNEDDVDEIKEAPAPKESGDGQ

SEQ ID NO: 22985 - protein, 259 aa, Pinus pinaster
MVESSREENVYMAKLAEQAERYEEMVEFMEKVTKGVEVEELTVEERNLLSVAYKNVIGARRASWRIISSIEQKEESRGNDEHVVTIREYRAKVEAELSKICEGILRLLDSHLIPSSTAAESKVFYLKMKGDYHRYLAEFKTGAERKEAAENTLLAYKSAQDIAAAELAPTHPIRLGLALNFSVFYYEILNSPDRACNLAKQAFDEAIAELDTLGEDSYKDSTLIMQLLRDNLTLWTSDMQEDAGEEIKETSKREDGEEQ

SEQ ID NO: 22986 - protein, 258 aa, Petroselinum crispum
MVASDASREDNVYNAKLAEQAERYEEMVEFMEKVAKTVDVEELTVEERNLLSVAYKNVIGARRASWRIISSIEQKEESRGNEDHVNIIKDYRGKIEAELSKICEGILNLLDSHLVPSASSAESKVFYMKMKGDYHRYLAEFKVGAERKEAAESTLLAYKSAQDIALAELASTHPIRLGLALNFSVFYYEILNSPDRACNLAKQAFDEAISELDTLGEESYKDSTLIMQLLRDNLTLWTSDIADETGDEIKEDPKQSDE

SEQ ID NO: 22987 - protein, 257 aa, Chenopodium quinoa
MATESREDSVYMAKLAEQAERYEEMVEFMEKVAKMTDAEELTVEERNLLSVAYKNVIGARRASWRIISSIEQKEESRGNEDHVTTIKEYRGKIETELSKICDGILNLLESHLIPSASSAESKVFYQKMKGDYHRYLAEFKTGAERKEAAENTLLAYKSAQDIALAELPPTHPIRLGLALNFSVFYYEILNSPDRACNLAKQAFDEAISELDTLGEDSYKDSTLIMQLLRDNLTLWTSDNAEEGGDEIKETAGKSGEQ

SEQ ID NO: 22988 - protein, 260 aa, Sarracenia psittacina
MAVASTAREENVYMAKLAEQAERYEEMVEFMEKVTAAVDSEELSVEERNLLSVAYKNVIGARRASWRIISSIEQKEESRGNEDHVAMIRDYRSKIESELSSICDGILKLLDSRLIPSGSSGDSKVFYLKMKGDYHRYLAEFKTGAERKEAAESTLTAYKAAQDIANAELAPTHPIRLGLALNFSVFYYEILNSPDRACSLAKQAFDEAIAELDTLGEESYKDSTLIMQLLRDNLTLWTSDMQDDGADEIKDAPKHDAEQH

SEQ ID NO: 22989 - protein, 261 aa, Sciadopitys verticillata
MSPVESSREENVYMAKLAEQAERYEEMVEFMEKVTKALEVEELTVEERNLLSVAYKNVIGARRASWRIISSIEQKEESRGNDDHVVTIREYRAKVEAELSKICDSILRLLDSHLIPSSTAGESKVFYLKMKGDYHRYLAEFKTGAERKEAAESTLLAYKSAQDIAVAELAPTHPIRLGLALNFSVFYYEILNSPDRACLLAKTAFDEAIAELDTLGEESYKDSTLIMQLLRDNLTLWTSDMQEDAGDEIKETPKPEEGGEQ

SEQ ID NO: 22990 - protein, 287 aa, Panicum virgatum
MSLPAELSREENVYMAKLAEQAERYEEMVEFMEKVAKAVDSEELTVEERNLLSVAYKNVIGARRASWRIISSIEQKEEGRGNEDRVTLIKDYRSKIEVELTKICDGILKLLDSHLVPSSTAPESKVFYLKMKGDYYRYLAEFKTGSERKDAAENTMVAYKAAQDIALAELAPTHPIRLGLALNFSVFYYEILNSPDRACSLAKQAFDEAISELDTLSEESYKDSTLIMQLLRDNLTLWTSESRRMPPKKSRRLPRASLEMGSKDDPCPQKLHFSVRSPSESVMCSGF

SEQ ID NO: 22991 - protein, 260 aa, Tripterygium wilfordii
MAVAPSPREESVYMAKLAEQAERYEEMVEFMEKVSASVDNEELTVEERNLLSVAYKNVIGARRASWRIISSIEQKEESRGNEDHVSTIRDYRSKIENELSNICDGILKLLDTRLIPSASAGDSKVFYLKMKGDYHRYLAEFKTGAERKEAAESTLTAYKAAQDIANAELAPTHPIRLGLALNFSVFYYEILNSPDRACNLAKQAFDEAIAELDTLGEESYKDSTLIMQLLRDNLTLWTSDMQDDGADEIKEAPKRDEDQQ

SEQ ID NO: 22992 - protein, 261 aa, Zamia vazquezii
MSPVESSRKKNVYMAKLAEQAERYEEMVEFMEKVIKTVDVEELTVEERNLLSVAYKNVIGARRASWRIISSIEQKEESRGNDDHVATIREYRAKVESELSSICDSILRLLDSHLIPSSTSGESKVFYLKMKGDYHRYLAEFKTGAERKEAAENTSLAYKSAQDIAGSDLAPTHPIRLGLALNFSVFYYEILNSPDRACALAKQAFDEAIAELDTLGEESYKDSTLIMQLLRDNLTLWTSDMQEDAGEEIRDPSKREEGDEQ

SEQ ID NO: 22993 - protein, 263 aa, Silene vulgaris
MASDASREDNVYMAKLAEQAERYEEMVEFMEKVAKMADADELTVEERNLLSVAYKNVIGARRASWRIISSIEQKEESRGNEDHVATIKEYRSKIETELSKICDGILNLLESHLIPKASAAESKVFYLKMKGDYHRYLAEFKTGAERKEAAENTLLAYKSAQDIALAELAPTHPIRLGLALNFSVFYYEILNSPDRACSLAKQAFDEAISELDTLGEESYKDSTLIMQLLRDNLTLWTSDNADEGNDDIKEAAKGDSGEVQPQQ

SEQ ID NO: 22994 - protein, 264 aa, Picea glauca
MAAAAVVESSREENVYMAKLAEQAERYEEMVEFMEKVTKGVEVEELTVEERNLLSVAYKNVIGARRASWRIISSIEQKEESRGNDEHVVTIREYRSKVESELSKICEGILRLLDSHLIPSSTAAESKVFYLKMKGDYHRYLAEFKTGAERKEAAENTLLAYKSAQDIAAAELAPTHPIRLGLALNFSVFYYEILNSPDRACNLAKQAFDEAIAELDTLGEDSYKDSTLIMQLLRDNLTLWTSDMQEDAGDEIKETSKRDEGEEQ

SEQ ID NO: 22995 - protein, 259 aa, Helianthus annuus
MVQTEASREENVYMAKLAEQAERYEEMVEFMEKVVKIVDSEELTVEERNLLSVAYKNVIGARRASWRIISSIEQKEESRGNEGHVTTIKSYRGKIETELSKICDGILALLESHLIPSASSAESKVFYLKMKGDYYRYLAEFKTGAERKEAAENTLLGYKSAQDIALADLAPTHPIRLGLALNFSVFYYEILNSPDRACSLAKQAFDEAISELDTLGEDSYKDSTLIMQLLRDNLTLWTSDVADETGDEIKETSNPDEEQ

SEQ ID NO: 22996 - protein, 259 aa, Ambrosia trifida
MASTEATREENVYMAKLAEQAERYEEMVEFMEKVVKIVDSEELTVEERNLLSVAYKNVIGARRASWRIISSIEQKEESRGNEDHVKLIKDYRATIETELSKICDGILALLDSHLVPSASSAESKIFYLKMKGDYFRYLAEFKTGADRKEAAESTLLAYKSAQDIALSDLAPTHPIRLGLALNFSVFYYEILNSPDRACNLAKQAFDEAIAELDTLGEDSYKDSTLIMQLLRDNLTLWTSDIADEAGDEIKESTKAEETQ

SEQ ID NO: 22997 - protein, 259 aa, Arnica chamissonis
MASTEASREENVYMAKLAEQAERYEEMVEFMEKVVKIVDVEELNVEERNLLSVAYKNVIGARRASWRIISSIEQKEESRGNEDHVKLIKDYRATIETELSKICDGILALLDSHLVPSASSAESKIFYLKMKGDYFRYLAEFKTGAERKEAAESTLLAYKSAQDIALSDLAPTHPIRLGLALNFSVFYYEILNSPDRACNLAKQAFDEAIAELDTLGEDSYKDSTLIMQLLRDNLTLWTSDIADEAGDEIKEPSKAEETQ

SEQ ID NO: 22998 - protein, 259 aa, Artemisia annua
MVQSEVSREDNVYLAKLAEQAERYEEMVEFMEKVVKAVDAEELTVEERNLLSVAYKNVIGARRASWRIISSIEQKEESRGNEDHVTVIKEYRSKIETELSKICDGILGLLDSHLVPSASAAESKVFYLKMKGDYYRYLAEFKTGAERKEAAEKTLLAYKSAQDIAVTDLASTHPIRLGLALNFSVFYYEILNSPDRACNLAKQAFDEAISELDTLGEDSYKDSTLIMQLLRDNLTLWTSDVADEAGDEIKEASNPEEKQ

SEQ ID NO: 22999 - protein, 258 aa, Brassica napus
  Sequence also found in Organisms: Brassica juncea, Brassica rapa
MSSSSREENVYMAKLAEQAERYEEMVEFMEKVAKSVDNEELTVEERNLLSVAYKNVIGARRASWRIISSIEQKEESKGNEDHVAIIKDYRGKIEAELSKICDGILNVLEAHLIPSASPAESKVFYLKMKGDYHRYLAEFKAGNERKDAAESTLVAYKSAQDIATAELAPTHPIRLGLALNFSVFYYEILNSPDRACSLAKQAFDEAIAELDTLGEESYKDSTLIMQLLRDNLTLWTSDMTDEAGDEIKETSKPEGAAE

SEQ ID NO: 23000 - protein, 257 aa, Brassica oleracea
MSSSREENVYMAKLAEQAERYEEMVEFMEKVAKSVDNEELTVEERNLLSVAYKNVIGARRASWRIISSIEQKEESKGNEDHVAIIKDYRGKIEAELSKICDGILNVLEAHLIPSASPAESKVFYLKMKGDYHRYLAEFKAGNERKDAAESTLVAYKSAQDIATAELAPTHPIRLGLALNFSVFYYEILNSPDRACSLAKQAFDEAIAELDTLGEESYKDSTLIMQLLRDNLTLWTSDMTDEAGDEIKETSKPEGAAE

SEQ ID NO: 23001 - protein, 257 aa, Brassica napus
  Sequence also found in Organisms: Brassica oleracea
MSSREVNVYMAKLAEQAERYEEMVEFMEKVAKTVDSEELTVEERNLLSVAYKNVIGARRASWRIISSIEQKEESKGNEEHVAIIKEYRGKIETELSKICDGILNVLEAHLIPSASPAESKVFYLKMKGDYHRYLAEFKAGDERKDAAESTLVAYKSAQDIATAELAPTHPIRLGLALNFSVFYYEILNSPDRACTLAKQAFDEAIAELDTLGEESYKDSTLIMQLLRDNLTLWTSDMTDEAGDEIKEASKPEGGAAE

SEQ ID NO: 23002 - protein, 262 aa, Beta vulgaris
MSPAEGSRDENVYLAKLAEQAERYEEMVEFMEKVAKTVDVEELTVEERNLLSVAYKNVIGARRASWRITSSIEQKEESRGNDDHVAIIKEYRGKIEAELSKICQGILKLLDSHLIPTATIAESKVFYLKMKSDYHRYLAEFMTGSERKESAEHTLLAYKSAQDIALAELAPTHPIRLGLALNFSVFYYEILNSPDRACALAKQAFDEAISELDTLGEESYKDSTLIMQLLRDNLTLWTSDNTDEVGDEIKELAKDESAPGQH

SEQ ID NO: 23003 - protein, 259 aa, Vaccinium corymbosum
MATPTPREDNVYMAKLAEQAERYEEMVEFMEKVSSLNDSEELTVEERNLLSVAYKNVIGARRASWRIISSIEQKEESRGNADHVAAIKDYRAKIESELSSICDGILKLLDSKLIPSAASGDSKVFYLKMKGDYHRYLAEFKSGAERKEAAENTLNGYKAAQDIANAELAPTHPIRLGLALNFSVFYYEILNSPDRACSLAKQAFDEAIAELDTLGEDSYKDSTLIMQLLRDNLTLWTSDMQEDGGDEIKEAPKRDDEQQ

SEQ ID NO: 23004 - protein, 248 aa, Theobroma cacao
MSPTESSREENVYMAKLAEQAERYEEMVEFMEKVAKTVDVEELTVEERNLLSVAYKNVIGARRASWRIISSIEQKEESRGNEDHVAIIKEYRGKIEAELSKICDGILSLLESHLIPSASSAESKVFYLKMKGDYHRYLAEFKTGAERKEAAESTLLAYKSAQDIALAELAPTHPIRLGLALNFSVFYYEILNSPDRACNLAKQAFDEAISELDTLGEESYKDSTLIMQLLRDNLTLWTSDITVSLSLS

SEQ ID NO: 23005 - protein, 259 aa, Cedrus atlantica
MVESSREENVYMAKLAEQAERYEEMVEFMEKVTKGVEVEELTVEERNLLSVAYKNVIGARRASWRIISSIEQKEESRGNDEHVVTIREYRAKVESELSKICEGILRLLDSHLIPSSTAAESKVFYLKMKGDYHRYLAEFKTGAERKEAAENTLLAYKSAQDIAAAELAPTHPIRLGLALNFSVFYYEILNSPDRACNLAKQAFDEAIAELDTLGEDSYKDSTLIMQLLRDNLTLWTSDMQEDAGDEIKETSKREEGEEQ

SEQ ID NO: 23006 - protein, 258 aa, Ceratodon purpureus
MTSESREENVYMAKLAEQAERYDEMVEAMEKVAKTVDTEELTVEERNLLSVAFKNVIGARRASWRIISSIEQKEESKGNEDHVSAIKEYRSKVEAELSTICDSILKLLDSHLIPSSTTGESKVFYLKMKGDYHRYLAEFKTGAERKEAAEATLLAYKSAQDIALTELAPTHPIRLGLALNFSVFYYEILNSPDRACTLAKQAFDEAIAELDTLGEESYKDSTLIMQLLRDNLTLWTSDMQDDIGEEGKDSKIEDADDH

SEQ ID NO: 23007 - protein, 258 aa, Cichorium intybus
MASEASREENVYMAKLAEQAERYEEMVEFMEKVAKTVDVEELTVEERNLLSVAYKNVIGARRASWRIISSIEQKEESRGNEDHVKLIKDYRSTIETELSKICDGILSLLESHLVPSASSAESKIFYLKMKGDYYRYLAEFKTGAERKEAAESTLLAYKSAQDIALSDLAPTHPIRLGLALNFSVFYYEILNSPDRACNLAKQAFDEAIAELDTLGEDSYKDSTLIMQLLRDNLTLWTSDIADETGDEIKESSKAEEAQ

SEQ ID NO: 23008 - protein, 259 aa, Cichorium intybus
MVQTEASRDENVYMAKLAEQAERYEEMVEFMEKVVKTVDTEELTMEERNLLSVAYKNVIGARRASWRITSSIEQKEESRGNEDHVTIIKNYRSKIESELSKICDGILSLLDSHLVPSASSAESKVFYLKMKGDYYRYLAEFKTGSDRKEAAENTLLAYKSAQDIALADLASTHPIRLGLALNFSVFYYEILNSPDRACNLAKQAFDEAISELDTLGEDSYKDSTLIMQLLRDNLTLWTSDVGDEVGDEIKEASNLEEKE

SEQ ID NO: 23009 - protein, 260 aa, Trifolium pratense
MAAAPTPREENVYMAKLAEQAERYEEMVEFMEKVSANADNEELTVEERNLLSVAYKNVIGARRASWRIISSIEQKEESRGNEDHVTVIRDYRSKIESELSNICDGILKLLDSRLIPSASSGDSKVFYLKMKGDYHRYLAEFKTGAERKDAAEATLAAYKSAQDIANAELPPTHPIRLGLALNFSVFYYEILNSPDRACNLAKQAFDEAIAELDTLGEESYKDSTLIMQLLRDNLTLWTSDMQDDGADEIKEAAPKPDEQQ

SEQ ID NO: 23010 - protein, 260 aa, Cocos nucifera
MAAVAATREENVYMAKLAEQAERYEEMVEFMEGVTAAMAEGEELTVEERNLLSVAYKNVIGARRASWRIVSSIEQKEESRGNQDHVAAIRDYRARIEAELTKICDGILNLLDSRLVLSAAAVDSKVFYLKMKGDYYRYLAEFKTGSERKDAAESTLNAYKAAQDIALPELAPTHPIRLGLALNFSVFYYEILNSPDRACTLAKQAFDEAISELDTLGEESYKDSTLIMQLLRDNLTLWTSDMQDDGADDIKEATKNEDEQ

SEQ ID NO: 23011 - protein, 262 aa, Eucalyptus grandis
MSPSDSSREEYVYMAKLAEQAERYEEMVDFMEKVAKTVDVEELTVEERNLLSVAYKNVIGARRASWRIISSIEQKEESRGNTDHVSIIKDYRGKIESELSKICEGILSLLESHLIPSASSAESKVFYLKMKGDYHRYLAEFKTATERKEAAESTLLAYKSAQDIAGAELASTHPIRLGLALNFSVFYYEILNSPDRACALAKQAFDEAIAELDTLGEESYKDSTLIMQLLRDNLTLWTSDLTDEAGDDIKEASKLESGEGQQ

SEQ ID NO: 23012 - protein, 259 aa, Flaveria ramosissima
MGSMEASREENVYMAKLAEQAERYEEMVEFMEKVAKTVDVEELSVEERNLLSVAYKNVIGARRASWRIISSIEQKEESRGNEDHVKLIKDYRATIETELSKICDGILGLLESHLVPSASSAESKIFYLKMKGDYYRYLAEFKTGADRKEAAENTLLAYKSAQDIALSDLAPTHPIRLGLALNFSVFYYEILNSPDRACNLAKQAFDEAIAELDTLGEDSYKDSTLIMQLLRDNLTLWTSDITDEGGDEIKESSKPEETQ

SEQ ID NO: 23013 - protein, 262 aa, Plantago ovata
MSPSDSPREENVYMAKLAEQAERYEEMVEFMEKVAKTSDTDELTVEERNLLSVAYKNVIGARRASWRIISSIEQKEESRGNEDHVSIIKDYRGKIETELSKICDGILNLLETHLVPAASSAESKVFYLKMKGDYHRYLAEFKTGAERKEAAESTLLAYKSAQDIALADLAPTHPIRLGLALNFSVFYYEILNSPDRACNLAKQAFDEAISELDTLGEESYKDSTLIMQLLRDNLTLWTSDTTDEVGDEIKEAAKPVPGEGQE

SEQ ID NO: 23014 - protein, 259 aa, Platanus occidentalis
MAAAAPREENVYMAKLAEQAERYEEMVEFMEKVTATVEAEELTVEERNLLSVAYKNVIGARRASWRIISSIEQKEESRGNEDHVAIIRDYRSKIESELSSICDGILRLLDSRLIPSSSAGDSKVFYLKMKGDYHRYLAEFKSGADRKEAAENTLAAYKSAQDIAVAELAPTHPIRLGLALNFSVFYYEILNSPDRACTLAKQAFDEAIAELDTLGEESYKDSTLIMQLLRDNLTLWTSDMQDDGADEIKEAPKPNDEQQ

SEQ ID NO: 23015 - protein, 259 aa, Pseudotsuga menziesii
MVESSREENVYMAKLAEQAERYEEMVEFMEKVTKGVEVEELTVEERNLLSVAYKNVIGARRASWRIISSIEQKEESRGNDEHVVTIREYRSKVESELSKICEGILRLLDSHLIPSSTAAESKVFYLKMKGDYHRYLAEFKTGAERKEAAENTLLAYKSAQDIAAAELAPTHPIRLGLALNFSVFYYEILNSPDRACNLAKQAFDEAIAELDTLGEDSYKDSTLIMQLLRDNLTLWTSDMQEDAGDEIKETSKREEGEEQ

SEQ ID NO: 23016 - protein, 258 aa, Raphanus sativus
MTSSSREENVYMAKLAEQAERYEEMVEFMEKVAKSVDNEELTVEERNLLSVAYKNVIGARRASWRIISSIEQKEESKGNEDHVAIIKDYRGKIEAELSKICDGILNVLEAHLIPSASPPESKVFYLKMKGDYHRYLAEFKAGDERKDAAESTLVSYKSAQDIATAELAPTHPIRLGLALNFSVFYYEILNSPDRACSLAKQAFDEAIAELDTLGEESYKDSTLIMQLLRDNLTLWTSDMTDEAGDEIKETSKPEGAAE

SEQ ID NO: 23017 - protein, 246 aa, Secale cereale
MSTAEATREENVYMAKLAEQAERYEEMVEFMEKVAKTADVGELTVEERNLLSVAYKNVIGARRASWRIISSIEQKEESRGNEAYVASIKEYRTRIETELSKICDGILKLLDSHLVPSATAAESKVFYLKMKGDYHRYLAEFKAGAERKEAAENTLVAYKSAQDIALADLPTTHPIRLGLALNFSVFYYEILNSPDRACNLAKQAFDEAIAELDSLGEESYKDSTLIMQLLRDNLTLWTSDNAEEGR

SEQ ID NO: 23018 - protein, 259 aa, Helianthus annuus
MASTEASREDNVYMAKLAEQAERYEEMVEFMEKVVKIVDSEELTVEERNLLSVAYKNVIGARRASWRIISSIEQKEESRGNEDHVKLIKDYRATIETELSKICDGILALLDSHLVPSASTAESKIFYLKMKGDYFRYLAEFKTGADRKEAAESTLLAYKSAQDIALSDLAPTHPIRLGLALNFSVFYYEILNSPDRACNLAKQAFDEAIAELDTLGEDSYKDSTLIMQLLRDNLTLWTSDIADEAGDEIKESAKAEETQ

SEQ ID NO: 23019 - protein, 260 aa, Helianthus annuus
KNGATEASREENVYMAKLAEQAERYEEMVEFMEKVVKIVDSEELTVEERNLLSVAYKNVIGARRASWRIISSIEQKEESRGNEDHVTTIKSYRGKIETELSKICDGILALLESHLIPSASSAESKVFYLKMKGDYYRYLAEFKTGAERKEAAENTLLGYKSAQDIALADLAPTHPIRLGLALNFSVFYYEILNSPDRACSLAKQAFDEAISELDTLGEDSYKDSTLIMQLLRDNLTLWTSDVADETGDEIKETSNPEEKQ

SEQ ID NO: 23020 - protein, 260 aa, Tripterygium wilfordii
MAVTPSPREENVYMAKLAEQAERYEEMVEFMEKLSASVDNEELTVEERNLLSVAYKNVIGARRASWRIISSIEQKEESRGNEDHVSTIRDYRSKIENELSNICDGILKLLDTRLIPSASAGDSKVFYLKMKGDYHRYLAEFKTGAERKEAAESTLTAYKAAQDIANAELAPTHPIRLGLALNFSVFYYEILNSPDRACNLAKQAFDEAIAELDTLGEESYKDSTLIMQLLRDNLTLWTSDMQDDGADEIKEAPKRDDDQQ

SEQ ID NO: 23021 - protein, 260 aa, Tripterygium wilfordii
MAVTPSPREESVYMAKLAEQAERYEEMVEFMEKVSASVDNEELTVEERNLLSVAYKNVIGARRASWRIISSIEQKEESRGNEDHVSTIRDYRSKIENELSNICDGILKLLDTRLIPSASAGDSKVFYLKMKGDYHRYLAEFKTGAERKEAAESTLTAYKAAQDIANAELAPTHPIRLGLALNFSVFYYEILNSPDRACNLAKQAFDEAIAELDTLGEESYKDSTLIMQLLRDNLTLWTSDMQDDGADEIKEAPKPDEDKQ

SEQ ID NO: 23022 - protein, 246 aa, Momordica charantia
EEMVEFMEKVAKTVDSEELTVEERNLLSVAYKNVIGARRASWRIISSIEQKEEGRGNEDRVTLIKDYRGKIETELTKICDGILKLLESHLVPSSTAPESKVFYLKMKGDYYRYLAEFKTGAERKDAAENTMVAYKAAQDIALAELPPTHPIRLGLALNFSVFYYEILNSPDRACSLAKQAFDEAISELDTLSEESYKDSTLIMQLLRDNLTLWTSDISEDPAEEIRRHPSTTRARGSKDGFTCPRN

SEQ ID NO: 23023 - protein, 266 aa, Triticum aestivum
MSPAEPTRDESVYMAKLAEQAERYEEMVEFMERVAKATGGAGPGEELSVEERNLLSVAYKNVIGARRASWRIISSIEQKEEGRGNDAHAATIRSYRSKIEAELAKICDGILALLDSHLVPSAGAAESKVFYLKMKGDYHRYLAEFKSGGERKEAAESTMNAYKAAQDIALADLAPTHPIRLGLALNFSVFYYEILNSPDRACNLAKQAFDEAISELDSLGEESYKDSTLIMQLLRDNLTLWTSDTNEDDVDEIKEAPAPKESGDGQ

SEQ ID NO: 23024 - protein, 477 aa, Populus trichocarpa
MGLGSEEGKVKSSWDVCKSKERKKKDGTKAGCWVKLRLVGGCISSRSKVDSSVSGTSTHFESKSINDTSTDQPAVPVVSSSTTSNTESNSSLSKLEEELKVASRLRKFTFNDLKLATRNFRPESLLGEGGFGCVFKGWIEENGTAPVKPGTGLTVAVKTLNHDGLQGHKEWLAEVNYLGDLVHPNLVKLIGYCIEDDQRLLVYEFMPRGSLENHLFRRSLPLPWSIRMKIALGAAKGLAFLHEEAERPVIYRDFKTSNILLDADYNAKLSDFGLAKDAPEGDKTHVSTRVMGTYGYAAPEYVMTGHLTSRSDVYSFGVVLLEMITGRRSMDKNRPNGEHNLVEWARPYLGERRRFYRLIDPRLQGHFSIKGAQKAAQLAAHCLSRDPKARPLMSEVVDTLKPLPNLKDMASSSYYFQTMQGDRVGSSPNAKNGVRSQAGLLSRNGHQQRSFSIPHGPHASPFHHQYPHQSPKPSGKP

SEQ ID NO: 23025 - protein, 485 aa, Prunus persica
  Sequence also found in Organisms: Prunus mume
MGLGAENGKVESWSMCKSKVRKKKKKDDDDDVEEEETGCWVRLRFFGSCISSRSKVDSSISGTSTHCETKSTNDTSRDQPTATVVSSSTTSNTESNASTSKLEEELKVASRLRKFTFNDLKLATRNFRPESLLGEGGFGCVFKGWIEENGTAPVKPGTGLTVAVKTLNHDGLQGHKEWLAEVNFLGDLVHPNLVKLIGYCIEDDQRLLVYEFMPRGSLENHLFRRSLPLPWSIRMKIALGAAKGLAFLHEEAERPVIYRDFKTSNILLDADYNAKLSDFGLAKDGPEGDKTHVSTRVMGTYGYAAPEYVMTGHLTSRSDVYSFGVVLLEMLTGRRSMDKNRPNGEHNLVEWARPHLGERRRFYRLIDPRLEGHFSIKGVQKAAQLAAHCLSRDPKARPLMSEVVEALKPLPNLKDMASSSYYFQTMQADRVGSSPNTRNGVRTQAGLLTRNGHHQQRSLSIPNGSHASPYHHQYPHQSPKPNSKP

SEQ ID NO: 23026 - protein, 482 aa, Cannabis sativa
MGIGAENGKVESWDVYKSKVRKKKKVDDADEEEETGCWVRLRFIGSCISSRSKVDSSISGTSTHYESKSTNETSRDHPTAAVVSSTTTSNAESNSSTSKLEEELKVASRLRKFTFNDLKMATRNFRPESLLGEGGFGCVFKGWIEENGTAPVKPGTGLTVAVKTLNHDGLQGHKEWLAEVNFLGDLVHPNLVKLIGYCIEDDQRLLVYEFMPRGSLENHLFRRSLPLPWSIRMKIALGAAKGLAFLHEEAERPVIYRDFKTSNILLDADYNAKLSDFGLAKDGPEGDKTHVSTRVMGTYGYAAPEYVMTGHLTSRSDVYSFGVVLLEMLTGRRSMDKNRPNGEHNLVEWARPHLGERRKFYKLIDPRLEGHFSIKGAQKAAQLASHCLSRDPKSRPLMSEVVEVLKPLPNLKDMASSSYYFQTMNADRVASSPNARNGVRTQGGLMSRNGHQQRSLSIPHGSHASPFHHQYPHQSPKPNGKA

SEQ ID NO: 23027 - protein, 486 aa, Citrus sinensis
MGFDGENGKVKKASWDSSKSKAKKKKKKVEDEVEVEEEEETGCWVKLRFFGSCISSRSKVDSSVSGTSTHYESKSTNDTSRDQPAAAVISSTTTSNAESNSSTSKLEEELKVASRLRKFTFNDLKLATRNFRPESLLGEGGFGCVFKGWIEENGTAPVKPGTGLTVAVKTLNHDGLQGHKEWLAEVNFLGDLVHLNLVKLIGYCIEDDQRLLVYEFMPRGSLENHLFRRSLPLPWSIRMKIALGAAKGLAFLHEEAERPVIYRDFKTSNILLDADYNAKLSDFGLAKDGPEGDKTHVSTRVMGTYGYAAPEYVMTGHLTSRSDVYSFGVVLLEMLTGRRSMDKNRPNGEHNLVEWARPHLGERRRFYRLIDPRLEGHFSIKGAQKAAQLAAHCLSRDPKARPLMSEVVEALKPLPNLKDMASSSYYFQTMQAERIGSSPNTRNGIRAQGGSLSRNGQRSLSIPNGSYASPYHHQFPHPSPKPNGKP

SEQ ID NO: 23028 - protein, 486 aa, Citrus clementina
MGFDGENGKVKKASWDSSKSKAKKKKKKVEDEVEVEEEEETGCWVKFRFFGSCISSRSKVDSSVSGTSTHYESKSTNDTSRDQPAAAVISSTTTSNAESNSSTSKLEEELKVASRLRKFTFNDLKLATRNFRPESLLGEGGFGCVFKGWIEENGTAPVKPGTGLTVAVKTLNHDGLQGHKEWLAEVNFLGDLVHLNLVKLIGYCIEDDQRLLVYEFMPRGSLENHLFRRSLPLPWSIRMKIALGAAKGLAFLHEEAERPVIYRDFKTSNILLDADYNAKLSDFGLAKDGPEGDKTHVSTRVMGTYGYAAPEYVMTGHLTSRSDVYSFGVVLLEMLTGRRSMDKNRPNGEHNLVEWARPHLGERRRFYRLIDPRLEGHFSIKGAQKAAQLAAHCLSRDPKARPLMSEVVEALKPLPNLKDMASSSYYFQTMQAERIGSSPNTRNGIRAQGGSLSRNGQRSLSIPNGSYASPYHHQFPHPSPKPNGKP

SEQ ID NO: 23029 - protein, 481 aa, Vitis vinifera
MGLGGNDVKVESWEVGKSKGRKKKDGGEEETGCCWVKLRFMASCISSRSKVDSSISGTSTHYENRSTNDTSRDQPVAPVVSSTTTSNAESNSSTSKLEEELKVASRLRKFSFNDLKMATRNFRPESLLGEGGFGCVFKGWIEENGTAPVKPGTGLTVAVKTLNHDGLQGHKEWLAEVNFLGDLIHPNLVKLIGYCIEDDQRLLVYEFMPRGSLENHLFRRALPLPWAIRMKIALGAAKGLAFLHEEAERPVIYRDFKTSNILLDAEYNAKLSDFGLAKDGPEGDKTHVSTRVMGTYGYAAPEYVMTGHLTSRSDVYSFGVVLLEMLTGRRSMDKNRPNGEHNLVEWARPHLGERRRFYRLIDPRLEGHFSIKGAQKAAQLAAHCLSRDPKVRPLMSEVVEALKPLPNLKDMASSSYYFQTMQAERIGSSPNARNGVRTQQGILSRNGHQQQRSLSIPNGSHASPYHQNQYPYQSPKPNGKP

SEQ ID NO: 23030 - protein, 486 aa, Gossypium hirsutum
MGLGFQEGKVKSWDTCKSKERKKKKNSGKEDLDDEAAVEETGCWVKLRFIGSCISSRSKVDSSVSGTSTNYDSKSAYDTSKDQPAAPVVSSTTTSNAESSSSTSKLEDELKVASRLRKFTFNDLKLATRNFRPESLLGEGGFGCVFKGWIEENGTAPVKPGTGLTVAVKTLNHDGLQGHKEWLAEVNYLGDLIHPNLVKLIGYCIEDDQRLLAYEFMPRGSLENHLFRRSLPLPWSIRMKIALGAAKGLAFLHEEAERPVIYRDFKTSNILLDADYNAKLSDFGLAKDGPEGDKTHVSTRVMGTYGYAAPEYVMTGHLTSRSDVYSFGVVLLEMLTGRRSMDKNRPNGEHNLVEWARPHLGERRRFYRLIDPRLEGHFSIKGAQKAAQLAAHCLSRDPKARPLMSEVVEVLKPLPNLKDMASSSYYFQTMQAERVGSSPLTRNGTRAQASSLSRNGHRSLSIPNGSHASPYHHQYPYQSPKPNGKP

SEQ ID NO: 23031 - protein, 486 aa, Gossypium raimondii
MGLGFQEGKVKSWDTCKSKERKKKKNSEKEDLDDEAAVEETGCWVKLRFIGSCISSRSKVDSSVSGTSTNYDSKSAYDTSKDQPAAPVVSSTTTSNAESSSSTSKLEDELKVASRLRKFTFNDLKLATRNFRPESLLGEGGFGCVFKGWIEENGTAPVKPGTGLTVAVKTLNHDGLQGHKEWLAEVNYLGDLIHPNLVKLIGYCIEDDQRLLAYEFMPRGSLENHLFRRSLPLPWSIRMKIALGAAKGLAFLHEEAERPVIYRDFKTSNILLDADYNAKLSDFGLAKDGPEGDKTHVSTRVMGTYGYAAPEYVMTGHLTSRSDVYSFGVVLLEMLTGRRSMDKNRPNGEHNLVEWARPHLGERRRFYRLIDPRLEGHFSIKGAQKAAQLAAHCLSRDPKARPLMSEVVEVLKPLPNLKDMASSSYYFQTMQAERVGSSPLTRNGTRAQASSLSRNGHRSLSIPNGSHASPYHHQYPYQSPKPNGKP

SEQ ID NO: 23032 - protein, 486 aa, Cajanus cajan
MGLGAENGKVMVESLDVCKSKGRKKKKKEDGDIEEEEETGCWFRLRFIGSCISSRSKVDSSVSGTSTNYAESKSTNDTSRDQPTVPVVSSTTTSNAESNSSTSKLEEELKVASRLRKFTFNDLKLATRNFRPESLLGEGGFGCVFKGWIEENGTAPVKPGTGLTVAVKTLNHDGLQGHKEWLAEVNYLGDLVHPNLVKLIGYCIEDDQRLLVYEFMPRGSLENHLFRRSLPLPWSIRMKIALGAAKGLAFLHEEAERPVIYRDFKTSNILLDADYNAKLSDFGLAKDGPEGDKTHVSTRVMGTYGYAAPEYVMTGHLTSRSDVYSFGVVLLEMLTGRRSMDKNRPNGEHNLVEWARPHLGERRRFYRLIDPRLEGHFSIKGAQKAAHLAAHCLSRDPKARPLMSEVVEALKPLPNLKDMASSSYYFQTMQADRFSASPNTRNGRTQGALLTRNGQQQRSLSIPHGTHASPYHHQFPQPSPKPNGKA

SEQ ID NO: 23033 - protein, 480 aa, Amsonia hubrichtii
MGLGGDGEKVESWDVGKSKGKKKKKKDGAVETGCWVKLRFIGSCISSRSKVDSSISGISTHCESKSANDTSRDQPVAAIISSTATSNGESNSSTSKLEEELKVASRLRKFTFNDLKLATRNFRPESLLGEGGFGCVFKGWIEENGTAPVKPGTGLTVAVKTLNHDGLQGHKEWLAEVSFLGDLIHPNLVKLIGYCIEDDQRLLVYEFMPRGSLENHLFRRSLPLPWSIRMKIALGAAKGLAFLHEEAERPVIYRDFKTSNILLDADYNAKLSDFGLAKDGPEGDKTHVSTRVMGTYGYAAPEYVMTGHLTSKSDVYSFGVVLLEMLTGRRSMDKNRPNGEHNLVEWARPHLGERRRFYRLIDPRLEGHFSIKGAQKAAQLAARCLSRDPKARPLMSDVVDALKPLPALKDMASSSYYFQTMQADRVGSSPNTRNGIRSHAASFSRNGQQHPRSLSIPNGSHASPYHHQFPHNSPKPNGKR

SEQ ID NO: 23034 - protein, 488 aa, Quercus alba
MGLGGENGKVESWEVGKSKVVKKKKKKEVVEAKGGVEEEEIGCWVRLRFLGSCISSRSKVDSSISGTTTHYAESKSTNDTSRDQPAAPIVPSSTTSNAESNSSTSKLEEELKVASRLRKFSFNDLKLATRNFRPESLLGEGGFGCVFKGWIEENGTAPVKPGTGLTVAVKTLNHDGLQGHKEWLAEVNFLGDLVHPNLVKLIGYCIEDDQRLLVYEFMPRGSLENHLFRRSLPLPWSIRMKIALGAAKGLAFLHEEAERPVIYRDFKTSNILLDADYNAKLSDFGLAKDGPEGDKTHVSTRVMGTYGYAAPEYVMTGHLTSRSDVYSFGVVLLEMLTGRRSMDKNRPNGEHNLVEWARPHLGERRRFYRLIDPRLEGHFSIKGAQKAAQLAAHCLSRDPKARPLMSEVVEVLKPLPNLKDMASSSYYFQTMQADRVGSSPNARNGIRTQGGSFSRNGQQQRSLSINSSHASPYHHHYTFQSPKPNGKP

SEQ ID NO: 23035 - protein, 489 aa, Manihot esculenta
MGLGSEDGEVKASLDVCQSKGRKKKKKDGGVGCSGEDDVVEEAETGCWFKFRFIGSCISSRSKIDSSVSGTSGESKSTNDTSRDQPAAPAISSTTTSNTESNSSTSKLEEELKIASRLRKFAFNDLKLATRNFRPESLLGEGGFGCVFKGWIEENGTAPVKPGTGLTVAVKTLNHDGLQGHKEWLAEVNFLGDLVHPNLVKLIGYCIEDDQRLLVYEFMPRGSLENHLFRRSLPLPWSIRMKIALGAAKGLAFLHEEAERPVIYRDFKTSNILLDADYNSKLSDFGLAKDGPEGDKTHVSTRVMGTYGYAAPEYVMTGHLTSRSDVYSFGVVLLEMISGRRSMDKNRPIGEHNLVEWARPHLGERRRFYRLIDPRLEGHFSIKGAQKAAQLAAHCLSRDPKARPLMSEVVEALKPLPNLKDMASSSYYFQTMQADRIASSPNAKNSSRIQGGLLRNGQQQRSLSIPNGSHPSPYHHQYPHQSPKPIGKP

SEQ ID NO: 23036 - protein, 487 aa, Glycine max
MGLGGAENGKVVVESLDVCKSKGRKKKKKEDGEVEEKEETGCWFRLRFIGSCISSRSKVDSSVSGTSTNYAESKSTIDTSRDQPTVPVVSSTTTSNAESNSSTSKLEEEFKVSSRLRKFTFNDLKLATRNFRPESLLGEGGFGCVFKGWIEENGTAPVKPGTGLTVAVKTLNHDGLQGHKEWLAEVNYLGDLVHPHLVKLIGYCIEDDQRLLVYEFMPRGSLENHLFRRSLPLPWSIRMKIALGAAKGLAFLHEEAERPVIYRDFKTSNILLDAEYNAKLSDFGLAKDGPEGDKTHVSTRVMGTYGYAAPEYVMTGHLTSRSDVYSFGVVLLEMLTGRRSMDKNRPNGEHNLVEWARPHLGERRRFYRLIDPRLEGHFSIKGAQKAAHLAAHCLSRDPKARPLMSEVVEALKPLPNLKDMASSSYYFQTMQADRFSASPNTRNGRTQGALLTRNGQQQRSLSIPHGTHASPYHHQFPQPSPKPNGKA

SEQ ID NO: 23037 - protein, 487 aa, Glycine max
MGLGGAENGKVVVESLDVCKSKGRKKKKKEDGEVEEEEETGCWFRLRFIGSCISSRSKVDSSVSGTSTNYAESKSTIDTSRDQPTLRVVSSTTTSNAESNSSTSKLEEELKVASRLRKFAFNDLKLATRNFRPESLLGEGGFGCVFKGWIEENGTAPVKPGTGLTVAVKTLNHDGLQGHKEWLAEVNYLGDLVHPHLVKLIGYCIEDDQRLLVYEFMPRGSLENHLFRRSLPLPWSIRMKIALGAAKGLAFLHEEAERPVIYRDFKTSNILLDAEYNSKLSDFGLAKDGPEGDKTHVSTRVMGTYGYAAPEYVMTGHLTSRSDVYSFGVVLLEMLTGRRSMDKNRPNGEHNLVEWARPHLGERRRFYKLIDPRLEGHFSIKGAQKAAHLAAHCLSRDPKARPLMSEVVEALKPLPNLKDMASSSYYFQTMQADRFSVSPNTRNGRTQGALLTRNGQQQRSLSIPHGTHASPYHHQFPQPSPKPNGKA

SEQ ID NO: 23038 - protein, 491 aa, Malus domestica
MGLKAEDGKVEAWDICKSKVRRKKKQKADGDDDDDVEEEGSGCWVRLRYFGSCISSRSKVDSSISGTSNTHCGETKSINDTSRDQPTATVVSSSTTSNTESNASTSKLEEELKVASRLRKFTFIDLKWATRNFRPESLLGEGGFGCVFKGWIEENGTAPVKPGTGLTVAVKTLNHDGLQGHKEWLAEVNYLGDLVHPNLVKLVGYCIEDDQRLLVYEFMPRGSLENHLFRRSLPLPWSIRMKIALGAAKGLAFLHEEAERPVIYRDFKTSNILLDADYNAKLSDFGLAKDGPEGDKTHVSTRVMGTYGYAAPEYVMTGHLTSRSDVYSFGVVLLEMLTGRRSMDKNRPNGEHNLVEWARPHLGERRRFYRLIDPRLEGHFSIKGVQKAAQLAAHCLSRDPKARPLMSEVVEALKPLPALKDMASSSYYFQTMQGDRVGSSPNTRNGVRPQGGLLTRNGHHQQRSLSIPNGTHASPYHHQYPHPSPKPNVKP

SEQ ID NO: 23039 - protein, 488 aa, Cicer arietinum
MGLGGENENGKVTESLDVCKSKGRKKKKKQDGVVQNEEETGCWLSFRFIGSCISSRSKVDSSVSGTSTNYAESKSTIDTSRDQPMLPVVSSTTTSNAESNSSTSKLEEELKVASRLRKFCFNDLKLATRNFRPESLLGEGGFGCVFKGWIEENGTAPVKPGTGLTVAVKTLNHDGLQGHKEWLAEVNYLGDLVHPHLVKLIGYCIEDDQRLLVYEFMPRGSLENHLFRRSLPLPWSIRMKIALGAAKGLAFLHEEAERPVIYRDFKTSNILLDADYNAKLSDFGLAKDGPEGDKTHVSTRVMGTYGYAAPEYVMTGHLTSRSDVYSFGVVLLEMITGRRSMDKNRPNGEHNLVEWARPHLGERRRFYRLIDPRLEGHFSIKGAQKAAHLAAHCLSRDPKARPLMSEVVEALKPLPNLKDMASSSYYFQTMQADRFSASPNTRNGRTQGALLARNGQQRSLSISHGTHASPFHHQYPQHSPKPSGKAQS

SEQ ID NO: 23040 - protein, 488 aa, Fragaria vesca
MGLGAENGQMKVQAWDISKSKVRRRKKKNVVDDGDDDVEEGETGCWLRLRFFGSCISSRSKVDSSISGTSTHCEIKSTNDTSRDQPMATVVSNSTTSNAESNASTAKFEEELKVASRLRKFAFNDLKLATRNFRPESLLGEGGFGCVFKGWIEENGTAPVKPGTGLTVAVKTLNHDGLQGHKEWLAEVNFLGDLVHPNLVKLIGYCIEDDQRLLVYEFMPRGSLENHLFRRSLPLPWSIRMKIALGAAKGLAFLHEEAERPVIYRDFKTSNILLDADYNAKLSDFGLAKDGPEGDKTHVSTRVMGTYGYAAPEYVMTGHLTSRSDVYSFGVVLLEMLTGRRSMDKNRPNGEHNLVEWARPHLGDRRRFYRLIDPRLEGHFSIKGVQKAAQLAAHCLSRDPKARPLMSEVVEALKPLPNLKDMASSSYYFQTMQGDRVGSSPNTRNGVRTQGGLLTRNGHRSLSIPNGSHASPYHHQFPHPSPKPNGKT

SEQ ID NO: 23041 - protein, 478 aa, Rosmarinus officinalis
MGLADDGLKVESWGVEKSKGRKEIDDDAVEETGCWIKLRFIGSCISSRSKVDNSLSGISTHESKSTNGTSIDQPVAPVIPSTTTSNAESNSSSSKLEEELKVSSRLRKFTFIDLKLATRNFRPESLLGEGGFGCVFKGWIEENGTAPVKPGTGLTVAVKTLNHDGLQGHKEWLAEVSFLGDLIHPNLVKLIGYCIEDDQRLLVYEFMPRGSLENHLFRRSLPLPWSIRMKIALGAAKGLAFLHEEAERPVIYRDFKTSNILLDADYNAKLSDFGLAKDGPEGDKTHVSTRVMGTYGYAAPEYVMTGHLTSKSDVYSFGVVLLEMLTGRRSMDKNRPNGEHNLVEWARPHLGERRRFYRLIDPRLEGHFSIKGAQKAAQLAARCLSRDPKVRPLMSEVVEALKPLPALKDMASSSYYFQTMQADRVGSSPNTRNGIRSQAATFSRNGQQHRSLSIPNGSHASPYHHQFPQNSPKPNGKQ

SEQ ID NO: 23042 - protein, 477 aa, Solanum lycopersicum
MGLGGDGEKGESWDVEKSKGKKKEVVEEETGCWTKLWFIGSCISSRSKVDSSISGISTHCESKSTNDTSRDQPVAPIISSTTTSNAESNSSTSKLEEELKVSSRLRKFAFNDLKLATRNFRPESLLGEGGFGCVFKGWIEENGTAPVKPGTGLTVAVKTLNHDGLQGHKEWLAEVNFLGDLVHPNLVKLIGYCIEDDQRLLVYEFMPRGSLENHLFRRSMPLPWSIRMKIALGAAKGLAFLHEEAERPVIYRDFKTSNILLDADYNAKLSDFGLAKDGPEGDKTHVSTRVMGTYGYAAPEYVMTGHLTSKSDVYSFGVVLLEMITGRRSMDKNRPNGEHNLVEWARPHLGERRRFYRLVDPRLEGHFSIKGAQKAAQLAARCLSRDPKVRPMMSEVVEALKPLPNLKDMASSSYYFQTMQADRVGSSPSTKNGVRTQGSFSRNGQQHPRSLSIPNGSHASPYHQQFPQNSPKPNGKT

SEQ ID NO: 23043 - protein, 478 aa, Capsicum annuum
MGLGGDGIKGESWNVEKAKGKKKKDISEEETGCWTKLWFIGSCISSRSKVDSSISGISTHCESKSTNDTSRDQPVAPIISSTTTSNAESNSSTSKLEEELKVSSRLRKFAFNDLKMATRNFRPESLLGEGGFGCVFKGWIEENGTAPVKPGTGLTVAVKTLNHDGLQGHKEWLAEVNFLGDLVHPNLVKLIGYCIEDDQRLLVYEFMPRGSLENHLFRRSMPLPWSIRMKIALGAAKGLAFLHEEAERPVIYRDFKTSNILLDADYNAKLSDFGLAKDGPEGDKTHVSTRVMGTYGYAAPEYVMTGHLTSKSDVYSFGVVLLEMITGRRSMDKNRPNGEHNLVEWARPHLGERRRFYRLVDPRLEGHFSIKGAQKAAQLAARCLSRDPKARPMMSEVVEALKPLPNLKDMASSSYYFQTMQADRVGSSPSTKNGVRTQGSFSRNGQQHPRSLSIPNGTHASPYHQQFPQNSPKPNGKT

SEQ ID NO: 23044 - protein, 477 aa, Solanum phureja
MGLGGDGEKGESWDVEKSKGKKKKEVAEEETGCWTKLWFIGSCISSRSKVDSSISGISTHCESKSTNTSRDQPVAPIISSTTTSNAESNSSTSKLEEELKVSSRLRKFAFNDLKLATRNFRPESLLGEGGFGCVFKGWIEENGTAPVKPGTGLTVAVKTLNHDGLQGHKEWLAEVNFLGDLVHPNLVKLIGYCIEDDQRLLVYEFMPRGSLENHLFRRSMPLPWSIRMKIAVGAAKGLAFLHEEAERPVIYRDFKTSNILLDADYNAKLSDFGLAKDGPEGDKTHVSTRVMGTYGYAAPEYVMTGHLTSKSDVYSFGVVLLEMITGRRSMDKNRPNGEHNLVEWARPHLGERRRFYRLVDPRLEGHFSIKGAQKAAQLAARCLSRDPKARPMMSDVVEALKPLPNLKDMASSSYYFQTMQADRVGSSPSTKNGVRTQGSFSRNGQQHPRSLSIPNGSHASPYHQQFPQNSPKPNGKT

SEQ ID NO: 23045 - protein, 482 aa, Nicotiana benthamiana
MGLGNDDGVKGESWDVKKSKGKRKNKEVTEEETTGCWTKLWFIGSCISSRSKVDSSISGISSTNCESKSTNDTSRDQPVAPIISSTTTSNAESNSSTSKLEEELKVSSRLRKFAFNDLKMATRNFRPESLLGEGGFGCVFKGWIEENGTAPVKPGTGLTVAVKTLNHDGLQGHKEWLAEVNFLGDLVHPNLVKLIGYCIEDDQRLLVYEFMPRGSLENHLFRRSMPLPWSIRMKIALGAAKGLAFLHEEAERPVIYRDFKTSNILLDADYNAKLSDFGLAKDGPEGDKTHVSTRVMGTYGYAAPEYVMTGHLTSKSDVYSFGVVLLEMITGRRSMDKNRPNGEHNLVEWARPHLGERRRFYRLVDPRLEGHFSIKGAQKAAQLAARCLSRDPKARPMMSEVVEALKPLPNLKDMASSSYYFQTMQADRVGSSPSTRNGVRTQGSFSRNGQQHPRSLPIPNGSHASPYHHQFPQNSPKPNGKT

SEQ ID NO: 23046 - protein, 495 aa, Ricinus communis
MGLGSEDGNRAKASSWEVCKPKGRNKKKQDVSNSSGGASPGDVVEEAETGCWFKFRFIGSCISSRSKVDSSVSGTSTHCESKSTNDTSRDQPTAPTISSTTTSNAESNSSTSKLEEELKIASRLRKFTFNDLKLATRNFRPESLLGEGGFGCVFKGWIEENGTAPVKPGTGLTVAVKTLNHDGLQGHKEWLAEVNYLGDLVHPNLVKLIGYCIEDDQRLLVYEFMPRGSLENHLFRRSLPLPWSIRMKIALGAAKGLAFLHEEAERPVIYRDFKTSNILLDADYNAKLSDFGLAKDGPEGDKTHVSTRVMGTYGYAAPEYVMTGHLTSRSDVYSFGVVLLEMITGRRSMDKNRPIGEHNLVEWARPHLGERRRFYRLIDPRLEGHFSIKGAQKAAQLAAHCLSRDPKARPLMSEVVEVLKPLPNLKDMASSSYYFQSMQADKIASSPNAKSSNRTQGGLLRNGQQQRSLSIPNGSHASPYHHQYPFQSPKPNGKQ

SEQ ID NO: 23047 - protein, 491 aa, Glycine max
MGLGGENGKVVESWDVCKSKGGRKKKKKGDAEEVEEGAEAEAGCWVRLRFIGSCISSRSKVDTSVSASGISTHYAESKSTNDTSRDQPTAPAVSSTTTSNAESNSSTSKLEEELKIASRLRKFSFNDLKSATRNFRPESFLGEGGFGCVFKGWIEENGTAPVKPGTGLTVAVKTLNHDGLQGHKEWLAEVNFLGDLVHPNLVKLVGYCIEDDQRLLVYEFMPRGSLENHLFRRSMPLPWSIRMKIALGAAKGLAFLHEEAERPVIYRDFKTSNILLDADYNAKLSDFGLAKDGPEGDKTHVSTRVMGTYGYAAPEYVMTGHLTSKSDVYSFGVVLLEMLTGRRSMDKHRPNGEHNLVEWARPHLGERRRFYRLIDPRLEGHFSVKGAQKAAQLAAHCLSRDPKSRPLMSEVVEALKPLPSLKDMASSSYYFQAMQADRFGASPNTRNGRMQGALLTRNGQQQRSLSIPNGTYASPYHHQFPQPSPKPNGKA

SEQ ID NO: 23048 - protein, 485 aa, Phaseolus vulgaris
MGLGAENGKVVEPWDVCKSKGRKKKKGDEEVEGAGSGCWLRLRFIGSCISSRSKVDTSVSGSGTSTHYAESKSTNDTSRDQPTAPAVSSTTTSIAESNSSTSKLEEELKIASRLRKFPFNDLKLATRNFRPESFLGEGGFGCVFKGWIEENGTAPVKPGTGLTVAVKTLNHDGLQGHKEWLAEVNFLGDLVHPNLVKLVGYCIEGDQRLLVYEFMPRGSLENHLFRRSLPLPWSIRMKIALGAAKGLAFLHEEADRPVIYRDFKTSNILLDAEYNAKLSDFGLAKDGPEGDKTHVSTRVMGTYGYAAPEYVMTGHLTSKSDVYSFGVVLLEMLTGRRSMDKHRPNGEHNLVEWARPHLGERRRFYKLIDPRLEGHFSVKGAQKAAQLAAHCLCRDPKARPLMSEVVEALKPLPNLKDMASSSYYYQTMQADRIGASPNTRNGRTQGALLTRNGHQQRSLSIPNGTYASPYHHRFPQPSPKPNGKA

SEQ ID NO: 23049 - protein, 489 aa, Medicago truncatula
MGLGGDNGKVIESLDVCKSKGWKKKKKQDGVMEDEETETGCWLSFRFIGSCISSRSKVDSSVSGTSTNYAESKSTIDTSRDQPSVPVVSSTTTTTSNAESNSSTSKVEDEIKVASRLRKFSFNDLKLATRNFRPESLLGEGGFGCVFKGWIEENGTAPVKPGTGLTVAVKTLNHDGLQGHKEWLAEVNYLGDLVHQNLVKLIGYCIEDDQRLLVYEFMPRGSLENHLFRRSLPLPWSIRMKIALGAAKGLAFLHEEAERPVIYRDFKTSNILLDAEYNAKLSDFGLAKDGPEGDKTHVSTRVMGTYGYAAPEYVMTGHLTSRSDVYSFGVVLLEMITGRRSMDKNRPNGEHNLVEWARPHLGERRRFYRLIDPRLEGHFSIKGAQKAAHLAAHCLSRDPKARPLMSEVVEALKPLPNLKDMASSSYYFQTMQADRFSASPNTRNGRTQGAFTRNGQQQRSLSISHGTHASPFHHQYPQNSPKPTGKAQS

SEQ ID NO: 23050 - protein, 509 aa, Theobroma cacao
MGLGLEEGKVKSWDMCKSKGRKKKKNSEKEDLDDEAVVEETGCWVKLRLIGSCISARSKVDSSVSGTSTHYVLLRGKIGLGNIVKTLVLSTRADYSKSANDTSRDQPTAPVVSSTTTSNAESNASTSKLEEELKVASRLRKFAFNDLKLATRNFRPESLLGEGGFGCVFKGWIEENGTAPVKPGTGLTVAVKTLNHDGLQGHKEWLAEVNFLGDLVHPNLVKLIGYCIEDDQRLLVYEFMPRGSLENHLFRRSLPLPWSIRMKIALGAAKGLAFLHEEAERPVIYRDFKTSNILLDADYNAKLSDFGLAKDGPEGDKTHVSTRVMGTYGYAAPEYVMTGHLTSRSDVYSFGVVLLEMLTGRRSMDKNRPNGEHNLVEWARPHLGERRRFYRLIDPRLEGHFSIKGAQKAAQLAAHCLSRDPKARPLMSEVVEALKPLPNLKDMASSSYYFQTMQAERIGSSPNARNGIRTQAGLLSRNGQRSLSIPNGSHASPYHHKYPYQSPKPNGKP

SEQ ID NO: 23051 - protein, 482 aa, Solanum phureja
MGLGGDGVKGESWDVEKSKGRKKKEGDEEETGCWMKLRFISSCISSRSKVDNSISGISTRCESKSTNDTSIDQPVAPIISSTTTSNAESNSSTSKLEEELKVFSQLRKFTFNDLKLATRNFRPESLLGEGGFGCVFKGWIEENGTAPVKPGTGLTVAVKTLNHDGLQGHKEWLAEVNFLGDLIHPNLVKLIGYCIEDDQRLLVYEFMPRGSLENHLFRRSLPLPWSIRMKIALGAAKGLAFLHEEAERPVIYRDFKTSNILLDADYNAKLSDFGLAKDAPEGDKTHVSTRVMGTYGYAAPEYVMTGHLTSKSDVYSFGVVLLEMMTGRRSMDKNRPNGEHNLVEWARPHLGERRRFYKLIDPRLEGHFSIKGAQKAAQLAARCLSRDPKVRPMMSDVVEALKPLPNLKDMASSSYYFQTMQADRVGSSPSPNTRNVLRTQGSFSRNGQQQQQPRSLSIPNGAHASPYRHQLSQNSPNPNGKP

SEQ ID NO: 23052 - protein, 482 aa, Panax ginseng
MVLSGDGVKVESWEVGKSKDRKKKDGDVEESGCWIKLRFIGSCISSRSKVDNSISGISTHCESKSTNGTSKDQPAPVISSTTTSIAESNSSTSKLEEELKVATRLRKFAFNDLKMATRNFRPESLLGEGGFGCVFKGWIEENGTAPVKPGTGLTVAVKTLNHDGLQGHKEWLAEVNFLGDLIHPNLVKLIGYCIEDDQRLLVYEFMPRGSLENHLFRRSLPLPWSIRMKIALGAAKGLAFLHEEAERLVIYRDFKTSNILLDAEYNAKLSDFGLAKDGPEGDKTHVSTRVMGTYGYAAPEYVMTGHLTSKSDVYSFGVVLLEMLTGRRSMDKNRPNGEHNLVEWARPHLGERRRFYKLIDPRLEGHFSIKGAQKAAHLAARCLSRDPKVRPVMSEVVEVLKPLPNLKDMASSSYYFQTIQVDRVGSSPNTRNGLNGIRSQAGSFSRNGQQHPRSLSIRNGSHASPYHLHQFPHHSPKPEGKP

SEQ ID NO: 23053 - protein, 481 aa, Solanum lycopersicum
MGLGGDGVKGGSWDVEKSKGRKKKEGDEEETGCWMKLRFISSCISSRSKVDNSISGISTRCESKSTNDTKIYQPVAPIISSTTTSNAESNSSTSKLEEELKVFSQLRKFTFNDLKLATRNFRPESLLGEGGFGCVFKGWIEENGTAPVKPGTGLTVAVKTLNHDGLQGHKEWLAEVNFLGDLIHPNLVKLIGYCIEDDQRLLVYEFMPRGSLENHLFRRSLPLPWSIRMKIALGAAKGLAFLHEEAERPVIYRDFKTSNILLDADYNAKLSDFGLAKDAPEGDKTHVSTRVMGTYGYAAPEYVMTGHLTSKSDVYSFGVVLLEMMTGRRSMDKNRPNGEHNLVEWARPHLGERRRFYKLIDPRLEGHFSIKGAQKAAQLAARCLSRDPKVRPMMSDVVEVLKPLPNLKDMASSSYYFQTTQADRVGSSPSPNTRNVLRTQGSFSRNGQQQPPRSLSIPNGSHASPYRHQLSQNSPNPNGKP

SEQ ID NO: 23054 - protein, 478 aa, Rosmarinus officinalis
MGLADDGLKVESWGVEKSKERKKIDDDAVETGCWIKLRFIGSCISSRSKVDNSLSGISTHESKSTNGTTIDQPAAPGIPSTTTSNAESNSSSSKLEEELKVSSRLRKFTFIDLKLATRNFRPESLLGEGGFGCVFKGWIEENGTAPVKPGTGLTVAVKTLNHDGLQGHKEWLAEVNFLGDLVHPNLVKLIGYCIEDDQRLLVYEFMPRGSLENHLFRRSLPLPWSIRMKIALGAAKGLTFLHEEAERPVIYRDFKTSNILLDAEYNSKLSDFGLAKDAPDEGKTHVSTRVMGTYGYAAPEYVMTGHLTSKSDVYSFGVVLLEVVTGRRSMDKNRPNGEHNLVEWARPHLGDRKRFYRLIDPRLEGHFSIKGAQKAALLAARCLSRDPKARPLMSEVVEALKPLPNLKDMASSSYYFRTMQADRVSSSPNGKNGLRTHGSFSRNGQHQQHPRSLSIPNGSHASPYHQFAHNSPKPNGKP

SEQ ID NO: 23055 - protein, 493 aa, Trifolium pratense
MGLDGVNGKVIESLDVCKSKGRKKKKLQDRVMEDEENETGCWHSFRFIGGCISSRSKVDSSVSGTGTNYAESKSTLDTSRDQPSVPVVSSTTTTTTTTTSNAESNSSTSKIEEELKVASRLRKFCFNDLKLATRNFRPESLLGEGGFGCVFKGWIEENGTAPVKPGTGLTVAVKTLNHDGLQGHKEWLAEVNYLGDLVHQNLVKLIGYCIEDDQRLLVYEFMPRGSLENHLFRRSLPLPWSIRMKIALGAAKGLAFLHEEAERPVIYRDFKTSNILLDAEYNAKLSDFGLAKDGPEGDKTHVSTRVMGTYGYAAPEYVMTGHLTSRSDVYSFGVVLLEMITGRRSMDKNRPNGEHNLVEWARPHLGERRRFYRLIDPRLEGHFSIKGAQKAAQLAAHCLSRDPKARPLMSEVVEALKPLPNLKDMASSSYYFQTMQADRFSASPNTRNGRTQGGSARNGQQQRSLSISHGTHASPFHHQYPQHSPKPTGKAQS

SEQ ID NO: 23056 - protein, 490 aa, Cicer arietinum
MGLLGGGNGEVVESWDVCKSKGVKKRKKNKKGKENEGVVKEEETGCWVRLWLIGSCISSRSKVDNSVSGTSTHYADSKSTNDTSRGQPTATVISSTTTSNTESNSSTSKLEEELKIASRLRKFSFNDLKLATRNFRPESFLGEGGFGCVFKGWIEENGTAPVKPGTGLTVAVKTLNHDGLQGHKEWLAEVNFLGDLVHQNLVKLIGYCIEDDQRLLVYEFMPRGSLENHLFRRSLPLPWSIRMKIALGAAKGLAFLHEEAERPVIYRDFKTSNILLDADYNAKLSDFGLAKDGPEGDKTHVSTRVMGTYGYAAPEYVMTGHLTSKSDVYSFGVVLLEMLSGRRSMDKHRPNGEHNLVEWARPHLGERRRFYRLIDPRLEGHFSIKGAQKAAQLAAHCLSRDPKARPLMSEVVEALKPLPNLKDMASSSYYFQTMQAERFGASPNSRSVHAQGPFARNGQQRRTLSIPNGTHVSPYHHKFPQQSPKPNGKA

SEQ ID NO: 23057 - protein, 489 aa, Trifolium pratense
MGLGGVNGKVIESLDVGKSKGRKKKKLQNGAMEDEENDSGCWHSFRFIGNCISSRSKVDSSVSGTSNNYAESKSTIDTSRDQPSVPVVSSTTTTTSNAESSSSTSKLEEELKIASRLRKFSFNDLKLATRNFRPESLLGEGGFGCVFKGWIEENGTAPVKPGTGLTVAVKTLNHDGLQGHKEWLAEVNYLGDLVHQNLVKLIGYCIEDDQRLLVYEFMPRGSLENHLFRRSLPLPWSIRMKIALGAAKGLAFLHEEAERPVIYRDFKTSNILLDAEYNAKLSDFGLAKDGPEGDKTHVSTRVMGTYGYAAPEYVMTGHLTSRSDVYSFGVVLLEMITGRRSMDKNRPNGEHNLVEWARPHLGERRRFYRLIDPRLEGHFSIKGAQKAAQLAAHCLSRDPKARPLMSEVVEALMPLPNLKDMASSSYYFQTMQADRFSASPNNRNGRTQGGSARNGQQQRSLSISHGTHASPFRHRYPQNSPKPTGKAQS

SEQ ID NO: 23058 - protein, 481 aa, Panax ginseng
MGLSGDGVKVESWEVGKSNDRKKKDGDVEETGCWIKLRFIGSCISSRSKVDNSISGISTHCDGKCTNDTGKDQPAPVISSTTTSIAESNSSTSKLEEELRVASRLRKFAFNDLKMATRNFRPESLLGEGGFGCVFKGWIEENGTAPVKPGTGLTVAVKTLNHDGLQGHKEWLAEVNFLGDLIHPNLVKLIGYCIEDDQRLLVYEFMSRGSLENHLFRRSLPLPWSIRMKISLGAAKGLAFLHEEAERLVIYRDFKTSNILLDAEYNAKLSDFGLAKDGPEGDKTHVSTRVMGTYGYAAPEYVMTGHLTSKSDVYSFGVVLLEMLTGRRSMDKNRPNGEQNLVEWARPHLGERKRFYRLIDPRLEGHFSIKGAQKAAHLAARCLSRDPKVRPLMSEVVEALKPLPNLKDMASSSFYFQTIQADRIGSSPNTRNGSNGIRSQGGSFSRNGQQHPRSLSIPNGSHASPYHHQFPHYSPKPQGKP

SEQ ID NO: 23059 - protein, 481 aa, Rosmarinus officinalis
MGLADDGLKVESWGVEKSKGRKEIDDDAVEETGCWIKLRFIGSCISSRSKVDNSLSGISTHESKSTNGTSIDQPVAPVIPSTTTSNAESNSSSSKLEEELKVSSRLRKFTFIDLKLATRNFRPESLLGEGGFGCVFKGWIEENGTAPVKPGTGLTVAVKTLNHDGLQGHKEWLAEVNFLGDLVHPNLVKLIGYCIEDDQRLLVYEFMPRGSLENHLFRRSLPLPWSIRMKIALGAAKGLAFLHEEAERPVIYRDFKTSNILLDAEYNSKLSDFGLAKDAPDEGKTHVSTRVMGTYGYAAPEYVMTGHLTSKSDVYSFGVVLLEVVTGRRSMDKNRPNGEHNLVEWARPHLGDRKRFYRLIDPRLEGHFSIKGAQKAAQLAARCLSRDPKVRPLMSEVVEALKPLPNLKDMASSSYYFQTMQADRVSASPNGKNGLRTQGSFLRNGPHQHQQHPRSLSIPNGSHASPYHQFAHNSPKPNGKP

SEQ ID NO: 23060 - protein, 482 aa, Panax ginseng
MGLSGDGVKVESWEVGKSNDRKKKDGDVEETGCWIKLRFIGSCISSRSKVDNSISGISTHCADSKCTNDTGKDQPTPVISSTTTSIAESNSSTSKLEEELRVASRLRKFAFNDLKMATRNFRPESLLGEGGFGCVFKGWIEENGTAPVKPGTGLTVAVKTLNHDGLQGHKEWLAEVNFLGDLIHPNLVKLIGYCIEDDQRLLVYEFMSRGSLENHLFRRSLPLPWSIRMKISLGAAKGLAFLHEEAERLVIYRDFKTSNILLDAEYNAKLSDFGLAKDGPEGDKTHVSTRVMGTYGYAAPEYVMTGHLTSKSDVYSFGVVLLEMLTGRRSMDKNRPNGEQNLVEWARPHLGERKRFYRLLDPRLEGHFSIKGAQKAAHLAARCLSRDPKVRPLMSEVVEALKPLPNLKDMASSSYYFQTIQADRIGSSPNTRNGSNGIRSQGGSFSRNGQQHPRSLSIPNGSHASPYHHQFPHYSPKPQGKP

SEQ ID NO: 23061 - protein, 487 aa, Lotus japonicus
MGLGAENGAKVVVESWDVSKSKGRKKKKKEVEGVVEEEETGCWVGFRFIGSCISSRSKVDSSVSGPSSHYAESKSTNYTSRDQQTAPVVPSTTTSNAESNSSTSRLEEELKIASRLRKFCFNDLKLATRNFRPESFLGEGGFGCVFKGWIEENGTAPVKPGTGLTVAVKTLNHDGLQGHKEWLAEVNFLGDLVHPNLVKLVGYCIEEDQRLLVYEFMSRGSLENHLFRRALPLPWSIRMKIALGAAKGLAFLHEEAERPVIYRDFKTSNILLDADYNAKLSDFGLAKDGPEGDKTHVSTRVMGTYGYAAPEYVMTGHLTSKSDVYSFGVVLLEMLTGRRSMDKHRPNGEHNLVEWARPHLGERRRFYRLIDPRLEGHFSIKGAQKAAQLAAHCLSRDPKARPLMSEVVEALKPLPSLKDMASSSYYFQTMQAERFRASPNTRSTPTQGSLLTRNGQQRRSLSMANGTHASPYHHQFPQLSPKPNSKA

SEQ ID NO: 23062 - protein, 482 aa, Chenopodium quinoa
MGFGSDVAKVETWDVEKSKGGKKKKDEDDSGEDTGCWIKLRFIGSCITSRSKVDSSVSGTSTNYAESKSTIDASRDQPVTAVVSSTTTSNAESSTSTSKLEEELKVSSRLRKFAFNDLKLATRNFRPESLLGEGGFGCVFKGWIEENGTAPVKPGTGLTVAVKTLNHDGLQGHKEWLAEVNYLGDLIHQNLVKLIGYCIEDDQRLLVYEFMPRGSLENHLFRRSLPLPWSIRMKIALGAAKGLAFLHEEAEKPVIYRDFKTSNILLDAEYNAKLSDFGLAKDGPEEGKTHVSTRVMGTYGYAAPEYVMTGHLTSRSDVYSFGVVLLEMITGRRSMDKNRPNGEHNLVEWARPHLGDRRRFYRLIDPRLEGHFSIKGAQKAVQLAAHCLSRDPKVRPLMSEIVDALKPLPNLKDMASSSYYFQTMQADRVRASPNARNGQPIGPHQRNGQQPGLRSLSIPHGSHASPYHHHQYHPSPKPSGKS

SEQ ID NO: 23063 - protein, 493 aa, Trifolium pratense
MGLDGVNGKVIESLDVSKSKGRKKKKLQDRVMEDEENETGCWHSFRFIGGCISSRSKVDSSVSGTGTNYAESKSTLDTSRDQPSVPVVSSTTTTTTTTTSNAESNSSTSKIEEELKVASRLRKFCFNDLKLATRNFRPESLLGEGGFGCVFKGWIEENGTAPVKPGTGLTVAVKTLNHDGLQGHKEWLAEVNYLGDLVHQNLVKLIGYCIEDDQRLLVYEFMPRGSLENHLFRRSLPLPWSIRMKIALGAAKGLAFLHEEAERPVIYRDFKTSNILLDAEYNAKLSDFGLAKDGPEGDKTHVSTRVMGTYGYAAPEYVMTGHLTSRSDVYSFGVVLLEMITGRRSMDKNRPNGEHNLVEWARPHLGERRRFYRLIDPRLEGHFSIKGAQKAAHLAAHCLSRDPKARPLMSEVVEALKPLPNLKDMASSSYYFQTMQADRFSASPNTRNGRTQGGFARNGQQQRSLSISHGTHASPFRHQYPQHSPKPTGKAQS

SEQ ID NO: 23064 - protein, 491 aa, Lupinus angustifolius
MGLGGVENGNKVVESWDVSKSKGRKKKKKKEDDVEVVVEEEEDIGCWVRLRLFGSCISSRSNVDGSLSGTNTHYAESKSTNDTSRDQPTVPVVSSTSTSNTSNSSSSKLEEELKVSSRLRKFAFNDLKLATRNFRPESLLGEGGFGCVFKGWIEENGTAPVKPGTGLTVAVKTLNHDGLQGHKEWLAEVNFLGDLVHPNLVKLIGYCIEDDQRLLVYEFMPRGSLENHLFRRSLLLPWSIRMKIALGAAKGLAFLHEEAERPVIYRDFKTSNILLDAEYNAKLSDFGLAKDGPEGDKTHVSTRVMGTYGYAAPEYVMTGHLTSKSDVYSFGVVLLEMLTGRRSMDKHRPNGEHNLVEWARPHLGDRRRFYRLIDPRLEGHFSVKGAQKAAQVASLCLSRDLKARPLMSEVVEALKPLPNLKDMASSSYYFQTMQADRFRASPNARNGQTQGGALLTRNWQQQRSLSIPNGTHVSPYHHQYPQQSPKPNVKA

SEQ ID NO: 23065 - protein, 499 aa, Arachis hypogaea
RNKRLGVGLGLGYLGAENGKVVEHLDVCKSKGGKKKKKKESGIVEEEQETGCWVRLRLFGSCISSRSKVDSSVSGTSTNYAESKSTIDTSRDQPTLPVVSSTTTSNAESNASTSKLEEELKVALRLRKFTFNDLKLATRNFRPESLLGEGGFGCVFKGWIEENGTAPVKPGTGLTVAVKTLNHDGLQGHKEWLAEVNFLGDLVHPNLVKLIGYCIEDDQRLLVYEFMPRGSLENHLFRRSLPLPWSIRMKIALGAAKGLAFLHEEAERPVIYRDFKTSNILLDSDYNAKLSDFGLAKDGPEGDKTHVSTRVMGTYGYAAPEYVMTGHLTSRSDVYSFGVVLLEMLTGRRSMDKNRPNGEHNLVEWARPHLGEKRRFYRLIDPRLEGHFSIKGAQKAASLAAHCLSRDPKARPLMSEVVEALKPLPNLKDMASSSYYFQTIQADRFSASPNTRNGRTQGALLTRNGQHPRSLSIPHGTHASPYHHQFPQQSPKPNGKAQS

SEQ ID NO: 23066 - protein, 501 aa, Euphorbia esula
MGLGSSEDGKEKIRVDVIKSKGSKKKKKDVNCNGEEDGEEEAAGTGCWFKFRFIGSCISSRSKVDSSVSGTSTHSVLTEGKSTNDTSIEQPAAPVISSTTTSNAESNSSTAKLEEELKIASRLRKFAFNDLKLATRNFRPESLLGEGGFGCVFKGWIEENGTAPVKPGTGLTVAVKTLNHDGLQGHKEWLAEVNFLGDLIHPNLVKLIGYCIEDDQRLLVYEFMPRGSLENHLFRRSLPLPWSIRMKIALGAAKGLAFLHEEAERPVIYRDFKTSNILLHAEYNAKLSDFGLAKDGPEGDKTHVSTPVMGTYGYAAPEYVMTGHLTSKSDVYSFGVVLLEMITGSRSMDKNRPIGEHNLVEWARPHLLERRRFYRLIDPRLEGHFSIKGAQKATQLAAHCLSRDPKARPLMSEVVEALKPLPNLKDMASSSYYFQTLQADRSASNSPNGKNSPNVKNGARTPGGLMKNGQQQRSLSIPNGSQASPYHHQYPHQSPKPGGKV

SEQ ID NO: 23067 - protein, 496 aa, Vinca minor
DDICSLYFGGCKRWELGGGGEKVESWDIGKSTKGGKKKKKKVVDDDDGGVETGCWTKLRFIGSCISSRSKVDSSISGISTHCESKSANDTSRDQPVAAIISLTATSNGESNSSTSKLEEELKVASRLRKFTFNDLKLATRNFRPESLLGEGGFGCVFKGWIEENGTAPVKPGTGLTVAVKTLNHDGLQGHKEWLAEVSFLGDLIHPNLVKLIGYCIEDDQRLLVYEFMPRGSLENHLFRRSLPLPWSIRMKIALGAAKGLAFLHEEAERPVIYRDFKTSNILLDADYNAKLSDFGLAKDGPEGDKTHVSTRVMGTYGYAAPEYVMTGHLTSKSDVYSFGVVLLEMLTGRRSMDKNRPNGEHNLVEWARPHLGERRRFYRLIDPRLEGHFSIKGAQKAAQLAARCLSRDPKARPLMSEVVEALKPLPALNDMASSSYYFQTMQADRIGSSPNTRNGIRSQAATFSRNPRSLSIPNGSHASPYHHQFPQKSPKPKGKQ

SEQ ID NO: 23068 - protein, 482 aa, Aquilegia formosa
MGLVPEVIQLDAWDIEKSKGKKKKKDGLVKEPFGCWVNFRFIGNCITSKSKVENSISGTSTHYESKSTTDTSRDQPVAQVISSSTTSNAESNPSTPKVGEELKIASQLRKFAFNELKSATRNFRPESLLGEGGFGCVFKGWIEENGTAPVKPGTGLTVAVKTLNHDGLQGHKEWVAEVNFLGDLLHPNLVKLIGYCIEDDQRLLVYEFMPRGSLENHLFRRSLPLPWSIRMKIALGAAKGLAFLHEEAERPVIYRDFKTSNILLDADYNAKLSDFGLAKDGPEGDKTHVSTRVMGTYGYAAPEYVMTGHLTSKSDVYSFGVVLLEMLTGRRSMDKNRPNGEHNLVEWARPHLGERRRFYRLIDPRLEGHFSIKGAQKAAQLAHHCLSRDPKVRPLMSEVVEVLKPLLNLKDMASSSYYFQTMQAERTGVNLNSLNSRNGLRMQAGFVSRNGQPIRSLSIPKGSHASPYHFQHPSPKQNDKQT

SEQ ID NO: 23069 - protein, 478 aa, Olea europaea
MGLGGDALKKESWDVGKSKGRKKKDGDSEEETGCWIKLRFIGSCMSSRSKVDSSISSISTHCESKTMNDTSRDQPVAPIISSSTTSNSESNSSSSKHEEELQISSRLRKFAFNDLKLATRNFRPESLLGEGGFGCVFKGWIEENGTAPVKPGTGLTVAVKILNHDGLQGHKEWLAEVNFLGDLIHPNLVKLIGSCIEDDQRLLVYEFMPRGSLENHLFRRSLPLPWSIRMKIALGAAKGLAFLHEEAERPVIYRDFKTSNILLDSEYNSKLSDFGLAKDAPDEGKTHVSTRVMGTYGYAAPEYVMTGHLTSKSDVYSFGVVLLEILSGRRSMDKNRPNGEHNLVEWARPHLGERRRFYRLIDPRLEGHFSIKGAQKAAQLVAHCLNRDAKARPLMSEVVEALKPLPNLKDMASSSYYFQSMQADRVGSSPNARNGLRTQGSFSRNGQLHPRSLSFHNGSHASPYHNKFVQSPKPNGKA

SEQ ID NO: 23070 - protein, 508 aa, Glycine max
MGLGAENGKVVESWDVCKSKGRKKKKGDEGGEAEAGCWVRLRFIGSCISSRSKVDTSVSGSGTSTHYAESKSTNDTSRDQPTAPAVSSTTTSNAESNSSSTSKLEEELKIASRLRKFSFNELKLATRNFRPESFLGEGGFGCVFKGWIEENGTAPVKPGTGLTVAVKTLNHDGLQGHKEWLAEVNFLGDLVHPNLVKLVGYCIEEDQRLLVYEFMPRGSLENHLFRRSIPLPWSIRMKIALGAAKGLAFLHEEAERPVIYRDFKTSNILLDAVSVKNYNKIAFPPFYQSNIVPIQEYNAKLSDFGLAKDGPEGDKTHVSTRVMGTYGYAAPEYVMTGHLTSKSDVYSFGVVLLEMLTGRRSMDKHRPNGEHNLVEWARPHLGERRRFYRLIDPRLEGHFSVKGAQKAALLAAHCLSRDPKARPLMSEVVEALKPLPNLKDMASSSYYFQAMQADRIGASPNTRNGRMQGALLTRNGQQQRSLSIPNGTYASPYHHQFPQPSPKPNGKA

SEQ ID NO: 23071 - protein, 481 aa, Daucus carota
MGLSGGDGVKVETSEVGKLKDRKKDKGSDVEDIGCWTKLRFIGSCISSRSKVDNSISGITTNCESKSINETTKDQPPPVISSTTTSIAESNSSTSKLEDELKVSSRLLKFAFNDLKTATRNFRPESLLGEGGFGCVFKGWIEENGTAPVKPGTGLTVAVKTLNHDGLQGHKEWVAEVNFLGDLIHPNLVKLIGYCIEDDQRLLVYEFMPRGSLENHLFRRALPLPWSIRMKIALGAAKGLAFLHEEAAKTVIYRDFKTSNILLDAEYNAKLSDFGLAKDGPEGDKTHVSTRVMGTYGYAAPEYVMTGHLTSRSDVYSFGVVLLEILTGRRSMDKNRPNGEHNLVEWARPHLGERRRFYKLIDPRLEGHFSIKGAQKAAHLAARCLSRDPKVRPLMSEVVEIMKPLPNLKDMASSSYYFQTVQADRTGSSPNTRNGSNGVRTPAGSFSRNGQQHPRSLSIPNGSHASPYHHQFPSPKPQGKP

SEQ ID NO: 23072 - protein, 456 aa, Aristolochia fimbriata
RKKKDADSEETGCWIKFRFIGSCISSRSKVDNSISSSSTNYAESKSTNEASRDQPTAAVVSSTTTSNAESNPSTPKVGEELKVASQLRKFTFNELKAATRNFRPESLLGEGGFGCVFKGWIEENGTAPVKPGTGLTVAVKTLNHDGLQGHKEWLAEVNFLGDLLHPNLVKLIGYCIEDDQRLLVYEFMPRGSLENHLFRRSLPLPWSIRMKIALGAAKGLAFLHEEAERPVIYRDFKTSNILLDADYNAKLSDFGLAKDGPEGDKTHVSTRVMGTYGYAAPEYVMTGHLTSRSDVYSFGVVLLEMLTGRRSMDKNRPNGEHNLVEWARPHLGERRRFFRLIDPRLEGHFSIKGAQKAAQLAHHCLSRDPKARPLMSEVVEALKPLINLKDMASSSYYFQTMQAERTGANSNSNARTGVKTQGVMVRNGQLPVRSLSNGAHASPYHHQSPKPNGKLP

SEQ ID NO: 23073 - protein, 513 aa, Eucalyptus grandis
MSVVTGSGGGGGAGGGGDNGKVEAWDSGESMGRKKKKSKDGGERKKAGGGREDGLGGDDDDDSVGVKESGCWVRLRFIGSCISSRSKVDSSISGTSTNYAESKFTNDTSRDQPAPPAVSSTTTSNTESNSSTSKLEEELKVASRLRKFNFNDLKLATRNFRPESLLGEGGFGCVFKGWIEENGTAPVRPGTGLTVAVKTLNHDGLQGHKEWLAEVNFLGDLVHPNLVKLIGYCIEDDQRLLVYEFMPRGSLENHLFRRALPLPWSIRMKIALGAAKGLAFLHEEAERPVIYRDFKTSNILLDADYNAKLSDFGLAKDGPEGDKTHVSTRVMGTYGYAAPEYVMTGHLTSRSDVYSFGVVLLEMLTGRRSMDKNRPNGEHNLVEWARPHLGERRRFYRLIDPRLEGHFSIKGAQKAAQLAAHCLSRDPKARPLMSDVVEALKPLPNLKDMASSSYYFQTMRAERIGSSPNARYGIQSQAGANARNRSLSIPNGTHASPYHHQYPHQSPKPNSKP

SEQ ID NO: 23074 - protein, 495 aa, Lupinus angustifolius
MELGGGKNGLNVTKVVESWDVSKSKGRKKKKKKEDEVKVLVEEKEDTRWWVKLMLFGSCISSRSKVDSSTSGTSNHYAESKSTNDTSRGQPIVPVVSSTSTSNTESNSSSSKFEEEMKVASRLRKFAFNDLKLATRNFRPESLLGEGGFGCVFKGWIEENGTAPVKPGTGLTVAVKTLNHDGLQGHKEWLAEVNFLGDLVHPNLVKLVGYCIEDDQRLLVYEFMPRGSLENHLFRRSLPLPWPIRMKIALGAAKGLAFLHEEAERLVIYRDFKTSNILLDAEYNAKLSDFGLAKDGPEGDNTHVSTRVMGTYGYAAPEYVMTGHLTSKSDVYSFGVVLLEMLTGRRSMDKSRPNGEHNLVEWARQHIGERRRFYKLIDPRLEGHFSIKGAQKAAQLAAHCLRRDPKARPLMSEVVEALKPLPNLKDMASSSYYFQTMQADRFRASPNTRNRQTQGGALLTRNGQQKRSLSIPNGTHASPYHHQYPQQSPKPDVKA

SEQ ID NO: 23075 - protein, 505 aa, Glycine max
MGLGGAENGKVVVESLDVCKSKGRKKKKKEDGEVEEKEETGCWFRLSIIVWEFLHLLEWGDEFMNQTIAFMTRKVGSIKVYHLLTMYTSESKSTIDTSRDQPTVPVVSSTTTSNAESNSSTSKLEEEFKVSSRLRKFTFNDLKLATRNFRPESLLGEGGFGCVFKGWIEENGTAPVKPGTGLTVAVKTLNHDGLQGHKEWLAEVNYLGDLVHPHLVKLIGYCIEDDQRLLVYEFMPRGSLENHLFRRSLPLPWSIRMKIALGAAKGLAFLHEEAERPVIYRDFKTSNILLDAEYNAKLSDFGLAKDGPEGDKTHVSTRVMGTYGYAAPEYVMTGHLTSRSDVYSFGVVLLEMLTGRRSMDKNRPNGEHNLVEWARPHLGERRRFYRLIDPRLEGHFSIKGAQKAAHLAAHCLSRDPKARPLMSEVVEALKPLPNLKDMASSSYYFQTMQADRFSASPNTRNGRTQGALLTRNGQQQRSLSIPHGTHASPYHHQFPQPSPKPNGKA

SEQ ID NO: 23076 - protein, 504 aa, Lupinus angustifolius
MGKVVESLDVSKSKGNKKKKKKKEENVLEEETVSGRCWLRFRFFGNCISSRSKVDSSVSGTSTNYGNLFSLFRTIIVLTMLLEIPSSDIKSTIDTSRDQPTVPVVSSTTTSNTESNASTSKLEEELKVASRLRKFSFNDLKFATRNFRPESLLGEGGFGCVFKGWIEENGTAPVKPGTGLTVAVKTLNHDGLQGHKEWLAEVNFLGDLVHPNLVKLIGYCIEDDQRLLVYEFMPRGSLENHLFRRSLPLPWSIRMKIALGAAKGLAFLHEEAERPVIYRDFKTSNILLDADYNAKLSDFGLAKDGPEGDKTHVSTRVMGTYGYAAPEYVMTGHLTSRSDVYSFGVVLLEMLTGRRSMDKNRPNGEHNLVEWARPHLGERRRFYRLIDPRLEGHFSIKGAQKAAHLAAHCLSRDPKARPLMSEVVEALKPLPNLKDMASSSYYFQTMQGNHFSTSPNTRNGRTQGGTLLSRNGQQQRSLSISHGTRASPYHHQYPQQSPKPNAKA

SEQ ID NO: 23077 - protein, 487 aa, Trigonella foenum-graecum
MGLFGSLNGKMVESWDVSKSKGGKNKKNKENEGVVDVEKAKTGCWVGLRFIGSCISSRSKVDSSLSGSGTSTHYAESKSTNDTSRGQRTAPVISSTTTSNTESNSSTSKLEEELKIASRLRKFSFNELKLSTRNFRPESFLGEGGFGCVFKGWIEENGTAPVKPGTGLTVAVKTLNHDGLQGHKEWLAEVNFLGDLVNENLVKLIGYCIEDDQRLLVYEFMPRGSLENHLFRRSAPLPWSIRMKIALGAAQGLAFLHEEAERPVIYRDFKTSNILLDADYNAKLSDFGLAKDGPEGDKTHVSTRVMGTYGYAAPEYVMTGHLTSKSDVYSFGVVLLEMISGRRSMDKHRPNGEHNLVEWARPHLGERRRFYRLLDPRLEGHFSVKGAQKAAQIAHHCLSRDPKARPLMSEVVEALEPLQNLKDMASSSYYFKSMQAASPNSRSVPAQGASLARNGQQRRSLSIPNGTQASPYNNKYPQQSPKPNVKA

SEQ ID NO: 23078 - protein, 481 aa, Mimulus guttatus
MGLGDEGLKGESWEVKKLKEKKKKNDNAAKKSGCCIRFRFIGSCITSRSKVDSSISGISSTQESKSTNGTSRDQPVVPVIPSTSTSNAESSSSSSKPEDELKVSSRLRKFTFNDLKLATRNFRPESLLGEGGFGCVFKGWIEENGTAPVKPGTGLTVAVKTLNHDGLQGHKEWLAEVNFLGDLVHPNLVKLIGYCIEDDQRLLVYEFMPRGSLENHLFRRSLPLPWSIRMKVALGAAEGLAFLHEEAERPVIYRDFKTSNILLDAEYNAKLSDFGLAKDAPDEGKTHVSTRVMGTYGYAAPEYVMTGHLTSKSDVYSFGVVLLEMLTGRRSMDKNRPNGEHNLVEWARPHLGERRRFYRLIDPRLEGHFSIKGAQRAAHLAARCLSRDSKSRPLMSEVVEALKPLPSLKDMASSSYYFQTMQADRVNSSPNGKNGLRTNGSFSRNSHQNIQRRLSIPNGGAHASPLFHQFTNNSPKPSGKP

SEQ ID NO: 23079 - protein, 476 aa, Daucus carota
MGLSDAKSEPWEVGKSKNKVKKDDADGEVTGCWIALRSIRSCITSRSKVDNSISGISLHESKYANSRKDQPSTAISSTTTSTAESSSSTSKLEEELKIASRLRKFAFNDLKMATRNFRPDSLLGEGGFGCVFKGWIEENGTAPVKPGTGLTVAVKTLNHDGLQGHKEWLAEVSFLGDLIHPNLVKLIGYCIEDDQRLLVYEFMSRGSLENHLFRRSLPLPWSIRMKIALGAAKGLAFLHEEAAKTVIYRDFKTSNILLDAEYNAKLSDFGLAKDGPEGDKTHVSTRVMGTYGYAAPEYVMTGHLTSRSDVYSFGVVLLEILTGRRSMDKNRPNGEHNLVEWARPHLGERRRFYKLIDPRLEGHFSIKGAQKAAHLAARCLSRDPKVRPLMSEVVEIMKPLPNLKDMASSSYYFQTVQADRTGSSPNTRNGSNGVRTPAGSFSRNGQQHPRSLSIPNGSHASPYHHQFPSPKPQGKP

SEQ ID NO: 23080 - protein, 485 aa, Cichorium intybus
MKSGDEKSVGSWHVVKSKGKNNKPKKSNGTCLETEEGTTAGCWNRWKVIGSCISSRSKVDNSISGISTTHCESKSTNDVSKDQPVIPAVSSTTTSTGESISSTQKLEEELKIASRLRKFAFNDLKMATRNFRPESLLGEGGFGCVFKGWIEENGTAPVKPGTGLTVAVKTLNHDGLQGHKEWLAEVSYLGDLIHPNLVKLIGYCIEDDQRLLAYEFMPRGSLENHLFRRSLPLPWSIRMKIALGAAKGLAFLHEEAKRPVIYRDFKTSNILLDAEYNAKLSDFGLAKDAPEGDKTHVSTRVMGTYGYAAPEYVMTGHLTSKSDVYSFGVVLLEMLTGRRSMDKNRPNGEHNLVEWARPHLGERRRFYRLIDPRLEGHFSIKGAQKAAQLAARCLSRDPKVRPLMSEVVDSLKPLPALKDMASSSYYFQTIQSERVGSSPNGRNGTRVQGGPGLRNGSQNARSLSVSNSTRASPYHQQFSPKPNEK

SEQ ID NO: 23081 - protein, 485 aa, Cichorium intybus
MKSGDEKSVESWHVVKSKGKNNKPKKSNGICLETEEGTTAGCWNRWKVIGSCISSRSKVDNSISGISTTHCESKSTNDVSKDQPVVPAVSSTTTSTGESISSTQKLEEELKIASRLRKFAFNDLKMATRNFRPESLLGEGGFGCVFKGWIEENGTAPVKPGTGLTVAVKTLNHDGLQGHKEWLAEVSYLGDLIHPNLVKLIGYCIEDDQRLLAYEFMPRGSLENHLFRRSLPLPWSIRMKIALGAAKGLAFLHEEAKRPVIYRDFKTSNILLDAEYNAKLSDFGLAKDAPEGDKTHVSTRVMGTYGYAAPEYVMTGHLTSKSDVYSFGVVLLEMLTGRRSMDKNRPNGEHNLVEWARPHLGERRRFYRLIDPRLEGHFSIKGAQKAAQLAARCLSRDPKVRPLMSEVVDSLKPLPALKDMASSSYYFQTIQSERVGSSPNGRNGNRVQGGAGLRNGSQNARSLSVSNSTRASPYHQQFSPKPNEK

SEQ ID NO: 23082 - protein, 493 aa, Tragopogon dubius
MKSGDEKGVESWQVVKSKGKKKKNNKPKESNEIGLVGDEEGTTTAGCWNRWKIIGSCISSRSKVDSSISGISTTHCETKSTNDTSKDQPAVPATVSSTTTSTGESVSSTQKLEVELNIASRLRKFAFNDLKMATRNFRPESLLGEGGFGCVFKGWIEENGTAPVKPGTGLTVAVKTLNHDGLQGHKEWLAEVNYLGDLIHPNLVKLIGYCIEDDQRLLAYEFMPRGSLENHLFRRSLPLPWSIRMKIALGAAKGLAFLHEEAKRPVIYRDFKTSNILLDAEYNAKLSDFGLAKDAPEGDKTHVSTRVMGTYGYAAPEYVMTGHLTSKSDVYSFGVVLLEMLTGRRSMDKNRPNGEHNLVEWARPHLGERRRFYRLIDPRLEGHFSVKGAQKAAQLAARCLSRDPKARPLMSEVVDCLKPLPALKDMASSSFYFQTIQSERVGSSPNGRSGIRVQGGSFSRNGQQNPRSLSISNSTRASPYNNQQYSPKPNEKQ

SEQ ID NO: 23083 - protein, 456 aa, Arnica chamissonis
DDDDGTTTGCWNKWNLIGSCVSSRSKVDTSISGISTHCESKSTNDTSKDQPVVQVVSSTTTSTGESNSSTQKLEDEIKVASRLRKFAFNDLKMATRNFRPESLLGEGGFGCVFKGWVEENGTAPVKPGTGLTVAVKTLNHDGLQGHKEWLAEVNYLGDLIHPNLVKLIGYCIEDDQRLLAYEFMPRGSLENHLFRRSLPLPWSIRMKIALGAAKGLAFLHEEAKRPVIYRDFKTSNILLDAEYNAKLSDFGLAKDAPEGDKTHVSTRVMGTYGYAAPEYVMTGHLTAKSDVYSFGVVLLEILTGRRSMDKNRPNGEHNLVEWARPHLGERRKFYKLIDPRLEGHFSIKGAQKAAQLASRCLSRDPKVRPLMSEVVEFLKPLPALKDMASSSYYFQTIQSERVGSSPNGRNGVRVQNGPLSRNGSQHPRSLSISSSTRASPFHQQLTQNSPKPNEKN

SEQ ID NO: 23084 - protein, 477 aa, Daucus carota
MGLSDAKSEPWEVGKSKNKVKKDDADGEVTGCWIALRSIRSCITSRSKVDNSISGISLHESKYANSRKDQPSTAISSTTTSTAESSSSTSKLEEELKIASRLRKFAFNDLKMATRNFRPDSLLGEGGFGCVFKGWIEENGTAPVKPGTGLTVAVKTLNHDGLQGHKEWLAEVSFLGDLIHPNLVKLIGYCIEDDQRLLVYEFMSRGSLENHLFRRSLPLPWSIRMKIALGAAKGLAFLHEEAERPVIYRDFKTSNILLDAEYNAKLSDFGLAKDGPEGDKTHVSTRVMGTYGYAAPEYVMTGHLTSKSDVYSFGVVMLEILSGRRSMDKNRPNGEHNLVEWARPHLGERRKFYKLIDPRLEGHFSVKGAQKAAHLAARCLSRDPKVRPRMSEVVEALKPLPNLKDMASSSYYFKTMQADRVASSPNTRNGSNGIIRSQAGSFTRPGQQPRSLSMPKGTQASPYHQFPHNSPKPQGKS

SEQ ID NO: 23085 - protein, 488 aa, Cucumis melo
MEVIAEDGKVESREVRESKGKKKQKNNKEQVETVEEETGCWIALRIFGSCISSRSKVDSSISGTSINYAESKSTADSSRDQPTPREISSTNTSMSNGESNSSTSKLEEELKISPHLRKFSFNDLKLATRNFRPESLLGEGGFGSVLKGWDEENGTAPVKPGTGLTVAVKTLNHDGLQGHKEWMAEVNFLSDLKHPNLVRLIGYCNEDDQRLLVYEFMPRGSLENHLFRRSLPLPWSIRMKIALGAAKGLAFLHEEAKRPVIYRDFKTSNILLDAEYNAKLSDFGLAKDGPDGDKTHVSTRVMGTYGYAAPEYVMTGHLTSRSDVYSFGVVLLEMLTGRRSMDKNRPNGEHNLVEWARPYLGEKKRFYRLIDPRLEGHFSIKGAQKAVQLAAQCLSRDQKVRPLMSEVVEALKPLPNLKDMASSSYYFQTMQADRVRSSPMARNGYHTAAGPAPKNGQQLRSYSIANGSHASPYHHQQPHPSPKPNVKA

SEQ ID NO: 23086 - protein, 490 aa, Flaveria ramosissima
MKSADEKGIGSWDVMKSKGKKKNKHKECDDIGLDGGGDGATTGCWSRWKLIGSCISSRSKVDTSISGISTHCESKSANDTSKDQPVVQVVSSTTTSTGESISSTQKLEDELKVSSRLRKFAFNDLKMATRNFRPESLLGEGGFGCVFKGWIEENGTAPVKPGTGLTVAVKTLNHDGLQGHKEWLAEVNYLGDLIHPNLVKLIGYCIEDDQRLLAYEFMPRGSLENHLFRRSLPLPWSIRMKIALGAAKGLAFLHEEAKRPVIYRDFKTSNILLDAEYNAKLSDFGLAKDAPEGDKTHVSTRVMGTYGYAAPEYVMTGHLTAKSDVYSFGVVLLEMLTGRRSMDKNRPNGEHNLVEWARPHLGERRRFYKLIDPRLEGHFSIKGAQKAAQLASRCLSRDPKVRPFMSEVVESLKPLPALKDMASSSYYFQTIQSERVGSSPNGRNRVQAQNGSLSRNGSQHPRSLSISSSTRASPFHQQSTQNSPKPIEKN

SEQ ID NO: 23087 - protein, 617 aa, Sorghum bicolor
MSEGNVDSIEISVSNDERRNRADAEISEDEPRHTRMRSLRKKALHASTRLTHSLKKRGKRKVDCRVPRIAIEDVRDAEEEQAVSSFREVLFARGLLPVKHDDYHMMLRFLKARKFDFEKAAQMWADMLQWRKEFGTDTIFEDFEFHELEEVLQYYPHGYHGVDKEGRPVYIELLGKVEPNKLVQITTVERYIKYHVQEFERAFREKFPACSISAKRHIDTTTTILDVHGVGWKNFSKIARDLVRCMQKIDGDYYPETLHQMFIVNAGPGFKLIWSTVKGLLDPKTSSKIHVLGTKYQSKLLEAIDASQLPEYFGGSCTCSNLGGCLRSNKGPWSDPSIMKLVHSMESLKEVGQVSDIEETFTGSMRLRALKLPERISDTSNAESGSDVDDLGSPVAPEDVEYPSLAPVREEVRESGSTTYSGLIGMSHTADKAVGSNRRYNSTGNEIRQFNTEQGSLINGGLPAPAGRRAPNDGVGNDDGFLKYISRRVVDVFLRVLSFLRFFIRRRQHLENVHSHAATAPSNLADLQTIKEDRVNPCLERLDRLESMFNQLSRKPPELPQDKDRAIQDSFDRIKSIEFDLEKTKKVLHATVIKQMQMAETLEAVTEPDLRRRKFCT

SEQ ID NO: 23088 - protein, 617 aa, Zea mays
MSEGNVDSIQISVSNDERRNRADAEISEDEPRHTRMRSLKKKALHASTRLTHSLKKRGKRKVDCRVPRIAIEDVRDAEEEQAVNSFREVLFARGLLPVKHDNYHTMLRFLKARKFDFEKAAQMWADMLQWRKEFGTDTIFEDFEFHELEEVLQYYPHGYHGVDKEGRPVYIELLGKVEPNKLIQITTVERYIKYHVQEFERAFREKFPACSISAKRHIDTTTTILDVHGVGWKNFSKIARDLVRCMQKIDGDYYPETLHQMFIVNAGPGFKLIWSTVKGLLDPKTSSKIHVLGTKYQSRLLEAIDASQLPEYFGGSCTCSNHGGCLRSNKGPWSDPSIMKLVHSMESLKEIGQVSDIEETVTGSMRLRALKLPERISDTSNAESGSDVDDLGSPVAPEDVEYPSLAPVREEARESGSTTYSGSIGMSRMADKVVGSNGRYNSTGNETRQVNAEQGSLINGGLLAPAGQRAPNDAVGNDDGFLKYISRRVVAIFLEVLSFLRFFIRRRQHSENVHSHTATAPSSLANLQTIKEDRVNPCLERLDRLESMFNQLSKKPPELPEDKDRAIQDSFDRIKSIEFDLQKTKKVLHATVIKQMQMAETLEAVTEPDLRRRKFCT

SEQ ID NO: 23089 - protein, 216 aa, Panicum virgatum
MAGNFGAICSRAAASLFSPRHRRRLLLPSTPTPPRILPFSRRLHPGTLSTTAMASSNGAAATDAVQEPPQKISKLAPLLKVKKLSDKAVLPSRGSALAAGYDLSSAAEMVVPARGKALVPTDLSIAIPEGTYARVAPRSGLALKHSIDVGAGVIDADYRGPVGVILFNHSDADFAVKPGDRIAQMIIEVIATPEVAEVEDLDATVRGEGGFGSTGV

SEQ ID NO: 23090 - protein, 215 aa, Panicum virgatum
MAGNFGAICSRAAASLFSPRRRRLLLPSTPTPPRFLPFSQRLHRGTLSTTAMAASNGAAATDAVQEPPQKISKLAPLLKVKKLSDKAVLPSRGSALAAGYDLSSAAEMVVPARGKALVPTDLSIAIPEGTYARIAPRSGLALKHSIDVGAGVIDADYRGPVGVILFNHSDADFAVKPGDRIAQMIIEVIATPEVAEVEDLDATVRGEGGFGSTGV

SEQ ID NO: 23091 - protein, 225 aa, Sorghum bicolor
MAGKFGAICSRAAACLFIPRPRNLLLHSTPTPARFLPFPRRLHPRSLSTLAMAATNGAATDSVQEHPAAATESVQEPPQKISKISPLLKVKKLSDKAVLPSRGSALAAGYDLSSAVEIVVPARGKALVPTDLSVAIPHGTYARIAPRSGLALKHSIDVGAGVIDADYRGPVGVILFNHSDADFAVKPGDRIAQMIIEVIATPEVAEVEDLDATVRGEGGFGSTGV

SEQ ID NO: 23092 - protein, 1388 aa, Sorghum bicolor
MAPPFVFPSSLRDLERDTDGDGDEEPSLRPQNPVAVATLRAADLEEFVKGASFDLSDKELFCIEEQEVFDAIYSIVRDFNCLPPALKFNIVETLRSNLSVLLPNIDSLSRASMSSPSDTTPITDRIASHRNALKIYSFFIISIVLTEESAAESGTGAKVTAHGRKKNHVYAWNWEAQRGRIMSLVANSLEADLSLLFGPGGTDERYLSFVSKCTFVLCENQNVLKDEDTRNGLCRIIGAIATKHQRVSQISASVSHLIHKFDFTVPHLAEAVASAEKKFGDGSLAISLVREIGRADPKEYARDSVGADNVGRFLVELADRLPKLMSTNIGVLIPHFGGESYKIRNALVGVLGKLAAKAFKDVEGDSNARLRSKQAMLEILIERCRDVSAYTRSRVLQVWSELCEENSISIGLWNEVASVASGRLEDKSAIVRKSALQLLITMLQHNPFGPQLRTATFEATLEKYKEKLQGMEPSNPDKDEVANDCSPGEVILGQDESVSDSCLASSQDQNDHDATIVDITNLEQIRALVASLEAGLRFSKCITSLMPILVQLLASSSATDVENTILLLMRCRQFQIEGSEAALRKMLPLVFSQDKSIYEAVESAFITLYTRKSPTETAKRLLDLAIDCSIGDLAALESLVSSLVSKAEISSSTVSALWDYFCFNINGVRPVQSRGALSILCMAAKSSPSILGAHLQDIIDIGFGRWAKEEPLLARTACLALQRLSDEDKGKLINTSSRVFAALQGLVTSFSIPEKIWYGAADKAISTIYTLHPAPEIFATETAKKSLSSVFSVLGNEDVSNGIETENDASLSSVSPSKLGRFLFVISHIALNHLVYIENSVRKVQKQIRKNEKSQSTVDLQSDVSKSTEAQGINAELGLGATIDIAIESLAERAEKEIVCCSSKKNLIGHCGPFLSKLCRNLTLLQKFPDLQASAMLALCRLMIIDAEFCEANLQILFTVAESAPSEIVRSNCTIALGDLAVRFPNLLEPWTEYIYARLRDPSVSVRKNAVLVISHLILNDMMKVKGYINEMAVRIEDEDERISSLAKLFFHELSKKGSNPIYNLLPDILGRLCNQHLKEETFCNIMQFLINSIKKDKQMEALVDKLCNRFAGVNDVRQWEYISYCLSQLTFTEKGLKKLIDNFKMFEHALSEDSVMNHFRSVISKCKKFAKPELKVCIEEFEEKLSKVHQEKKEQEETTKNAEAHRQRIGSLDEFLATKEVSQNSGNSTEEETSEVVDPSVDSSTEHKENTPECSDHTSTENFQTSPQATESGGAGEIQSTQTVRKGVSQLRAKKTRDPVADPSVDSSTENKENTPEHSANTSTENSQTSAPLTGSEGGDEEIQSTQSVRKGASRSRAKKTRDPVVEDSAVSGPVRRATRSTRRQGR

SEQ ID NO: 23093 - protein, 1319 aa, Setaria italica
MAPPFVFPSSLRDLERDTDGDDEPSLRPQNPVAVATLRAADLEEFVKGVSFDLSDKELFCIEEQEVFDSIYSVVRDFNCLPPGLKFNLVETLRSNLSVLLPNIDSLSRASMSSPSDATPITDRIASHRNALKIYSFFLLSIVLMEESAAESCTGAKVTAHGRKKNPVYTWNWEAQRGRILNLIANSLEADLSLLFGPGGTDERYLSFVSKCTFVLYENQNGLKDEDTRNGLCRIIGAIATKHQRISQISASVLHLIHKFDFTVAHLAETVASAEKKFGDGSLAISLIREIGRTDPKDYVRDSVGADNVGRFLVELADRLPKLMSTNIGVLVPHFGGDSYKIRNALVGVLGKLAAKAFKDVEGDNTARLRSKQAMLEILIERCRDVSAYTRSRVLQVWAELCEENSISIGLWNEVASVASGRLEDKSAIVRKSALQLLITMLQHNPFGPQLRTSTFEATLEKYKEKLEGMDPPNPDQDEVVDDSSPGEVVMGQPDSVSDSCVANSQDQNNPDPTIVEITNLEQIRALVASLEAGLRFSKCITSLMPTLVQLLASSSATDVENTILLLMRCRQFQIEGSEAALRKMLPLVFSQDKSIYEAVESAFITIYTRKSATETAKSLLNLAIDCSIGDLAALECLVSSLVSKAEISSSTVSALWDYFCFNISGVKPVQSRGALSILCMAAKSSPSILGTHLQDIIDIGFGRWAKEEPLLARTACLALQRLSEEDRSKLISTNSRVFAALISLTTSFSLPEKIWYGAADKAISTIYTLHPAPEIFATEIAKKCLSSVFSVLRTEDVSNGDETQNDAFLSSLPPSKLGRFLFVISHIALNHLVYIETSVRKIQKQKRKNENSQPISEDPQLDASKSSEAQGINAELGLGATIDIAIESLAERAEKEIVCCSSEKNLIGHCGPFLSKLCRNLTLLQKFPELQASAMLALCRLMIIDPEFCEANLQILFTVAESAPSEIVRSNCTIALGDLAVRFPNLLEPWTEYIYARLRDPSASVRKNAVLVISHLILNDMMKVKGYINEMAVRIEDENERISSLAKLFFHELSKKGSNPIYNLLPDILGRLCNQHLKDETFRNIMQFLISSIKKEKQMEALVDKLCNRFAGVNDVRQWEYISYCLSQLTFTEKGLKKLIDNFKMFEYALSEDSVMNHFRSVISKCKKFAKPELKVCIEEFEEKLSKVHQEKKEQEETTKNAEAHRQRIGSLDEVLASKEVGQSCGHSVEEETSEIVDPSVDGSTEDKENMPECSGNISTENCQTSTSTGSEDGGEEIQSKQPVRKGLSRSRAKKTRDPVVEDSADSAPVRRSTKRQGR

SEQ ID NO: 23094 - protein, 119 aa, Saccharum officinarum
MLEQLLPVSEASVSSEDVKGASNDEEKLAKPSFSLVNGGGIPKLNEIEYMESMYMKSPLAALRSLKEIRSKSSTVSMFLLPPFQGNNAQGSYQIRAEQTKLNEEPNRWSKVPVIKQAAK

SEQ ID NO: 23095 - protein, 78 aa, Flaveria ramosissima
MLNEDELRDAVLLVFANKQDLPNAMNAAEITDKLGLHSLRQRHWYIQSTCATSGEGLYEGLTGSPTTLLTRHEVMIDL

SEQ ID NO: 23096 - protein, 475 aa, Ambrosia trifida
MKMWLVRATTMVLLLTCLVQLTALSGGSWGPRVLKGWPSCFTQDSHTAAALDIKLLPSAPVRILPHKRVYKNNGYLVVSCNGGLNQMRSAICDMVAIARYLNVTLIVPELDKTSFWADPSEFEDIFDVDHFITSLRDEVRILKQLPPRLKKRVELGIVHTMPPVSWSDISYYHNQILPLIQKYKVVHLNRTDARLANNGQPLELQKLRCRVNFDALRFTTQIEELGRRVVKLLRRNGPFLVLHLRYEMDMLAFSGCTQGCNDEEIEELTRMRYAYPWWKEKIINSDLKRKDGLCPLTPEETALTLKALDIDRDIQIYIAAGEIYGGKRRMDSLADAYPRLVRKETLLGPADLQYFQNHSSQMAALDYLVSLESDIFVPTYDGNMAKVVEGHRRFLGFKKTILLDRKVLVDLIDRYTSGALSWDEFSGAVKETHAQRMGAPTKRLVMPDRPKEEDYFYANPEECLQPSDDEPVSIL

SEQ ID NO: 23097 - protein, 499 aa, Centaurea maculosa
MGLKTLGESKVAKLKSSMANARSPKMKVWLIRATTTVLLWTCLVQLTALGGTWGPRVLKGWPSCFTQDSHSATALDVKLLPAVPARVLPPKRVYKNNGYLVVSCNGGLNQMRSAICDMVAIARYLNVTLIVPELDKTSFWSDPSEFEDIFDVDHFITSLRDEVRVLKELPPRLKKRVELGIVHTMPPVSWSDISYYQNQILPLIQKYKVVHLNRTDARLANNGQPLELQKLRCRVNFGALRFTTQIEELGRRVVKLLRQNGPFLVLHLRYEMDMLAFSGCTQGCNAEEVEELTRMRYAYPWWKEKIINSDLKRKDGLCPLTPEETALTLRALDIDHDIQIYIAAGEIYGGKRRMDSLAEAYPKLVRKETLLGPADLQYFQNHSSQMAALDYLVSLESDIFVPTYDGNMAKVVEGHRRFLGFKKTILLDRRLLVDLIDKYNSGFLSWDEFSKGVKEAHAERMGNPTKRLVISDRPKEEDYFYANPEECLQASEDEPMSIL

SEQ ID NO: 23098 - protein, 499 aa, Centaurea maculosa
MGLKTLGESKVAKLKSSMANARSPKMKVWLIRATTTVLLWTCLVQLTALGGTWGPRVLKGWPSCFTQDSHSATALDVKLLPAVPARVLPPKRVYKNNGYLVVSCNGGLNQMRSAICDMVAIARYLNVTLIVPELDKTSFWSDPSEFEDIFDVDHFITSLRDEVRVLKELPPRLKKRVESGIVHTMPPVSWSDISYYQNQILPLIQKYKVVHLNRTDARLANNGQPLELQKLRCRVNFGALRFTTQIEELGKRVVKLLRQNGPFLVLHLRYEMDMLAFSGCTQGCNAEEVEELTRMRYAYPWWKEKIINSDLKRKDGLCPLTPEETALTLRALDIDHDIQIYIAAGEIYGGKRRMDSLAEAYPKLVRKETLLGPADLQYFQNHSSQMAALDYLVSLESDIFVPTYDGNMAKVVEGHRRFLGFKKTILLDRRLLVDLIDKYNSGFLSWDEFSKGVKEAHAERMGNPTKRLVISDRPKEEDYFYANPEECLQTSEDEPMSIL

SEQ ID NO: 23099 - protein, 500 aa, Cirsium arvense
MGLKTLGETRVAKLKSSMANARSPKMKVWLIRATSTVLLWTCLVQLTALGGTWGPRVLKGWPSCFTQDSHSATALDIKLLPTVPARVLPPKRVYKNNGYLVVSCNGGLNQMRSAICDMVAIARYLNVTLIVPELDKTSFWSDPSEFEDIFDVDHFITSLRDEVRVLKQLPPRLKKRVELGIVHTMPPVSWSDISYYHNQILPLIQKYKVVHLNRTDARLANNGQPLELQKLRCRVNFGALRFTTQIEELGRRVVQLLRQNGPFLVLHLRYEMDMLAFSGCTQGCNTEEVEELTRMRYAYPWWKEKIINSDLKRKDGLCPLTPEETALTLRALDIDHDIQIYIAAGEIYGGKRRMDSLADAYPKLVRKETLLGPADLQYFQNHSSQMAALDYLVSLESDIFVPTYDGNMAKVVEGHRRFLGFKKTILLDRKLLVELIDKYNSGFLSWDEFSNGVKEAHAERMGNPTKRVVILDRPKEEDYFYANPEECLQASAEDEPVSIL

SEQ ID NO: 23100 - protein, 494 aa, Chrysanthemum coronarium
MGLKKRLSEIRVDKFRNSMRSSSKMKMWLIRATTTVLLWTCVVQLTALGGTWGPRVLKGWPSCFSVDDHVAKSLDIPVPARVLPPKRVYKNNGYLVVSCNGGLNQMRSAICDMVAIARYLNVTLIVPELDKTSFWADPSEFQDIFDVDHFITSLRDEVRVLKQLPPRLKKRVELGIVHTMPPVSWSDISYYHNQILPLIQKFKVVHLNRTDARLANNFQPLELQKLRCRANFDALRFTPQIEDLGRRVVRLLRQNGPFLVLHLRYEMDMLAFSGCTQGCNIEEVEELTRMRYAYPWWKEKIINSDLKRKDGLCPLTPEETALTLKALDIDHDIQIYIAAGEIYGGKRRMDSLAEAFPKLVRKETLLGPDDLQYFQNHSSQMAALDYLVSLESDIFVPTYDGNMAKVVEGHRRFLGFKKTILLDRRLLVELIDKYTSGSLTWDEFSSGVKEAHAQRMGNPTKRLVIPDRPKEEDYFYANPEECLQPSDDEPLSIM

SEQ ID NO: 23101 - protein, 494 aa, Chrysanthemum coronarium
MGLKKRLSEIRVDKFRNSMRSSSKMKMWLIRATTTVLLWTCVVQLTALGGTWGPRVLKGWPSCFSVDDHVAKSLDIPVPAKVLPPKRVYKNNGYLVVSCNGGLNQMRSAICDMVAIARYLNVTLIVPELDKTSFWADPSEFQDIFDVDHFITSLRDEVRVLKQLPPRLKKRVELGIVHTMPPVSWSDISYYHNQILPLIQKFKVVHLNRTDARLANNFQPLELQKLRCRANFDALRFTPQIEDLGRRVVRLLRQNGPFLVLHLRYEMDMLAFSGCTQGCNTEEVEELTRMRYAYPWWKEKIINSDLKRKDGLCPLTPEETALTLKALDIDHDIQIYIAAGEIYGGKRRMDSLAEAFPKLVRKETLLGPDDLQYFQNHSSQMAALDYLVSLESDIFVPTYDGNMAKVVEGHRRFLGFKKTILLDRRLLVELIDKYTSGSLTWDEFSSGVKEAHAQRMGNPTKRLVIPDRPKEEDYFYANPEECLQPSDDEPLSIM

SEQ ID NO: 23102 - protein, 494 aa, Chrysanthemum coronarium
MGLKKRLSEIRVDKFRNSMRSSSKMKMWLIRATTTVLLWTCVVQLTALGGTWGPRVLKGWPSCFSVDDHVAKSLDIPVPAKVLPPKRVYKNNGYLVVSCNGGLNQMRSAICDMVAIARYLNVTLIVPELDKTSFWADPSEFQDIFDVDHFITSLRDEVRVLKQLPPRLKKRVELGIVHTMPPVSWSDISYYHNQILPLIQKFKVVHLNRTDARLANNFQPLELQKLRCRANFDALRFTPQIEDLGRRVVRLLRQNGPFLVLHLRYEMDMLAFSGCTQGCNTEEIEELTRMRYAYPWWKEKIINSDLKRKDGLCPLTPEETALTLKALDIDHDIQIYIAAGEIYGGKRRMDSLAEAFPKLVRKETLLGPDDLQYFQNHSSQMAALDYLVSLESDIFVPTYDGNMAKVVEGHRRFLGFKKTILLDRRLLVELIDKYTSGSLTWDEFSSGVKEAHAQRMGNPTKRLVIPDRPKEEDYFYANPEECLQPSDDEPLSIM

SEQ ID NO: 23103 - protein, 503 aa, Conyza canadensis
MGLRKLSEIRVEKLKNSARSPKIKMWAIRGISSVLIWTFLVQLSAIGSGGGGGDGGNSNWGRRALSCFGQDSSVSSAALDVKFLPNVPAKVLPPKRVYKNNGYLVVSCNGGLNQMRSAICDMVAIARYLNVTLIVPELDKTSFWADPSDFEDIFDVDHFITSLRDEVRVLKQLPPRLKKRVELGIVHTMPPISWSDISYYHNQILPLIQKYKVVHLNRTDARLANNGQPLELQKLRCRVNFGALRFTTQIEELGRRVVKLLRQNGPFLVLHLRYEMDMLAFSGCTQGCNVEEVEELTRMRYAYPWWKEKIINSDLKRKDGLCPLTPEETALTLRALDIDRDIQIYIAAGEIYGGKRRMDSLTDVYPKVVRKETLLGADDLQYFQNHSSQMAALDYLVSLESDIFVPTYDGNMAKVVEGHRRFLGFKKTILLDRRVLVELIDKYTSGSLSWDDFSSAVKETHAQRMGNPTKRLVISDRPKEEDYFYANPEECLQPSDDEPMSIL

SEQ ID NO: 23104 - protein, 494 aa, Chrysanthemum coronarium
MGLKKRLSEIRVDKFRNSMRSSSRMKMWLIRATTTVLLWTCVVQLTALGGTWGPRVLKGWPSCFTFDDHVAKSLDIPVPVKHLADKRVYKNNGYLVVSCNGGLNQMRSAICDMVAIARYLNVTLIVPELDKTSFWADPSEFQDIFDVDHFITSLRDEVRVLKQLPPRLKKKVELGFVHTMPPVSWSDISYYHNQILPLIQKFKVVHLNRTDARLANNNQPLELQKLRCRTNFDALRFTPQIEDLGRRVVSLLRQNGPFLVLHLRYEMDMLAFSGCTQGCNTEEVEELTRMRYAYPWWKEKIINSDLKRKDGLCPLTPEETALTLKALDIDHDIQIYIAAGEIYGGKRRMDSLAEAFPKLVRKETLLGPDDLQYFQNHSSQMAALDYLVSLESDIFVPTYDGNMAKVVEGHRRFLGFKKTILLDRRLLVDLIDRYTSGSLNWDEFSTGVKEAHAQRMGNPTKRLVIPDRPKEEDYFYANPEECLQPSDDEPLSIM

SEQ ID NO: 23105 - protein, 495 aa, Cirsium arvense
MGLKAFGGSRVEKLRTRSPAKMKLWMIRATTVVLLWTCLVQLTALGDTWGPMVLKGWPSSRDSLSAAPTLDAKLLPIVPARVLPPKRVYKNNGYLLISCNGGLNQMRSAICDMVAIARYLNVTLIVPELDKTSFWADPSEFEDIFDVDHFITSLRDEVRILKKLPIRLKKRVELGIIHTMPPVSWSDISYYHMQILPLIQRYKVLHLNRTDARLANSGQPLDLQKLRCRVNFSALRFTTQIEELGRRVVKLLRQNGPFLVLHLRYEMDMLAFSGCTQGCNDEEVEELTRMRYAYPWWKEKIINSELKRKDGLCPLTPEETALALRALDIDRDIQIYIAAGEIYGGERRVASLAAAYPKLVRKETLLAPADLQFFQNHSSQMAALDYLVSLESDVFVPTFDGNMAKVVEGHRRYLGFKKTILLDRKLLVELIDKYTSKSLSWDEFSSAVKAAHAQRMGNPTKRSVIPDKPKEEDYFYANPEECLQPSDNEPVNIML

SEQ ID NO: 23106 - protein, 495 aa, Chrysanthemum coronarium
MGLKKRLSEIRVDKFRNSMRSSSRMKMWLIRATTTVLLWTCVVQLTALGGTWGPRVLKGWPSCFTFDDHVAKSLDIPVPVKHLADKRVYKNNGYLVVSCNGGLNQMRSAICDMVAIARYLNVTLIVPELDKTSFWADPSEFQDIFDVDHFITSLRDEVRVLKQLPPRLKKKVELGFVHTMPPVSWSDISYYHNQILPLIQKFKVVHLNRTDARLANNFQPLELQKLRCRANFDALRFTPQIEDLGRRVVRLLRQNGPFLVLHLRYEMDMLAFSGCTQGCNTEEVEELTRMRYAYPWWKEKIINSDLKRKDGLCPLTPEETALTLKALDIDHDIQIYIAAGEIYGGERRMASLAASYPKLVRKETLLGPDDLGFFQNHSSQMAALDYLVSLESDIFVPTFDGNMAKVVEGHRRYLGFKKTILLDRKLLVELIDKYTSKSLSWDEFSTAVKEAHAQRMGNPTKRLIIPDRPKEEDYFYANPEECLQPSDDEPVNIMQ

SEQ ID NO: 23107 - protein, 444 aa, Chrysanthemum coronarium
PSMVLTSSNSNGGGADSVVNSVKLLPTVPARVLPPKRVYKNNGYLMVSCNGGLNQMRSAICDMVAIARYLNVTLIVPELDKTSFWADPSEFQDIFDVDHFITSLRDEVRVLKQLPPRLKKRVELGIVHTMPPVSWSDISYYHNQILPLIQKFKVVHLNRTDARLANNFQPLELQKLRCRANFDALRFTPQIEDLGRRVVRLLRQNGPFLVLHLRYEMDMLAFSGCTQGCNTEEIEELTRMRYAYPWWKEKIINSDLKRKDGLCPLTPEETALTLKALDIDHDIQIYIAAGEIYGGKRRMDSLAEAFPKLVRKETLLGPDDLQYFQNHSSQMAALDYLVSLESDIFVPTYDGNMAKVVEGHRRFLGFKKTILLDRRLLVELIDKYTSGSLTWDEFSSGVKEAHAQRMGNPTKRLVIPDRPKEEDYFYANPEECLQPSDDEPLSIM

SEQ ID NO: 23108 - protein, 410 aa, Echinacea purpurea
LWTCLVQLTALGGSWGPRVLKGWPSCFTQDSHSAAVLDVKLFPNVPVRVLPQKRVYKNNGYLLISCNGGLNQMRSAICDMVAIARYLNVTLIVPELDKTSFWADPSEFEDIFNVDHFITSLRDEVRILKQLPIRLKKKVELGILHTMPPVSWSDISYYHNQILPLIQKYKVVHLNRTDARLANNGQPLELQKLRCRVNFNALRFTPQIEELGRRVVKLLRQNGPFLVLHLRYEMDMLAFSGCTQGCNDEEIEELTRMRYAYPWWKEKIINSDLKRKDGLCPLTPEETALTLKALDIDRDIQIYIAAGEIYGGKRRTDSLADAYPKLVRKETLLGADDLQYFQNHSSQMAALDYLVSLESDIFVPTYDGNMAKVVEGHRRFLGFKKTILLDRRVLVDLIDKYTSGLLSWDE

SEQ ID NO: 23109 - protein, 499 aa, Panax ginseng
MGLKTFGGESRKRIEKLKSSMVSKSRMKLWMIRATTSVLLWTCLVQLTALGEMRGPMVLKGWPSCFSQDSAMDVKLVQTIPTRVLPPKRVYKNNGYLMVSCNGGLNQMRAAICDMVAIARYLNVTLIVPELDKTSFWADPSEFQDIFDVDHFIASLRDEVRILKELPPRLKKRVELGMFYTMPPISWSDISYYHNQILPLIKKYKVVHLNRTDARLANNGQPLEIQKLRCRVNFSTLRFTTQIEELSRRVIKLLRQNGPFLVLHLRYEMDMLAFSGCSQGCNNEEVEELTRMRYAYPWWKEKIINSDLKRKDGLCPLTPEETALTLRALDIDRDIQIYIAAGEIYGGERRMASLAAAYPKLVRKETLLGPSDLGYFQNHSSQMAALDYLVSLESDIFVPTYDGNMAKVVEGHRRFLGFKKTILLDRRLLVDLIDQYNHGSLNWDEFSSAVKEAHADRMGSPTKRLVIPDRPKEEDYFYANPEECLQSSNPSEELSTSIL

SEQ ID NO: 23110 - protein, 498 aa, Panax ginseng
MGLKTFRGESRKGIEKLKTSMVSRSRMKLWMIRATTSVLVWTCLVQLTALGEMWGPRVLKGWPSCFSQDSAMDVKLPPALPDRVLPPKRVYKNNGYLIVSCNGGLNQMRAAICDMVAIARYLNVTLIVPELDKTSFWADPSEFEDIFDVDHFISSLRDEVRILKELPPRLKRRVELGIFYTMPPISWSDISYYQNQILPLIKKYKVVHLNRTDARLANNGQPLEIQKLRCRVNFSALRFTTQIEELGRRVIKLLRQNGPFLVLHLRYEMDMLAFSGCTQGCNNEEVEELTRMRYAYPWWKEKIINSDLKRKDGLCPLTPEETALTLRALDIDRDIQIYIAAGEIYGGERRMASLAAAYPKLVRKETLLGPSDLNYFQNHSSQMAALDYLVSLDSDIFVPTYDGNMAKVVEGHRRFLGFKKTILLDRRLLVDLIDQYNHGSLNWDEFSTAVKEAHGDRMGTPTKRLVIPDRPKEEDYFYANPEECLQSSGLSEELSRVI

SEQ ID NO: 23111 - protein, 498 aa, Panax ginseng
MGLKTFRGESRKGIEKLKTSMVSRSRMKLWMIRATTSVLVWTCLVQLTALGEMWGPRVLKGWPSCFSQDSAMDVKLPPALPARVLPPKRVYKNNGYLIVSCNGGLNQMRAAICDMIAIARYLNVTLIVPELDKTSFWADPSEFEDIFDVDHFISSLRDEVRILKELPPRLKRRVELGIFYTMPPISWSDISYYQNQILPLIKKYKVVHLNRTDARLANNGQPLEIQKLRCRVNFSALRFTTQIEELGRRVIKLLRQNGPFLVLHLRYEMDMLAFSGCTQGCNNEEVEELTRMRYAYPWWKEKIINSDLKRKDGLCPLTPEETALTLRALDIDRDIQIYIAAGEIYGGERRMASLAAAYPKLVRKETLLGPSDLNYFQNHSSQMAALDYLVSLDSDIFVPTYDGNMAKVVEGHRRFLGFKKTILLDRRLLVDLLDQYNHGSLNWDEFSTAVKEAHGDRMGTPTKRLVIPDRPKEEDYFYANPEECLQSSDLSEELSSVI

SEQ ID NO: 23112 - protein, 498 aa, Panax ginseng
MGLKTFRGESRKGIEKLKTSMVSRSRMKLWMIRATTSVLVWTCLVQLTALGEMWGPRVLKGWPSCFSQDSAMDVKLPPALPARVLPPKRVYKNNGYLIVSCNGGLNQMRAAICDMVAIARYLNVTLIVPELDKTSFWADPSEFEDIFDVDHFISSLRDEVRILKELPPRLKRRVELGIFYTMPPISWSDISYYQNQILPLIKKYKVVHLNRTDTRLANNGQPLEIQKLRCRVNFSALRFTTQIEELGRRVIKLLRQNGPFLVLHLRYEMDMLAFSGCTQGCNNEEVEELTRMRYAYPWWKEKIIDSDMKRKDGLCPLTPEETALTLRALDIDRDIQIYIAAGEIYGGERRMASLAAAYPKLVRKETLLGPSDLNYFQNHSSQMAALDYLVSLDSDIFVPTYDGNMAKVVEGHRRFLGFKKTILLDRRLLVDLIDQYNHGSLNWDEFSTAVKEAHGDRMGTPTKRLVIPDRPKEEDYFYANPEECLQSSGLSEELSRVI

SEQ ID NO: 23113 - protein, 645 aa, Brachypodium distachyon
MASSLLRASPLSLLSRLRPLSRRPPSPHLLLLSGSTSASCSPPTLRTLATDAATIPEEAALPAAEAKLERMLPLQWPRRDALCGEISAGDAGHRVRLCGWVALRRTHAGLTFLTLRDSSGNGSDQVTTLPEYPEVYTVVNKLRVESVVVVEGVVRPRPTEAFNAEMKTGAIEVAADHILVLNSVARSLQFPITTADAVKDKFLEEVRLRFRVLDLRRPQMQSNLRLRHKVIKHVRRYLEDRHDFVEPGTCFALPQSPQLFKQMLMASGFEKYFQIARCFRNEDLRADRQQEFTQLDMEIAFTSMEDMLKFNEELMTHIFQEVGDIKLPKYFPRLTYVEAMNRYGTDRPDLRFDWELKDASDVFLGSSFKVFADTLENGGVIKALCVPGGAKVFSNTDLKKGTVYTEASKAGAKGLPFLKVMDNGELEGIGPLVSTLKPEKKEQLLELMDAKAGDLILFALGEHSTANQILGRLRLFIAHKLEVIDTTAQSILWVTDFPMFEWNSDEERYEALHHPFTAPNPEDMNDLPSARALAYDMIYNGVEIGGGSLRIYKSDVQQRIFEILGISPEQAEEKFGYLLECFDMGAPPHGGIAYGWDRLVMLLARESSIRDVIAFPKTTTAQCSLTKASSPVDPQQLKDLSLRAS

SEQ ID NO: 23114 - protein, 1107 aa, Sorghum bicolor
MAPSAAVPGGSEAEGAPRMAKFLCSFGGSILPRPLDGCLRYVGGETRIVMLPRDISYADLAARMRELYKDADIIKYQQPDEDLDALVSVVNDDDVVNMMEEYDKVIATGEAFTRLRIFLFSQHLDDDAASVAVHYNVDERETERRYVDALNSLGDVKSPSSPVSVEQLFGIGGNDSGIPDFAGLRHLNVPRPSHSQRYGEMDSPWSPAYVSPGQYGVHDPRDFPISPSSARFQVGAEDFDERIPDDFVRQSPKYRHYEAQSPSHVDNLVWLPPGAIIQQNAGFPGNLSRSNNFLDGNSGCDHCRSPFQKGQGSVSDPIYMNPRWTRPVQQHFDQASMISDYPSHHASSCSDYCLPGEHYVGGQDVRLENGVYVKEQNGGHPPMFYNESHPHDRVWHAHTNQSHQRYEDPRLHHPANGRVIEPYIVDGNSVNSAFAPNKVYEMHSASLGRSSHESPHHFHGTSELINDTYHNQQVGGSGSYVQPAGFEESSGQHYNHSSAYGADSFYQMQQNLPPIQSLRRRANSPVHTASPYDSPHLPMPNGSISTNFVRNTGDVSPRIPGLPGYDRMPNPWTPPNGNIPYRVVGHDVPSAMENTSAFAPRSNPTAAQYVQPFIAPESIQHQPGGPLIHPERAYPEPMPASYADSKVAVSALPLTDQLSRLDANTMKKLEGPDDNSTRNVNETTPLHAVNEPSTLPHHVGAVHEVSPKQKPTEHESRQKQHEAGATALQECGDISEDRLNFLPELIASVKKAALEDAAETQIVQSDANAAVSPVPDDDDNGKKLDEATAVNTDANQDPDLQGSLDRQKSSKIESTTAEAEALSKGLQTIQNDDLEEIRELGSGTYGAVYHGKWRGCDVAIKRIKASCFDGRPSERERLIADFWKEALILSSLHHPNVVSFYGVVRDGPDGSLATVTEFMVNGSLKQFLRKKDRTIDRRKRVILAMDAAFGMEYLHGKNIVHFDLKCENLLVNMRDPQRPICKIGDLGLSKVKQHTLVSGGVRGTLPWMAPELLSGKSNMVSEKIDVYSFGIVMWELLTGDEPYSDMRAAEIIGGIVNDSLRPQIPSWCDPEWKGLMESCWSSDPAERPSFTDISQRLRKMAAAMNVK

SEQ ID NO: 23115 - protein, 1104 aa, Zea mays
MAPSAAVPGGSEVEGSPRMAKFLCSFGGSILPRPLDGCLRYVGGETRIVMLPRDISYADLAARMRELYKDADIIKYQQPDEDLDALVSVVNDDDVVNMMEEYDKVIATGEAFTRLRIFLFSQHLDDDAASVDVHYNVDERETERRYVDALNSLGDVKSPSSPVSVEQLFGIGGNDSGIPDFAGLRHLNVPRPTHSQRYGEMDSPWSPAYVSPGQYGVHDPRDFPISPSSARFQVGAEDFDERTPDDFVRQSPKYRHYEAHSPSHMDNLVWLPPGAVIQQNAGFPGNLSRSNNFLDGSNGCDHCRSPFHKVQGSVNDPIYMNPRWTRPVQQHFDQPSMINDYPGHHANSCPDYCRPGDHYVGGQDVRLENGVYVKEQNGGHPPMFYNESHPHDRVWHVHTKQSHQRYEDPRLHHPANGRVIEPYIMDANKVYEVHSASLARSSHESPHYYHGSSEVINDTYHNQQVGGSGSYVQPAGFEESPSHHYNHSSAYGADSFYQMQQNLPPIQSLRRRANSPVHTASPYDSPHLPISNGTINTNFVRNTGDVSPRIPGLPGYDRMPNTWTPPNGSIPYRVVGHDVHAASMENTSAFGPRSNPTAAQYVQHFIAPESIQHQPGAPLREVHPERSYPEPMPSSYVDGKVAVSALPLTDQLSRLDTNTIKKPEGPDDVNSTQNVNETTPLHAVDEPSTLPHHVVVVHEVDTKQGKPTEHESRQKQHEAGATALQECGDISEDRLNFLPELIASVKKAALEDAAETRIAQSDANGAVSPVPDDDDDNEKKLDAAAAGTTDANQDPDLQGSIDRQKSSKIESTTAEAEALSKGLQTIKNDDLEEIRELGSGTYGAVYHGKWRGCDVAVKRIKASCFVGRPSERERLIADFWKEALILSSLHHPNVVSFYGVVRDGPDGSLATVTEFMINGSLKQFLRKKDRTIDRRKRVILAMDAAFGMEYLHGKNIVHFDLKCENLLVNMRDPQRPICKIGDLGLSKVKQHTLVSGGVRGTLPWMAPELLSGKSNMVSDKIDVYSFGIVMWELLTGEEPYSGMRAAEIIGGIVNDSLRPQIPSWCDPEWKGLMESCWSSDPAERPSFTDISQRLRKMAAAMNVK

SEQ ID NO: 23116 - protein, 1110 aa, Panicum virgatum
MAPPAAAPGSSEAEGPPHMAKFLCSFGGSILPRPLDGCLRYVSGDTRIVMLPRDISYADLAARMRELYKDADVIKYQQPDEDLDALVSVVNDDDVVNMMEEYDKVIASGEVFTRLRIFLFSQNLDDDAASAVVHYNVDERETERRYVDALNSLGDVNTPSSPVSVEQLFGIVGNDSGIPDFASLRHLNVPRPSQSQSYGEMDSPWSPAYISPGQYAVHDPRDFPISPSSARFQVGAEDFDERIPDDFVRQSPKYRHYEPQSPPHMDNLVWLPPGAVIQQNAGFPGNLSRSNNFLDGNSVSDHCRSPFHKGHGSVTDPRYMDPRWTRTVQQHFDQPNKTSEYPGHPSNSCSNCCRPGEHYVGGQDVRMENGVYVKEQNGGHAPMFYNESHSHERLRHAHTSQSHQRYEDPRLHLPGNGRVIEPYIVDSNSVNSAFAPNKVYEMHSASLGRSSHESPHYFHGSSELINDAYHNQQVGGSGAYLQPAGFEESPGQHYNHSSTYGADSFYQMQQNLPPIQSLRRRASSPVHTASPYDSPHLPMPNGSINTNFVRNTGDVSPRIPGQPAYDRMPNSWAPPNGSIPYRVVGHDVPVAMENTSALGPRSNPITAQYVQPFIAPESIQQQHRAPSREVNPERAYAEHMPSSYVDGRVAVSALPLADQSSKLDTKTVRKPGPEDDSSTRNVNEGTPLHAVDEPSTLPHRVGAVHEVDPKLGKPTEHESRTKQHEAGAIALQEQGDISEDRLNFLPELIASVKKAALEDATQTHIAKSDANAAVAPVPDDDDNGKKLDVATAGNTDANQDSDLHGSNDQQKSSKIESTTAEAEALSKGLQTINNDDLEEIRELGSGTYGAVYHGKWRGCDVAIKRIKASCFAGRPSERERLIADFWKEAQILSSLHHPNVVSFYGVVRDGPDGSLATVTEFMVNGSLKQFLRKKDRTIDRRKRVILAMDAAFGMEYLHGKNIVHFDLKCENLLVNMRDPQRPICKIGDLGLSKVKQHTLVSGGVRGTLPWMAPELLSGKSNMVSEKIDVYSFGIVMWELLTGEEPYSDMRAAEIIGGIVNDSLRPQIPSWCDPEWKALMESCWSSDPTGRPSFTDISQRLRKMAAAMNVK

SEQ ID NO: 23117 - protein, 1117 aa, Setaria italica
MAPPAAAAGGSEAEGAPRMAKFLCSFGGSILPRPVDGCLRYVGGDTRIVMLPRDISYADLAARMRELYKDADIIKYQQPDEDLDALVSVVNDDDVVNMMEEYDKVIASGEVFTRLRIFLFSQNLDDDAASAVVHYNVDERETERRYVDALNNLGDVNTPSSPVSVEQLFGIVGNDSGIPDFAGLRHLNVPRPSQSQRYGEMDSPWSPAYVSPGQYAVHDPRDFPVSPSSARFQVGAEDFDERTPDDFVRQSPKYRHYEAQSPPHMDNLVWLPPGAVIQQNAGFPGNLSRSNNFLDGNSVGEHGRLPFQQGQGSMTDPRYMDPRWTRPAQQHFDQPSMTNEYPGHPSNSCSNCYRSGEHYMGGQDIRMENGVYVKEQNGGHPPMFYNESHLHDRVWHAHTSQSHQRYEDPRLHLPGNGRVIEPYIVDTNPVNSVFAPNKVYEMHSATLGRSSHESPHYFHGSCELINDTYHNQQVGGSGSYVQPAGFEESPGQHYNHSSTYGADSFYQMQQNLPPIQSLRRRANSPVHAGSPYDSPHLPMPNGSIPMPNGSINTNFVRNTGDVSPRIPGLPAYERMPNPWAPPNGSIPYRVVGHDVPAAMESTSALGPRSNPITAQYVQPFIAPESVQHQHGAPSREVNPERAYADHIPPPYVDGRVAVSALPLTDQLSRLDTNTMKKPEGPEYDNSTRNVNEGTPLHAVDETNTLPRHVGAVHEVDPKQKPTEHEIRTKQLEAGVTALQECGDISEDRLNFVPELIASLKKAALEDATETQMAQSDANAAVSPVPDDDDNGKKLDVATAGNTDAIQDSDLHGSSDQQKSSKIESTTAEAEALSKGLQTINNDDLEEIRELGSGTYGAVYHGKWRGCDVAIKRIKASCFAGRPSERERLIADFWKEALILSSVHHPNVVSFYGVVRDGPDGSLATVTEFMVNGSLKQFLRKKDRTIDRRKRVILAMDAAFGMEYLHGKNIVHFDLKCENLLVNMRDPQRPICKIGDLGLSKVKQHTLVSGGVRGTLPWMAPELLSGKSNMVSEKIDVYSFGIVMWELLTGEEPYSDMRAAEIIGGIVNDSLRPQIPAWCDPEWKALMESCWSSDPTERPSFTDISQRLRKMAAAMNVK

SEQ ID NO: 23118 - protein, 328 aa, Setaria italica
MAEGAAATPAATSSFEVDLGNLMAYDPSHHLTAASSREELRQECLQKGTELAQAVADALFALPPSEDRDGPIVHLPPPTIRLPREKHLPKPKPPTKWELFAKAKGITKRKKNKREWDEQTQSWKRTYGYDRVNDDKDIPIIDAKATDEPGVDPFALRRQDKKKRVEKQEKSRLENLKKAAKVGALPSHIQLAAKALPITGTKADLPKKSRKEDLENVAGMASSATASGGKFDEKLPGEKPLKHPGKHRKFLPVAEGKGMGNLEKQQNDKILNSLLARNSDEQLDVGKAITMYKVKKEKQRSKDKKMSSKSDKLKPQKKPLKKSSKKKA

SEQ ID NO: 23119 - protein, 329 aa, Echinochloa colona
MAEGAAATPAATSSCEVDLGNIMAYDPSHHLAAAAASREELRAECLQKGTELAQAVADALFALPPHEDRDGPLVHLPPPTVRLPREKHLPKPKPPTKWELFAKAKGITKHKKNKREWDEQTQSWKRTYGYDRVNDDKDIPIIEAKSTDEPGVDPFAQRMQEKKKRVEKQEKNRLENLKKAAKVGALPSHIQLAAKALPITGTKADLPKKSKKEDLENVAGMASSATASGGKFDEKLPGEKPPKHPGKHRKFLPVAEGKGMGNLEKQQNDKILNSLLARNSDEQLDVGKAITMYKVKKEKQRRKDKEMYSKSDKLKTQKKPFKKSSKKKA

SEQ ID NO: 23120 - protein, 329 aa, Echinochloa colona
MAEGAAATPAATSSCEVDLGNLMAYDPSHHLAAAAASREELRAECLQKGTELAQAVADALFALPPHEDRDGPLVHLPPPTVRLPREKHLPKPKPPTKWELFAKAKGITKRKKNKREWDEQTKSWKRTYGYDRVNDDKDIPIIDAKSTDEPGVDPFAQRMQEKKKRVEKQEKNRLENLKKAAKVGALPSHIQLAAKALPITGTKADLPKKSKKEDLENVAGMASSATASGGKFDEKLPGEKPPKHPGKHRKFLPVAEGKGMGNLEKQQNDKILNSLLARNSDEQLDVGKAITMYKVKKEKQRRKDKEMFSKSDKLKTQKKPFKKSSQKKA

SEQ ID NO: 23121 - protein, 327 aa, Panicum virgatum
MADGAAPTPAAASSFEVDLGNLMAYDPSHHAAATSREELRQVCLQKATELAQAVANSLFALPPSEDRDGPIVHLPPPTIRLPREKHLPKPKPPTKWELFAKAKGITKRKKNKREWDEQTQSWKRTYGYDRVNDDKDVPIIDAKATDEPGVDPFAQRRQEKKKRVEKQEKNRLENLKKAEKVGALPSHIQLAAKALPITGTKADLLKKSRKEDLENVAGMASSATASGGKFDAKLPGEKPPKHHGKHRKFLPVAEGKGMGNLEKQQNDKILNSLLARNSDEQLDVGKAITMYKVKKEKQRRKDKETFSKSDKLKPQKKSLKKSSKKKA

SEQ ID NO: 23122 - protein, 330 aa, Sorghum bicolor
MAEVPAVVAAASSCEVDLGNLMAYDPSHHVVSAAAAASREELRQECLRKGTELAQAVADALFALPPSEDRDGPIVHLPPPTVRLPREKHLPKPKPPTKWELFAKAKGITKRKKNKREWDEQTQSWKRTYGYDRVNDDKDIPIVEAKLTDEPGVDPFAQRRDEKKKRVEKQEKNRLENLKKAAKIGALPSHIQLAAKALPITGTKADLPKKSRKEDLESVVGMASSATASGGKFDEKLPGEKPPKHSGKHRKFLPVAEGKGMGSLEKQQNDKILNSLLARNSDEPLDVGKAITMYKVKKEKQRRKEKDMSSKSDKLKPQKKPHKKSSKKKA

SEQ ID NO: 23123 - protein, 326 aa, Zea mays
MAEEPAVVVASSSYEVDLGNLMAYDPSHHVATASREELRQECLRKGTELAQAVADVLFALPPNEDRDGPIIHLPPPTFRLPREKHLPKPKPPTKWELFAKAKGITKRKKNKREWDEQTQSWKRTHGYDRVNDDKDIPIIEAKLTDEPGVDPFAQRRDEKKKRVEKQEKNRLDNLKKAAKVGALPSHIQLAAKALPITGTKADLPKKSRKEDLESVVGMASSATASGGKFDEKLPGEKPPKHPGKHRKFLPVAEGKGMGSLEKQQNDKILNSLLARNSDEPLDVGKAITMYKVKKEKQRRKEKGMSSKSDKLKPQKKPHKKSSKKKA

SEQ ID NO: 23124 - protein, 330 aa, Zea mays
MAEEPAIVVAASSSCEVDLGNLMAYDPCHHVAAAASASREELRQECLRKGTELAQAVADALFALPPTEDRDGPIVHLPPHTVRLPREKHLPKPKPPTKWELFAKAKGITKRKKNKREWDEQTQSWKRTYGYDRVNDDKDVPILEAKLTDEPGVDPFAQRRDEKKKRVEKQEKSRLENLKKAAKVGALPSHIQLAAKALPITGTKADLPKKSRKEDLESVVGMASSATASGGKFDEKLPGEKPPKHPGKHRKFLPVAEGKGMGSLEKQQNDKILSSLLARNSDEPLDVSKAITMYKVKKEKQRRKEKNMPSKSDKLKPQKKPHKKSSKKRA

SEQ ID NO: 23125 - protein, 332 aa, Brachypodium distachyon
MAEETAAAATSMATNYEVDLGNLMACDPSHHIAAAQSSREELRNECLQKATELAQAVADALFALPATVGRDGPSVRLPPPVHRLPREKHLPRPKPPTKWEQFAKSKGIVKHKKNKREWDEQTASWKRTYGYDRVNDDRDVPIIEAKMTDEPGVDPFAKRRDEKKQRVEKQEKNRLGNLKNAAKVGALPSHIQLAATAVPITGTKADLPKKAKKEDLENVAGMASSATASGGKFDKKLPGEKAPKKAGKNRKFLPVVEGKGMGNLEKQQNDKILNSLLAKNFEEPLDVSKAITMYKVKKDNKRRKEKQSSSGSNKKLKPQKKLQKKSSKKTAA

SEQ ID NO: 23126 - protein, 331 aa, Pseudoroegneria spicata
MAEEAAASASAAATNFEVDLGHLLAYDPSHHLAAAPSSRPELRDECLRKATELAQAVANALFSLPATEGRDGPVVRLPPPTNRLPREKHLPRPKPPTKWEHFANSKGIIKHKKNKRAWDEQTNSWKRTYGYDRVNDDRDVPIIEAKLTDEPGVDPFAQRREEKKSRVDKQEKNRLGNLKNAAKVGALPSHIQLAATSVPITGTKADLPRKAKKEDLENVAGMASAATASGGKFDKKLPGEKPLKKAGKNRKFLPVVEGKGMGNLEKQQNDKILNSLLAKNFEEPLDVSKAITMYKVKKDNKRRKDKQSSSSGSNKLKPQKKIHKKSSKKSA

SEQ ID NO: 23127 - protein, 380 aa, Triticum aestivum
MKPSAGVLLAAVVALLLVAAVRGDDDCGSPESAAQDRARANPLKIAAFFSILVCGALGCSLPVLGRRVPALRPEGDVFFLVKAFAAGVILATGFIHILPDAFENLTSDCLPSDGPWKDFPFAGLGAMVGAIGTLVVDTVATGYFTRAHLNKDGAHGHGAVSSSAVVVDEEKQAAAAASEEARRHEGGEHEVHVHTHATHGHAHGSAALVAAVGGAEDEKDTIRHRVISQVLELGIVVHSVIIGISLGASQDPETIKPLVVALSFHQMFEGMGLGGCIVQAKFKARSIVTMILFFCLTTPVGIAVGYGISRVYNENSPTALVVEGGLNSVAAGILVYMALVDLLAEDFMNPKVQSRGKLQLGINVSMLVGAGLMSMLAKWA

SEQ ID NO: 23128 - protein, 375 aa, Hordeum vulgare
MKPSAAVLLAAVVALLLVSAVRGGDDCGSPESAAHDRARARPLKIVAFFSILICGALGCSLPVLGRRVPALRPDGDVFFLVKAFAAGVILATGFIHILPDAFENLTSDCLPAAGPWKDFPFAGLGAMVGAIGTLVVDTVATGYFTRAHLNKDRAHGSSAAVVDEEKQAAAAAAATAASEEAHEGHVHLHTHATHGHAHGSAALVAAVGGAEDEKDTIRHRVISQVLELGIVVHSVIIGISLGASQDPETIKPLVVALSFHQMFEGMGLGGCIVQAKFKARSIVTMILFFCLTTPVGIAIGFGISRVYHENSPTALVVEGSLNSVAAGILVYMALVDLLAEDFMNPMVQSRGKLQLGINVSMLVGAGLMSMLAKWA

SEQ ID NO: 23129 - protein, 380 aa, Triticum aestivum
MKPSAAVLLAAVVALLLVSAVRGEDDCGSPESAARDRARARPLKIAAFFSILICGALGCSLPVLGRHVPALRPDGDVFFLVKAFAAGVILATGFIHILPDAFENLTSDCLPAAGPWKDFPFAGLGAMVGAIGTLVVDTLATGYFTRAHLNKDRAHGSSAAVVDEEKQAAAAAAASELARHYHDDGEHEGHVHLHTHATHGHTHGSAALVAAVGGAEDEKDTIRHRVISQVLELGIVVHSVIIGISLGASQDPETIKPLVVALSFHQMFEGMGLGGCIVQAKFKARSIVTMILFFCLTTPVGIAIGFGISQVYNENSPTALVVEGSLNSVAAGILVYMALVDLLAEDFMNPKVQSRGKLQLGINVSMLVGAGLMSMLAKWA

SEQ ID NO: 23130 - protein, 366 aa, Brachypodium distachyon
MKPSAAILLGAAIAALLLVSAVRGEGEEDECGSAESAAADRARVRPLKIAAFFSILVSGALGCSLPVLARRVPGLRPDGDVFFLVKAFAAGVILATGFIHILPDAFENLGSPCLPSDGPWKDFPFAGLGAMVGAIGTLVVDTLATGYFTRAHSKKGGGAVVDEEKQAAAAAGEEDVHVHTHATHGHAHGSAALVAAVGGAEDDKMDTIRYRVISQVLELGIVVHSVIIGISLGASQEPDTIKPLVVALSFHQMFEGMGLGGCIVQAKFKARSIVTMILFFCLTTPVGIAVGVGISRVYNENSPTALVVEGGLNSVAAGILVYMALVDLLAEDFMNPKVQSRGKLQLGINLSMLLGAGLMSMLAKWA

SEQ ID NO: 23131 - protein, 512 aa, Panicum virgatum
MAIGAFAEGPAGAGYSGRVTSFVVLSCIVAGSGGILFGYDLGISGGVTSMESFLSKFFQMKGDKNVSNYCRFDSELLTVFTSSLYVAGLVSTLFASSVTRRFGRRASILIGGSVFIVGSVFGGAAVNVYMLLLNRILLGIGLGFTNQSIPLYLSEMAPPQYRGAINNGFELCISIGILIANLINFGVEKIVDGWGWRISLSLAAVPAAFLTMGAIFLPETPSFIIQRDGNIDEAKILLQRLRGTTRIQKELDDLVSASNVSRTIQHPLRNIFKRKYRPQLVIALLVPFFNQVTGINVINFYAPVMFRTIGLKESASLMSAVVTRICATVANIVAMVVVDRFGRRKLFLVGGIQMILSQIMVGAVLAAKFKDHGGMEKEYAYLVLIIMCVFVAGFAWSWGPLTYLVPTEICPLEIRSAGQSIVVAVIFLVTFVIGQTFLAMLCHLKFGTFFLFGGWVCVMTLFVYFFLPETKQLPMEQMEQVWRRHWFWRRIIVGEEEEEEEREARSIALSNT

SEQ ID NO: 23132 - protein, 525 aa, Zea mays
MAIGGFVEAPAGADYGGRVTSFVVLSCIVAGSGGILFGYDLGISGGVTSMESFLRKFFPDVYHQMKGDKDVSNYCRFDSELLTVFTSSLYIAGLVATLFASSVTRRFGRRTSILIGGTVFVIGSVFGGAAVNVYMLLLNRILLGVGLGFTNQSIPLYLSEMAPPQYRGAINNGFELCISIGILIANLINYGVEKIAGGWGWRISLSLAAVPAAFLTVGAIYLPETPSFIIQRRGGSNNVDEARLLLQRLRGTTRVQKELDDLVSATRTTTTGRPFRTILRRKYRPQLVIALLVPFFNQVTGINVINFYAPVMFRTIGLKESASLMSAVVTRVCATAANVVAMVVVDRFGRRKLFLVGGVQMILSQAMVGAVLAAKFQEHGGMEKEYAYLVLVIMCVFVAGFAWSWGPLTYLVPTEICPLEIRSAGQSVVIAVIFFVTFLIGQTFLAMLCHLKFGTFFLFGGWVCVMTLFVYFFLPETKQLPMEQMEQVWRTHWFWKRIVDEDAAGEQPREEAAGTIALSSTSTTT

SEQ ID NO: 23133 - protein, 538 aa, Sorghum bicolor
MAIGGFVDAPAAAAGADYGGRVTSFVVLSCIVAGSGGILFGYDLGISGGVTSMESFLRKFFPDVYHQMKGDKDVSNYCRFDSELLTVFTSSLYVAGLVATLFASSVTRRFGRRTSILIGGTVFVLGSVFGGAAVNVYMLLLNRILLGIGLGFTNQSIPLYLSEMAPPQYRGAINNGFELCISIGILIANLINYGVEKIAGGWGWRLSLSLAAVPAAFLTVGAIFLPETPSFIIQRGGGGSDIDEARLLLQRLRGTTRVQKELDDLVSAASEASRTTATRRPFRNILRSKYRPQLVIALLVPFFNQVTGINVINFYAPVMFRTIGLKESASLMSAVVTRVCATAANVVAMVVVDRFGRRKLLLVGGVQMILSQVMVGAVLAAKFKDHGGMDKEYAYLVLVIMCVFVAGFAWSWGPLTYLVPTEICPLEIRSAGQSIVIAVIFFVTFLIGQTFLAMLCHLKFGTFFLFGGWVCVMTLFVYFFLPETKQLPMEQMEQVWRTHWFWKRIADADADAGEEEEQGQRRPRPRGEAAGTIALSAT

SEQ ID NO: 23134 - protein, 618 aa, Secale cereale
MSESNIDGIEISVSNDERRDRADAENSEDEPKHRRMRSLRKKALHASTKLTHSLKKRGKRKVDCRVPRIPIEDVRDAGEEQAVSSFREVLFARNLLPERHDDYHMMLRFLKARKFDVEKAAQMWDEMLQWRNEFGTDTILEDFEFHELEEVLQYYPQGYHGVDKDGRPVYIELLGKVEPNKLVQTTTVERYIKYHVQEFERAFREKFPACSISAQKHIDTTTTILDVHGVGWKNFGKIARDLVRCMQKIDGDYYPETLHQMFIVNAGAGFKLIWSTIKGLLDPKTSSKIHVLGAKYQSRLLEAIDASQLPEFFGGLCTCTNQGGCLRSNKGPWSDPLIMKIVHSMESSALRDILQVSDIEETITGSVRLRALKLPERISDTSNAESGSDVDDLGSPIAPEDVEYHSLAPVREEARESGSTTYGCSDDRPLSVDKAVESNKRYNLAGNVLRQYNTRQNSSMNRVSPEPGRAPNVREGDADDGILKLFSRKVLAVILKVLSLLRLFTRHQQQLENVHPHTAAVPSNQPNLQIVKEDRVNPCLERLERLESMCNQLSRKPPEIPQDKDRAIQDSFDRIKSIEFDLEKTKKVLHATVIKQMQMAETLESVTESGHRRRKFCT

SEQ ID NO: 23135 - protein, 618 aa, Triticum aestivum
MSESNIDGIEISVSNDERRDRADAENSEDEPKHRRMRSLRKKALHASTKLTHSLKKRGKRKVDCRVPRIPIEDVRDAGEEQAVSSFREVLFARNLLPERHDDYHMMLRFLKARKFDVEKAAQMWDEMLQWRNEFGTDTILEDFEFHELEEVLQYYPQGYHGVDKDGRPVYIELLGKVEPNKLVQTTTVERYIKYHVQEFERAFREKFPACSIAAQKHIDTTTTILDVHGVGWKNFGKIARDLVRCMQKIDGDYYPETLHQMFIVNAGAGFKLIWSTIKGLLDPKTSSKIHVLGAKYQSRLLEAIDASQLPEFFGGLCTCSNQGGCLRSNKGPWSDPLIMKIVHSMESSALRDIVQVSDIEETVTGSVRLRALKLPERISDTSNAESGSDVDDLGSPVAPEDVEYHSLAPVREEARESGSTTYGCSDDRPLSVDKAVESNKRYNLAGNVLRQYNTRQNSSMNRVSPEPGRAPNVREGDADDGILKLFSRKVLAVILKVLSLLRLFTRHEQQLENVHPHTAAVPSNQPNLQIVKEDRVNPCLERLERLESMCNQLSRKPPEIPQDKDRAIQDSFDRIKSIEFDLEKTKKVLHATVIKQMQMAETLESVTESGHRRRKFCT

SEQ ID NO: 23136 - protein, 618 aa, Triticum aestivum
MSESNIDGIEISVSNDERRDRADAENSEDEPKHRRMRSLRKKALHASTKLTHSLKKRGKRKVDCRVPRIPIEDVRDAGEEQAVSSFREVLFARNLLPERHDDYHMMLRFLKARKFDVEKAAQMWDEMLQWRNEFGTDTILEDFEFHELEEVLQYYPQGYHGVDKDGRPVYIELLGKVEPNKLVQTTTVERYIKYHVQEFERAFREKFPACSIAAQKHIDTTTTILDVHGVGWKNFGKIARDLVRCMQKIDGDYYPETLHQMFIVNAGAGFKLIWSTIKGLLDPKTSSKIHVLGAKYQSRLLEAIDASQLPEFFGGLCTCSNQGGCLRSNKGPWSDPLIMKIVHSMESSALRDIVQVSDIEETITGSVRLRALKLPERISDTSNAESGSDVDDLGSPVAPEDVEYHSLAPVREEARESGSTTYGCSDDRPLSVDKAVESNKRSNVAGNVLRQYNTRQNSSMNRVSPEPGRAPNVREGDADDGILKLFSRKVLAVILKVLSLLRLFTRHQRQLENVHPHTAAVPSNQPNLQIVKEDRVNPCLERLERLESMCNQLSRKPPEIPQDKDRAIQDSFDRIKSIEFDLEKTKKVLHATVIKQMQMAETLESVTESGHRRRKFCT

SEQ ID NO: 23137 - protein, 619 aa, Brachypodium distachyon
MSESNIDGIEISVSNDDRRDRADAENSEDEPRHRRMRSLRKKALHASTRLTHSLKKRGKRKVDCRVPHIAIEDVRDAEEEQAVSSFREVLFARNLLPERHDDYHMMLRFLKARKFDFEKASQMWEEMLQWRKGFGADTILEDFQFHELEEVLQYYPQGYHGVDKEGRPVYIELLGKVEPNKLLQTTTMERYLQYHVQEFERAFREKFPACSIAAKKHVDTTTTILDVHGVGWKNFGKVARDLVRCMQKIDGDYYPETLHQMFIVNAGTGFKLIWSTVKGLLDPKTSSKIHVLGAKFQSRLLEAIDASQLPEFFGGLCTCSHQGGCLRSNKGPWSDPLIMKIVHSMESSALREVVQVSDMEETLTGSVRLRACKLPERISDTSNAESGSDVDDLGSPIAPADIEYHSLAPVREEARESGSTTCDRSDDWPLSVDKAVESNKRYNLAGNVLRQYNTRQNSSTNRVSPEPGPAPNDREGIADDGILKYFSRKILAVILKILSLLRFFTRRRQQLENVHPHTPTVSGSNQADLQVVKEDRVNPCLERLERLESMCNQLSRKPPEIPQDKDRAIQDSFDRIKSIEFDLEKTKKVLHATVIKQMQMAETLEAVKDSDLRRRKFCT

SEQ ID NO: 23138 - protein, 617 aa, Setaria italica
MSEGNVDGIEIAISNDERRDRADVEISEDEPRHTKIRLLRKKALHASTRLTHSLKKRGKRKVDCRVQRIAIEDVRDAEEEQAVSSFREVLFARGLLPVKHDDYHMMLRFLKARKFDLEKAAQMWADMLHWRKEFGTDTIFEDFEFHELEEVLQYYPHGYHGVDKEGRPVYIELLGKVEPNKLVQITSVERYIKYHVQEFERAFREKFPACSIAAKRHIDTTTTILDVHGVGWKNFSKIARDLVRCMQKIDGDYYPETLHQMFIVNAGPGFKLIWSTVKGLLDPKTSSKIHVLGTKYQSRLLEAIDASQLPEYFGGSCSCPNHGGCLRSNKGPWSDPSIMKLVHSMESLREIGQVSDIEETITGSVRLRALKLPERISDTSNAESGSDIDDLGSPVAPEDVEYPSLAPVREEVRESGSTTYSGSDGTSHMADKVVGSNQRYNTAGNEARQFNTEQRSFVNGALPAPGRRVPNNGGGNADDGILKHLSRKVVAVFLKVLSLLRFFIRRRQHLENVHPHATTVPRNQADLQIIREDRVNPCLERLDRLESVFNQLSRKPPELPQDKDQAIQDSFDRIKSIEFDLEKTKKVLHATVIKQMQMAETLEAVKESDLRRRKFCT

SEQ ID NO: 23139 - protein, 616 aa, Triticum aestivum
SNIDGIEISVSNDERRDRADAENSEDEPKHRRMRSLRKKALHASTKLTHSLKKRGKRKVDCRVPRIPIEDVRDAGEEQAVSSFREVLFARNLLPERHDDYHMMLRFLKARKFDVEKAAQMWDEMLQWRNEFGTDTILEDFEFHELEEVLQYYPQGYHGVDKDGRPVYIELLGKVEPNKLVQTTTVERYIKYHVQEFERAFREKFPACSIAAQKHIDTTTTILDVHGVGWKNFGKIARDLVRCMQKIDGDYYPETLHQMFIVNAGAGFKLIWSTIKGLLDPKTSSKIHVLGAKYQSRLLEAIDASQLPEFFGGLCTCSNQGGCLRSNKGPWSDPLIMKIVHSMESSALRDIVQVSDIEETITGSVRLRALKLPERISDTSNAESGSDVDDLGSPVAPEDVEYHSLAPVREEARESGSTIYGCSDDRPLSVDKAVESNKRYNLTGNVLRQYNTRQNSSMNRVLPEPGRAPNVREGDADDGILKLFSRKVLAVILKVLSLLRLFTRHQQHLENVHPHTAAVPSNQPNLQIVKEDRVNPCLERLERLESMCNQLSRKPPEIPQDKDRAIQDSFDRIKSIEFDLEKTKKVLHATVIKQMQMAETLESVTESGHHRRRKFCT

SEQ ID NO: 23140 - protein, 618 aa, Avena sativa
MSESNIDGIEISVSNDERRDRADAENSEDEPKHRRMRSLRKKALHASTKLTHSLKKRGKRKVDCRVPRIAIEDVRDAEEEQAVSSFREVLFARSLLPERHDDYHMMLRFLKARKFDFEKAAQMWDEMLQWRNEFGTDTILEDFEFHELEEVLQYYPQGYHGVDKDGRPVYIELLGKVEPNKLVQTTTVERYIKYHVQEFERAFREKFPACSIAAKKHIDTTTTILDVHGVGWKNFGKIARDLVRFMQKIDGDYYPETLHQMFIVNAGAGFKLIWSTIKGLLDPKTSSKIHVLGTKYQSRLLEAIDASQLPDFFGGLCTCSNQGGCLRSNKGPWSDPLTMKIVHSMESSALREIAQISDIEETITGSVRLRALKLPERISDTSNAESSSDVDDLGSPTAPEDVEYHSLAPVREEARESGSTTYSRSDDRSLSVDKAVDSNKRYNLTGNVLRQYNTRQNSLMNRISPEPGRVPNDHEGDAGEGILKLFSRKVLAVILKVLSLFRFFIRRRQQLENVHPHTANVPSNQENLQIVNEDRVNPCLERLERLESMCNQLSRKPPEIPQDKDRAIQDSFDRIKSIEYDLEKTKKVLHATVIKQMQMAETLESVKEPDHRRRKFCT

SEQ ID NO: 23141 - protein, 617 aa, Panicum virgatum
MSEGNADGIEILICNDERRDRADAEISEDEPRHTKMRALRKKALHASTRLTHSLKKRGKRKVDCRVPRIAIEDVRDAEEEQAVSSFREILFARSLLPVKHDDYHMMLRFLKARKFDFEKAAQMWADMLQWRKEFGTDAIFEDFEFHELEEVLQYYPHGYHGVDKEGRPVYIELLGKVEPNKLVQITSVERYIKYHVQEFERAFREKFPACLIAAKRHIDTTTTILDVHGVGWKNFSKIARDLVRCMQKIDGDYYPETLHQMFIVNAGPGFKLIWSTVKGLLDPKTSSKIHVLGTKYQSRLLEAIDASQLPEYFGGSCACPNHGGCLRSNKGPWSDPSIMKLVHGMESLREIGQVSDIEETITGSVRLRALKLPERISDTSNAESGSDVDDIGSPVAPEDVEYPSLAPVHEEARESGSTTYSGSDGTSHMADKVVRSKQRYNAAGNEARQFDTEQNSLVNGALPVPGWHALNDGVGNADDGVLKHLSRTVIAVFVKVLSILRFFIPRRQHLENVRPHTATVPSNQADLQMIREDRVNPCLERLERLESVFNQLSRKPPELPQDKDRAIQDSFDRIKSIEFDLEKTKKVLHATVIKQMQMAETLEAVKESDLRRRKFCT

SEQ ID NO: 23142 - protein, 252 aa, Cirsium arvense
MVGPADRPQIVLFGSSIVQLSFSNDGWGAILADVYARKADIVLRGYYGWNSRRAIKVLDQVFPKDSANQPSLVIVYFGGNDSMGPHSSGLGPHVPLPEYVENMRKIATHLQGLSETTRIIFLSCPPVDEVRVRENTSSIFSELVRTNELCRMYSEACVELCNEMGVKVIDLWTAFQKRDDWMTACFTDGVHLSGEGSKIVVAEILKVLKEAEWKPSLHWKSMPTEFSEDSPYDLVYSDGKTTLNPSDWTFHR

SEQ ID NO: 23143 - protein, 242 aa, Carthamus tinctorius
MVGPADRPQIVLFGSSIVQLSFSNDGWGAILADVYARKADIVLRGYYGWNSRRAIKVLDQIFPKDSANQPSLVIVYFGGNDSMGPHSSGLGPHVPLPEYVENMRKIATHLQGLSETTRIIFLSCPPVDEVRVRENTSSIFSELVRTNELCRMYSEACVELCNEMGVKVIDLWTAFQKRDDWTTACFTDGVHLSGEGSKIVVAEILKVLKEAEWKPSLHWKSMPTEFSEDSPYDLVYSDGKTR

SEQ ID NO: 23144 - protein, 241 aa, Taraxacum officinale
MIGPGRPQIVLFGSSIVQLSFSNDGWGAILADVYARKADIVLRGYYGWNSRRAIKVLDQVFPKDAANHPSLIIVYFGGNDSMGPHSSGLGPHVPLPEYIENMRKIITHLKSLSDTTRLIFLSCPPVDEVKLSETASSFFSELVRTNELCRIYSEACVDLCNETGVKVIDLWTAFQKRDDWKTACFTDGVHLSGEGSKIVVEEIIKVLKESEWKPSLFWKNMPTEFSEDSPYDLVYSDGKTT

SEQ ID NO: 23145 - protein, 209 aa, Leymus cinereus x Leymus triticoides
MAAPRAFVLGVLLAIAVANAEAASVVVGLAKCADCTRKNMKAEEAFKGLQVAIKCKNVHGEYESKAVGGLDGTGAFSVPLAADLHGADCVAQLHSAASNAPCSGQEPSKIVPVSEGTTFGVVAGAKTNAVASPECASATLCGPIKKHIIEHFHHKQPVPPKPEPKPQPHPDYHPVPKPEPKPQPHPDYHPVPPTPTYGGGGGGGYHGHH

SEQ ID NO: 23146 - protein, 210 aa, Pseudoroegneria spicata
MAAPRALVLAVLLAIAVANAEAASVVVGLAKCADCTRKNIKAEEAFKGLQVAIKCKNVHGEYESKAVGGLDGTGAFSVPLAADLHGADCVAQLHSAASNAPCSGQEPSKIVPVSQGTTFGVVAGAKTDVAASPQCASATLCGPIKKHIIEHFHHKQPVPPKPEPKPQPHPDYGPVPKPEPKPQPHPDYHPVPPTPTYGGGGGGGGYHGHH

SEQ ID NO: 23147 - protein, 210 aa, Triticum aestivum
MAAPRASLVLALLLAIAVANAEAASVVVGLAKCTDCTRKNIKAEEAFKGLQVAIKCKNVNGEYESKAVGALDGTGAFSVPVAADLHSADCVAQLHSAASNAPCSGQEPSKIVPVSEGTTFGVVAGAKTNALASPECASATLCGPIKKHIIEHFHHKKPVPPKPEPKPQPHPDYGPVPKPEPKPQPHPDYHPVPPTPSYGGGGGGGYHGHH

SEQ ID NO: 23148 - protein, 211 aa, Triticum aestivum
MAAPRALVLAVLLAVAVANAEAVSVVVGLAKCADCTMKNIKAEEAFKGLQVAIKCKNNAGDYESKAVGALDGTGAFSVPLAADLHGADCVAQLHSAASNAPCSGQEPSKIVPVSEGTTFGVVAGAKTDTVASPECASATLCGPIKKHIIEHFHHKKPVPPKPEPKPQPHPDYGPVPKPEPKPKPHPDYHPVPPTPTYGGGGGGGGGYHGHH

SEQ ID NO: 23149 - protein, 213 aa, Secale cereale
MAAPTRALVLCVLLAIAVANAEAASVVVGMAKCADCTRKNMKAEEAFKGLQVAIKCKNNAGDYESKAVGGLDGTGAFSVPLAADLHGADCVAQLHSAASNAPCPGQEPSKIVPVSEGTTFGVVAGENTATPSSASPECASMTLCGPIKKHIMEHFHHKKPVPPKPEPKPQPHPDYGPVPKPEPKPQPHPDYHPVPPTPTYGGGGGGGGYHGHH

SEQ ID NO: 23150 - protein, 209 aa, Secale cereale
MATPRALVLGVLLVIAVSNAEAASVVVGLAKCADCTRKNIKAEEAFKGLQVAIKCKNVHGDYESKAVGALDRTGAFSVPLASDLHGAACVAQLHSAASNAPCSGQEPSKIVPVSEGTTFGIVAGDHTATPSVASPECASMTLCGPIKKHIIEHFHHKKPVPPKPEPKPQPHPDYGPVPKPEPKPQPHPDYHPVPPTPTYGGGGGYHGHH

SEQ ID NO: 23151 - protein, 207 aa, Triticum aestivum
MAAPRALVLAVLLAIAVANAEAASVVVGLAKCADCTRKNIKAEEAFKGLQVAIKCKNIDGEYESKAVGALDGTGAFSVPLAADLHGADCVAQLHSAASNAPCSGQKPSKIVPVSEGTTFGVVAGAKTDTVASPECASATLCGPIKKHIIEHFHHKKLVPPKPEPKPQPHPEYGPVPKPEPKPQPHPDYHPVPPTPTYGGGGGYHGHH

SEQ ID NO: 23152 - protein, 210 aa, Triticum aestivum
MAAPRALVLAVLLALAVANAEAASVVVGLAKCADCTRKNLKAEEAFKGLQVAIKCKNVHGDYESKAVGALDGTGAFSVPLAADLHGADCVAQLHSAASNAPCPGQEPSKIVPVSEGTTFGVVAGDSIATPSAASPECASMTLCGPIKKHIIEHFHHKQPVPPKPEPKPQPHPDYHPVPKPEPKPQPHPDYHPVPPTPTYGGGGGGYHGHH

SEQ ID NO: 23153 - protein, 211 aa, Triticum aestivum
MAAPRALVLAVLLAIAVANAEAASVVVGLVKCADCTRKNMKAEEAFKGLQVAVKCKNVHGDYESKALGALDGTGAFRMPLAADLHGADCVAQLHSAASNAPCPGQEPSKIVPVSEGTTFGIVAGDSIATPSAASPECASMTLCGPIKKHIIEHFHHKKPVPPKPEPKPQPHPDYGPVPKPEPKPQPHPDYHPIPPTPTYGGGGGGGYHGHH

SEQ ID NO: 23154 - protein, 212 aa, Secale cereale
MAAATRALVLAVLLTIAVANTEAASVVVGLAKCADCTRKNMKAEEAFKGLQVAIKCKNSAGDYESKAVGGLDGTGAFSVPLAADLHGADCVAQLHSAASNMPCPGQEPSKIVPVSEGTTYGIVAGENRATPSAASPECASMTLCGPIKKHIIEHFHHKKPVPPKPEPKPQPHPDYGPVPKPEPKPQPHPDYHPVPPTPTYGGGGGGGYHGHH

SEQ ID NO: 23155 - protein, 215 aa, Hordeum vulgare
MAAPTRALVLAVLLAIAVANAEAASVVVGLAKCADCTRKNMKAEEAFKGLQVAIKCKNVHGEYESKAVGGLDGTGAFSVPLAADLHGADCVAQLHSAASNAPCPGQEPSKIVPVSEGTTFGIVAGDNTATPSAASPECASMTLCGPIKKHIMEHFHHKKPVPPKPEPKPEPHPDYGPVPKPEPKPQPHPDYHPVPPTPTYGSGGGGGGGGYHGHH

SEQ ID NO: 23156 - protein, 209 aa, Pseudoroegneria spicata
MAAPTRALVLAVLLAIAVANAEAGSVVVGLAKCADCTRKNMKAEEAFKGLQVAIKCKNVHGDYESKAVGALDGTGAFSVPLAADLHGADCVAQLHSAASNAPCSGQEPSKIVPVSEGTTFGIVAGDNTATPSAASPECSSMTLCGPIKKHIIEHFHHKKPVPPKPEPKPQPHPDYGPVPKPQPHPNYHPVPPTPTYGGGGGGGGYHGHH

SEQ ID NO: 23157 - protein, 211 aa, Pseudoroegneria spicata
MAAPRALVLCVLLAIAVANAEAASVVVGLAKCADCTRKNIKAEEAFKALQVAIKCRNSAGEYESKAVGGLDGTGAFSVPLAADLHGADCVAQLHSAASNAPCPGQEPSKIVPVSEGTTFGVVAGDNIATPSAASPECASMTLCGPIKKHIIEHFHHKQPVPPKPEPKPQPHPDYGPVPKPEPKPQPHPDYHPVPPTPTYGGGGGGGYHGHH

SEQ ID NO: 23158 - protein, 211 aa, Secale cereale
MAAPRALALCVLLAIAVANAEAASVVVGMAKCADCTRKNMKAEEAFKALQVAIKCKNSAGEYESKAVGGLDGTGAFSVPLASDLHGADCVAQLHSAASNAPCPGQEPSKIVPASEGTTFGVVAGDNIATPSTASPECASMTLCGPIKKHIMEHFHHKKPVPPKPEPKPQPHPDYGPVPKPEPKPQPHPDYHPVPPTPTYGGGGGGGYHGHH

SEQ ID NO: 23159 - protein, 211 aa, Secale cereale
MAAPRALALCVLLAIAVANAEAASVVVGMAKCADCTRKNMKAEQAFKALQVAIKCKNSAGEYESKAVGGLDGTGAFSVPLASDLHGADCVAQLHSAASNVPCPGQEPSKIVPVSEGTTFGVVAGDNIATPYAASPECASMTLCGPIKKHIMEHFHHKKPVPPKPEPKPQPHPDYGPVPKPEPKPQPHPDYHPVPPTPTYGGGGGGGYHGHH

SEQ ID NO: 23160 - protein, 212 aa, Triticum aestivum
MAAPTRALVLGVLLAIAVANAEAASVVVGLVKCADCTRKNMKAEEAFKGLQVAVECKNVHGDYESKAVGALDRTGAFSVPLTADLHGTNCVAQLHSAASNAPCPGQEPSKIVPVSEGTTFGIVAGDSIATPSAASRECTSMTLCGPIKKHIIEHFHHKKPVPPKPEPKPQPHPDYGPVPKPEPKPQPHPDYHPVPPTRTYGGGGGGGYHGHH

SEQ ID NO: 23161 - protein, 212 aa, Secale cereale
MAAATRALVLAVLLTIAVANAEAAPVVVGLAKCADCTRKNMKAEEAFKGLQVAIKCKNSAGDYESKAVGGLDGTGAFSVPLAADLHGADCVAQLHSAASNMPCPGQEPSKIMPVSEGTTYGIVAGENRATPSAASPECASMTLCGPIKKHIIEHFHHKKPVPPKPETKPQPHPDYGPVPKPEPKPQPHPDYHPVPPTPTYGGGGGGGYHGHH

SEQ ID NO: 23162 - protein, 210 aa, Pseudoroegneria spicata
MAAPRALVLAVLLAVAVANAEAASVVVGLANCADCARKNMKAEEAFKGLQVAVKCKNVHGDYESKGVGGLDGTGAFSVPLAADLHGADCVAQLHSAASNAPCPGQEPSKIVPVSEGTTFGIVAGDNIATPSASSPECASMTLCGPIKKHIIEHFHHKKPVPPKPEPKPQPHPDYGPVPKPEPKPQPHPDYHPVPPTPTYGGGGGGYHGHH

SEQ ID NO: 23163 - protein, 211 aa, Secale cereale
MAAPRALALCVLLAIAVANAEAASVVVGMAKCADCTRKNMKAEESFKALQVAIKCKNSAGEYESKAVGGLDGTGAFSVPLASDLHGADCVAQLHSAASNAPCPGQEPSKIVPASEGTTFGVVAGDNIATPSAASPECASMTLCGPIKKHIMEHFHHKKPVPPKPEPKPQPHPDYGPVPKPEPKPQPHPDYHPVPPTPTYGGGGGGGYHGHH

SEQ ID NO: 23164 - protein, 208 aa, Triticum aestivum
MAAPRALVLAVMLAVAVANAEAASVVVGLACADCTRKNIKTEKAFKGLHVAIKCKNVDGEYESKAVGALDGSGAFSVPLAADLHGADCVAQLHNAASNAPCSGQEPSKIVPVSEGTTFGVIAGAKTNALASPECASTTLCGPIKKHIIEHFHHKKPVPPKPEPKPQRHPDYHPVPKPEPKPHPHPDYHPVPPTPTYGGGGGGGYHGHH

SEQ ID NO: 23165 - protein, 215 aa, Hordeum vulgare
MAAPTRALVLAVLLAMAVANAEAASVVVGLAKCADCTRKNMKAEEAFKGLQVAIKCKNVHGEYESKAVGGLDGTGAFSVPLASDLHGADCVAQLHSAASNAPCAGQEPSKIMPMSEGTTFGIVAGDHTATPSAASPECASMTLCGPIKKHIMEHFHHKKPVPPKPEPKPEPHPDYGPVPKPEPKPQPHPDYHPVPPTPTYGSGGGGGGGGYHGHH

SEQ ID NO: 23166 - protein, 213 aa, Triticum aestivum
MAAPTRGLVLAVLLAIAVANAEAASVVVGLAKCTDCTRKNMKAEEAFKGLEVAIKCKNVHGDYESKAVGAIDGTGAFSVPLASDLHGADCVAQLHSAASNVPCAGQEPSKIVPVSESTTFGIIAGDNTATLSEASPECASMKLCGPIKKHIIEHFHHKKPVPPKPEPKPQPHPDHGPVPKPEPKPQPHPDYHPVPPTPTYGGSGGGGGYHGHH

SEQ ID NO: 23167 - protein, 211 aa, Triticum aestivum
MAAPRALVLAVLLVIAIANAEATSVVIGLAKCADCTRKNMKAEEAFKGLQVAIKCKNVDGEYESKAVGSLDGTGAFSVPLASDLHGADCVAQLHSAASNASCPGQEPSKIVPVSEGTTFGVIAGANTATPSVASPECASMTLCGPIKKHIIEHFHHKKPVPPKPEPKPQPHPEYHPVPKPEPKPQPHPDYHPVPPMPTYGGGGGGGYHGHH

SEQ ID NO: 23168 - protein, 207 aa, Triticum aestivum
RALVLGVLLAITVANAEAASVVVGLAKCADCTRKNIKAEEAFKGLQVAIKCKNNAGDYESKAVGALDGTGAFSVPLAADLHGADCVAQLHSAASNAPCPGQEPSKIVPVSEGTTFGIVAGNNIATPSAASSPECASMTLCGPIKKHIIEHFHHKKPVPPKPEPKPEPHPDYGPVPKPEPKPQPHPDYHPVPPTPTYGGGGGGYHGHH

SEQ ID NO: 23169 - protein, 208 aa, Triticum aestivum
MVAPRALVLAVLLAIAVANAEAASVVVGLAKCADCTRKNLKAEEAFKGLQVAIKCKNVHGEYESKAVGGLDGTGAFSVPLAADLHDADCVAQLHSAASNAPCSGQEPSKIVPASEGTTFGIVAGDSIATRSAASPECASMTLCGPIKKHIIEHFHHKQPVPPKPEPKPQPHPDYHPVPKPQPHPDYHPVPPTPTYGGGGGGGGYHGHH

SEQ ID NO: 23170 - protein, 211 aa, Leymus cinereus x Leymus triticoides
MAAPRALVLCVLLAIAVANAEAASVVVGLAKCADCTSKNIKAEEAFKALQVAIKCKNSAGEYESKAMGGLDGTGAFSVPLAADLHGADCIAQLHSAASNAPCPGQVPSKIVPLSEGTTYGIVAGDNTATPSAASPECASVTLCGPIKKHIIEHFHHKKPVPPKPEPKPQPHPDYGPVPKPEPKPQPHPDYHPVPPTPTYGGGGGGGYHGHH

SEQ ID NO: 23171 - protein, 210 aa, Triticum aestivum
MAAPRAVVLCVLLAVAVANAEAASVIVGLAKCADCTRKSMKSEEAFKALQVAIKCKNSAGEYESKAVGALNGTGAFSVPLAADLHGADCVAQLHSASSNAPCPGQEPSKIVPVSEGSTYGVVAGENTATSSAASPECASMTLCGPIKKHIIEHFHHKKPVPPKPEPKPQPHPDYGPVPKPEPKQPHPDYHPVPPTPTYGGGGGGGYHGHH

SEQ ID NO: 23172 - protein, 208 aa, Triticum aestivum
PRALVLAVLLALAFANAEAASVVVGLAKCADCTRKNLKAEEAFKGLQVAIKCKNVQGEYESKAVGALDGTGAFSVPLAADLHGADCVAQLHSTASNAPCSGQEPSKIVPVFEGTTFGIVAGDSIATPSAASPECASMTLCGPIKKHIIKHFHHKQPVPPKPEPKPQPHPDYHPVPKPEPKPQPHPDYHPVPPTPTYGGGGGGGYHGHH

SEQ ID NO: 23173 - protein, 212 aa, Triticum aestivum
MAAPRALVLCVLLAIAVAHAEAASVVVGLAKCADCTRKNMKAGEAFKAVQVVIKCKNSAGEYESKAVGGLDGTGAFSVPLVADLHGADCVAQLHSAASNAPCPGQEPSKIVPLSEGTTFGFVAGENTARPSAASLECASMTLCGPIKKHIIEHFHHKKPVPPKPELKPQPHPDYGPMPKPEPKPQPHPDYHPVPPTPTYGSGGGGGGYHGHH

SEQ ID NO: 23174 - protein, 193 aa, Secale cereale
NAEAGSVVVGLAKCADCTRKNLKAEEAFKGLQVAIKCKNVHGDYESKAVGALDGTGAFSVPLASDLHGADCVAQLHSAASNAPCSGQEPSKIVPVSEGTTFGIVAGDHTATPSAASPECASMTLCGPIKKHIMEHFHHKKPVPPKPEPKPQPHPDYGPVPKPEPKPQPHPDYHPVPPTPTYGGGGGGGYHGHH

SEQ ID NO: 23175 - protein, 196 aa, Secale cereale
RALVLAVLLTIAVANAEAASVVVGLAKCADCTRKNMKAEEAFKGLQVAIKCKNSAGDYESKAVGGLDGTGAFSVPLAADLHGADCVAQLHSAASNMPCPGQEPSKIVPVSEGTTYGIVAGENRATPSAASPECASMTLCGPIKKHIIEHFHHKKPVPPKPEPKPQPHPDYRPVPKPEPKPQPHPDYHPVPPTPTYA

SEQ ID NO: 23176 - protein, 776 aa, Sorghum bicolor
MDTPDRAAAPSAASRAEDSPVFSFLNNLSPIEPLKSAYNTNSLQGFQSINITSISSIFTSPHDNVNKEPRLPKSSLGDISENEVCADGADTNKPSKSSNAVRLFACTSTVTRETHSVTCSGVVDPPTGPCDLAQPGQFDNGSPDHNTTPCHGVRSDLKLDKTRKLEAAQTVKNTLEKRKCLFSTDIQLLDGSSEPVNDNDQVLGCEWSDLISTTSAELLAFDSTMDEHHRGVHLAAKNAESCGYLLSKLTGDGDVSDRAHPSASGQVYYQELVMGEDQTENAEIFQDGQETISTEEIQDNICEANGCLPLEYKVEGQQQRGVRRRCLVFEASGFSNSVVKKGTVENLSVSTCKGKSPVQTQPRGLRGIGLHLNALALTPKGKMACQDPTASALLPSSASEKDVHGRLLSAGENFTHSGGELLEFPVDDCSAGGFPVNDHVSGQSVSPQKKRRKTDNGDDGEACKRCSCKKSKCLKLYCECFAAGVYCSEPCSCQGCLNKPIHEEIVLSTRKQIEFRNPLAFAPKVIRMSDAGLETGEDPNNTPASARHKRGCNCKKSSCLKKYCECYQGGVGCSTNCRCESCKNTFGRRDAESELTEEMKQESEQTENCSQEKENGQQKANVQSEDHPLLDLVPITPPFDLSSSLLKLPNFSSAKPPRPSKPRSVNSRSSASKATATVQPCKSSKIAVSGIDEEMPDILKEPNSPSNCVKTTSPNGKRVSPPHNALSISPNRKGGRKLILKSIPSFPSLAGDTISGSAMNNTDSTFSVSPLTLGPS

SEQ ID NO: 23177 - protein, 776 aa, Panicum virgatum
GTGRNLAPCWFVLDAHNPDSPVFSFINNLSPIEPLKSAYNANSLQGYQSINITSISSIFTSPHDNAHKETRLAKSSLGEISESEACADGSKTNKPAKSSNAVRLFACASTVTRETRTVTCSDAADPPTGPCDLAHPVRFDNGSPDHNTTPCHGVKSDLKQDKCRKLDVVQTVKNTVEKRKCLFSTEIQLLDGGQPVNGSDDVLGCQWSDLVSTTSGELLAFDSTMDDHHRGMHLAAKNAESCGYLLSKLTGGGEISDRAHPSASGQVYYQELVMGEDQTENPQIFQDGQQTISTEEIQDNIYEENGCIPLDYKVESQQRGIRRRCLVFEAAGFSNTVVQKETVESLSVSTCKGKSHVQTQPRGLRGIGLHLNALALTPKGKMANQDPMASGLHPSSGSEKDAHGKFLSAGENFPNSGGDLLEFPMDDCSAGSFPVNDHVSSQSVSPQKKRRKTDNNGDDGEACKRCSCKKSKCLKLYCECFAAGVYCSEPCSCQGCLNKPIHEEIVLSTRKQIEFRNPLAFAPKVIRMSDAGPETGEDPNSTPASARHKRGCNCKKSSCLKKYCECYQGGVGCSSNCRCESCKNTFGRRDADTELTEELKQEGEQTENCGKEKENDQQKANVQNGDHPLLELVPITPPFDLSSSLLKLPNFSSAKPPRPSKARSGNSRSSASKATATLQSSKSSKVAGSVIDEEMPDILKEADSPNNCVKSTSPNGKRVSPPHNALSISPNRKGGRKLILKSIPSFPSLMGESNSGSTMNDTDNTFSTSPLVLGPS

SEQ ID NO: 23178 - protein, 336 aa, Sorghum bicolor
MSFFFRAATRQRPSPQEIARSIKDSLVALDTKTGAKALEDAEKNILTLRHTLAGDGEVEPNQEQVLQVALEICKEGVLSLFVQNLPSLGWEARKDLVHCWCILLRQKVDEGYCCVQYIENHFDLLDFLVVCYKNLEVALNCGNMLRECIKYPTLAKYILESSSFELFFQYVELPNFDIASDALNTFKDLLTKHEDQVSEFLSSHYEQFFGLYTKLLSSTNYVTRRQSVKFLSEFLLEAPNAQIMKRYILEVRYLNIMMGLLKDSSKNIRICSFHIFKVFVANPNKPREIIQVLVDNHRELLKLLHNLPTSKGEDEQLDEERDLIIKEIEKLVRLSV

SEQ ID NO: 23179 - protein, 336 aa, Pennisetum glaucum
MSFFFRGGSRQRPTPQEIVRSIKDSLVALDTKTGAKALEDAEKNILTLRHTLSGDGEVEPNQEQVLQIALEICKEGVLSLFVQNLPSLGWEGRKDLVHCWCILLRQKVDESYCCVQYIENHVDLLDFLVVCYKNLEVALNCGNMLRECIKYPTLAKYILESSSFELFFQYVELPNFDIASDALNTFKDLLTKHEDAVSEYLSSHYEQFFGLYTRLLSSTNYVTRRQSVKFLSEFLLEAPNAQIMKRYILDVHYLNIMIGLLKDSSKNIRICAFHIFKVFVANPNKPREIFRVLVDNHRELLKLLHNLPTSKGEDEQLDEERDLIIKEIEKLVRLSV

SEQ ID NO: 23180 - protein, 336 aa, Setaria italica
MSFFFRGGSRQRPTPQEIVRSIKDSLVALDTKTGAKALEDAEKNILTLRHALSGDGEVEPNQEQVLQIALEICKEGVLSLFVQNLPSLGWEGRKDLVHCWCILLRQKVDESYCCVQYIENHVDLLDFLVVCYKNLEIALNCGNMLRECIKYPTLAKYILESSSFELFFQYVELPNFDIASDALNTFKDLLTKHEDAVSEFLSSHYEQFFGLYTRLLSSTNYVTRRQSVKFLSEFLLEAPNAQIMKRYILDVHYLNIMIGLLKDSSKNIRICAFHIFKVFVANPNKPREIVRVLVDNHRELLKLLHNLPTSKGEDEQLDEERDLIIKQIEKLVRLSV

SEQ ID NO: 23181 - protein, 336 aa, Panicum virgatum
MSFLFRGGSRQRSSPQEIVRSIKDSLVALDTKTGAKALDDAEKNILTLRHMLSGDGEVEPNQEQVLQIAIEICKEGVLSLFVQNLPSLGWEGRKDLVHCWSILLRQKVDESYCCVQYIENHVDLLDFLVVCYKNLEIALNCGNMLRECIKYPTLAKYILESSSFELFFQYVELPNFDIASDALNTFKDLLTKHEDAVSEFVSSHYEQFFGLYTRLLSSTNYVTRRQSVKFLSEFLLEAPNAQIMKRYILDVHYLNIMIGLLKDSSKNIRICAFHIFKVFVANPNKPREIVQVLVDNHREVLKLLHNLPTSKGEDEQLDEERDLIIKEIEKLVRLSV

SEQ ID NO: 23182 - protein, 336 aa, Echinochloa colona
MSFFFRGGSRQRPSPQDIVRSIKDSLVALDTKTGAKALEDAEKNILTLKHTLSGDGEVEPNQEQVLQIALEICKEGVLSLFVQNLPSLGWEGRKDLVHCWCILLRQKVDENYCCVQYIENHVDLLDFLVVCYKNLEVALNCGNMLRECIKYPTLAKYILESSSFELFFQYVELPNFDIASDALNTFKDLLTKHEDAVSEFLSAHYEQFFGLYTRLLSSTNYVTRRQSVKFLSEFLLETPNAQIMKRYILDVHYLNIMIGLLKDSSKNIRICAFHIFKVFAANPNKPHEIVQVLVDNHRELLKLLHNLPTSKGEDEQLDEERDFVIKEIEKLVRLSA

SEQ ID NO: 23183 - protein, 337 aa, Oryza sativa
MSFFFRAASRPARPSPQELVRSIKESLLALDTRTGAKALEDVEKNVSTLRQTLSGDGEVEPNQEQVLQIALEICKEDVLSLFVQNMPSLGWEGRKDLAHCWSILLRQKVDEAYCCVQYIENHFDLLDFLVVCYKNLEVALNCGNMLRECIKYPTLAKYILESSSFELFFQYVELSNFDIASDALNTFKDLLTKHEAAVSEFLCSHYEQFFELYTRLLTSTNYVTRRQSVKFLSEFLLEAPNAQIMKRYIVEVSYLNIMIGLLKDTSKNIRICAFHIFKVFVANPNKPRDIIQVLVDNHRELLKLLGNLPTSKGEDEQLEEERDLIIKEIEKLVHSSV

SEQ ID NO: 23184 - protein, 336 aa, Hordeum vulgare
MSFFFRAASRPRSSQQDLVRSIKDSLLALDTKTGAKALEDVEKNIFTLRQTLSGDGEVEPNQDHVLQIALEICKEGVLSLFVQNLPSLGWEGRKDLAHCWCILLRQKVDESHCCVQYIENHVDLLDFLVVCYKNLEVALNCGNMLRECIKYPSLAKYILESNSFELFFQYVELPNFDIASDALNTFKDLLTKHEDAVSEFLISHYEQFFELYKRLLTSDNYVTRRQSVKFLSEFLLEAPNAQIMKRYILEVRYLNIMMGLLKDSSKNIRICSFHIFKVFVANPNKPRDIIQVLVDNHKELLKLLHALPASKGEDDQLDEERDLIIKEIEKLVRLSV

SEQ ID NO: 23185 - protein, 336 aa, Secale cereale
MSFFFRAASRPRSSQQDLVRSIKDSLLALDTKTGAKALEDVEKNISTLRQTLSGDGEVEPNQDHVLQIALEICKEGVLSLFVQNLPSLGWEGRKDLAHCWCILLRQKVDESHCCVQYIENHVDLLDFLVVCYKNLEVALNCGNMLRECIKYPSLAKYILESNSFELFFQYVELPNFDIASDALNTFKDLLTKHEDAVSEFLISHYEQFFELYKRLLTSDNYVTRRQSVKFLSEFLLEAPNAQIMKRYILEVRYLNIMMGLLKDSSKNIRICSFHIFKVFVANPNKPRDIIQVLVDNHKELLNLLHALPASKGEDEQLDEERDLIVKEIEKLVRLSV

SEQ ID NO: 23186 - protein, 336 aa, Triticum aestivum
MSFFFRAASRPRSSQQDLVRSIKDSLLALDTKTGAKALEDVEKNIFTLRQTLSGDGEVEPNQDHVLQIALEICKEGVLSLFVQNLPSLGWEGRKDLAHCWCILLRQKVDESHCCVQYIENHVDLLDFLVVCYKNLEVALNCGNMLRECIKYPSLAKYILESNSFELFFQYVELPNFDIASDALNTFKDLLTRHEDAVSEFLISHYEQFFELYKRLLTSDNYVTRRQSVKFLSEFLLEAPNAQIMKRYILEVRYLNIMMGLLKDSSKNIRICSFHIFKVFVANPNKPRDIIQVLVDNHKELLKLLHALPASKGEDEQLDEERDLIVKEIEKLVRLSV

SEQ ID NO: 23187 - protein, 336 aa, Brachypodium distachyon
MSFFFRAASRPRSSQNELVRSIKDSLLALDTKTGAKALEDVEKNIFTLRQTLSGDGEVEPNQEQVLQIALEICKEGVLSLFVQNLPSLGWEGRKDLVHCWGVLLRQKVDESHCCVQYIENHVDLLDFLVVCYKNLEVALNCGNMLRECIKYPALAKYILKSSSFELFFQYVELPNFDIASDALNTFKDLLTRHEDAVSEFLSSHYEQFFELYTRILTSNNYVTRRQSVKFLSEFLLEAPNAQIMKRYILEVRYLNIMIGLLKDSSKNIRICAFHIFKVFVANPNKPRDIIQVLVDNHRELLKLLTDLPAGKGEDDQLDEERDLIIKEIQKLVRSSV

SEQ ID NO: 23188 - protein, 324 aa, Leymus cinereus x Leymus triticoides
SSQQDLVRSIKDSLLALDTKTGAKALEDVEKNIFTLRQTLSGDGEVEPNQDHVLQIALEICKEGVLSLFVQNLPSLGWEGRKDLAHCWCILLRQKVDESYCCVQYIENHVDLLDFLVVCYKNLEVALNCGNMLRECIKYPSLAKYILESNSFELFFQYVELPNFDIASDALNTFKDLLTKHEDAVSEFLISHYEQFFELYKRLLTSDNYVTRRQSVKFLSEFLLEAPNAQIMKRYILEVRYLNIMMGLLKDSSKNIRICSFHIFKVFVANPNKPRDIIQVLVDNHKELLKLLHALPASKGEDEQLDEERDLIIKEIEKLVRLSV

SEQ ID NO: 23189 - protein, 336 aa, Oryza sativa
MSFFFRMASRLRPSTPEEVVRSIKDSFQALHTKNGARALEEVEKNLSSLRQMLSGDGEAEPNQEQVLQITLEICKEDVLSLFVQNLPSLGWGVRKDLVHCWCILLRQKFDESYCCVKYIENHLELLDFLVGCYKNLDVALNCGNMLRECIKYPTLTKYILDSSSFELFFEYVELPNFDIASDALNTFKDLLTKHETVVAEFLSSHYEQFFELYTRLLTSPNYVTRRQSVKFLSEFLLEAPNARIMKRYITEVRFLNIMITLLKDSSKNIRICAFHVFKVFVANPNKPRSIIEALIENRRELLKLLQNLPTSKGEDELDEERNLIIQGIQKLACSSA

SEQ ID NO: 23190 - protein, 903 aa, Sorghum bicolor
MHLSLWKPLSHCAAVLLAKNHRRRGGGGGGHGGGSNGHRDDPASFLRQLRDALDAASEDGSLCPPPDTAGADADAAVSRSRSLARLRAQRDFLRATALAAAAGPFRSLSDLPLLPHAIATFLAMYPDYASTADVDRLRVDHYSHLDAPGAGRVCLDYCGFGLFDSSWDSSSSSFTLHELNANLSNHALYGGAEPGTVENDIKERILEYLNVPASEYALVFTVSRGSAFRLLAECYPFETNRRLLTMFDHESQSVNWMAQSARAKGAKTRTAWFRWPTLKLCSTELRKEIVGKKKGRRRDAAVGLFVFPAQSRVTGAKYSYQWMALAQQNGWHVMLDAGALGPKDMDSLGLSLFRPDFIITSFYRVFGADPTGFGCLLIKKSVIGTLQGRNGCNASGMVRIVPVFPQYLSDSVDGFDAFDGLEDDAGINKDEKPSSNAQNGSQLPAFSGVYTSAQVRETFESDPGRDSSSDRDGASTIFEETESVSMGEVMRSPAFSEDCSSENSFWVDVGQSPLGSEKSGQFKKGKLGSPLPSSWFNGRKCNKRMSPNLTSRISRSPLYDGHVISFDAAVLSVSQDADCLKEDPEEDNFENGRRTHFRQVSEIQEEPEVEEVACQRAMNGNAEHKESAIRRETEGEFRLLGGRDGNSRFTGGRLFGVEEIDGGLSMGRRVSFSAEANIIADRLTRASDAAEASGYTFRDDDGCASDGYDDAQDWGRREPEIICRHIDHVDMMGLNRTTLRLRYLINWLVTSLLQLKLPDSKGGDGVPLVHIYGPKIKYERGAAVAFNVKQSDGTFINAEVVQKIAEKNGISVGIGFLSHIKVDMNQKQLNGTLDIPEASFYKNGRRDNKKVTIRVEVVTASLGFLTNFEDVYNMWAFVAKFLDPSFLESERLTIAADHSEGQN

SEQ ID NO: 23191 - protein, 904 aa, Setaria italica
MHLSLWKPLSHCAAVLLAKNHRRRGGGGGWHGGHGNNGHRDDPSSFLRQLRDALDAASEDGSLCPPPDAAGADADAAVSRSRSLARLRAQRDFLRATALAAAAGPFRSISDLPLLAHAIATFLAMYPDYASTADVDRLRVDHYSHLDAPGAGRVCLDYCGFGLFDSSWDSSSSSFTLHELNANLSNHALYGGAEPGTVENDIKERILEYLNVPASEYALVFTVSRGSAFRLLAECYPFESNRRLLTMFDHESQSVNWMAQSARAKGAKTRAAWFRWPTLKLCSTELRKEIVGKKKGRRRDAAVGLFVFPAQSRVTGAKYSYQWMALAQQNGWHVMLDAGALGPKDMDSLGLSLFRPDFIITSFYRVFGSDPTGFGCLLIKKSVIGSLQGRNGCNASGMVRIVPVFPQYLSDSVDGFDAFDGLEDDSGINKDEKPASNAQNGSQLPAFSGVYTSAQVRETFESDPGRDSSSDRDGASTIFEETESISMGEVMRSPAFSEDCSSENSFWVDVGQSPLGSEKSGQFKKGKLGSPLPSSWFNGRKCNKRMSPNLTSRISRSPLYDGHVISFDAAVLSVSQDTDCLKEDPEEEIFENGRRNHFRQVSEIQEEPEVEEVACQHAMNGGAEHKESAIRRETEGEFRLLGGRDGNSRFTGGRLFGVEEIDGGLSMGRRVSFSTEANIIADRLNRASDAAEASGYTFRDDEGCASDGYDDAQDWGRREPEIICRHIDHVDMMGLNRTTLRLRYLINWLVTSLLQLKLPDSKGGDGVPLVHIYGPKIKYERGAAVAFNVKQSDGTFVNAEVVQKIAEKNGISVGIGFLSHIKLDMNQKQLNGTLDIPEASFYKNGRRDNKKVTVRVEVVTASLGFLTNFEDVYKMWAFVAKFLDPSFLESERLTISADHLEGQT

SEQ ID NO: 23192 - protein, 898 aa, Zea mays
MHLSLWKPLSHCAAVLLAKNHRRRGGGGGSNGRRDDSSAFLRQLRDALDAASEDGSLCPPPDAGGADADAAVSRSRSLARLRAQRDFLRATALATAAGPFRSLSDLPLLPHAIATFLAMYPDYASTADVDRLRVDHYSHLDAPGAGRVCLDYCGFGLFDSGWDSSSSSFTLHELNANLSNHALYGGAEPGTVENDIKERILEYLNVPASEYALVFTVSRGSAFRLLAECYPFETNRRLLTMFDHESQSVNWMAQSARAKGAKTRTAWFRWPTLKLCSTELRKEIVGKKKGRRRDAAVGLFVFPAQSRVTGAKYSYQWMALAQQNGWHVMLDAGALGPKDMDSLGLSLFRPDFIITSFYRVFGADPTGFGCLLIKKSVIGTLQGRNGCNASGMVRIVPVFPQYLSDSVDGFDAFDGFEDDPGVDKDEKPSSNAQNGSQLPAFSGVYTSAQVRETFESDPGRDSSSDRDGASTIFEETESVSMGEIMRSPAFSEDCSSENSFWVDVGHSPLGSEKSGQFKKGKLGSPLPSSWFNGRKCNKRMSPNLSSRISRSPLYDGHVISFDAAVLSVSQDADCLKEDPEEENFENGRRAHFRQVSEIQEEPEAEEVACQRAMNGGAEHKESAIRRETEGEFRLLGGRDGNNRFTGGRLFGVEEIDGGLSMGRRVSFSTEANIIADRLNRASDAAEASGYTFPGDDGCASDGYDDAQDWGRREPEIICRHIDHVDMMGLNRTTLRLRYLINWLVTSLLQLKLSDSKGGDGVPLVHIYGPKIKYERGAAVAFNVKQNDGTFVNAEVVQKIAEKNGISVGIGFLSHIKVDMKQKQLNGTLDIPEASFYKNGRRDNKKVTIRVEVVTASLGFLTNFEDVYKMWAFVAKFLDPSFLESERLTIAADHSEGQT

SEQ ID NO: 23193 - protein, 904 aa, Panicum virgatum
MHLSLWKPLSHCAAVLLAKNHRRRGGGGGGHGGPGSNGHRDDPSSFLRQLRDTLDAASEDGSLYPLPDAAGADADAAVSRSRSLARLRAQRDFLRATALAAAAGPFRSLSDLPLLSHAIATFLAMYPDYASTADVDRLRVDHYSHLDAPGAGRVCLDYCGFGLFDSSWDSSSSSFTLHGLNANLSNHALYGGAEPGTVENDIKERILEYLNVPASEYALVFTVSRGSAFRLLAECYPFETNRRLLTMFDHESQSVNWMAQSARAKGAKTRTAWFRWPTLKLCSTELRKEIVGKKKGRRRDAAVGLFVFPVQSRVTGAKYSYQWMALAQQNGWHVMLDAGALGPKDMDSLGLSLFRPDFIITSFYRVFGADPTGFGCLLIKKSVIGSLQGRNGCNASGMVRIVPVFPQYLSDSVDGFDAFDELEDDSGINKDEKTASNAQNGSHLPAFSGVYTSAQVRETFENDPGHDSSSDRDGASTIFEETESISMGEVMRSPAFSEDCSSENSFWVDVGQSPLGSEKSGQFKKGKLGSPLPSSWFSGRKCNKRMSPNLTSRISRSPLYDGNVISFDAVVLSVSQDADCLKEDPEEEFFENSRRTHFRQVSEIQEEPDVEDVACQHGMNGGAEHKESAIRRETEGEFRLLGGRDGNNRFTGGRLFGVENIGGDLSMGRRVSFSTEANIIADRMNRALDAAEASGYTFRDDDGYATDGCDDAQDWGRREPEIICRHIDHVDMMGLNRITLRLRYLINWLVTSLLQLKLPDSKGGDGLPLVHIYGPKIKYERGAAVAFNVKQSDGAFVNAEVVQKIAERNGISVGIGFLSHIKLDMNQKQLNGVLDIPEASFYKNGRRDNKKVTVRVEVVTASLGFLTNFEDVYKMWAFVAKFLDPSFLESELLTISADHSEGQT

SEQ ID NO: 23194 - protein, 904 aa, Panicum virgatum
MHLSLWKPLSHCAAILLAKNHRRRGGGSGRHGGHGSNGHRDDPSSFLRQLRDTLDAASEDGFLHPLPDSAGADADAAVSRSRSLARLRAQQDFLRATALAAAAGPFRSLSDLPLLSHAIATFLAMYPDYPSTADVDRLRVDHYSHLDAPGAGKVCLDYCGFGLFDSSWDSSSSSFTLHGLNANLSNHALYGGAEPGTVENDIKERILEYLNVPASEYALVFTVSRGSAFRLLAECYPFETNRRLLTMFDHESQSVNWMAQSARAKGAKTPTAWFRWPTLKLCSTELRKEIVGKKKGRRRDAAVGLFVFPAQSRVTGAKYSYQWMALAQQNGWHVMLDAGALGPKDMDSLGLSLFRPDFIITSFYRVFGADPTGFGCLLIKKSVIGSLQGRNGCNASAMVRIVPVFPQYLSDSVDGFDAFDELEDDSGINRDEKPASNAQNGLQLPAFSGVYTSAQVRETFENDPGRDSSSDRDGASTIFEETESISMGEVMRSPAFSEDCSSENSFWVDVGQSPLGSEKSGQFNKGKLGSPLPSSWFNGRKCNKRMSPNLTSRISRSPLYDGNVISFDAVVLSVSQDADCLKEDPEEEFFENGRRTHFRQVSEIQEEPDVEEVACQHGMNGGAEHKESAIRRETEGEFRLLGGRDGNNRFTGGRLFGVEDIGGGLSMGCRVSFSTEANIIADRMNRASDAAEASGYTFRDDDGCATDGYDDAQDWGRREPEIICRHIDHVDMMGLNRTTLRLRYLINWLVTSLLQLKLPDSKGGDELPLVHIYGPKIKYERGAAVAFNVKQSDGTFVNAEVVQKIAEKNGISVGIGFLSHIKLDMNQKQLNGMLDIPEASFYKNGRRDNKKVTVRVEVVTASLGFLTNFEDVYKMWAFVAKFLDPSFLESELLTISADHSEGQT

SEQ ID NO: 23195 - protein, 911 aa, Brachypodium distachyon
MHLSLWKPLSHCAAILLAKNHRRRGGGGGGGGGGGGHGSNGRRDDPSSFLRQLRDALDAASEEGSLCPPPDAQAGADADAAVTRSRSLARLRAQRDFLRATALAAAAGPFRSPSDLPLLAHAIATFLSMYPEYASTSDVDRLRLDHYSHLDAPGAGRVCLDYCGFGLFDSSWDSSSSCFTLSELNANLSNHALYGGAEPGTAENDIKERILEYLNVPASEYALVFTVSRGSAFKLLAECYPFESNRRLLTMFDHESQSVNWMAQSARAKGAKTRTALFRWPTLKLCSTELRKEIVGKRKGRRRDAAAGLFVFPAQSRVTGAKYSYQWMALAQQNGWHVMLDAGALGPKDMDSLGLSLFRPDFIITSFYRVFGADPTGFGCLLIKKSVIGILQGRNGCNASGMVKIVPVFPQYLSDSIDEFDALEADGLEDDSGAPKDENPVSDVRNGSQLPAFSGVYTSAQVRETFDCDPGRDSSSDRDGASTIFEETESLSVGEVMRSPAFSEDCSSENSFWVDVGQSPLGSEKSGQFKKGKLGSPLPSSWFTGRKNNKRMSPNLASRISRSPLYDGNVISFDAAVLSVSQDVDCLREDPDEEILENGRRNHFRQVSEIQEEPEVEEVACRHAMNGGVDHKESAIRRETEGEFRLLGGRDGNSRFTGGRLFGVEEIDGGISMGRRVSFNTEANMIADRLHRASDAAEASGYPFRDDDGCISDAYDDDAQDWSRREPEIVCRHIDHVDMMGLNRTTLRLRYLINWLVTSLLQLRLPGSKDVDGVPLVHIYGPKIKYERGAAVAFNLKQSDGTFINAEVVQKIAEKNCISLGIGFLSHIKIDPNQKQSNGALDIPEATLYKNGRRDSKKVTLRVEVVTASLGFLTNFEDVYKMWAFVAKFLDPSFLESERLAIATDHSEGQI

SEQ ID NO: 23196 - protein, 1171 aa, Panicum virgatum
MASNGGGGLRHSNSSRLSRMSYSGEDGRGAQAPAADRPMVTFARRTHSGRYVSYSRDDLDSELGGDFSPDHQEFHSYHVHIPATPDNQPMDPAISARVEEQYVSNSLFTGGFNSVTRAHLMDKVIESEASHPQMAGAKGSSCAINGCDAKVMSDERGEDILPCECDFKICAECFGDAVKNGGAVCPGCKEPYKNTELEDVVGGAAGARATLSLPPPPGAGGTAASRMERRLSIMRSQKAMTRSQTGDWDHNRWLFETKGTYGYGNAIWPKENEVESGGGGGGGLGGADGQPAEFTTKPWRPLTRKLSIPAGILSPYRLLILIRMAVLGLFLAWRIKHKNEDAMWLWGMSVVCELWFGFSWLLDQLPKLCPVNRATDLAVLKDKFETPTPSNPTGRSDLPGLDIFVSTADPEKEPPLVTANTILSILAADYPVEKLSCYVSDDGGALLTFEAMAEAASFANMWVPFCRKHNIEPRNPESYFNLKRDPYKNKVRPDFVKDRRRVKREYDEFKVRINGLPDSIRRRSDAYHAREEIKAMKRQREAALDDAVEPVKIPKATWMADGTHWPGTWIQPSAEHTRGDHAGIIQVMLKPPSDDPLYGSPGEEDRPLDFTEVDIRLPMLVYVSREKRPGYDHNKKAGAMNALVRSSAVMSNGPFILNLDCDHYVYNSQAFREGMCFMMDRGGDRIGYVQFPQRFEGIDPSDRYANHNTVFFDVNMRALDGLMGPVYVGTGCLFRRVALYGFDPPRTKEHGGCCSCCFPQRRKVKTSAAAPEETRALRMADFDEDEMNMSSFPKKFGNSNFLINSIPIAEFQGRPLADHPGVKNGRPPGALTVPRDLLDASTVAEAISVISCWYEDKTEWGHRVGWIYGSVTEDVVTGYRMHNRGWKSVYCVTKRDAFRGTAPINLTDRLHQVLRWATGSVEIFFSRNNALLASRKMKVLQRIAYLNVGIYPFTSIFLIVYCFLPALSLFSGQFIVKQLNVTFLTYLLVITLTLCMLAVLEIKWSGISLEEWWRNEQFWLIGGTSAHLAAVLQGLLKVIAGIEISFTLTSKSGGDDVDDEFADLYTVKWTSLMIPPIVIMMVNLIAIAVGFSRTIYSEIPQWSKLLGGVFFSFWVLAHLYPFAKGLMGRRGRTPTIVFVWAGLLSITISLLWVAINPPSQNSQIGGSFTFP

SEQ ID NO: 23197 - protein, 1139 aa, Echinochloa colona
ADRPMVTFARRTHSGRYVSYSRDDLDSELGGSGDFSPDHEEFHSYHVHIPATPDNQPMDPAISARVEEQYVSNSLFTGGFNSVTRAHLMDKVIESEASHPQMAGAKGSSCAINGCDAKVMSDERGEDILPCECDFKICAECFGDAVKNGGGVCPGCKEPYKNTELEDVVSGAAGPRATLSLPPPPGAGGGAASRMERRLSIMRSQKAMTRSQTGDWDHNRWLFETKGTYGYGNAIWPKENEVESGGGGGGGLGGTDGQPAEFTTKPWRPLTRKLSIPAGILSPYRLLILIRMAVLGLFLTWRIKHKNEDAIWLWGMSVVCELWFGFSWLLDQLPKLCPVNRATDLAVLKDKFETPTPSNPTGRSDLPGLDIFVSTADPEKEPPLVTANTILSILAADYPVEKLSCYVSDDGGALLTFEAMAEAASFANMWVPFCRKHNIEPRNPESYFNLKKDPYKNKVRQDFVKDRRRVKREYDEFKVRINGLPDSIRRRSDAYHAREEIKAMKRQREAALDDAVEPVKIPKATWMADGTHWPGTWIQPSAEHTRGDHAGIIQVMLKPPSDDPLYGSTGEEGRPLDFTEVDIRLPMLVYVSREKRPGYDHNKKAGAMNALVRSSAVMSNGPFILNLDCDHYVYNSQAFREGMCFMMDRGGDRIGYVQFPQRFEGIDPSDRYANHNTVFFDVNMRALDGIMGPVYVGTGCLFRRVALYGFDPPRTKEHGGCCSCCFPQRRKIKASAAQPEETRALRMADFDEDEMNMSSFPKKFGNSNFLINSIPIAEFQGRPLADHPGVKNGRPPGALTVPRDLLDASTVAEAISVISCWYEDKTEWGHRVGWIYGSVTEDVVTGYRMHNRGWKSVYCVTKRDAFRGTAPINLTDRLHQVLRWATGSVEIFFSRNNALLASRKMKFLQRIAYLNVGIYPFTSIFLIVYCFLPALSLFSGQFIVKTLNVAFLTYLLVISLTLCMLAVLEIKWSGISLEEWWRNEQFWLIGGTSAHLAAVLQGLLKVIAGIEISFTLTSKSGGDDVDDEFADLYIVKWTSLMIPPIVIMMVNLIAIAVGFSRTIYSEIPQWSKLLGGVFFSFWVLAHLYPFAKGLMGRRGRTPTIVFVWAGLLSITISLLWVAINPPSQNSQIGGSFTFP

SEQ ID NO: 23198 - protein, 1150 aa, Musa acuminata
MDSNNVLRVSRSVRVASSSDQQQADGRPTNVPPTVTFARRTPSGRYVSYSRDDLDSDFGSGDFDKEYTNYHVHIPPTPDNQPMDPVISAKVEEQYVSNSLFTGGCNSVTRAHLMDKVIESEASHPQMAGAKGSSCAMPGCDSKVMSDERGVDILPCECDFKICAECFSDAVKVGGGICPGCKEPYKTIELEEVVSNAVAGRPLSLPAPHGMSKMERRLSIMRSQKMTRSQTSDWDHNRWLFETKGTYGYGNAIWPTENKVDGGDGGNAQPTELTNKPWRPLTRKLKIPAAVLSPYRLLIFVRMAVLALFLAWRIKHKNEDAVWLWGMSVVCELWFAFSWLLDQLPKLAPVNRAADLAVLKEKFETPTATNPSGKSDLPGVDVFVSTADPEKEPPLVTANTILSILAADYPVEKLACYVSDDGGALLTFEAMAEAASFANIWVPFCRKHGVEPRNPESYFNLKKDPYKNKVRPDFVKDRRRVKREYDEFKVRINGLPDSIRRRSDAYHAREEIKAMKRQREVAGDDLVESVKIPKATWMADGTHWPGTWMNPSSEHTRGDHAGIIQVMLKPPSHEPLFGNNEEGGPLDFTVVDIRLPMLVYVSREKRPGYDHNKKAGAMNALVRASAIMSNGPFILNLDCDHYVYNSQALREGMCFMMDRGGDRICYVQFPQRFEGIDPSDRYANNNTVFFDVNMRALDGLQGPVYVGTGCLFRRIALYGFDPPRSKERHGSCCSCCFPQKRKTHAAVASEETRALRMGDSDDDEMAISTFPKKFGNSTFLIDSIPIAELQGRPLADHPAVKNGRAPGLLTAPRDLLDASTVAEAISAISCWYEDKTEWGQRVGWIYGSVTEDVVTGYRMHNRGWKSVYCVTKPDAFRGTAPINLTDRLHQVLRWATGSVEIFFSRNNALLASPRMKILQRIAYLNVGIYPFTSIFLIVYCFLPALSLFTGQFIVQTLNVTFLTYLLIITLTLCMLAVLEIKWSGIELEEWWRNEQFWLIGGTSAHLAAVLQGLLKVIAGIEISFTLTSKSAGDDENDEFADLYIVKWTSLMIPPITIMMVNLIAIAVGFSRTIYSTIPQWSKLLGGVFFSFWVLAHLYPFAKGLMGRRGRTPTIVFVWSGLIAITISLLWVAINPPSGSNSQIGGSFTFP

SEQ ID NO: 23199 - protein, 1149 aa, Musa acuminata
MTSNNVLRASRSVRVASSSDSQQGDGRPPNAPVVTFARRTPSGRYVSYSRDDLDSDFGSRDFDKEYMNYHVHIPPTPDNQPMDTVISAKVEEQYVSNSLFTGGCNSVTRAHLMDKVIESVANHPQMAGAKGSSCAMPGCDSKVMSDERGVDILPCECDFKICAECFSDAVKVGGGICPGCKEPYKTTELEEVVNNAVAGQPLSLPAPHGVSKMERRLSIMRSQKMTRSQTGDWDHNRWLFETKGTYGYGNAIWPTEDRGEGGDGGNEQPTELMNKPWRPLTRKLKIPAAVLSPYRLLIVIRMAFLALFLAWRIKHKNEDAVWLWGMSVVCELWFAFSWLLDQLPKLCPVNRAADLAILREKFETPSANNPSGKSDLPGIDVFVSTADPEKEPPLVTANTILSILAADYPVEKLACYVSDDGGALLTFEAMAEAASFANIWVPFCRKHGVEPRNPESYFNLKRDPYKNKVRSDFVKDRRRVKREYDEFKVRINGLPDSIRRRSDAYHAREEIKAMKRQREVAGDDPVEPVKIPKATWMADGTHWPGTWMNPSSEHTRGDHAGIIQVMLKPPSHEPLFGNNEEGRPLDFTDIDIRLPMLVYVSREKRPGYDHNKKAGAMNALVRASAIMSNGPFILNLDCDHYVYNSQALREGMCFMMDRGGDRICYVQFPQRFEGIDPSDRYANNNTVFFDVNMRALDGLQGPVYVGTGCLFRRIALYGFDPPRSKEQHGGCCSCCFPQKHKTHAAVASEETRALRMGDSEDDEMAMSTFPKKFGNSTFLIDSIPVSEFQGRPLADHPAVKNGRAPGLLTAPRDLLDASTVAEAISVISCWYEDKTEWGQRVGWIYGSVTEDVVTGYRMHNRGWKSVYCVTKPDAFRGTAPINLTDRLHQVLRWATGSVEIFFSRNNALLASPRMKILQRIAYLNVGIYPFTSIFLIVYCFLPALSLFTGQFIVQTLNVTFLTYLLIITLTLCMLAVLEIKWSGIELEEWWRNEQFWLIGGTSAHLAAVLQGLLKVIAGIEISFTLTSKSAGDDEDDEFADLYIVKWTSLMIPPITIMMMNLIAIAVGVSRTIYSTIPQWSKLLGGVFFSFWVLAHLYPFAKGLMGRRGRTPTIVFVWSGLISITISLLWVAISPPSGGNSQIGGSFTFP

SEQ ID NO: 23200 - protein, 1149 aa, Elaeis guineensis
MASNSALRASRSARMSSTGVELQHGGNKPPAAPTVTFCRRTPSGRLVNYSRDDLDSELSGEFSREFLNYHVTIPPTPDNQPMDPSISAKVEEQYVSNSLFTGGFNSVTRAHLMDKVIESEAMHPQMAGAKGSSCAIPGCDSKVLSDERGIDILPCECDFKICADCFNDSVKAGGAVCPGCKEPYKATELEEVMNNAGAAARRLSLPPPPPGVSRMERRLSLMKSTKMTRSQTGDWDHNRWLFETKGTYGYGNAIWPKESGGDGGNGEVGQPSELTSKPWRPLTRKLKIPAAVLSPYRLLIVFRMAALGLFLAWRVKHKNEDAVWLWGMSVVCELWFAFSWLLDQLPKLCPVNRATDLAVLRDKFETPTPSNPTGKSDLPGIDVFVSTADPEKEPPLVTANTILSILAADYPVEKLSCYVSDDGGALLTFEAMAEAASFANTWVPFCRKHDIEPRNPESYFNLKKDPYKNKVRSDFVKDRRRLKREYDEFKVRINGLPDSIRRRSDAYHAREEIKAMKRQRETAGDDVVEPVKIPKATWMADGTHWPGTWINPSSEHTRGDHAGIIQVMLKPPSDETLFGDKEEGKPLDLTDVDIRLPMLVYVSREKRPGYDHNKKAGAMNALVRASAIMSNGPFILNLDCDHYIYNSEALREGMCFMMDRGGDRICYVQFPQRFEGIDPSDRYANHNTVFFDVNMRALDGLQGPVYVGTGCLFRRVALYGFDPPRAKEHQPGCCSCCFPRRKSPAAVASEETRALRMGDSDDEEMNLSTFPKKFGNSSVLVDSIPVAEYQGRPLADHPAVKNGRPPGALTIPRDLLDASTVAEAISAISCWYEDKTEWGQRVGWIYGSVTEDVVTGYRMHNRGWKSVYCVTKRDAFRGTAPINLTDRLHQVLRWATGSVEIFFSRNNALLASSRMKLLQRIAYLNVGIYPFTSFFLLVYCFLPALSLFSGQFIVQTLNVTFLTYLLLITLTLCMIAMLEIKWSGVSLEEWWRNEQFWLIGGTSAHLAAVLQGLLKVIAGIEISFTLTSKSAGDDVDDEFADLYIVKWTSLMIPPITIMMVNLIAIAVGVSRTIYSVLPQWSRLLGGVFFSFWVLAHLYPFAKGLMGRRGRTPTIVFVWSGLIAITISLLWVAINPPSANSQIGGSFTFP

SEQ ID NO: 23201 - protein, 1148 aa, Cocos nucifera
MASNSYLRASRSARMSSSGVELQHGGTKPPAVPTVTFCRKTPSGRLVNYSRDDLDSELSGEFSREFLNYHVTIPPTPDNQPMDPSISAKVEEQYVSNSLFTGGFNSVTRAHLMDKVIESEAMHPQMAGAKGSSCAIPGCDSKVLSDERGNDILPCECDFKICADCFNDSVKAGEAVCPGCKEPYKATELEEVMNNAGAAARLSLPPPPPGVSRMERRLSLMKSTKMNRSQTGDWDHNRWLFETKGTYGYGNAIWPKESGGDGGNGEVGQPSELTSKPWRPLTRKLKIPAAVLSPYRLLIVIRMAALGLFLAWRVKHKNEDAVWLWGMSVVCELWFAFSWLLDQLPKLCPVNRATDLAVLKDKFETSTPSNPTGKSDLPGIDVFVSTADPEKEPPLVTANTILSILAADYPVEKLSCYVSDDGGALLTFEAMAEAASFANIWVPFCRKHDIEPRNPETYFNLKRDPYKNKVRSDFVKDRRRVKREYDEFKVRTNGLPDSIRRRSDAYHAREEIKAMKRQRETAGDDLVEPVKIPKATWMADGTHWPGTWINPSSEHSRGDHAGIIQVMLKPPSDEPLFGNNEEGKPLDFTDVDIRLPMLVYVSREKRPGYDHNKKAGAMNALVRASAIMSNGPFILNLDCDHYIYNSEALREGMCFMMDRGGDRICYVQFPQRFEGIDPSDRYANHNTVFFDANMRALDGLQGPVYVGTGCLFRRIALYGFDPPRAKEHQPGCCSCCFPRRRSPRAAAPEETRALRMGDSDDEDVNLSTFPKKFGNSNFLIDSIPVAEYQGRPLADHPAIKNGRPPGALTIPRDLLDASTVAEAISVISCWYEDKTEWGQRVGWIYGSVTEDVLTGFRMHNRGWKSVYCVTKRDAFRGTAPINLTDRLHQVLRWATGSVEIFFSRNNALLASTRMKLLQRIAYLNVGIYPFTSIFLLVYCFLPALSLFSGQFIVQTLNVTFLTYLLIITLTLSMLAGLEIKWSGISLEEWWRNEQFWLIGGTSAHLAAVLQGLLKVIAGIEISFTLTSKSAGDDVDDEFADLYIVKWTSLMIPPMTIMMVNLIAIAVGVSRTIYSTVPQWSKLLGGVFFSFWVLAHLYPFAKGLMGRRGRTPTIVFVWSGLIAITISLLWVAINPPSSNSQIGGSFTFP

SEQ ID NO: 23202 - protein, 1152 aa, Cocos nucifera
MASNSYLRASRSARMSSSGVELQHGGTKPPAVPTVTFCRKTPSGRLVNYSRDDLDSELSGEFSREFLNYHVTIPPTPDNQPMEVTMDQTISAKVEEQYVSNSLFTGGFNSVTRAHLMDKVIESEAMHPQMAGAKGSSCAIPGCDSKIMTDERGNDILPCECDFKICADCFTDAVKVGGAVCPGCKEPYKATDLEEVMNNAGPVRQLSLAPPPPGVSRMERRLSLMKSTKLTRSQTGDWDHNRWLFETKGTYGYGNAIWPKESEGDDGNGGDGQPSELMSKPWRPLTRKLKIPAAILSPYRLLIVIRLAALGLFLAWRIRHKNEDAIWLWGMSVVCELWFAFSWILDQLPKLCPVNRATDLAVLKDKFETPTPNNPTGKSDLPGIDVFVSTADPEKEPPLVTANTILSILAADYPVEKLSCYVSDDGGALLTFEAMAEAASFANIWVPFCRKHDIEPRNPESYFNLKKDPYKNKVRSDFVKDRRRVKREYDEFKVCINGLPDSIRRRSDAYHAREEIKAMKRQRETAGDDVVEPVKIPKATWMADGTHWPGTWINPSSEHTRGDHAGIIQVMLKPPSDETLLGDKEEGKPLDLTDVDIRLPMLVYVSREKRPGYDHNKKAGAMNALVRASAIMSNGPFILNLDCDHYIYNSEALREGMCFMMDRGGDRICYVQFPQRFEGIDPSDRYANHNTVFFDVNMRALDGLQGPVYVGTGCLFRRIALYGFDPPRAKEHQPGCCSCCFPRHKSPAAVASEETRALRMGDSDDEEMNLSTFPKKFGNSSVLVDSIPVAEYQGRPLADHPAVKNGRPPGALTIPRDLLDASTVAEAISVISCWYEDKTEWGQRVGWIYGSVTEDVVTGYRMHNRGWKSVYCVTKRDAFRGTAPINLTDRLHQVLRWATGSVEIFFSRNNALLGSSRLKLLQRIAYLNVGIYPFTSIFLLVYCFLPALSLFSGQFIVQTLNVTFLTYLLMITLTLCMIAMLEIKWSGVSLEEWWRNEQFWLIGGTSAHLAAVLQGLLKVIAGIEISFTLTSKSSGDDVDDEFADLYIVKWTSLMIPPITIMMVNLIAIAVGVSRTIYSVLPQWSRLLGGVFFSFWVLAHLYPFAKGLMGRRGRTPTIVFVWSGLIAITISLLWVAINPPSSNSQIGGSFTFP

SEQ ID NO: 23203 - protein, 1152 aa, Cocos nucifera
MASNGALRSSRSGRMASSGVELQQGGNKPPPQPSVTFGRRTQSGRYISYSRDDLDSELSEEFSKEFLNYHVTIPPTPDNQPMEVTMDQTISAKVEEQYVSNSLFTGGFNSVTRAHLMDKVIESEAMHPQMAGAKGSSCAIPGCDSKIMTDERGNDILPCECDFKICADCFTDAVKVGGAVCPGCKEPYKATDLEEVMNNAGPVRQLSLAPPPPGVSRMERRLSLMKSTKLTRSQTGDWDHNRWLFETKGTYGYGNAIWPKESEGDDGNGGDGQPSELMSKPWRPLTRKLKIPAAILSPYRLLIVIRLAALGLFLAWRIRHKNEDAIWLWGMSVVCELWFAFSWILDQLPKLCPVNRATDLAVLKDKFETPTPNNPTGKSDLPGIDVFVSTADPEKEPPLVTANTILSILAADYPVEKLSCYVSDDGGALLTFEAMAEAASFANIWVPFCRKHDIEPRNPETYFNLKRDPYKNKVRSDFVKDRRRVKREYDEFKVRTNGLPDSIRRRSDAYHAREEIKAMKRQRETAGDDLVEPVKIPKATWMADGTHWPGTWINPSSEHSRGDHAGIIQVMLKPPSDEPLFGNNEEGKPLDFTDVDIRLPMLVYVSREKRPGYDHNKKAGAMNALVRASAIMSNGPFILNLDCDHYIYNSEALREGMCFMMDRGGDRICYVQFPQRFEGIDPSDRYANHNTVFFDANMRALDGLQGPVYVGTGCLFRRIALYGFDPPRAKEHQPGCCSCCFPRRRSPRAAAPEETRALRMGDSDDEDVNLSTFPKKFGNSNFLIDSIPVAEYQGRPLADHPAIKNGRPPGALTIPRDLLDASTVAEAISVISCWYEDKTEWGQRVGWIYGSVTEDVLTGFRMHNRGWKSVYCVTKRDAFRGTAPINLTDRLHQVLRWATGSVEIFFSRNNALLGSSRLKLLQRIAYLNVGIYPFTSIFLIVYCFLPALSLFSGQFIVQTLNVTFLTYLLIITLTLSMLAGLEIKWSGISLEEWWRNEQFWLIGGTSAHLAAVLQGLLKVIAGIEISFTLTSKSAGDDVDDEFADLYIVKWTSLMIPPMTIMMVNLIAIAVGVSRTIYSTVPQWSKLLGGVFFSFWVLAHLYPFAKGLMGRRGRTPTIVFVWSGLIAITISLLWVAINPPSSNSQIGGSFTFP

SEQ ID NO: 23204 - protein, 1144 aa, Cajanus cajan
MSSKVFRATRSSISATSSDAPDGQKPPLPPTVTFGRRTSSGRYVSYSRDDLDSELGSTDFMNYTVHIPPTPDNQPMDPSISQKVEEQYVSNSLFTGGFNSVTRAHLMDKVIESEANHPQMAGAKGSSCAVPGCDSKVMSDERGVDILPCECDFKICRDCYVDAVKTGGGVCPGCKEQYKNTELDEGAVDNGRPLPLPPPSGMSKMERRLSLMKSTKSALMRSQTGDFDHNRWLFETKGTYGYGNAIWPKEGGFGNEKEDDVVEPTELMNRPWRPLTRKLKIPAAVLSPYRLIIFIRLVVLALFLAWRIKHQNTDAVWLWGMSVVCEIWFAFSWVLDQLPKLCPVNRSTDLNVLKEKFETPTPNNPTGKSDLPGIDVFVSTADPEKEPPLVTANTILSILAADYPVEKLSCYVSDDGGALLTFEAMAEAASFANMWVPFCRKHDIEPRNPESYFNLKRDPYKNKVRSDFVKDRRRVKREYDEFKVRINSLPDSIRRRSDAYHAREEIKAMKVQRQNREDEPVETVKIPKATWMADGTHWPGTWLSPASEHSKGDHAGIIQVMLKPPSDEPLLGNADDAKLLDLTDVDIRLPLLVYVSREKRPGYDHNKKAGAMNALVRASAIMSNGPFILNLDCDHYIYNSKAMREGMCFMMDRGGDRLCYVQFPQRFEGIDPSDRYANHNTVFFDVNMRALDGLQGPVYVGTGCLFRRIALYGFDPPRSKEHHTGCCNCCFGRQKKHASIASTPEENRALRMGDSDEEEMNLSLFPKKFGNSTFLIDSIPVAEFQGRPLADHPAVKNGRPPGALLIPRDLLDASTVAEAISVISCWYEDKTEWGHRVGWIYGSVTEDVVTGYRMHNRGWKSVYCVTKRDAFRGTAPINLTDRLHQVLRWATGSVEIFFSRNNALLASPRMKILQRIAYLNVGIYPFTSIFLIVYCFLPALSLFSGQFIVQTLNVTFLSYLLGITVTLCMLAVLEIKWSGIELEEWWRNEQFWLIGGTSAHLAAVLQGLLKVIAGIEISFTLTSKSGGDDVDDEFADLYIVKWTSLMIPPITIMMVNLIAIAVGVSRTIYSVIPQWSRLLGGVFFSFWVLAHLYPFAKGLMGRRGRTPTIVFVWSGLIAITISLLWVAINPPAGSNQIGGSFQFP

SEQ ID NO: 23205 - protein, 1143 aa, Glycine max
MASKLFRASRSSISSSSDAPDDQKPPLPPSVQFGRRTSSGRYVSYSRDDLDSELGSTDFMNYTVHIPPTPDNQPMDPSISQKVEEQYVSNSLFTGGFNSVTRAHLMDKVIESEANHPQMAGAKGSSCAIPGCDSKVMSDERGADILPCECDFKICRDCYIDAVKTGGGICPGCKEPYKNTELDEVAVDNGRPLPLPPPSGMSKMERRLSMMKSTKSALMRSQTGDFDHNRWLFETKGTYGYGNAIWPKEGGFGNEKEDDVVQPTELMSRPWRPLTRKLKIPAAVLSPYRLIIFIRLVVLALFLAWRIKHQNSDAVWLWGMSVVCEIWFAFSWLLDQLPKLCPVNRSTDLNVLKEKFETPNPNNPTGKSDLPGIDIFVSTADPEKEPPLVTANTILSILAADYPVEKLSCYVSDDGGALLTFEAMAEAASFANMWVPFCRKHDIEPRNPESYFNLKRDPYKNKVKPDFVKDRRRVKREYDEFKVRINSLPESIRRRSDAYHAREEIKAMKVQRQNREDDPLETVKIPKATWMADGTHWPGTWLSPTSEHSKGDHAGIIQVMLKPPSDEPLLGSADDTRLIDLTDVDIRLPLLVYVSREKRPGYDHNKKAGAMNALVRASAIMSNGPFILNLDCDHYIYNSKAMREGMCFMMDRGGDRLCYVQFPQRFEGIDPSDRYANHNTVFFDVNMRALDGLQGPVYVGTGCLFRRVALYGFDPPRSKEHHTGCCNCCFGRQKKHASLASTPEENRALRMGDSDDEEMNLSLFPKKFGNSTFLIDSIPVAEFQGRPLADHPAVKNGRPPGALTIARDLLDASTVAEAISVISCWYEDKTEWGNRVGWIYGSVTEDVVTGYRMHNRGWKSIYCVTKRDAFRGTAPINLTDRLHQVLRWATGSVEIFFSRNNALLASPRMKILQRIAYLNVGIYPFTSIFLIVYCFLPALSLFSGQFIVQTLNVTFLSYLLGITVTLCMLAVLEIKWSGIELEEWWRNEQFWLIGGTSAHLAAVLQGLLKVVAGIEISFTLTSKSGGDDVDDEFADLYIVKWTSLMIPPITIMMVNLIAIAVGVSRTIYSVIPQWSRLLGGVFFSFWVLAHLYPFAKGLMGRRGRTPTIVFVWSGLIAITISLLWVAINPPAGTDQIGGSFQFP

SEQ ID NO: 23206 - protein, 1143 aa, Populus trichocarpa
MASKSFKATRSNLSTSSDAAESHKPPLPPSVTFGRRTSSGRYISYSRDDLDSELGSSDFMNYTVHIPPTPDNQPMDPSISQKVEEQYVSNSLFTGGFNSVTRAHLMDKVIESEASHPQMAGAKGSSCAIPGCDAKVMSDERGVDILPCECDFKICRDCYIDAVKSGGGICPGCKEPYKNTELDEVAVDSGRPLPLPPPGTMSKMERRLSLMKSTKSVLMRSQTGDFDHNRWLFETRGTYGYGNAIWPNDGGFGNGNDEEVGEPKELMSKPWRPLTRKLKIPAAVISPYRLLILIRIVILALFLEWRVRHPNNDAIWLWGMSVVCEIWFAFSWLLDQLPKLCPINRATDLNVLKDKFETPSLSNPTGKSDLPGIDVFVSTADPEKEPPLVTANTILSILAADYPVEKLSCYVSDDGGALLTFEAMAEAASFANVWVPFCRKHGVEPRNPESYFNLKRDPYKNKVKPDFVKDRRRVKREYDEFKVRINSLPDSIRRRSDAYHAREEIKAMKLQKQHKDDEPVESVKIAKATWMADGTHWPGTWLNSAPEHSRGDHAGIIQVMLKPPSDEPLLGTADDTKIMDFTDVDIRLPLLVYVSREKRPGYDHNKKAGAMNALVRASAIMSNGPFILNLDCDHYIYNSQAMREGMCFMMDRGGDRLCYVQFPQRFEGIDPSDRYANHNTVFFDVNMRALDGLMGPVYVGTGCLFRRIALYGFDPPRAKENHPGCCSCCFSRRKKHSSIANTPEENRALRMGDSDDEEMNLSLLPKKFGNSTFLIDSIPVAEYQGRPLADHPAVKNGRPPGALTIPRELLDASTVAEAISVISCWYEDKTEWGNRVGWIYGSVTEDVVTGYRMHNRGWKSVYCVTKRDAFRGTAPINLTDRLHQVLRWATGSVEIFFSRNNALLASPRMKFLQRIAYLNVGIYPFTSIFLIVYCFLPALSLFSGQFIVQTLNVTFLAYLLIITLTLCLLAVLEIKWSGIELEEWWRNEQFWLIGGTSAHLAAVLQGLLKVVAGIEISFTLTSKSAGDDVDDEFADLYVVKWTSLMIPPITIMMVNLIAIAVGFSRTIYSVIPQWSRLLGGVFFSFWVLAHLYPFAKGLMGRRGRTPTIVFVWSGLIAITISLLWVAINPPSGTNQIGGSFQFP

SEQ ID NO: 23207 - protein, 1143 aa, Glycine max
MASKLFRESRSSISSSSDAPDGQKPPLPPSVQFGRRTSSGRYVSYSRDDLDSELGSTDFMNYTVHIPPTPDNQPMDPSISQKVEEQYVSNSLFTGGFNSVTRAHLMDKVIESEANHPQMAGAKGSSCAIPGCDSKVMSDERGADILPCECDFKICRDCYIDAVKTGGGICPGCKEPYKNTELDEVAVDNGRPLPLPPPSGMSKMERRLSMMKSTKSALVRSQTGDFDHNRWLFETKGTYGYGNAIWPKEGGFGNEKEDDFVQPTELMNRPWRPLTRKLKIPAAVLSPYRLIIFIRLVVLALFLAWRIKHQNTDAVWLWGMSVVCEIWFAFSWLLDQLPKLCPVNRSTDLNVLKEKFETPTPNNPTGKSDLPGIDIFVSTADPEKEPPLVTANTILSILAADYPVEKLSCYVSDDGGALLTFEAMAEAASFANVWVPFCRKHDIEPRNPESYFNLKRDPYKNKVKPDFVKDRRRVKREYDEFKVRINSLPDSIRRRSDAYHAREEIKAMKVQRQNREDEPLEAVKIPKATWMADGTHWPGTWLSPTSEHSKGDHAGIIQVMLKPPSDEPLLGSSDDTRLIDLTDIDIRLPLLVYVSREKRPGYDHNKKAGAMNALVRASAIMSNGPFILNLDCDHYIYNSKAMREGMCFMMDRGGDRLCYVQFPQRFEGIDPSDRYANHNTVFFDVNMRALDGLQGPVYVGTGCLFRRVALYGFDPPRSKEHHTGCCNCCFGRQKKHASLASTPEENRSLRMGDSDDEEMNLSLFPKKFGNSTFLIDSIPVAEFQGRPLADHPAVKNGRPPGALTIPRDLLDASTVAEAISVISCWYEDKTEWGNRVGWIYGSVTEDVVTGYRMHNRGWKSVYCVTKRDAFRGTAPINLTDRLHQVLRWATGSVEIFFSRNNALLASPRMKILQRIAYLNVGIYPFTSIFLIVYCFLPALSLFSGQFIVQTLNVTFLSYLLGITVTLCMLAVLEIKWSGIELEEWWRNEQFWLIGGTSAHLAAVLQGLLKVIAGIEISFTLTSKSGGDDVDDEFADLYIVKWTSLMIPPITIMMVNLIAIAVGVSRTIYSVIPQWSRLLGGVFFSFWVLAHLYPFAKGLMGRRGRTPTIVFVWSGLIAITISLLWVAINPPAGTDQIGGSFQFP

SEQ ID NO: 23208 - protein, 1143 aa, Populus trichocarpa
MASRSFKGTRSNLSISSDAAESHKPPLPQTVTFGRRTSSGRYISYSRDDLDSELGSSDFMNYTVHLPPTPDNQPMDPSISQRVEEQYVSNSLFTGGFNSVTRAHLMDKVIESEASHPQMAGAKGSSCAIPGCDAKVMSDERGVDILPCECDFKICRDCFIDAVKIGGGICPGCKEPYKNTELDEVVVDSGRPLPLPPPGTVSKMERRLSLMKSTKSALMRSQTGDFDHNRWLFETRGTYGYGNAIWPSDGGFGNGNDEEVGGPKELMNKPWRPLTRKLKIPAAIISPYRLLIFVRIVILALFLHWRIRHPNNDAIWLWGMSVVCEIWFAFSWLLDQLPKLCPINRATDLNVLKDKFETPSPSNPTGKSDLPGVDVFVSTADPEKEPPLVTANTILSILAADYPVEKLSCYVSDDGGALLTFEAMAEAASFANVWVPFCRKHDIEPRNPESYFSLKRDPYKNKVKQDFVKDRRRVKREYDEFKVRINSLPDSIRRRSDAYHAREEIKAMKLQKQHKDDGPVESVKIPKATWMADGTHWPGTWLNPSPEHSRGDHAGIIQVMLKPPSDEPLLGTSDETKIMDFTDVDIRLPLLVYVSREKRPGYDHNKKAGAMNALVRASAIMSNGPFILNLDCDHYIYNSQAMREGMCFMMDRGGDRLCYVQFPQRFEGIDPSDRYANHNTVFFDVNMRALDGLMGPVYVGTGCLFRRIALYGFDPPRAKEDHPDCCSCCFARRKKHSSAANTPEENRALRMGDYDDEEMNLSLLPKKFGNSTFLIDSIPVTEFQGRPLADHPAVKNGRPPGALTIPRELLDASTVAEAISVISCWYEDKTEWGNRVGWIYGSVTEDVVTGYRMHNRGWKSVYCVTKRDAFRGTAPINLTDRLHQVLRWATGSVEIFFSRNNALLASRRMKFLQRIAYLNVGIYPFTSIFLIVYCFLPALSLFSGQFIVQTLNVTFLAYLLIITLTLCLLAVLEIKWSGIDLEEWWRNEQFWLIGGTSAHLAAVLQGLLKVIAGIEISFTLTSKSGGDDVDDEFADLYVVKWTSLMIPPITIMMVNLIAIAVGFSRTIYSVIPQWSRLLGGVFFSFWVLAHLYPFAKGLMGRRGRTPTIVFVWSGLIAITISLLWVAINPPSGTTQIGGSFQFP

SEQ ID NO: 23209 - protein, 1143 aa, Ricinus communis
MASKSFKLSRSNLSVSSDANDSQKPPLPPTVTFGRRTSSGRYISYSRDDLDSELGSSDFMNYTVHIPPTPDNQPMDPSISQKVEEQYVSSSLFTGGFNSVTRAHLMDKVIESETSHPQMAGAKGSSCSIPGCDAKVMSDERGVDILPCECDFKICRDCYIDAVKTGGGICPGCKESYKNTELDEVAVDNGRPLPLPPPGTVSKMERRLSLMKSTKSVLMRSQTGDFDHNRWLFETRGTYGYGNAIWPNDGGFSNGKDEEVVEPKELMNKPWRPLTRKLKIPAAIISPYRLLICIRVVVLALFLMWRVSHPNEDAVWLWGMSVVCEIWFAFSWLLDQLPKLCPINRATDLNVLKEKFETPTPSNPTGKSDLPGIDVFVSTADPEKEPPLVTANTILSILAADYPVEKLACYVSDDGGALLTFEAMAEAASFANIWVPFCRKHDIEPRNPESYFNLKRDPYKNKVRPDFVKDRRRVKREYDEFKVRINGLPDSIRRRSDAFHAREEIKAMKLQRQNRDDEPVESVKIPKATWMADGTHWPGTWMQSAPEHSKGDHAGIIQVMLKPPSDEPLHGTADDTKIIDFTDVDIRLPLLVYVSREKRPGYDHNKKAGAMNALVRASAIMSNGPFILNLDCDHYIYNSQAMREGMCFMMDRGGDRICYVQFPQRFEGIDPSDRYANHNTVFFDVNMRALDGLMGPVYVGTGCLFRRTALYGFDPPRAKEHHPGCCDCCFSRRKKHSSVGNTPEENRALRMGDSDDEEMNLSLFPKKFGNSTFLVDSIPVAEFQGRPLADHPAVKNGRPPGALTIPRDLLDASTVAEAISVISCWYEDKTEWGHRIGWIYGSVTEDVVTGYRMHNRGWKSVYCVTKRDAFRGTAPINLTDRLHQVLRWATGSVEIFFSRNNALLASPRMKLLQRIAYLNVGIYPFTSIFLIVYCFLPALSLFSGQFIVQTLNVTFLVYLLVISLTLCLLALLEIKWSGIELEEWWRNEQFWLIGGTSAHLAAVLQGLLKVVAGIEISFTLTSKSAGDDVDDEFADLYVVKWTSLMIPPIVIMMVNLIAIAVGFSRTIYSVIPQWSRLIGGVFFSFWVLAHLYPFAKGLMGRRGRTPTIVFVWSGLIAITISLLWVAINPPSNTDQIGGSFQFP

SEQ ID NO: 23210 - protein, 1144 aa, Phaseolus vulgaris
MASKMFRASRSSISTSSDGAPDGQKPPLPPSVQFGRRTSSGRYVSYSRDDLDSEIGSTDFMNYTVHIPATPDNQPMDPSISQKVEEQYVSNSLFTGGFNSVTRAHLMDKVIESEASHPQMAGAKGSSCAVPGCDSKVMSDERGADILPCECDFKICRDCYIDAVKTGGGTCPGCKESYKNTELDEVAADNGHPLQLPPPGGMSKMERRLSLMKSTKSVLMRSQTGDFDHNRWLFETKGTYGYGNAIWPKQGGFGNEIENDVVEPTELMNRPWRPLTRKLKIPAAILSPYRLIIFIRLVVLALFLAWRVKHQNTDAVWLWGMSVVCEIWFAFSWLLDQLPKLCPVNRSTDLNVLKEKFETPTPNNPTGKSDLPGIDIFVSTADPEKEPPLVTANTILSILAADYPVEKLSCYVSDDGGALLTFEAMAEAASFANAWVHFCRKHDIEPRNPESYFSLKRDPYKNKVRPDFVKDRRRVKREYDEFKVRINSLPDSIRRRSDAYHAREEIKAMKVQRQNREDEPLETAKIPKATWMADGTHWPGTWLNPTSEHSKGDHAGIIQVMLKPPSDEPLPGSADDTSLIDQTDVDIRLPLLVYVSREKRPGYDHNKKAGAMNALVRASAIMSNGPFILNLDCDHYIYNSKAMREGMCFMMDRGGDRLCYVQFPQRFEGIDPSDRYANHNTVFFDVNMRALDGLQGPVYVGTGCLFRRIALYGFDPPRSKEHATGCCNCCFGRQKKHASMASTPEENRALRMGDSDEEEMNLSLFPKKFGNSTFLIDSIPVAEFQGRPLADHSAVKNGRPPGALTIPRDLLDASTVAEAISVISCWYEDKTEWGNRVGWIYGSVTEDVVTGYRMHNRGWKSVYCVTKRDAFRGTAPINLTDRLHQVLRWATGSVEIFFSRNNALLASPRMKILQRIAYLNVGIYPFTSIFLIVYCFLPALSLFSGQFIVQTLNVTFLSYLLGITVTLCILAVLEIKWSGIELEEWWRNEQFWLIGGTSAHLAAVLQGLLKVIAGIEISFTLTSKSGGDDVDDEFADLYIVKWTSLMIPPITIMMVNLIAIAVGVSRTIYSVIPQWSRLLGGVFFSFWVLAHLYPFAKGLMGRRGRTPTIVFVWSGLIAITISLLWVAINPPAGSNQIGGSFQFP

SEQ ID NO: 23211 - protein, 1145 aa, Prunus persica
MASRSFKASRSNLSSNSDMPDAHNKPPVPPTVTFGRRTSSGRYISYSRDDLDSELGSGDFMNYTVHIPPTPDNQPMDPSISQKVEEQYVSNSLFTGGFNSVTRAHLMDKVIESEANHPQMAGAKGSSCAIPGCDAKVMSDERGVDILPCECDFKICRDCYTDAVKTGGSICPGCKETYKNTDLDEMAVDNARPPLPLPLPNGMSKNERRLSLMKSTKSVLMRSQTGDFDHNRWLFETKGTYGYGNAIWPKEGGFGNGKDDEIVEPTELMNKPWRPLTRKLKIPAAILSPYRLLIFIRMVVLALFLAWRVNHPNNDAIWLWGMSVVCEIWFAFSWLLDQLPKLCPVNRSTDLNVLKEKFETPSPNNPTGKSDLPGIDIFVSTADPDKEPPLVTANTILSILATDYPVEKLACYVSDDGGALLTFEAMAEAASFANIWVPFCRKHRIEPRNPESYFNLKRDPYKNKVLPDFVKDRRRVKREYDEFKVRINGLPDSIRRRSDAYHAREEIKAMKLQRENREDEPVESVKVPKATWMADGTHWPGTWLSASPEHSKSDHAGIIQVMLKPPSDEPLHGADDDARLIDLTDVDIRLPMLVYVSREKRPGYDHNKKAGAMNALVRASAIMSNGPFILNLDCDHYIYNSQAMREGMCFMMDRGGDRLCYVQFPQRFEGIDPSDRYANHNTVFFDVNMRALDGLQGPVYVGTGCLFRRISLYGFDPPRSKEHHPGCCSCCFSRRRKHSSVANTPEENRALRMGDSDDEEMNLSLLPKRFGNSSFLIDSIPVAEFQGRPLADHPAVKNGRPPGALTIPRELLDASTVAEAISVISCWYEDKTEWGQRVGWIYGSVTEDVVTGYRMHNRGWKSVYCVTKRDAFRGTAPINLTDRLHQVLRWATGSVEIFFSRNNALLASPRMKLLQRIAYLNVGIYPFTSIFLIVYCFLPALSLFSGQFIVQSLNVTFLTYLLTITLTLCMLAVLEIKWSGIELEEWWRNEQFWLIGGTSAHLAAVLQGLLKVIAGIEISFTLTSKSGGDDEDDEFADLYIVKWSSLMIPPITIMMVNLIAIAVGFSRTIYSVIPQWSRLLGGVFFSFWVLAHLYPFAKGLMGRRGRTPTIVFVWSGLIAITISLLWVAINPPSGTNQIGGSFQFP

SEQ ID NO: 23212 - protein, 1148 aa, Citrullus lanatus
MASKSFKLTRSNLSSTSDVSDAQKQPMPQTVTFARRTSSGRYVRYSRDDLDSELGSGDFTNYTVHIPPTPDNQPMDPSISQKVEEQYVSNSLFTGGFNSVTRAHLMDKVIESEATHPQMAGTKGSSCAVPGCDAKVMSDERGNDILPCECDFKICRDCYVDAVKSGNAICPGCKEPYKNTDMDEITVEHGRPLPLPPTRTMSKGERRLSLMKSTKSMMVRSQTGVGDFDHNRWLFETKGTYGYGNAIWPKDGVTGNGNDKDDEVVEPKEFMNKPWRPLTRKLKIRAAVLSPYRLLILVRMVVLGLFLAWRIRHPNTDAYWLWAMSVVCEIWFAFSWLLDQLPKLCPVNRATDLNVLKDKFETPSPSNPTGKSDLPGIDVFVSTADPEKEPPLVTANTILSILAADYPVEKLACYVSDDGGALLTFEAMAEAASFANTWVPFCRKHDIEPRNPESYFNLKRDPFKNKVRSDFVKDRRRVKREYDEFKVRINGLPDSIRRRSDAYHAREEIKAMKRQRQNVGEDEPLETVKIPKATWMADGTHWPGTWMQPSAEHSKGDHAGIIQVMLKPPSDEPLHGTADETKLLDLSEVDIRLPLLVYVSREKRPGYDHNKKAGAMNALVRASAIMSNGPFILNLDCDHYIYNSQAMREGMCFMMDRGGDRICYVQFPQRFEGIDPSDRYANHNTVFFDVNMRALDGLQGPVYVGTGCLFRRIALYGFDPHRSKEQHPGCCSCCFGKRKKHTSIANSPEEHRGLRMGDSDDEEMDLSLFPKRFGNSVFLVDSIPIAEFQGRPLADHPAVKYGRPPGALTIPRELLDASTVAEAISVISCWYEDKTEWGQRVGWIYGSVTEDVVTGYRMHNRGWKSIYCVTKRDAFRGTAPINLTDRLHQVLRWATGSVEIFFSRNNALLASSRMKILQRIAYLNVGIYPFTSIFLIVYCFLPALSLFSGQFIVQTLNVAFLTYLLVITITLCLLAVLEIKWSGIELEEWWRNEQFWLIGGTSAHLAAVLQGLLKVIAGIEISFTLTSKSAGDDVDDEFADLYIVKWTSLMIPPITIMMINLIAIAVGVSRTIYSTIPQWSRLIGGVFFSFWVLVHLYPFAKGLMGRRGRTPTIVFVWSGLLAITISLLWVAISPPSGANQIGGSFSFP

SEQ ID NO: 23213 - protein, 1073 aa, Cocos nucifera
TPDNQPMDPSISAKVEEQYVSNSLFTGGFNSVTRAHLMDKVIESEAMHPQMAGAKGSSCAIPGCDSKVLSDERGNDILPCECDFKICADCFNDSVKAGEAVCPGCKEPYKATELEEVMNNAGAAARLSLPPPPPGVSRMERRLSLMKSTKMNRSQTGDWDHNRWLFETKGTYGYGNAIWPKESGGDGGNGEVGQPSELTSKPWRPLTRKLKIPAAVLSPYRLLIVIRMAALGLFLAWRVKHKNEDAVWLWGMSVVCELWFAFSWLLDQLPKLCPVNRATDLAVLKDKFETSTPSNPTGKSDLPGIDVFVSTADPEKEPPLVTANTILSILAADYPVEKLSCYVSDDGGALLTFEAMAEAASFANIWVPFCRKHDIEPRNPESYFNLKKDPYKNKVRSDFVKDRRRVKREYDEFKVCINGLPDSIRRRSDAYHAREEIKAMKRQRETAGDDVVEPVKIPKATWMADGTHWPGTWINPSSEHTRGDHAGIIQVMLKPPSDETLLGDKEEGKPLDLTDVDIRLPMLVYVSREKRPGYDHNKKAGAMNALVRASAIMSNGPFILNLDCDHYIYNSEALREGMCFMMDRGGDRICYVQFPQRFEGIDPSDRYANHNTVFFDVNMRALDGLQGPVYVGTGCLFRRIALYGFDPPRAKEHQPGCCSCCFPRHKSPAAVASEETRALRMGDSDDEEMNLSTFPKKFGNSSVLVDSIPVAEYQGRPLADHPAVKNGRPPGALTIPRDLLDASTVAEAISVISCWYEDKTEWGQRVGWIYGSVTEDVVTGYRMHNRGWKSVYCVTKRDAFRGTAPINLTDRLHQVLRWATGSVEIFFSRNNALLASTRMKLLQRIAYLNVGIYPFTSIFLLVYCFLPALSLFSGQFIVQTLNVTFLTYLLIITLTLSMLAGLEIKWSGISLEEWWRNEQFWLIGGTSAHLAAVLQGLLKVIAGIEISFTLTSKSAGDDVDDEFADLYIVKWTSLMIPPMTIMMVNLIAIAVGVSRTIYSTVPQWSKLLGGVFFSFWVLAHLYPFAKGLMGRRGRTPTIVFVWSGLIAITISLLWVAINPPSSNSQIGGSFTFP

SEQ ID NO: 23214 - protein, 1144 aa, Gossypium hirsutum
MASKSFKGTRSSLSISADATESQKPPIPPTVTFGRRTSSGRYVSYSRDDLDSELSSSDFMNYTVHIPPTPDNQPMDPSISQKVEEQYVSNSLFTGGFNSVTRAHLMDKVIESEANHPQMAGAKGSSCAVPGCDAKIMSDERGADILPCECDFKICRDCYIDAVKSGDGLCPGCKEPYKNTDLDEAAVDNSSRPLPLPPPATMSKMERRLSLMKSMKSGLMRSQTGDFDHNRWLFETRGTYGYGNAIWPKDGNIGNGKDDEVAEPTELMNKPWRPLTRKLKIPAAVLSPYRLLIFLRIVVLGLFLAWRVNHPNNDAIWLWGMSVVCEIWFAFSWLLDQLPKLCPINRSTDLNVLKDKFETPTLNNPTGKSDLPGIDVFVSTADPEKEPPLVTANTILSILAADYPVEKLACYVSDDGGALLTFEAMAEAASFANIWVPFCRKHNIEPRNPESYFNLKRDPYKNKVKPDFVKDRRRVKREYDEFKVRINGLPDSIRRRSDAFHAREEIKAMKLQRQNREDEPVEAVKIPKATWMADGTHWPGTWLNPANEHSRGDHAGIIQVMLKPPSDEPLHGTADDRLIDLTDVDIRLPLLVYVSREKRPGYDHNKKAGAMNALVRASAIMSNGPFILNLDCDHYIYNSQAMREGMCFMMDRGGDRICYVQFPQRFEGIDPSDRYANNNTVFFDVNMRALDGLMGPVYVGTGCLFRRVALYGFDPPRSKEHHPGCCSCCFFGRNKKHSSMAHSPEENRALRMGDSDDEEMNLSLLPKRFGNSTFLIDSIPVAEFQGRPLADHPAVKNGRPPGALTIPRELLDASTVAEAISVISCWYEDKTEWGHRVGWIYGSVTEDVVTGYRMHNRGWRSVYCVTKRDAFRGTAPINLTDRLHQVLRWATGSVEIFFSRNNALLASPRMKILQRIAYLNVGIYPFTSIFLIVYCFLPALSLFSGQFIVQTLNVTFLTYLLIITVTLCLLAVLEIKWSGIELEEWWRNEQFWLIGGTSAHLAAVLQGLLKVIAGIEISFTLTSKSAGDDLDDEFADLYIVKWTSLMIPPITIMMVNLIAIAVGFSRTIYSVIPQWSRLLGGVFFSFWVLAHLYPFAKGLMGRRGRTPTIVFVWSGLMAITISLLWVAINPPSTTNQIGGSFQFP

SEQ ID NO: 23215 - protein, 1144 aa, Gossypium raimondii
MASKSFKGTRSSLSISSDATESQKPPIPPTVTFGRRTSSGRYVSYSRDDLDSELSSSDFMNYTVHIPPTPDNQPMDPSISQKVEEQYVSNSLFTGGFNSVTRAHLMDKVIESEANHPQMAGAKGSSCAVPGCDAKIMSDERGADILPCECDFKICRDCYIDAVKSGDGLCPGCKEPYKNTDLDEAAVDNSSRPLPLPPPATMSKMERRLSLMKSMKSGLMRSQTGDFDHNRWLFETRGTYGYGNAIWPKDGNIGNGKDDEVAEPTELMNKPWRPLTRKLKIPAAVLSPYRLLIFLRIVVLGLFLAWRVNHPNNDAIWLWGMSVVCEIWFAFSWLLDQLPKLCPINRSTDLNVLKDKFETPTLNNPTGKSDLPGIDVFVSTADPEKEPPLVTANTILSILAADYPVEKLACYVSDDGGALLTFEAMAEAASFANIWVPFCRKHNIEPRNPESYFNLKRDPYKNKVKPDFVKDRRRVKREYDEFKVRINGLPDSIRRRSDAFHAREEIKAMKLQRQNREDEPVEAVKIPKATWMADGTHWPGTWLNPANEHSRGDHAGIIQVMLKPPSDEPLHGTADDRLIDLTDVDIRLPLLVYVSREKRPGYDHNKKAGAMNALVRASAIMSNGPFILNLDCDHYIYNSQAMREGMCFMMDRGGDRICYVQFPQRFEGIDPSDRYANNNTVFFDVNMRALDGLMGPVYVGTGCLFRRVALYGFDPPRSKEHHPGCCSCCFFGRNKKHSSMAHSPEENRALRMGDSDDEEMNLSLLPKRFGNSTFLIDSIPMAEFQGRPLADHPAVKNGRPPGALTIPRELLDASTVAEAISVISCWYEDKTEWGHRVGWIYGSVTEDVVTGYRMHNRGWRSVYCVTKRDAFRGTAPINLTDRLHQVLRWATGSVEIFFSRNNALLASPRMKILQRIAYLNVGIYPFTSIFLIVYCFLPALSLFSGQFIVQTLNVTFLTYLLIITVTLCLLAVLEIKWSGIELEEWWRNEQFWLIGGTSAHLAAVLQGLLKVIAGIEISFTLTSKSAGDDLDDEFADLYIVKWTSLMIPPITIMMVNLIAIAVGFSRTIYSVIPQWSRLLGGVFFSFWVLAHLYPFAKGLMGRRGRTPTIVFVWSGLMAITISLLWVAINPPSTTNQIGGSFQFP

SEQ ID NO: 23216 - protein, 1145 aa, Prunus mume
MASRSFKASRSNLSSNSDMPDAHDKPPVPPTVTFGRRTSSGRYISYSRDDLDSELGSGDFMNYTVHIPPTPDNQPMDPSISQKVEEQYVSNSLFTGGFNSVTRAHLMDKVIESEANHPQMAGAKGSSCAIPGCDAKVMSDERGVDILPCECDFKICRDCYTDAVKTGGSICPGCKETYKNTDLDEMAVDNARPPLPLPLPNGMSKNERRLSLMKSTKSVLMRSQTGDFDHNRWLFETKGTYGYGNAIWPKEGGFGNGKDDEVVEPTELMNKPWRPLTRKLKIPAAILSPYRLLIFIRMVVLALFLAWRVNHPNNDAIWLWGMSVVCEIWFAFSWLLDQLPKLCPVNRSTDLNVLKEKFETPSPNNPTGKSDLPGIDIFVSTADPDKEPPLVTANTILSILATDYPVEKLACYVSDDGGALLTFEAMAEAASFANIWVPFCRKHRIEPRNPESYFNLKRDPYKNKVLPDFVKDRRRVKREYDEFKVRINGLPDSIRRRSDAYHAREEIKAMKLQRENREDEPVESVKVPKATWMADGTHWPGTWLSASPEHSKSDHAGIIQVMLKPPSDEPLHGADDDARLIDLTDVDIRLPMLVYVSREKRPGYDHNKKAGAMNALVRASAIMSNGPFILNLDCDHYIYNSQAMREGMCFMMDRGGDRLCYVQFPQRFEGIDPSDRYANHNTVFFDVNMRALDGLQGPVYVGTGCLFRRISLYGFDPPRSKDHHPGCCSCCFSRRRKHSSVAHTPEENRALRMGDSDDEEMNLSLLPKRFGNSSFLIDSIPVAEFQGRPLADHPAVKNGRPPGALTIPRELLDASTVAEAISVISCWYEDKTEWGQRVGWIYGSVTEDVVTGYRMHNRGWKSVYCVTKRDAFRGTAPINLTDRLHQVLRWATGSVEIFFSRNNALLASPRMKLLQRIAYLNVGIYPFTSIFLIVYCFLPALSLFSGQFIVQSLNVTFLTYLLTITLTLCMLAVLEIKWSGIELEEWWRNEQFWLIGGTSAHLAAVLQGLLKVIAGIEISFTLTSKSGGDDEDDEFADLYIVKWSSLMIPPITIMMVNLIAIAVGFSRTIYSVIPQWSRLLGGVFFSFWVLAHLYPFAKGLMGRRGRTPTIVFVWSGLIAITISLLWVAINPPSGTNQIGGSFQFP

SEQ ID NO: 23217 - protein, 1138 aa, Eucalyptus grandis
MASKSFKASRSTLSQSSESADLRPPLPPTVTFGRRTSSGRYVSYSRDDLDSELGSGDFVNYTVHIPPTPDNQPMDPSISQKVEEQYVSNSLFTGGFNSVTRAHLMDKVIESEASHPQMAGAKGSSCAIPGCDAKVMSDERGMDILPCECDFKICRDCYIDAVKTGGGICPGCKEPYKNTDLDEIAVDNGRPLPLPPPGGMSKMERRLSLMKSTKSVLMRSQTGDFDHNRWLFETRGTYGYGNAIWPKDGGFTGKDDDVVEPTELMNKPWRPLTRKLKIPAAILSPYRLLIFVRMVVLGLFLAWRVSHPNNDAVWLWGMSVVCEIWFAFSWLLDQLPKLCPVNRSTDLNVLREKFETPGLNNPTGKSDLPGVDVFVSTADPEKEPPLVTANTILSILAADYPVEKLACYVSDDGGALLTFEAMAEAASFANIWVPFCRKHNIEPRNPESYFNLKRDPYKNKVKEDFVKDRRRVKREYDEFKVRINGLPESIRRRSDAYHAREEIQAMKNQRNNRDDEPVETLKIPKATWMADGTHWPGTWMNPGPEHSRGDHAGIIQVMLKPPSDEPLLGTADDAKIINLTDVDIRLPLLVYVSREKRPGYDHNKKAGAMNALVRASAIMSNGPFMLNLDCDHYIYNSQALREGMCFMMDRGGDRICYVQFPQRFEGIDPSDRYANHNTVFFDVNMRALDGLQGPVYVGTGCLFRRVALYGFDPPRAKEHQPGCCSCCFDRRKKVASTSEEKRALRMGDSDDEEMNLSLIPKRFGNSTFLIDSIPVAEFQGRPLADHPAVKNGRPPGALTIPRDLLDASTVAEAISVISCWYEDKTEWGHRVGWIYGSVTEDVVTGYRMHNRGWKSVYCVTKRDAFRGTAPINLTDRLHQVLRWATGSVEIFFSRNNALLASPRMKLLQRIAYLNVGIYPFTSIFLIVYCFLPALSLFSGQFIVQTLNVTFLTYLLTITLTLCMLAVLEIKWSGIELEEWWRNEQFWLIGGTSAHLAAVLQGLLKVVAGIEISFTLTSKSGGDDVDDEFADLYVVKWTSLMIPPITIMMTNLIAIAVGFSRTIYSVIPQWSRLIGGVFFSFWVLAHLYPFAKGLMGRRGRTPTIVFVWSGLIAITISLLWVAISPPAGSTQIGGSFQFP

SEQ ID NO: 23218 - protein, 1143 aa, Gossypium raimondii
MASRSFKGSRSSLSISSDAAESHKPPVPPTVTFARRTSSGRYVSYSRDDLDSELGCSDFMNYTVHIPPTPDNQPMDPSISQKVEEQYVSNSLFTGGFNSVTRAHLMDKVIESETNHPQMAGAKGSSCAIPGCDAKVMSDERGLDILPCECDFKICRDCYIDAVKTGGGICPGCKEPYKNTDLDETAVDSNTRPLPLPPPSTMSKMERRLSLMKSTKSALMRSQTGDFDHNRWLFETRGTYGYGNAIWPKDGNLGNGDDDEAAEPTELMNKPWRPLTRKLKIPAAILSPYRLLIFIRVVVLGLFLAWRVTNPNKDAIWLWGMSVVCEIWFAFSWLLDQLPKLCPINRATDLNVLKEKFETPSPSNPTGKSDLPGIDVFVSTADPEKEPPLVTANTILSILAANYPVEKLACYVSDDGGALLTFEAMAEAASFANVWVPFCRKHDIEPRNPESYFNLKRDPYKNKVKPDFVKDRRRVKREYDEFKVRINGLPDSIRRRSDAFHAREEIKAMKLQRQNRGDEPIDSVKIPKATWMADGTHWPGTWLNPSTDHSRGDHAGIIQVMLKPPSDEPLHGTAEDGLIDLTDVDIRLPLLVYVSREKRPGYDHNKKAGAMNALVRASAIMSNGPFILNLDCDHYIYNSQAMREGMCFMMDRGGDRLCYVQFPQRFEGIDPSDRYANHNTVFFDVNMRALDGLMGPVYVGTGCLFRRIALYGFDPPRSKEHHAGCCSCCFGRSRKHSSMAHTPEENRALRMGDSDDEEMNLSLLPKRFGNSTFLIDSIPVAEFQGRPLADHPAVKNGRPPCALTIPRELLDASTVAEAISVISCWYEDKTEWGQRVGWIYGSVTEDVVTGYRMHNRGWKSVYCVTKRDAFRGTAPINLTDRLHQVLRWATGSVEIFFSRNNALLASPRMKLLQRIAYLNVGIYPFTSIFLIVYCFLPALSLFSGQFIVQTLNVTFLTYLLIITVTLCLLAVLEIKWSGIELEEWWRNEQFWLIGGTSAHLAAVLQGLLKVIAGIEISFTLTSKSAGDDLDDEYADLYVVKWTSLMIPPITIMMVNLIAIAVGFSRTVYSVIPQWSRLLGGVFFSFWVLAHLYPFAKGLMGRRGRTPTIVFVWSGLIAITISLLWVAINPPSGTNQIGGSFQFP

SEQ ID NO: 23219 - protein, 366 aa, Brachypodium distachyon
MTGAEEQGRRLFGVSLTDRPVWQQFLICSSGFFFGYLVNGICEEYVYNRLQFSYGWYFTFVQGFVYLALIRLQGFTVKQMVNPWRTYIRLSAVLMGSNGLTKGSLAFLNYPAQIMFKSTKVLPVMIMGAFIPGLRRKYPFHEYVSAVMLVLGLILFTLADAQTSPNFSMVGVAMVSSALIMDAFLGNLQEAIFKMNPDTTQMEMLFCSTVVGLPFLAVPMVLTGELRTAWNSCSQHLYVYAVLVFEAMATFVGQVSVLSLIALFGAATTAMVTTARKAVTLLLSYLIFTKPMTEQHVTGLLLITMGIVLRLLPENKEKKGPAALRQAKMAVALPQRGGGEEDRQRQQWRGDDDVVEEEGEEKSPLV

SEQ ID NO: 23220 - protein, 349 aa, Oryza sativa
MTGGEEQGRRLFGVSLTDRPRWQQFLICSSGFFFGYLVNGICEEYVYNRLQFSFGWYFTFVQGFVYLGLIRLQGFTVKQMVNPWRTYVRLSAVLMGSHGLTKGSLAFLNYPAQIMFKSTKVLPVMIMGAFIPGLRRKYPFHEYISAVMLVIGLILFTLADAQSSPNFSMIGVAMVSGALVMDAFLGNLQEAIFKMNPDTTQMEMLFCSTVVGLPFLVVPMVLTGELMRAWTACSQHMYVYAVLVFEAMATFVGQVSVLSLIALFGAATTAMVTTARKAVTLLLSYLIFTKPLTEQHVTGLLLISMGIVLKLLLENKENVPRRQVRKTVQHWDDKQREIREVEEEKAPLV

SEQ ID NO: 23221 - protein, 344 aa, Zea mays
MTGGGEEQGRSLFGVSLTNRPRWQQFMICSSGFFFGYLVNGICEEYVYNRLQFSYGWYFTFVQGFVYLALIRLQGFTVKQMVNPWRTYVRLSAVLMGSNGLTKGSLAFLNYPAQIMFKSTKVLPVMVMGAFIPGLRRKYAFQEYVSAVMLVVGLILFTLADAQTSPNFSMAGVAMVSGALVMDAFLGNLQEAIFKMNPDTTQMEMLFCSTVVGLPFLAVPMVLTGELVTAWTSCSQHLYVYAVLVLEAMATFVGQVSVLSLIALFGAATTAMVTTARKAVTLLLSYLIFTKPLTEQHATGLLLITMGIVIKLLPENKERRPRRLPKNDDDDKPRESREAGEETA

SEQ ID NO: 23222 - protein, 353 aa, Sorghum bicolor
MTGGGEEQGRSLFGVSLTDRPRWQQFLICSSGFFFGYLVNGICEEYVYNRLQFSYGWYFTFVQGFVYLALIRLQGFTVKQMVNPWRTYVRLSAVLMGSNGLTKGSLAFLNYPAQIMFKSTKVLPVMVMGAFIPGLRRKYPFQEYVSAVMLVIGLILFTLADAQTSPNFSLVGVAMVSGALVMDAFLGNLQEAIFKMNPDTTQMEMLFCSTVVGLPFLAVPMVLTGELMTAWTSCSQHLYVYAVLVFEAMATFVGQVSVLSLIALFGAATTAMVTTARKAVTLLLSYLIFTKPLTEQHATGLLLITMGIVIKLLPENKEGRLRRLPKKTEERSGDDDDKPLESREADAEKASLV

SEQ ID NO: 23223 - protein, 217 aa, Brachypodium distachyon
MSADELRLDLEELRRLESLATRPRVLSLLSNEIRSVDAKLAARTATAPAPAPAPQAVAAVAPAGVNYVTLGTFSWDQDNEKITVYVFLEDVDQEKVETTFKPMSVDIKIHDVKGKNYRCAIPKLNKEIVPEKCKVVVKPKKIVITLCKASKGSWLDLHYKEDKFKPSTAKDKDPMAGIMDLMKGMYEEGDDNMRRTIAKAWTDARSGKTADSAKGLP

SEQ ID NO: 23224 - protein, 592 aa, Secale cereale
MDAPKDASPSPKLHTRLRVWEFADRYVFEPVDGLADLFLSVSRTNGSMNLVPELPPRGPSANPKVRIVFGVVGVLKLAVGSCCLVITDRDCVGSYMGHAVFKVTGLKALPCTTASSAEQKKMESEFSDLLDAAERSIGLYFSYEANLTLTLQRLYDLGDTFKALPLWRQAERRFMWNGYLLEPLIENKLDQYLLPVIQGSFQNIHAEVGSDKVVVTMIARRCTRRIGTRCWRRGADPEGYAANFVESEQIMQTKGYTASYVQVRGSMPFLWEQIVDLTYKPSFDIVRVEEAARVLERHYHDLQKKYGAVVGIDLVNTTGGEGRLYERYAKSIEPILSEDIRFIHFDFHKICGHIHFERLSQLYDQIEDYLKKHKYFLLDDEGKKIVGQTGTVRTNCVDCLDRTNVTQSMVGRKILESQLQQLGVFGGNDTVSNYPAFDADYKVLWANHGDAISTQYSGTPALKGDFVRYGKRTTQGIFNDLWNALARYYFNNFADGTKQDAMDLLQGHYVSSVSRDAAIPSKPGAMQSFRVAFALIFCAAIFMLMSLRQARNDLRHLVVALVWAGLCIGIALYVKKNGRKFCNRPRFYLSRN

SEQ ID NO: 23225 - protein, 591 aa, Triticum aestivum
DAPKDASPSPKLHTRLRVWEFADRYVFEPVDGLADLFLSISRTNGSMNLVQELPPRGPSANPKVRIVFGVVGVLKLAVGSCCLVITDRDCVGSYMGHAVFKVTGLKFLPCTTASSAEQKKMESEFSDLLDAAERSIGLYFSYEANLTLTLQRLYDLGDTFKALPLWKQAERRFMWNGYLLEPLIENKLDQYLLPVIQGSFQNIHAEVGSDKVVVTMIARRCTRRIGTRCWRRGADPEGYAANFVESEQIMQTKGYTASYVQVRGSMPFLWEQIVDLTYKPSFDIVRVEEAARVLERHFHDLQKKYGAVVGIDLVNTTGGEGRLYERYAKSIEPILTEDIRFIHFDFHKICGHIHFERLSQLYDQIEDYLKKHKYFLLDDQGKKMVGQTGTVRTNCVDCLDRTNVTQSMVGRKTLESQLQQLGVFGGNDTISNYPAFDADYKVLWANHGDAISTQYSGTPALKGDFVRYGKRTTQGIFNDLWNALARYYFNNFADGTKQDAMDLLQGHYVSSVSRDAALPSKPGVMQSFRVAFALIFCAAMFMLMSLRQARNDLRHLVVALVWAGLCVGIALYVKKNGRKFCNRPRFYLSRN

SEQ ID NO: 23226 - protein, 592 aa, Triticum aestivum
MDAPKDASPSPKLHTRLRVWEFADRYVFEPVDGLADLFLSISRTNGSMNLVQELPPRGPSANPKVRIVFGVVGVLKLAVGSCCLVITDRDCVGSYMGHAVFKVTGLKFLPCTTASSAEQKKMESEFSDLLDAAERSIGLYFSYEANLTLTLQRLYDLGDTFKALPLWKQAERRFMWNGYLLEPLIENKLDQYLLPVIQGSFQNIHAEVGSDKVVVTMIARRCTRRIGTRCWRRGADPEGYAANFVESEQIMQTKGYTASYVQVRGSMPFLWEQIVDLTYKPSFDIVRVEEAARVLERHYHDLQKKYGAVVGIDLVNTTGGEGRLYERYAKSIEPILSEDIRFIHFDFHKICGHIHFERLSQLYDQIEDYLKKHKYFLLDDQGKKMAGQTGTVRTNCVDCLDRTNVTQSMVGRKTLESQLQQLGVLGGNDTISNHPAFDADYKVLWANHGDAISTQYSGTPALKGDFVRYGKRTTQGILNDLWNALARYYFNNFADGTKQDAMDLLQGHYVSSVSRDAAVPSRPGVMQSFRAAFALIFCAAMFMLMSLRQARNDLRHLVVALVWAGLCVGIALYVKKNGRKFCNRPRFYLSRN

SEQ ID NO: 23227 - protein, 592 aa, Secale cereale
MDAPKDAAPSPKLHTRLRVWEFADRYVFEPVDGLADLFLSVSRTNGSMNLVPELPPRGPSANPKVRIVFGVIGVLKLAVGSCCLVITDRDCVGSYMGHAVFKVTGLKALPCTTSSSAEQKKMESEFSDLLDAAERSIGLYFSYEANLTLTLQRLYDLGDTFKALPLWRQAERRFMWNGYLLEPLIENKLDQYLLPVIQGSFQNIHAEVGSDKVVVTMIARRCTRRIGTRCWRRGADPEGYAANFVESEQIMQTKGYTASYVQVRGSMPFLWEQIVDLTYKPSFDIVRVEEAARVLERHYHDLQKKYGAVVGIDLVNTTGGEGRLYERYAKSIEPILSEDIRFIHFDFHKICGHIHFERLSQLYDQIEDYLKKHKYFLLDDEGKKIVGQTGTVRTNCVDCLDRTNVTQSMVGRKILESQLQQLGVFGGNDTVSNYPAFDADYKVLWANHGDAISTQYSGTPALKGDFVRYGKRTTQGIFNDLWNALARYYFNNFADGTKQDAMDLLQGHYVSSVSRDAAIPSKPGAMQSFRVAFALIFCAAIFMLMSLRQARNDLRHLVVALVWASLCVGIALYVKKNGRKFCNRPRFYLSRN

SEQ ID NO: 23228 - protein, 592 aa, Triticum aestivum
MDAPKDASPSPKLHTRLRVWEFADRYVFEPVDGLADLFLSISRTNGSMNLVQELPPRGPSANPKVRIVFGVVGVLKLAVGSCCLVITDRDCVGSYMGHAVFKVTGLKFLPCTTASLAEQKKMESEFSDLLDAAERSIGLYFSYEANLTLTLQRLYDLGDTFKALPLWKQAERRFMWNGYLLEPLIENKLDQYLLPVIQGSFQNIHAEVGSDKVVVTMIARRCTRRIGTRCWRRGADPEGYAANFVESEQIMQTKGYTASYVQVRGSMPFLWEQIVDLTYKPSFDIVRVEEAARVLERHYHDLQKKYGAVVGIDLVNTTGGEGRLYERYAKSIEPILSEDIRFIHFDFHKICGHIHFERLSQLYDQIEDYLKKHKYFLLDDQGKKMAGQTGTVRTNCVDCLDRTNVTQSMVGRKTLESQLQQLGVLGGNDTISNHPAFDADYKVLWANHGDAISTQYSGTPALKGDFVRYGKRTTQGILNDLWNALARYYFNNFADGTKQDAMDLLQGHYVSSVSRDAAIPSRPGVMQSFRAAFALIFCAAMFMLMSLRQARNDLRHLVVALVWAGLCVGIALFVKKNGRKFCNRPRFYLSRN

SEQ ID NO: 23229 - protein, 597 aa, Brachypodium distachyon
MDVANDACPSPKLHTRLRLWEFADHYVFEPVDGLADLYLSVSRPKGSMNLVEELPPRGPSTNPKVRIVFGVIGVLNLSVGSYCLVITDRDCVGSYLGHAVFKVTGLKVLPCNNSHSTSAEQKKMEKEFSALLDAAERSIGLYFSYETNLTLTSQRLYDLGDKFKALPLWRQAEPRFLWNGYLLEPLIENKLDQYLLPVIQGSFQNIHAEVGSDKVNVTMIARRCTRRIGTRCWRRGADPEGYAANFVESEQIMQSKGFTASYVQVRGSMPFLWEQIVDLTYKPSFDVIRVEEAACVLERHFHDLQKKYGAVVAIDLVNTTGGEGRLYERYAKSIEPILSEDIRFVHFDFHKICGHIHFERLSQLYDQIEDYLKKHKYFLLNDEGKTMEEQTGTVRTNCVDCLDRTNVTQSMVGRKILESQLQRLGVLSANSTISDYPAFDADYKVLWANHGDAISTQYSGTPALKGDFVRYGKRTTQGIFNDLWNALERYYLNNFADGTKQDAMDLLQGHYISSLSRDIAASSKAGLIENYASCRLAFALIVVAVMLMMMSLRQARNDLRHLVLALLWAGLCIGIVRFVKINGRKFTNRPRFHLSRH

SEQ ID NO: 23230 - protein, 597 aa, Oryza sativa
MSVATEACPSPKLHTRLRLWEFADRYVFEPVDGLADLFLSVDRTNGSMSLVEELPPRGPSTNPKVRIVFGVIGVLKLAVRSYFLVITGRDCVGSYLGHAIFKLTGLKVLPCNNSLNTSSAEQKKMESEFSELLDAAERTIGLYFSYDVNLTLTSQRLHDLGDQFKSLPLWRQAEPRFLWNGYLLEPLIENKLHQYLLPVIQGSFQSIHAEVGSEKVNVTLIARRCTRRIGTRMWRRGADPEGYAANFVESEQIMQSKEFTASYVQVRGSMPFLWEQIVDLTYKPSFDVVRVEEAPRVLERHFHDLQKKYGAVVAVDLVNTHGGEGRLYERYAKSIEPILSEDIRFVHFDFHQICGHIHFERLSQLYDQIEDYLKKHRYFLLNSKGEKMEEQTGTVRTNCVDCLDRTNVTQSMIGRKILESQLQKISVLGDNNTISDYPAFDADYKVLWANHGDAISTQYSGTPALKGDFVRYGKRTTQGILNDLWNAMARYYLNNFADGTKQDAMDLLQGHHISSVSRDMPTPTKGLIENHASFRLAFALLLAAVIFLIMSLRRARNDVFHLVLSLLWSGFCFGITRYVKANGRKFTNRPRFHLSRH

SEQ ID NO: 23231 - protein, 597 aa, Setaria italica
MDVPNNSCPSPKLHTRLRLWEFADQYVFEPVDGLADLFLSVSRVNGSMSLVEELPQRGPSTNPKVQIVFGVIGVLKLEVGTYFLVITDRDCVGSYLGHAVFKVTGLRVLRCNNSINASAEQKNMDTEFLELLDAAERTIGLYFSYDSNLTVTSQRLHELGDEFKSLPLWRQAEPRFLWNGYLLERLIENKLHQYLLPVIQGSFQSIHAEVRSEKVNVTLIARRCTRRIGTRMWRRGADPEGYAANFVESEQIVQSKGFTASYVQVRGSMPFLWEQIVDLTYKPGFDVVRVEEAARVLERHFHDLQKKHGAVVAVDLVNTHGGEGRLYERYAKSIEPILSEDIRFVHFDFHKICGHIHFERLSQLYDQIEDYLKKHKYFLLSDKGEKTEQQTGTVRTNCVDCLDRTNVTQSMIGRKLLESQLQRIGVFGANDTVSNFLDFDANYKVLWANHGDAISTQYSGTPALKGDFVRYGKRTTQGILNDLWNALARYYLNNFVDGTKQDAMDLLQGHYISSVSRDMAPTSKAGLLENYASFRLAFALVLVAVSFMIISLRQARNDARHLVLSLMWAGLCIGISRYVRTNGRMFCNRPRFYQSRH

SEQ ID NO: 23232 - protein, 998 aa, Setaria italica
MATRPASRQRKAGSASAAAAAKGSHQQQQQPQPGSPTSTTTTTTSSSRLTPELSLDGPASPLFAGLDEDPAPKENVTVTVRFRPLSPREIRQGEEVAWYADGDTVVRSEQNPNVAYAYDRVFAPTTTTRHVYDVAAQHVVSGSMEGVNGTIFAYGVTSSGKTHTMHGDQRSPGIIPLAVKDAFSIIQETLNREFLLRVSYLEIYNEVVHDLLNPAGQNLRIREDPQGTFVEGIKEEVVLSPAHALSLIAAGEEHRHVGSTNFNLLSSRSHTIFTLTIESSPCGESNEGEAVTFSQLNLIDLAGSESSRAETTGVRRKEGSYINKSLLTLGTVISKLTDGKATHIPYRDSKLTRLLQSSLSGQGRVSLICTVTPASSNSEETHNTLKFAHRAKRIEIQASQNKIIDEKSLIKKYQTEIRRLKEELEQLKMGIITGTPSKDTGEDNIILWKQKLEDGNVKLQSRLEQEEEAKAALLARIQRLTKLILVSTKATQTSRFSPHPGPRRRHSFGEEELAYLPYRRRDIMMDNESNELLLPVEGFGVSLEDSSKEEKKNRKGLLNWFKLRKRDGASILTSSEGDKSSLTKSTAPSTPIGESVNFRAEPRISNSLAGENVSADLFIIGHGEFPSGSIHGEEIALTSGKTMDHVDLLREQLKILSGEVALQTSVLKRLTEEAGRSPLSENIQMEMKKISDEIKGKKRQIASLEREIAHATLGSQGKADKLELSPSYPELLEQLNEKSFELEVKAADNRVIQDQLNEKINECMGLQAEVTHLKEQLSQALEAKDLLSNSMVQNNRVVNHEVERHADQDSAVPREVSSELLQKQQQSIEIDELKQKVSELIEIKAQLEDRNQKLLEESTYAKGLASAAGVELKALSEEVTKLMNQNEKLATELASLRSPTPRRVTNGPRGGRRESMSRRHEPASRRDTNASHEREKALENMLMEKEQKEAELQRKVEESKQKEAFLESELANMWVLVAKLKKSQGYEHEDSEAKHDVS

SEQ ID NO: 23233 - protein, 997 aa, Sorghum bicolor
MATRPASRQRKAGHASAVAAGPKGLHQQQPPQSGSPTSTTTTTTSSSRLTPELSLDGPVSPLFAGLDEDPAPKENVTVTVRFRPLSPREIRQGEEVAWYADGDTVVRSEQNPSVAYAYDRVFAPTTTTRHVYDVAAQHVVSGAMEGVNGTIFAYGVTSSGKTHTMHGDQRSPGIIPLAVKDAFSIIQETPNREFLLRVSYLEIYNEVVNDLLNPAGQNLRIREDPQGTFVEGIKEEVVLSPAHALSLIAAGEEHRHVGSTNFNLLSSRSHTIFTLTIESSPCGEANEGEAVTFSQLNLIDLAGSESSRAETTGVRRKEGSYINKSLLTLGTVISKLTDGKATHIPFRDSKLTRLLQSSLSGQGRVSLICTVTPASSNSEETHNTLKFAHRAKRIEIQASQNKIIDEKSLIKKYQTEIRRLKEELEQLKMGIITGTPSKDTEEDNIILWKQKLEDGNVKLQSRLEQEEEAKAALLARIQRLTKLILVSTKATPTSRFSPHPGPRRRHSFGEEELAYLPYRRRDIMMDNESNELLLPVEGFGVSLEDSSKEEKKNRKGLLNWFKLRKRDGASILTSSEGDKSSLTKSTAPSTPIGESINFPAEPRISNSLAGENVSADLFSIGHGEFPSGSIHGEETPLASGKTMDHVDLLREQLKILSGEVAFNTSALKRLTEEAGRSPKNEKIQMEMKKKTDEIKGKQQQIASLEREIAHATLGTQGKVDKLELSPSYHELLEQLNEKSFELEVKAADNRVIQDQLNEKISECMELQAEVTHLKEQLSQALEAKDLLSNSMIQNNRVNQEVEHHAGQNVPREISSEPQQKQQQSVEINELKQKVSELIEIKAQLEDRNQKLLEESTYAKGLASAAGVELKALSEEVTKLMNQNEKLATDLSSLRSPTPAPRRVSNGPRGTRRESMSRRHEPASRRDTNANHEREKALETMLMEKEQKEAELQRKVEESKQKEAFLESELANMWVLVAKLKKSQGYDHEDPEAKNDGS

SEQ ID NO: 23234 - protein, 998 aa, Brachypodium distachyon
MATRPASRQRKASPAAAAAKSSQQQQQQPQSGSPTSSATTSSSRLTPEMSVDGPASPLFAGLDEDPGTKENVTVTVRFRPLSPREIRQGEEVAWYADGDTVVRSEQNPNVGYAYDRVFAPTTTTRQVYDVAAQHVVSGAMEGIYGTIFAYGVTSSGKTHTMHGDQRSPGIIPLAVKDAFSIIQETPNREFLLRVSYLEIYNEVVNDLLNPAGQSLRIREDPQGTFVEGIKEEVVLSPAHALSLIAAGEEHRHVGSTNFNLLSSRSHTIFTLTIESSSYGESNEGEAVTFSQLNLIDLAGSESSRAETTGVRRKEGSYINKSLLTLGTVISKLTDGKATHIPFRDSKLTRLLQSSLSGQGRVSLICTVTPASSNSEETHNTLKFAHRAKRIEVQASQNKIIDEKSLIKKYQNEIRRLKEELEQLKMGIITGTPLKDAEEDNIILWKQKLEDGNVKLQSRLEQEEEAKSALLARIQRLTKLILVSTKATQTSRFSPHPGPRRRHSFGEEELAYLPYRRRDIILDNESTELLTSGEGFGVTLEDSSKEEKKNRKGLLNWFKLRKRDAGGASTLTSSECDKSSLTKSTAPSTPIGESLNFHAEPRISNSFVADSVSADMLSIGNGEFPSDGLHGEETPLVSTRTIDHVDLLREQLKILSGEVAFHTSVLKRLTDEAGKNPNSEKIQMKMKKTSDEIKGKQHQIASLEKQIPHSMSNSQVKDEKSELSPSYAELLEQLNEKSFELEVKVADNRVIQDQLQEKTSECLELQDAVSRLKEHLSQALQANDSLSNSIMTQQSAGVNHEDQHHVDQGKSVPKEISAEPLQKEQQSVEIGELKQRLCELTEVKAQLEVRNQKLLEESTYAKGLASAAGVELKALSEEVTKLMNQNEKLASELASLRSPTPRRVSNGPRGTTRRDSMSRRHEPASRRDGNASHERERVLETILAEKEQKEAELQRKVEESKQKEAFLESELANMWVLVAKLKKSHGDDQEDLEAKYNGS

SEQ ID NO: 23235 - protein, 994 aa, Zea mays
MASRPTSRQRKAGHASAAAGPKGLHHHQQLPPQSGSPTSTATTSSSRLTPELSLDGPASPLFAGLDEDPAPKENVTVTVRFRPLSPREIRQGEEVAWYADGDTVVRSEQNPSVAYAYDRVFAPTTTTRHVYDVAAQHVVSGAMEGVNGTIFAYGVTSSGKTHTMHGDQRSPGIIPLSVKDAFSIIQETPNREFLLRVSYLEIYNEVVNDLLNPAGQNLRIREDPQGTFVEGIKEEVVLSPAHALSLIAAGEEHRHVGSTNFNLLSSRSHTIFTLTIESSPCGESNEGEAVTFSQLNLIDLAGSESSRAETTGVRRKEGSYINKSLLTLGTVISKLTDGKATHIPYRDSKLTRLLQSSLSGQGRVSLICTLTPASSNSEETHNTLKFAHRAKCIEIQASQNKIIDEKSLIKKYQTEIRRLKEELEQLKMGIITGTPLKDTEEDNIILWKQKLEDGNVKLQSRLEQEEEAKAALLARIQRLTKLILVSTKATPASRFSPHPGPRRRHSFGEEELAYLPYRRRDIMIDNESNELLLPVEGFGVSLEDSSKEEKKNRKGLLNWFKLRKRDGASILTSSEGDKSSLTKSTAPSTPIGESVNFPAEPRISNSLAGENVSSDLFSIGHGEFPSGSIHGEETLSASGKTMDHVDLLREQLKILSGEVAFNTSALKRLTEEAGRSPKNEKIQMEMKKKTDEIKGKQQQIASLEREIAHATLGTQGKVDTLEHSPSYHELLEQLNEKSLELEVKAADNRVIQDQLNEKITECMELHAEVTHLKEQLSQALEAKDLVSNSMIHNNRVNHEVEHLVDQDVPREISSEPQQKQQSVEINELKQKVSELMEIKAQLEDRNQKLLEESTYAKGLASAAGVELKALSEEVTKLMNQNEKLATELSSLRSPTPAPRRFNNGPRGTRRESMSRREPASRRDTNASHEREKALEALLMEKEQKEAELQRKVEESKQKEAFLESELANMWVLVAKLKKSQGYDHEDLEAKHDGS

SEQ ID NO: 23236 - protein, 833 aa, Echinacea purpurea
MDPFGGAYFTDEKAARVENIFLEFLKSYPNARAPFYESEIEAMKPNESNTMFIDFRHVMEFNDVLQKAVADEYLRFEPYLKNACKRFVMGQKPTFITDDNPNKDINIAFYNLPIIKRLRELGTSEIGRLVSVTGVVTRTSEVRPELIQGTFKCLECGTIVKNVEQQYKYTEPMICMNATCSKKGRWTLLRQESKFADWQRVRMQETSKEIPAGSLPRSLDVILRHDIVEQARAGDTVIFTGTVVVIPDLLALAAPGERAEVRREGGQGQRSGNGTVQEGVKGLRALGVRDLSYKLAFIANSVQICDGRRDTDIRNRKRDAEDDDMQQFTPEELDEVRQMKNTPDFFNKLVASMAPTVYGHHDIKRAILLMLLGGVHKFTHEGINLRGDINVCIVGDPSCAKSQFLKYTTTLVPRSVYTSGKSSSAAGLTATVAKEPETGEFCIEAGALMLADNGVCCIDEFDKMDVRDQVAIHEAMEQQTISITKAGIQATLNARTSILAAANPTGGRYDKTKPLKYNVALPPAILSRFDLVYVMIDDPDDTTDYHIASHIVKVHQKRNEAVSPDFTTAQLKRFIAVAKSKKPKLNAEARKLLVDSYVDLRRGDTAPGSKVAYRMTVRQLEALIRLSEAIARCHLDDEVLPRHVTLATKLLKTSVISVESSEIDLTEFQEENREDGDIGEDGDIGENGDAGENGEAQPGGADADANNNHPENAKDSGAKKLVITDEYFQRVTQALVMRLRQHEETVTREGSGLAGMRQRDLIQWYVKQQNENEAYENEEEAKAEITKIKAIIESLVRREGHLIVVNEGDDDGNARPPSRNDRILAVAPNYVID

SEQ ID NO: 23237 - protein, 832 aa, Chrysanthemum coronarium
MDSFGGAYFTDEKAAKVENIFLDFLKTFRLDPNSREPYYESEIEAMRPNESNTMFIDFAHVMRFNDVLQKAISDEYLRFESYLKNACKRFVMGQKPTFITDDNPNKDINIAFFNLPIIKRLRELSTSEIGRLVSVTGVVTRTSEVRPELLQGTFKCLDCSAIVKNVEQQYKYTEPMICMNPMCAKKGWWTLLRQESKFADWQRVRMQETSKEIPAGSIPRSLDVILRHDIVEQARAGDTVVFTGTVVVIPDILALAAPGERAECRREGGQRSNSGSVQEGVKGLRALGVRDLSYKLAFIANSVQICDGRRDADIRNRKRDAEDGDTPEFTSEELAEVRQMRNTPDFFNKLVDSVAPTVFGHQDIKRAILLMLLGGVHKFTHEGINLRGDINVCIVGDPSCAKSQFLKYTTTLVSRSVYTSGKSSSAAGLTATVAKEPETGEFCIEAGALMLADNGVCCIDEFDKMDVRDQVAIHEAMEQQTISITKAGIQATLNARTSILAAANPTGGRYDKSKPLKYNVALPPAILSRFDLVYVMIDDPDDTTDFHIASHIVRVHQKREEAVSPTFTTAQLKRYIAVAKSKKPKLNADARQILVDSYVALRKGDTAPGSRVAYRMTVRQLEALIRLSEAIARCHLDDEVHPRHVRLATRLLKTSVISVESTEIDLTEFQDDIQEENQGDGDIGGNGEAQPSGADADMTNEHPENAEVPGAKKLVITDEYFQRVTQALVMHLRQHEETVAREGTGLAGMRQRDLIQWYVGQQNEKNNYNSMEEAKAEVTKIKAIIESLVRREGHLIVVDEEEATAQGDDDGNGRRTSRNNRILAVAPNYVID

SEQ ID NO: 23238 - protein, 832 aa, Chrysanthemum coronarium
MDSFGGAYFTDEKAAKVENIFLDFLKTFKLDPNSREPYYESEIEAMRPNESNTMFIDFAHVMRFNDVLQKAISDEYLRFESYLKNACKRFVMGQKPTFITDDNPNKDINIAFFNLPVIKRLRELSTSEIGRLVSVTGVVTRTSEVRPELLQGTFKCLDCSTIVKNVEQQYKYTEPMICMNPMCAKKGWWTLLRQESKFADWQRVRMQETSKEIPAGSIPRSLDVILRHDIVEQARAGDTVVFTGTVVVIPDILALAAPGERAECRREGGQRNNSGGVQEGVKGLRALGVRDLSYKLAFIANSVQICDGRRDADIRNRKRDAEDGDTPEFTSEELAEVRQMRNTPDFFNKLVDSVAPTVFGHQDIKRAILLMLLGGVHKFTHEGINLRGDINVCIVGDPSCAKSQFLKYTTTLVSRSVYTSGKSSSAAGLTATVAKEPETGEFCIEAGALMLADNGVCCIDEFDKMDVRDQVAIHEAMEQQTISITKAGIQATLNARTSILAAANPTGGRYDKSKPLKYNVALPPAILSRFDLVYVMIDDPDDTTDFHIASHIVRVHQKREEAVAPTFTTAQLKRYIAVAKSKKPKLNAEARQILVDSYVTLRKGDTAPGSRVAYRMTVRQLEALIRLSEAIARCHLDDEVHPRHVRLATRLLKTSVISVESTEIDLTEFQDDIQEENQEDGDIGGNGAAQPSDADADMTNENPENAEAPGAKKLVITDEYFQRVTQALVMRLRQHEETVAREGTGLAGMRQRDLIQWYVGQQNEKNNYNSMEEAKAEVTKLKAIIESLVRREGHLIVVDEEEAPAQGDDDGIGKRTSRNNRILAVAPNYVID

SEQ ID NO: 23239 - protein, 821 aa, Lactuca sativa
MDSFGGAYFTDEKAAKVENIFLEFLKSFRLDANSREPFYESEIEAMRPNESNTMFIDFSHVMRFNDVLQKAISDEYLRFESYLKNACKRFVMGQKPTFITDDNPNKDINIAFYNLPVIKRLRELSTSEIGRLVSVTGVVTRTSEVRPELLQGTFKCLDCGTIIKNVEQQYKYTEPMICINAMCSKKGKWALLRQESKFADWQRVRMQETSKEIPAGSLPRSLDVILRHDIVEQARAGDTVIFTGTVVVIPDIFALAAPGERAEVRRDGGSKRDTTGTVQEGVKGLRALGVRDLSYRLAFIANSVQICDGRRDADIRNRKRDAEDEDNLQFTPEEVAEVKQMRNTPDFFNKLVDSMAPTVFGHQDIKRAILLMLLGGVHKFTHEGINLRGDINVCIVGDPSCAKSQFLKYTTTLVSRSVYTSGKSSSAAGLTATVAKEPETGEFCIEAGALMLADNGVCCIDEFDKMDIRDQVAIHEAMEQQTISITKAGIQATLNARTSILAAANPTGGRYDKSKPLKYNVALPPAILSRFDLVYVMIDDPDDTTDFHIASHIVRVHQKRENAVAPAFTTAQLKRYIQVAKSKKPKLSVEARKILVDSYVALRRGDTAPGSRVAYRMTVRQLEALIRLSEAIARCHLDDEVHPRHVKLATRLLKTSVISVESTEIDLTEFQEDGDVDGDVDGNGEPETADAAANNEQPENGEGQGGKKLVITDEYFQRVTQALVMRLRQHEETVMQDGSGLAGMRQRDLIQWYVGQQNEKNNYSSMEEAKAEVTKIKAIIESLVRREGHLIVVDEEAQGDDGVRSSRNNRILAVAPNYVID

SEQ ID NO: 23240 - protein, 776 aa, Artemisia annua
ECVHVMRFNDVLQKAISDEYLRFESYLKNACKRFVMGQKPTFITDDNPNKDINIAFFNLPIIKRLRELSTSEIGRLVSVTGVVTRTSEVRPELLQGTFKCLDCSAIVKNVEQQYKYTEPMICMNPMCAKKGWWTLLRQESKFADWQRVRMQETSKEIPAGSIPRSLDVILRHDIVEQARAGDTVIFTGTVVVIPDILALAAPGERAECRREGGQRSNSGSVQEGVKGLRALGVRDLSYKLAFIANSVQICDGRRDADIRNRKRDAEDGDTPEFTSEELAEVRQMRNTPDFFNKLVDSVAPTVFGHQDIKRAILLMLLGGVHKFTHEGINLRGDINVCIVGDPSCAKSQFLKYTTTLVSRSVYTSGKSSSAAGLTATVAKEPETGEFCIEAGALMLADNGVCCIDEFDKMDVRDQVAIHEAMEQQTISITKAGIQATLNARTSILAAANPTGGRYDKSKPLKYNVALPPAILSRFDLVYVMIDDPDDTTDFHIASHIVRVHQKREEAVSPTFTTAQLKRYIAVAKSKKPKLNAEARQILVDSYVALRKGDTAPGSRVAYRMTVRQLEALIRLSEAIARCHLDDEVHPRHVRLATRLLKTSVISVESTEIDLTEFQDDIQEENQEDGDIGGNGAAQPSGADADMTNEHPENAEVPGAKKLVITDEYFQRVTQALVMRLRQHEETVAREGTGLAGMRQRDLIQWYVGQQNEKNNYNSMEEAKAEVTKIKAIIESLVRREGHLIVVDEEEAAAQGDDDGNGRRTSRNNRILAVAPNYVID

SEQ ID NO: 23241 - protein, 832 aa, Panax ginseng
MDSFGGGYYVDEKAVRVENIFLEFLKSFRLNPNSREPYYESEIEAMKPNESNTMFIDFSHVMRFNDVLQKAISDEFLRFESYLKNACKRFVMEQKPTFITDDNPNKDINVAFFNLPLLKRLRELSTAEIGKLVSVTGVVTRTSEVRPELLQGTFNCLECGTIVKNVEQQYKYTEPVICMNPTCSKTKSWALLRQDSKFADWQRVRMQETSKEIPAGSLPRSLDVILRHDIVEQARAGDTVIFTGTVVVIPDIMALASPGERAETRREASQHKNPTGQGVKGLRALGVRDLSYRLAFIANSVQICDGRRDSDVRNRRRDAEDDDNQEFTAEELDEVQQMRNTPDFFNKLVDSIAPTIFGHQDIKRAILLMLLGGVHKFTHEGINLRGDINVCIVGDPSCAKSQFLKYTAGLVPRSVYTSGKSSSAAGLTATVAKEPETGEFCIEAGALMLADNGVCCIDEFDKMEVRDQVAIHEAMEQQTISITKAGIQATLNARTSILAAANPAGGRYDKSKPLKYNVALPPAILSRFDLVYVMIDDPDDQTDYHIAHHIVRVHQKHEDAISPAFSTAQLKRYISYAKTLKPKLSAEARQLLVESYVTLRRGDTAPGSRVAYRMTVRQLEALIRLSEAIARSHLEVQVATRHVRLAVRLLKTSIISVESSEIDLSEFQDENRDNVDHGDGGPGEGEPQPSGAEPESTSRNAENGDEATTQKGKKLVITDEYFQRVTHALVMRLRQHEETVMHEGTGLAGMRQRDLIQWYVGQQNEKNNYSSMEEAAAEVSKIKAIIESLVRREGHLIVVDDGRQAAEEGENARQSSSRNDRILAVAPNYVID

SEQ ID NO: 23242 - protein, 833 aa, Capsicum annuum
MDSYGGGGYYVDEKAVRVENIFLEFLKSFRVDANSREPFYETEIEAMRPNESNTMFIDFSHVMRFNDVLQKAISDEFLRFESYLKNACKRFVMELKPTFITDDNPNKDINVAFYNLPLIKRLRELTTAEIGKLVSVTGVVTRTSEVRPELLQGTFKCLDCGTVIKNIEQQFKYTEPIICMNATCQNKARWALLRQESKFADWQRVRMQETSKEIPAGSLPRSLDVILRHDIVEQARAGDMVIFTGSVVVIPDILSLASPGERAECRRDASQRKNASGGQEGVKGLRALGVRDLSYRLAFIANSVQICDGRRDNDIRNRRRDVEEDENPQFTAEELEDIQRMRKIPDFFNKLVESIAPTVFGHSDIKRAILLMLLGGVHKFTHEGINLRGDINVCIVGDPSCAKSQFLKYTAGLVPRSVYTSGKSSSAAGLTATVAKEPETGEFCIEAGALMLADNGICCIDEFDKMDVRDQVAIHEAMEQQTISITKAGIQATLNARTSILAAANPTGGRYDKTKPLKYNVALPPAILSRFDLVYVMIDDPDDQTDYNIAHHIVRVHQKRENPVDPPFSTAQVKRYIMYAKTLKPKLSTEARELLVDSYVALRRDDTAPGSRVAYRMTVRQLEALIRLSEAIARSHLDIQVQPRHVQIARRLLKTSIISVESSEIDLSEFQDGNREDDVGDTENGTGQGENQPTEAPAESVSGNAENATGTTSKQGKKLVITDEYFQRVTRALILRLRQHEETVTQDGTGLAGMRQKDLIQWYISQQNDKNSYSSMEEAAAEVAKVKAIIESLIRREGHLIVVDDGRQAGEDGGRQPSRNDRILAVAPNYVVD

SEQ ID NO: 23243 - protein, 834 aa, Solanum lycopersicum
MDSYGGGGYFVDEKAVRVENIFLEFLKSFRVDANSREPFYESEIEAMRPNESNTMFIDFSHVMRFNDILQKAISDEFLRFESYLKNACKRFVMELKPTFITDDNPNKDINVAFYNLPLINRLRELTTSEIGKLVSVTGVVTRTSEVRPELLQGTFKCLDCGTVIKNVEQQFKYTEPIICMNATCQNKARWALLRQESKFADWQRVRMQETSKEIPAGSLPRSLDVILRHDIVEQARAGDTVIFTGTVVVIPDILALASPGERAECRRDASQRKNGTGAQEGVKGLRALGVRDLSYRLAFIANSVQICDGRRDNDIRNRRRDVDEEESPQFMTEELEDIQRMRKVPDFFNKLVESVAPTVFGHSDIKRAILLMLLGGVHKFTHEGINLRGDINVCIVGDPSCAKSQFLKYTAGLVPRSVYTSGKSSSAAGLTATVAKEPETGEFCIEAGALMLADNGICCIDEFDKMDVRDQVAIHEAMEQQTISITKAGIQATLNARTSILAAANPTGGRYDKTKPLKYNVALPPAILSRFDLVYVMIDDPDDQTDYNIAHHIVRVHQRRQNPVDPPFSTAQVKRYIMYAKTLKPKLSAEARELLVDSYVALRQDDTAPGSRVAYRMTVRQLEALIRLSEAIARCHLDIQVQPRHVQIAKKLLKTSIISVESSEIDLSEFQNENPEDGVGDTQNGTGQGETEPTEAPAESVSGNAENGAGTTNKQGKKLVITDEYFQRVTRALILRLRQHEETVMQDGTGLAGMRQKDLIQWYVSQQNDKNSYSSMEEAAAEVTKVKAIIESLIRREGHLIVVDDGTQAGEESGRQSASRNDRILAVAPNYVVD

SEQ ID NO: 23244 - protein, 661 aa, Solanum phureja
MSKFGLKVEEGKEGKNGEPSIGPVYRNPIAKNGFPSADPDLSTAWQLFRSAVEKYPGNRMLGWRDFKDGKWGSYNWKTYKEAYEETLQTGSALRAHGIEPGARIGIYGANCPQWIVAMEACSAHSLICVPLYDTLGSGAVDFIIEHAEIDIVFVQDKKVKELLNEECTHAKRLKLIVCFTSLQQEEKDKAVSMDIKPYSWNEFLNMGKENPSEPSPPQPLDICTIMYTSGTSGEPKGVILTHENMTASVTGVDHFMEEFEDKMTVDDVYISFLPLAHILDRMIEEFFFHRGASVGYFHGNINEIQEDMMELKPTFLAGVPRVYEKVHEGVLKALEELNPFRRHMFHVLYNLKLKWMNLGYKQKYASRLADLLAFRKVKNRLGGRIRLIVSGGAPLSSEVEEFLRVTSCGFVLQGYGLTETCGLATIGHPDEMCMLGTVGPPFVFTEVRLEEVPEMGYDPLADPPRGEICVRGRTTFAGYYKNPELTKEAIKDGWFHTGDIGEMMPNGVVKVIDRKKNVIKLSQGEYVALEYLEKVYGIAPIVEDIWVYGDSFKSMLVAVVAPHEGNTKKWADKNGHKGSITELCSLQDLNQYVLLELKSAAERNKLRGFENIKGVILEPQPFEFDKELVTATMKKRRERLLKRYKVEIDDLYKRLNAAAKR

SEQ ID NO: 23245 - protein, 663 aa, Capsicum annuum
MSMTMFGVKVEEGKEGKNGQPSIGPVYRNPISKNGFPSADPDLSTAWQLFRSAVDKYPGNRMLGWRDFKDGKWGPYNWKTYKEAYEEILQTGSALRAHGIEPGARIGIYGANCPQWIVAMEACSAHNLICVPLYDTLGPGAVNFIIEHAEIDIVFYQDKKVKELLNSECTHAKRLKLIVSFTSLQQEEKDKAVSMNIKPYSWNEFLNMGKENPSEPSPPQPLDICTIMYTSGTSGEPKGVILTHENMTASITGVDHFMEEFEDKMTVDDVYISFLPLAHILDRMIEEFFFHRGASVGYFHGNINEIQEDMMALKPTFLAGVPRVYERVHEGVLKALDELNPFRRRMFHLLYNLKLKWMNLGYKHKYASRLADLLAFRKVKARLGGRIRLIVSGGAPLSSEVEEFLRVTSCGFVLQGYGLTETCGLATIGHPDEMCMLGTVGPPFVFTELRLEEVPEMGYDPLGDPPRGEICVRGRTTFAGYYKKPELTREAIKDGWFHTGDIGEMMPNGVVKIIDRKKNVIKLSQGEYVALEYLEKVYGIAPIVEDIWVYGDSFKSMLVAVVVPHEGNIKKWADQNGHKGSIPELCSLQELNQYVLLELKSAAERNKLRGFENIKGVILEPQPFEFDQDVVTATMKKRRERLLKRYKVDIVDLYQRLNAAPRR

SEQ ID NO: 23246 - protein, 290 aa, Vigna unguiculata
MDPSSLLFSHLKGADPFFLLAGPNVIESEDHILRMAKHVKSIATEVGIPLVFKSSFDKANRTSSKSFRGPGMVEGLKILEKVKIAYDIPIVTDVHETIQCEAVGRVADIIQIPAFLCRQTDLLVAAAKTGKIINIKKGQFCAPSVMANSAEKVRLAGNPNVMVCERGTMFGYNDLIVDPRNLEWMREANCPIVADITHSLQQPAGKKLDGGGVASGGLRELIPCIARTAVAVGVDGIFMEVHDDPLNAPVDGPTQWPLRHLKELLEELVAIAKVSKGKKQFKIDLTPFRE

SEQ ID NO: 23247 - protein, 290 aa, Cajanus cajan
MDPSPLLFSHLKGAEPFFLLAGPNVIESEEHIMRMAKNIKSIASEVGIPLVFKSSFDKANRTSSKSFRGPGMAEGLKILEKVKIAYDIPIVTDVHETIQCEAVGRVADIIQIPAFLCRQTDLLVAAAKTGKIINIKKGQFCAPSVMSNSAEKVRLAGNPNVMVCERGTMFGYNDLIVDPRNLEWMREANCPIVADITHSLQQPAGKKLDGGGVASGGLRELIPCIARTAVAVGVDGIFMEVHDDPLNAPVDGPTQWPLRHLKELLEELVAIARVSKGKQRFNIDLTPFRE

SEQ ID NO: 23248 - protein, 291 aa, Glycine max
MDPSAALLFNHLKGADPFFLLAGPNVIESEEHILRMAKNIKSVASEVGIPLVFKSSFDKANRTSSKSFRGPGMAEGLKILEKVKIAYDIPIVTDVHETIQCEAVGRVADIIQIPAFLCRQTDLLVAAAKTGKIINIKKGQFCAPSVMTNSAEKVRLAGNPNVMVCERGTMFGYNDLIVDPRNLEWMREANCPIVADITHSLQQPAGKMLDGGGVASGGLRELIPCIARTAVAVGVDGIFMEVHDDPLNAPVDGPTQWPLRHFKELLEELVAIARVSKGKQRFNIDLTPFRE

SEQ ID NO: 23249 - protein, 291 aa, Glycine max
MDPSAALLFNHLKGADPFFLLAGPNVIESEEHILRMAKNIKTIASEVGIPLVFKSSFDKANRTSSKSFRGPGMVEGLKILEKVKIAYDIPIVTDVHESIQCEAVGRVADIIQIPAFLCRQTDLLVAAAKTGKIINIKKGQFCAPSVMTNSAEKVRLAGNPNVMVCERGTMFGYNDLIVDPRNLEWMREANCPIVADITHSLQQPAGKKLDGGGVASGGLRELIPCIARTAVAVGVDGIFMEVHDDPLKAPVDGPTQWPLRHFKELLEELVAIARISKGKQRFNIDLTPFRE

SEQ ID NO: 23250 - protein, 289 aa, Lupinus angustifolius
MDPATLFSTLKGAEPFFLLAGPNVIESEEHIMRMAKHIKTIASKVGIPLVFKSSFDKANRTSSKSFRGPGMAEGLKILEKVKIAYDIPIVTDVHESIQCEPVGKVADIIQIPAFLCRQTDLLVAAAKTGKIINIKKGQFCAPSVMANSAEKVRLAGNPNVMVCERGTMFGYNDLIVDPRNLEWLREANCPVVADITHSLQQPAGKKLDGGGVASGGLRELIPCIARTAVAVGVDGIFMEVHDDPLNAPVDGPTQWPLRHFEELLEELVAISRVSKGKQQFNIDLTPFRE

SEQ ID NO: 23251 - protein, 290 aa, Lotus japonicus
MDPSALLYSQLKAAEPFFLLAGPNVIESEEHIMRMAKHIKSIATKVGIPLVFKSSFDKANRTSSKSFRGPGMVEGLKILGKVKIAYDIPIVTDVHEASQCEAVGRVADIIQIPAFLCRQTDLLVAAAKTGKIINIKKGQFCAPSVMENSAEKVRLAGNPNVMVCERGTMFGYNDLIVDPRNLEWMREANCPVVADITHSLQQPAGKKLDGGGVASGGLRELIPCIARTAVAVGVDGIFMEVHDDPLSAPVDGPTQWPLRHLEQLLEELVAISRVSKGKQQFNIDLTPFRE

SEQ ID NO: 23252 - protein, 290 aa, Arachis hypogaea
MDPPSMLYSQLKAAEPFFLLAGPNVIESEEHIMKMAKHIKTITSKVGIPLVFKSSFDKANRTSSKSFRGPGMVEGLKILEKVKVAYDLPIVTDVHESIQCEAVGRVADIIQIPAFLCRQTDLLVAAAKTGKIVHIKKGQFCAPSVMANSAEKVRLAGNPNVMVCERGTMFGYNDLIVDPRNLEWMREANCPIVADITHSLQQPAGKKLDGGGVASGGLRELIPCIARTAVAVGVDGIFMEVHDDPLNAPVDGPTQWPLRHLEELLEELVAIARVSKGKKKFNIDLTPFRE

SEQ ID NO: 23253 - protein, 289 aa, Trifolium pratense
MDPSLLYNQLKAADPFFLLAGPNVIESEEHIMRMAKHIKIISSKFGIPLVFKSSFDKANRTSSKSFRGPGMVEGLKILEKVKIAYDLPIVTDVHEAIQCEPVGKVADIIQIPAFLCRQTDLLVAAAKTGKIINIKKGQFCAPSVMANSAEKVRLAGNPNVMVCERGTMFGYNDLIVDPRNLEWMREANCPIVADITHSLQQPAGKKLDGGGVASGGLRELIPCIARTSVAVGVDGIFMEVHDDPLNAPVDGPTQWPLRHLEELLEELIAISRVSKGKKPFKIDLTPFRE

SEQ ID NO: 23254 - protein, 290 aa, Cicer arietinum
MDPSALLYKQLKGANPFFLLAGPNVIESEEHIMRMAKHIKTISSKFGIPLVFKSSFDKANRTSSKSFRGPGMVEGLKILEKVKIAYDIPIVTDVHEAAQCEPVGKVADIIQIPAFLCRQTDLLVAAAKTGKIINIKKGQFCAPSVMANSAEKVRLAGNPNVMVCERGTMFGYNDLIVDPRNLEWMREANCPVVADITHSLQQPAGKKLDGGGVASGGLRELIPCIARTSVAVGVDGIFMEVHDDPLNAPVDGPTQWPLRHLEELLEELIAISRVSKGKKQFNIDLTPFHE

SEQ ID NO: 23255 - protein, 290 aa, Castanea mollissima
MESSAQLFNQLKAADPFFLLAGPNVIESEEHIFRMAKHIKTIASKVGLPLVFKSSFDKANRTSSKSFRGPGMVEGLKILEKVKLAYDIPIVTDVHETIQCEAVGRVADIIQIPAFLCRQTDLLVAAAKTGKIVNIKKGQFCAPSVMVNSAEKIRLAGNPNVMVCERGTMFGYNDLIVDPRNFEWMREANSPVVADVTHALQQPAGKKLDGGGVASGGLRELIPCIARTAVAVGVDGIFMEVHDDPLNAPVDGPTQWPLRNLEELLEELVAIARVSKGKQHLNIDLTPFRD

SEQ ID NO: 23256 - protein, 290 aa, Pisum sativum
MDPSVLLYNQLKAADPFFLLAGPNVIESEEHIMRMAKHIKTISSKFGIPLIFKSSFDKANRTSSKSFRGPGIVEGLKILEKVKIAYDIPIVTDVHEASQCEPVGRVADIIQIPAFLCRQTDLLVAAAKTGKIINIKKGQFCAPSVMANSAEKVRLAGNPNVMVCERGTMFGYNDLIVDPRNLEWMREANCPVVADITHSLQQPAGKKLDGGGVASGGLRELIPCIARTSVAVGVDGIFMEVHDDPLNAPVDGPTQWPLRHLEELLEELIAISRVSKGKKPFNIDLTPFRE

SEQ ID NO: 23257 - protein, 290 aa, Quercus alba
MESSALLFNQLKAADPFFLLAGPNVIESEEHIFRMAKHIKTIAAKVGLPLVFKSSFDKANRTSSKSFRGPGMVEGLKMLEKVKLAYDIPIVTDVHETIQCEAVGRVADIIQIPAFLCRQTDLLVAAAKTGKIVNIKKGQFCAPSVMVNSAEKIRLAGNPNVMVCERGTMFGYNDLIVDPRNFEWMREANSPVVADVTHALQQPAGKKLDGGGVASGGLRELIPCIARTAVAVGVDGIFMEVHDDPLNAPVDGPTQWPLRNLEELLEELVAIARVSKGKQHLNIDLTPFRD

SEQ ID NO: 23258 - protein, 290 aa, Euonymus alatus
MESSALLFQHLKTAEPFFLLAGPNVIESEEHILRMAKHMKHVAAKVGLPLVFKSSFDKANRTSSKSFRGPGMAEGLKILEKVKIAYDIPIVTDVHESIQCEAVGRVADIIQIPAFLCRQTDLLVAAAKTGKIINIKKGQFCAPSVMVNSAEKVRLAGNSNVMVCERGTMFGYNDLIVDPRNLEWMREANCPVVADITHSLQQPAGKKLDGGGVASGGLRELIPCIARTAVAVGVDGIFMEVHDDPLNAPVDGPTQWPLRNLEELLQELVAIARVSKGKKRMNIDLTPFHD

SEQ ID NO: 23259 - protein, 290 aa, Citrus clementina
  Sequence also found in Organisms: Citrus sinensis
MDPSTALFNQLKAAEPFFLLAGPNVIESEEHIMRMAKHIKSISTKVGLPLVFKSSFDKANRTSSKSFRGPGMVEGLKILEKVKIAYDIPIVTDVHETVQCEEVGKVADIIQIPAFLCRQTDLLVAAAKTGKIINIKKGQFCASSVMVNSAEKVRLAGNPNVMVCERGTMFGYNDLIVDPRNLEWMREANCPVVADVTHSLQQPAGKKLDGGGVASGGLRELIPCIARTAIAVGVDGVFMEVHDDPLNAPVDGPTQWPLRNLEELLEELVAIAKVSKGKQRMNIDLTPFRD

SEQ ID NO: 23260 - protein, 290 aa, Euonymus alatus
MDSSALLFEQLKKAEPFFLLAGPNVIESEEHILKMAKHIKHVAAKVGLPLVFKSSFDKANRTSSKSFRGPGMTEGLKILEKVKIAYDIPIVTDVHESIQCEAVGQVADIIQIPAFLCRQTDLLVAAAKTGKIVNIKKGQFCASSVMANSAEKVRLAGNPNVMVCERGTMFGYNDLIVDPRNLEWMREANCPVVADITHSLQQPAGKKLDGGGVASGGLRELIPCIARTAVAVGVDGIFMEVHDDPLNAPVDGPTQWPLRNLEELLQELVAIARVSKGKKQMNIDLTPFHD

SEQ ID NO: 23261 - protein, 290 aa, Theobroma cacao
MDTSSVLFNQLKGAEPFFLLAGPNVIESEDHILRMAKHIKTIATKLGLPLVFKSSFDKANRTSSKSFRGPGMAEGLKILEKVKVAYDIPIVTDIHETIQCEPVGRVADIIQIPAFLCRQTDLLVAAAKTGRIINIKKGQFCAPSVMVNSAEKIRLAGNPNVMVCERGTMFGYNDLIVDPRNLEWMREANCPVVADITHSLQQPAGRKLDGGGVASGGLRELIPCIARTAVAVGVDGIFMEVHDNPLNAPVDGPTQWPLRHLEELLEELMAIARVSKGKQRFNIDLTPYHD

SEQ ID NO: 23262 - protein, 290 aa, Medicago truncatula
MDPSALLYNQLKAAHPFFLLAGPNVIESEEHIMKMAKHIKAISSKFGIPLVFKSSFDKANRTSSKSFRGPGMVEGLKILEKVKVAYDIPIVTDVHEASQCEAVGRVADIIQIPAFLCRQTDLLVAAAQTGKIINIKKGQFCAPSVMANSAEKVRLAGNPNVMVCERGTMFGYNDLIVDPRNLEWLREANCPVVADITHSLQQPAGKKLDGGGVASGGLRELIPCIARTSVAVGVDGIFMEVHDDPLSAPVDGPTQWPLRHLEELLEELIAISRVSKGKKPFNIDLTPFRE

SEQ ID NO: 23263 - protein, 290 aa, Panax ginseng
MDSSTVLFNQLKSAEPFFLLAGPNVIESEEHILRMAKHIKAITSKLGLPLVFKSSFDKANRTSSKSFRGPGLAEGLKILEKVKVAYDLPIVTDVHEANQCDAVGQVADIIQIPAFLCRQTDLLVAAAQTGKIINIKKGQFCAPSVMTNSAEKVRLSGNQNVMVCERGTMFGYNDLIVDPRNLEWMREANCPIVADITHSLQQPAGKKLEGGGVASGGLRELIPCIARTAVAVGVDGIFMEVHDDPLNAPVDGPTQWPLRHLEELLEELVAIARVTKGKQQFKIDLTPFRD

SEQ ID NO: 23264 - protein, 290 aa, Euonymus alatus
MESSALLFQHLKTAEPFFLLAGPNVIESEEHILRMAKHMKHVAAKVGLPLIFKSSFDKANRTSSKSFRGPGMTEGLKILEKVKIAYDIPIVTDVHESIQCEAVGRVADIIQIPAFLCRQTDLLVAAAETGKIINIKKGQFCAPSVMVNSAEKVRLAGNSNVMVCGRGTMFGYNDLIVDPRNLEWMREANCPVVADITHSLQQPAGKKLDGGGVASGGLRELIPCIARTAVAVGVDGIFMEVHDDPLNAPVDGPTQWPLRNLEELLQELVAIARVSKGKKRMNIDLRPFHD

SEQ ID NO: 23265 - protein, 290 aa, Brassica rapa
MAATSPLYNQLKDAEPFFLLAGPNVIESEEHILRMAKHIKHIATKVGLPLVFKSSFDKANRTSSKSFRGPGMAEGLKILEKVKVAYDLPIVTDVHESIQCEEVGKVADIIQIPAFLCRQTDLLVAAAQTGKIINIKKGQFCAPSVMNNSAEKIRLAGNPNVMVCERGTMFGYNDLIVDPRNFEWMREANCPVVADITHALQQPAGKKLEGGGVASGGLRELIPCIARTAVAVGVDGIFMEVHDDPLSAPVDGPTQWPLRHLEELLEELIAIARVTKGKQQFQIDLTPFRD

SEQ ID NO: 23266 - protein, 289 aa, Cucurbita pepo
MESSLLFNQLQAAEPFFLLAGPNVIESEEHIFRMAKHIKNISSKFGLPLVFKSSFDKANRTSAKSFRGPGMVEGLKILEKVKLAYDIPIVTDVHETIQCEAVGKVADIIQIPAFLCRQTDLLVAAAKTGRIINIKKGQFCAPSVMKNSAEKIRMAGNSNVMVCERGTMFGYNDLIVDPRNLEWMREANCPVVADITHSLQQPAGRQLGDGGVASGGLRELIPCIARTAVAVGVDGIFMEVHDDPMNAPVDGPTQWPLRHLEELLEELVAIARASKGKQHFNIDLTPFRE

SEQ ID NO: 23267 - protein, 290 aa, Eutrema halophilum
MAATSPLYNQLKAAEPFFLLAGPNVIESEEHILRMAKHIKDIATKIGLPLVFKSSFDKANRTSSKSFRGPGMAEGLKILEKVKVAYDLPIVTDVHESIQCEAVGKVADIIQIPAFLCRQTDLLVAAAQTGKIINIKKGQFCAPSVMENSAEKVKLAGNPNVMVCERGTMFGYNDLIVDPRNFEWMREANCPVVADITHALQQPAGKKLEGGGVASGGLRELIPCIARTAVAVGVDGIFMEVHDDPLSAPVDGPTQWPLRHLEELLEELIAIARVTKGKQRFQIDLTPYRE

SEQ ID NO: 23268 - protein, 290 aa, Eucalyptus grandis
MESSALLFNQLKAADPFFLLAGPNVIESEEHVLYMAKHIKSVAAKVGLPLVFKSSFDKANRTSSKSFRGPGMAEGLKILEKVKATYDIPIVTDVHETIQCEAVGRVADIIQIPAFLCRQTDLLVAAAKTGKIINIKKGQFCASSVMANSAEKIRLAGNPHVMVCERGTMFGYNDLIVDPRNLEWMREANCPVVADVTHALQQPAGRKLEGGGVASGGLRELIPCIARTAVAVGVDGLFMEVHNDPLNSPVDGPTQWPLRHLEELLEELVAIARASKGKQQLKIDLTPYHL

SEQ ID NO: 23269 - protein, 290 aa, Allium cepa
MDSSTDLYNMLKGAEPFFLLAGPNVIESEEHVLKMAKHIKDVTSKLGVPLVFKSSFDKANRTSSKSFRGPGLEEGLKILEKVKVAYDLPIVTDVHESSQCEAVGRVADIIQIPAFLCRQTDLLVAAAKTGKIINIKKGQFCAPSVMVNSAEKVRLAGNPNVMVCERGTMFGYNDLIVDPRNFEWMREANCPIVADVTHSLQQPAGKKLDGGGVASGGLRELIPCIARTSVVVGVDGIFMEVHDDPLNAPVDGPTQWPLRHLEELLEELIAIARVTKGKRPFKIDLTPYED

SEQ ID NO: 23270 - protein, 289 aa, Citrullus lanatus
MESSLLFNQLRAAEPFFLLAGPNVIESEEHIFRMAKHIKNISSKFGLPLVFKSSFDKANRTSAKSFRGPGMVEGLKILEKVKLAYDIPIVTDVHETIQCEPVGKVADIIQIPAFLCRQTDLLVAAAKTGRIINIKKGQFCAPSVMKNSAEKIRMAGNSNVMVCERGTMFGYNDLIVDPRNLEWMREANCPVVADITHSLQQPAGRQLGDGGVASGGLRELIPCIARTAVAVGVDGIFMEVHDDPLNAPVDGPTQWPLRHLEELLEELVAIARASKGKQRFNIDLTPFHE

SEQ ID NO: 23271 - protein, 290 aa, Brassica juncea
  Sequence also found in Organisms: Brassica rapa
MAATSPLYNQLKDAEPFFLLAGPNVIESEDHILRMAKHIKHIATKVGLPLVFKSSFDKANRTSSKSFRGPGMAEGLKILEKVKVAYDLPIVTDVHEAYQCEEVGKVADIIQIPAFLCRQTDLLVAAAQTGKIINIKKGQFCAPSVMENSAEKIRLAGNPNVMVCERGTMFGYNDLIVDPRNFEWMREANCPVVADITHALQQPAGKKLEGGGVASGGLRELIPCIARTAVAVGVDGIFMEVHDDPLSAPVDGPTQWPLRHLEELLEELIAIARVTKGKQRFQIDLTPYRD

SEQ ID NO: 23272 - protein, 290 aa, Brassica oleracea
MAATSPLYNQLKDAEPFFLLAGPNVIESEEHILRMAKHIKHIATKVGLPLVFKSSFDKANRTSSKSFRGPGMAEGLKILEKVKVAYDLPIVTDVHESIQCEEVGKVADIIQIPAFLCRQTDLLVAAAQTGKIINIKKGQFCAPSVMNNSAEKIRLAGNPNVMVCERGTMFGYNDLIVDPRNFEWMREANCPVVADITHALQQPAGKKLEGGGVASGGLRELIPCIARTAVAVGVDGIFMEVHDDPLSAPVDGPTQWPLRHLEELLEELIAIARVTKGKQRFQIDLTPYRD

SEQ ID NO: 23273 - protein, 290 aa, Brassica napus
MAATSPLYNKLKDAEPFFLLAGPNVIESEEHILRMAKHIKHIATKVGLPLVFKSSFDKANRTSSKSFRGPGMAEGLKILEKVKVAYDLPIVTDVHESIQCEEVGKVADIIQIPAFLCRQTDLLVAAAQTGKIINIKKGQFCAPSVMNNSAEKIRLAGNPNVMVCERGTMFGYNDLIVDPRNFEWMREANCPVVADITHALQQPAGKKLEGGGVASGGLRELIPCIARTAVAVGVDGIFMEVHDDPLSAPVDGPTQWPLRHLEELLEELIAIARVTKGKQRFQIDLTPYRD

SEQ ID NO: 23274 - protein, 290 aa, Arabidopsis thaliana
MAATSLLYNQLKAAEPFFLLAGPNVIESEEHILRMAKHIKDISTKVGLPLVFKSSFDKANRTSSKSFRGPGMAEGLKILEKVKVAYDLPIVTDVHESSQCEAVGKVADIIQIPAFLCRQTDLLVAAAQTGKIINIKKGQFCAPSVMENSAEKIRLAGNPNVMVCERGTMFGYNDLIVDPRNFEWMREANCPVVADITHSLQQPAGKKLDGGGVASGGLRELIPCIARTAVAVGVDGIFMEVHDDPLSAPVDGPTQWPLRHLEELLEELIAIARVTKGKQRLQIDLTPYRD

SEQ ID NO: 23275 - protein, 290 aa, Triphysaria pusilla
MDSSALLYNQLKAAEPFFVLAGPNVIESEEHVLYMAKHIKAITSKLGLPLVFKSSFDKANRTSSKSFRGPGLEEGLKILEKVKTTYDIPIVTDVHESSQCEAVGRVADIIQIPAFLCRQTDLLVAAAKTGKIINIKKGQFCAPSVMANSAEKIRMAGNENVMVCERGTMFGYNDLIVDPRNLEWMREANCPIVADITHSLQQPAGRKLEGGGVASGGLRELIPCIARTAVAVGVDGIFMEVHDDPLSAPVDGPTQWPLRHFEELLEELIAIARVSKGKQQFQINLTPFRP

SEQ ID NO: 23276 - protein, 290 aa, Triphysaria pusilla
MDSSAMLYNQLKAAEPFFVLAGPNVIESEEHVLYMAKHIKAITSKLGLPLVFKSSFDKANRTSSKSFRGPGLEEGLKILEKVKTTYDIPIVTDVHESSQCEAVGRVADIIQIPAFLCRQTDLLVAAAKTGKIINIKKGQFCAPSVMANSAEKIRMAGNENVMVCERGTMFGYNDLIVDPRNLEWMREANCPIVADITHSLQQPAGRKLEGGGVASGGLRELIPCIARTAVAVGVDGIFMEVHDDPLSAPVDGPTQWPLRHFEELLEELIAIARVSKGKQQFQIDLTPFRP

SEQ ID NO: 23277 - protein, 289 aa, Cucumis sativus
MESSLLFNQLRAAEPFFLLAGPNVIESEEHIFRMAKHIKNISSKFGLPLVFKSSFDKANRTSAKSFRGPGMVEGLKILEKVKLAYDIPIVTDVHESIQCEAVGKVADIIQIPAFLCRQTDLLVAAAKTGRIINIKKGQFCAPSVMTNSAEKIRMAGNSNVMVCERGTMFGYNDLIVDPRNLEWMRETNCPVVADITHSLQQPAGRQLGDGGVASGGLRELIPCIARTAVAVGVDGIFMEVHDDPLNAPVDGPTQWPLRHLEALLEELVAIARVSKGKQRFNIDLTPFRD

SEQ ID NO: 23278 - protein, 289 aa, Cucumis melo
MESSLLFNQLRAAEPFFLLAGPNVIESEEHIFRMAKHIKNISSKFGLPLVFKSSFDKANRTSAKSFRGPGMVEGLKILEKVKLAYDIPIVTDVHESIQCEAVGKVADIIQIPAFLCRQTDLLVAAAKTGRIINIKKGQFCAPSVMTNSAEKIRMAGNSNVMVCERGTMFGYNDLIVDPRNLEWMREANCPVVADITHSLQQPAGRQLGDGGVASGGLRELIPCIARTAVAVGVDGIFMEVHDDPLNAPVDGPTQWPLRNLEALLEELVAIARVSKGKQRFNIDLTPFRD

SEQ ID NO: 23279 - protein, 290 aa, Arabidopsis lyrata
MAATSPLYNQLKAAEPFFLLAGPNVIESEEHILRMAKHIKDISTKVGLPLIFKSSFDKANRTSSKSFRGPGMAEGLKILEKVKVAYDLPIVTDVHESSQCEAVGKVADIIQIPAFLCRQTDLLVAAAHTGKIINIKKGQFCAPSVMENSAEKIRLAGNPNVMVCERGTMFGYNDLIVDPRNFEWMREANCPVVADITHSLQQPAGKKLDGGGVASGGLRELIPCIARTAVAVGVDGIFMEVHDDPLSAPVDGPTQWPLRHLEELLEELIAIARVTKGKQRLQIDLTPYRD

SEQ ID NO: 23280 - protein, 290 aa, Brassica napus
  Sequence also found in Organisms: Brassica oleracea
MAATSPLYNQLKDAEPFFLLAGPNVIESEEHILRMAKHIKHIATKVGLPLVFKSSFDKANRTSSKSFRGPGMAEGLKILEKVKVAYDLPIVTDVHEAYQCEEVGKVADIIQIPAFLCRQTDLLVAAAQTGKIINIKKGQFCAPSVMENSAEKIRLAGNPNVMVCERGTMFGYNDLIVDPRNFEWMREANCPVVADITHALQQPAGKKLEGGGVASGGLRELIPCIARTAVAVGVDGIFMEVHDDPLSAPVDGPTQWPLRHLEELLEELIAIARVTKGKQRFQIDLTPYRD

SEQ ID NO: 23281 - protein, 290 aa, Ocimum basilicum
MDSSALLFNQLKAAEPFFLLAGPNVIESEEHILYMAKNIKSIASKLGLPLVFKSSFDKANRTSSKSFRGPGLAEGLKILEKVKTTYDIPIVTDVHESAQCEAVGKVADIIQIPAFLCRQTDLLVAAAKTGKIINIKKGQFCAPSVMVNSAEKIRMAGNENVMVCERGTMFGYNDLIVDPRNLEWLREANCPVVADITHSLQQPAGKKLEGGGVASGGLRELIPCIARTAVAVGVDGIFMEVHDDPLKAPVDGPTQWPLRHLEELLEELIAISRVTKGKKQFNIDLTPFQP

SEQ ID NO: 23282 - protein, 290 aa, Daucus carota
MDSASELYNHLKSVEPFFVLAGPNVIESEEHIFRMAEHIKAITSKLGLPLIFKSSFDKANRTSSKSFRGPGLAEGLKILEKVKLAYDLPIVTDVHEASQCDAVGQVADIIQIPAFLCRQTDLLVAAAQTGKIINIKKGQFCAPSVMTNSAEKVRLAGNQNVMVCERGTMFGYSDLIVDPRNLEWMREANCPIVADITHSLQQPAGKKLEGGGVASGGLRELIPCIARTAVAVGVDGIFMEVHDDPLSAPVDGPTQWPLRHLEELLEELVAIARVTKGKQQFKIDLTPFRD

SEQ ID NO: 23283 - protein, 290 aa, Daucus carota
MDSSALLYNKLKSAEPFFVLAGPNVIESEEHVLSMASHIKTITSKLGLPLVFKSSFDKANRTSSKSFRGPGLAEGLKILEKVKLAYDLPIVTDVHEASQCDAVGQVADIIQIPAFLCRQTDLLVAAAQTGKIINIKKGQFCAPSVMTNSAEKVRLAGNQNVMVCERGTMFGYSDLIVDPRNLEWMREADCPIVADITHSLQQPAGKKLEGGGVASGGLRELIPCIARTAVAVGVDGIFMEVHDDPLSAPVDGPTQWPLRHLEELLEELVAIARVTKGKQQFKIDLTPFRD

SEQ ID NO: 23284 - protein, 290 aa, Gossypium hirsutum
MDSSASLLNKLMGADPFFLLAGPNVIESEDHILRMAGYIKTITTKLGLPLVFKSSFDKANRTSSKSFRGPGMAEGLQILEKVKVAYDIPIVTDVHETIQCEAVGRVADVIQIPAFLCRQTDLLVEAAKTGRIINIKKGQFCAPSVMVNSAEKIRLAGNPNVMVCERGTMFGYNDLIVDPRNLEWMREANCPVVADITHSLQQPAGRKLDGGGVASGGFRELIPCIARTAVAVGVDGIFMEVHDNPLNAPVDGPTQWPLRHLEELLEELIAIAGVSKGKKRFNIDLTPYSG

SEQ ID NO: 23285 - protein, 290 aa, Petroselinum crispum
MDSASELYNQLKSAEPFFILAGPNVIESEEHIFRMAKHIKAITSKHGLPLIFKSSFDKANRTSSKSFRGPGLAEGLKILEKVKLAYDLPIVTDVHEVSQCDAVGQVADIIQIPAFLCRQTDLLVAAAQTGKIINIKKGQFCAPSVMTNSAEKVRLAGNQNVMVCERGTMFGYSDLIVDPRNLEWMREANCPIVADITHSLQQPAGKKLEGGGVASGGLRELIPCIARTAVAVGVDGIFMEVHDDPLNAPVDGPTQWPLRHLEELLVELVEIARVTKGKQQFKIDLTPFRD

SEQ ID NO: 23286 - protein, 293 aa, Aristolochia fimbriata
MEPSLLFNQLKAAEPFFLLAGPNVIESEEHILRMAKHIKGITSKLGLPLVFKSSFDKANRTSSKSFRGPGMEEGLKILEKVKVAYDLPIVTDVHETSQCEPVGRIADIIQIPAFLCRQTDLLVAAAKTGKIVNIKKGQFCAPSVMVNSAEKIRLAGNGNVMVCERGTMFGYNDLIVDPRNLEWMREANCPVVADVTHSLQQPAGKKLDGGGVASGGLRELIPCIARTAVAVGVDGLFMEVHDDPTNAPVDGPTQWPLRHLEELLEELMAIARVSKGKKQMKIDLTPFRAPEES

SEQ ID NO: 23287 - protein, 290 aa, Amsonia hubrichtii
MDAPTALYNQLKTANPFFIMAGPNVIESEEHIFYMAKHIKAITDKLGLPLVFKSSFDKANRTSSKSFRGPGLTQGLKILEKVKAAYDIPIVTDVHETIQCEAVGQVADIIQIPAFLCRQTDLLVAAAQTGKIINIKKGQFCASSVMLNSAEKVRLAGNQNVMVCERGTMFGYNDLIVDPRNLEWMREANCPVVADVTHSLQQPAGKKLEGGGVASGGLRELIPCIARTAVAVGVDGIFMEVHNDPLNAPVDGPTQWPLRHLKELLEELISIAKASKGKQQFKIDLTPFLD

SEQ ID NO: 23288 - protein, 290 aa, Catharanthus roseus
MDASTALFNQLKNADPFFLMAGPNVIESEEHVFYMAKHIKAIAAKLGLPLVFKSSFDKANRTSSKSFRGPGLSQGLKILEKVKVAYDIPIITDVHETIQCEAVGQVADIIQIPAFLCRQTDLLVAAAQTGKIINIKKGQFCAPSVMLNSAEKVRLAGNQNIMVCERGTMFGYNDLIVDPRNLEWMREANCPVVADVTHSLQQPAGKKLEGGGVASGGLRELIPCIARTAVAVGVDGIFMEVHNDPLNAPVDGPTQWPLRHLEELLEELISIANASKGKQQFKIDLTPFLD

SEQ ID NO: 23289 - protein, 290 aa, Flaveria ramosissima
MDSSTALFNQLKEAQPFFVLAGPNVIESEEHILHMAKQIKAVTSKLGLPLVFKSSFDKANRTSSKSFRGPGLAEGLKILEKVKTTYDLPIVTDVHESDQCEAVGRVADIIQIPAFLCRQTDLLVAAAKTGKIVNIKKGQFCAPSVMTNSAEKVRLAGNQNVMVCERGTMFGYNDLIVDPRNFEWMREANCPVVADVTHALQQPAGKKLEGGGVASGGLRELIPCIARTAVAVGVDGLFMEVHDDPLNAPVDGPTQWPLRHFEELLEELMAIARVTKGKQQYKIDLTPFRE

SEQ ID NO: 23290 - protein, 290 aa, Gossypium raimondii
MDSSASLLNKLMGADPFFLLAGPNVIESEDHILRMAGYIKTITTKLGLPLVFKSSFDKANRTSSKSFRGPGMAEGLQILEKVKVAYDIPIVTDVHETIQCEAVGRVADVIQIPAFLCRQTDLLVEAAKTGRIINIKKGQFCAPSVMINSAEKIRLAGNLNVMVCERGTMFGYNDLIVDPRNLEWMREANCPVVADITHSLQQPAGRKLDGGGVASGGFRELIPCIARTAVAVGVDGIFMEVHDNPLNAPVDGPTQWPLRHLEELLEELIAIARVSKGKKRFNIDLTPYSG

SEQ ID NO: 23291 - protein, 290 aa, Raphanus sativus
MAATSPLYNQLKDAEPFFLLAGPNVIESEEHILRMAKHIKHIATKVGLPLVFKSSFDKANRTSSKSFRGPGMAEGLKILEKVKVAYDLPIVTDVHEAYQCEEVGKVADIIQIPAFLCRQTDLLVAAAQTGKIINIKKGQFCAPSVMENSAEKIRLAGNPNVMVCERGTMFGYNDLIVDPRNFEWMREANCPVVADITHALQQPAGKKLEGGGVASGGLRELIPCIARTAVAVGVDGIFMEVHDDPLSAPVDGPTQWPLRHLEELLEELITIARVTKGKQRFQIDLTPYRD

SEQ ID NO: 23292 - protein, 290 aa, Fragaria vesca
MESPALLYNQLKTAEPFFLLAGPNVIESEEHIFRMAKHIKTIATKVGLPLVFKSSFDKANRTSSKSFRGPGMAEGLKILEKVKLAYDLPIVTDVHESIQCEEVGKVADIIQIPAFLCRQTDLLVAAAKTGKIVNIKKGQFCAPSVMVNSAEKVRLAGNPNVMVCERGTMFGYNDLIVDPRNLEWIREANCPVVADVTHALQQPAGRKLDDGGVASGGLRELIPCIARTAVAVGVDGIFMEVHDDPSNAPVDGPTQWPLRHLEELLVELIAIARVSKGKQRFNIDLSPYRD

SEQ ID NO: 23293 - protein, 292 aa, Amorphophallus konjac
MDASTALFNQLKVAEPFFLLAGPNVIESEEHVLKMAKHIKSIASKLGLPLVFKSSFDKANRTSSKSFRGPGLVEGLKILEKVKIAYDIPIITDVHEASQCEPVGRVADIIQIPAFLCRQTDLLVAAAKTGRIINIKKGQFCSPSVMVNSAEKVRLAGNQNVMVCERGTMFGYNDLIVDPRNLEWMREANCPVVADVTHSLQQPAGKKLEGGGVASGGLRELIPCIARTCIAVGVDGIFMEVHDDPLSAPVDGPTQWPLRHLEELLGELISIAKASKGKQPFKIDLTPFGKSV

SEQ ID NO: 23294 - protein, 290 aa, Cichorium intybus
MDSSTALYNQLKGAQPFFVLAGPNVIESEEHILHMAKQIKAVTSKLGLPLVFKSSFDKANRTSSKSFRGPGLAEGLKILEKVKATYDLPIVTDVHESSQCEAVGRVADIIQIPAFLCRQTDLLVAAAKTGKIVNIKKGQFCASSVMTNSAEKVRLAGNQNVMVCERGTMFGYNDLIVDPRNFEWMREANCPVVADVTHALQQPAGKKLEGGGVASGGLRELIPCVARTAVAVGVDGLFMEVHDDPLNAPVDGPTQWPLRHLEELLEELVAIARVSKGKKKFKIDLTPFRG

SEQ ID NO: 23295 - protein, 290 aa, Vitis vinifera
MDSSTMLYNQLKSSEPFFLLAGPNVIESEEHIMYMAKAIKSLTSKFGLKLVFKSSFDKANRTSSKSFRGPGMIEGLKILEKVKVAYDIPIVTDVHEIEQCEPVGRVADIIQIPAFLCRQTDLLVAAAKTGKIINIKKGQFCAPSVMVNSAEKIRLAGNENVMVCERGTMFGYNDLIVDPRNLEWMREANCPIVADVTHSLQQPAGRKLEGGGVASGGLRELIPCIARTAVAVGVDGIFMEVHNDPLNAPVDGPTQWPLRHLEELLEELVAIARVSKGKQRFNIDLTPVHD

SEQ ID NO: 23296 - protein, 290 aa, Tropaeolum majus
MDSSTLLYNQLKAAEPFFLLAGPNVIESEEHVLQMAKQIKNITTKLGVPLVFKSSFDKANRTSSKSFRGPGMMEGLKILEKVKTVYDIPIVTDVHETIQCEAVGRVADIIQIPAFLCRQTDLLVAAAKTGKIINIKKGQFCAPSVMVNSAEKVKLAGNSNVMVCERGTMFGYNDLIVDPRNLEWLREAHCPVVADITHSLQQPAGKQLDGGGVASGGLRELIPCIARTAVAVGVDGLFMEVHNDPLNAPVDGPTQWPLRHLEELLEELIALARVSKGKQPFNIDLTPSDI

SEQ ID NO: 23297 - protein, 290 aa, Elaeis guineensis
MESSVALYNQLKAAEPFFLLAGPNVIESEEHILYMAKHIKDVTSKLGVPLVFKSSFDKANRTSSKSFRGPGLEEGLKILEKVKLTYDLPIVTDVHESSQCEAVGRVADIIQIPAFLCRQTDLLVAAAKTGKIINIKKGQFCAPSVMLNSAEKVRLAGNQNVMVCERGTMFGYNDLIVDPRNLEWMREANCPVVADITHSLQQPAGKKLEGGGVASGGLRELIPCIARTAVAVGVDGIFMEVHDNPLKAPVDGPTQWPLRHLEELLEELIAIASVSKGKKPFKIDLTPYQD

SEQ ID NO: 23298 - protein, 290 aa, Prunus mume
MDASTVLYNQLKAAEPFFLLAGPNVIESEEHIFRMAKHIKHVATKVGLPLVFKSSFDKANRTSSKSFRGPGLTEGLKILEKVKVAYDIPIITDVHEASQCEEVGKVADIIQIPAFLCRQTDLLVAAAKTGKIINIKKGQFCAPSVMVNSAEKVRLAGNPNVMVCERGTMFGYNDLIVDPRNLEWIREANCPVVADVTHALQQPAGRKLDDGGVASGGLRELIPCIARTAVAVGVDGIFMEVHDDPSNAPVDGPTQWPLRHLEELLVELVAIARVSKGKQRFNIDLTPYRD

SEQ ID NO: 23299 - protein, 290 aa, Tragopogon dubius
MDSSTLLYNQLKEAQPFFVLAGPNVIESEEHILHMAKQIKTITSKLGLPLVFKSSFDKANRTSSKSFRGPGLAEGLKILEKVKMTYDLPIVTDVHESSQCEAVGRVADIIQIPAFLCRQTDLLVAAAKTGKIVNIKKGQFCAPSVMSNSAEKVRLAGNQNVMVCERGTMFGYNDLIVDPRNFEWLREANCPVVADVTHALRQPAGKKLEGGGVASGGLRELIPCVARTAVAVGVDGLFMEVHDDPLNAPVDGPTQWPLRHLEELLEELVAIARVTKGKQTYKIDLTPFRE

SEQ ID NO: 23300 - protein, 289 aa, Amborella trichopoda
MDSTALFNQLKAAEPFFLLAGPNVIESEAHVLKMAGHIKDITSKLGVQLVFKSSFDKANRTSSKSFRGPGLEEGLKILQKVKMTFDLPIVTDVHEASQCEPVGRVADIIQIPAFLCRQTDLLVAAAKTGKIVNIKKGQFCAPSVMVNSAEKVRLAGNQNVMVCERGTMFGYNDLIVDPRNLEWMREANCPVVADITHSLQQPAGKKLDGGGVASGGLRELIPCIARTSVAVGVDGIFMEVHDDPLNAPVDGPTQWPLCHLEELLEELIAISRVSKGKQPFKIDLTPFRG

SEQ ID NO: 23301 - protein, 289 aa, Plantago ovata
MDPAMLFNQLKTAEPFFVLAGPNVIESEEHILHMAKQIKAITSKLGLSLVFKSSFDKANRTSSKSFRGPGLEEGLKILEKVKMTYDLPIVTDVHESIQCEAVGRVADIIQIPAFLCRQTDLLVAAAKTGKIINIKKGQFCAPSVMANSAEKVRMAGNDNVMVCERGTMFGYNDLIVDPRNLEWMREANCPVVADITHSLQQPAGKKLEGGGVASGGLRELIPCIARTAVAVGVDGIFMEVHDNPLAAPVDGPTQWPLRHFEELLEELVAIAGVSKGKKKFEIDLTPYSL

SEQ ID NO: 23302 - protein, 291 aa, Eutrema halophilum
MADSSSLLYNQLKVAEPFFLLAGPNVIESEEHVLRMAKSIKDISTKLGLPLVFKSSFDKANRTSSKSFRGPGMAEGLKILEKVKVAYDLPIVTDVHESSQCEAVGKVADIIQIPAFLCRQTDLLVAAAQTGKIINIKKGQFCAPSVMGNSAEKIRLAGNPNVMVCERGTMFGYNDLIVDPRNLEWMREANCPVVADITHSLQQPAGKKLDGGGVASGGLRELIPCIARTAVAVGVDGIFMEVHDDPLSAPVDGPTQWPLRHLEELLEELIAIARVTKGKQRFQIDLTPYHD

SEQ ID NO: 23303 - protein, 290 aa, Malus domestica
MDSSVLLYNQLKATEPFFLLAGPNVIESEEHIFRMAEHIKSVATKVGLPLVFKSSFDKANRTSSKSFRGPGLEEGLKILEKVKTAYDLPIITDVHEASQCEAVGKVADIIQIPAFLCRQTDLLVAAAKTGKIINIKKGQFCAPSVMVNSAEKVRLAGNPNVMVCERGTMFGYNDLIVDPRNLEWIREANCPVVADVTHALQQPAGRKLDDGGVASGGLRELIPCIARTAVAVGVDGIFMEVHDDPSNAPVDGPTQWPLRHLEELLVELIAIARVSKGKQPFNIDLTPYRD

SEQ ID NO: 23304 - protein, 290 aa, Arnica chamissonis
MDSSTALYNQLKEAQPFFVLAGPNVIESEEHILHMAKQIKAVTSKLGLPLVFKSSFDKANRTSSKSFRGPGLAEGLKILEKVKTTYDLPIVTDVHESNQCEAVGRVADIIQIPAFLCRQTDLLVAAAKTGKIVNIKKGQFCAPSVMTNSAEKVRLAGNQNVMVCERGTMFGYNDLIVDPRNFEWMREANCPVVADITHALQQPAGKKLEGGGVASGGLRELIPCIARTAVAVGVDGLFMEVHDDPLNAPVDGPTQWPLRHFEELLEELMAIARVTKGKQQYNINLTPFRE

SEQ ID NO: 23305 - protein, 290 aa, Artemisia annua
MDSSTLLYNQLKEAKPFFVLAGPNVIESEEHIMYMAKQIKAVTTKLGLPLVFKSSFDKANRTSSKSFRGPGLAEGLKILEKVKMTYDLPIVTDVHEASQCEAVGRVADIIQIPAFLCRQTDLLVAAAKTGKIVNIKKGQFCASSVMTNSAEKVRLAGNQNVMVCERGTMFGYNDLIVDPRNFEWMREANCPVVADITHALQQPAGKKLEGGGVASGGLRELIPCVARTAVAVGVDGLFMEVHDDPLSAPVDGPTQWPLRHFEELLEELVAIARVTKGKQQFKIDLTPFRE

SEQ ID NO: 23306 - protein, 290 aa, Chrysanthemum coronarium
MDSSTLLYNHLKEAQPFFVLAGPNVIESEEHIMYMAKQIKAVTTKLGLPLVFKSSFDKANRTSSKSFRGPGLAEGLKILEKVKVTYDLPIVTDVHESSQCEAVGRVADIIQIPAFLCRQTDLLVAAAKTGKIVNIKKGQFCASSVMTNSAEKVRLAGNQNVMVCERGTMFGYNDLIVDPRNFEWMREANCPVVADITHALQQPAGKKLEGGGVASGGLRELIPCIARTAVAVGVDGLFMEVHDDPLSAPVDGPTQWPLRHFEELLEELVAIARVTKGKQQYKIDLTPYRE

SEQ ID NO: 23307 - protein, 290 aa, Chrysanthemum coronarium
MDSSTLLYNQLKEAKPFFVLAGPNVIESEEHIMYMAKQIKAVTTKLGLPLVFKSSFDKANRTSSKSFRGPGLAEGLKILEKVIVTYDLPIVTDVHESSQCEAVGRVADIIQIPAFLCRQTDLLVAAAKTGKIVNIKKGQFCAPSVMTNSAEKVRLAGNQNVMVCERGTMFGYNDLIVDPRNFEWMREANCPVVADITHALQQPAGKKLEGGGVASGGLRELIPCIARTAVAVGVDGLFMEVHDDPLSAPVDGPTQWPLRHFEELLEELVAIARVTKGKQQFKIDLTPFRK

SEQ ID NO: 23308 - protein, 290 aa, Cichorium intybus
MDSSTALYNQLKGAQPFFVLAGPNVIESEEHILHMAKQIKAVTSKLGLPLVFKSSFDKANRTSSKSFRGPGLAEGLKILEKVKATYDLPIVTDVHESSQCEAVGRVADIIQIPAFLCRQTDLLVAAAKTGKIVNIKKGQFCAPSVMTNSAEKVRLAGNQNVMVCERGTMFGYNDLIVDPRNFEWMREANCPVVADVTHALQQPAGKKLEGGGVASGGLRELIPCVARTAVAVGVDGLFMEVHDDPLNAPVDGPTQWPLRHLEELLEELVAIARVTKGKKKYEIDLTPFRE

SEQ ID NO: 23309 - protein, 290 aa, Cocos nucifera
MESSVALYNQLKAAEPFFLLAGPNVIESEEHILKMAKHIKNVASKFGLPLVFKSSFDKANRTSSKSFRGPGLEEGLKILEKVKLTYDLPIVTDVHESSQCEAVGRVADIIQIPAFLCRQTDLLVAAAKTGKIINIKKGQFCAPSVMLNSAEKVRLAGNQNVMVCERGTMFGYNDLIVDPRNLEWMREANCPVVADVTHSLQQPAGKKLEGGGVASGGLRELIPCIARTSVAVGVDGIFMEVHDNPLKAPVDGPTQWPLRHLEELLEELIAIARVSKGKKPFKIDLTPHED

SEQ ID NO: 23310 - protein, 290 aa, Cocos nucifera
MESSVALYNQLKAAEPFFLLAGPNVIESEEHILKMAKHIKNVASKFGLPLVFKSSFDKANRTSSKSFRGPGLEEGLKILEKVKLTYDLPIVTDVHESSQCEAVGRVADIIQIPAFLCRQTDLLVAAAKTGKIINIKKGQFCASSVMSNSAEKVRLAGNQNVMVCERGTMFGYNDLIVDPRNLEWMREANCPIVADITHSLQQPAGKKLEGGGVASGGLRELIPCIARTAVAVGVDGIFMEVHDNPLKAPVDGPTQWPLRHLEEILEELIAIARVSNGKKPFKIDLTPYQD

SEQ ID NO: 23311 - protein, 290 aa, Flaveria ramosissima
MDSSTALFNQLKEAQPFFVLAGPNVIESEEHILHMAKQIKAVTTKLGLPLVFKSSFDKANRTSSKSFRGPGLAEGLKILEKVKTTYDLPIVTDVHESNQCEAVGRVADIIQIPAFLCRQTDLLVAAAKTGKIVNIKKGQFCASSVMTNSAEKVRLAGNQNVMVCERGTMFGYNDLIVDPRNFEWMREANCPVVADVTHALQQPAGKKLEGGGVASGGLRELIPCIARTAVAVGVDGLFMEVHDDPLNAPVDGPTQWPLRHFEELLEELMAIARVTKGKQQYKIDLTPFRE

SEQ ID NO: 23312 - protein, 290 aa, Prunus persica
MDASTVLYNQLKAAEPFFLLAGPNVIESEEHIFRMAKHIKHVATKVGLPLVFKSSFDKANRTSSKSFRGPGLTEGLKILEKVKVAYDIPIITDVHEASQCEEVGKVADIIQIPAFLCRQTDLLVAAAKTGKIINIKKGQFCAPSVMVNSAEKVRLAGNPNVMVCERGTMFGYNDLIVDPRNLEWIREANCPVVADVTHALQQPAGRKLDDGGVASGGLRELIPCIARTAVAVGVDGIFMEVHDDPSNAPVDGPTQWPLRHLEELLVELVAIARVSKGKQHFNIDLTPYCD

SEQ ID NO: 23313 - protein, 290 aa, Chenopodium quinoa
MDSSAALYTQLKGAKPFFLIAGPNVIESEEHIMKMAKHIKAITTKLGVPLIFKSSFDKANRTSSKSFRGPGMAEGLKILEKVKVAFDLPIVTDVHESEQCEAVGKVADIIQIPAFLCRQTDLLVAAGKTGKIINIKKGQFCAPTVMVNSAEKVRGTGNQNVMVCERGTMFGYNDLIVDPRNLEWMREANCPVVADITHSLQQPAGKKLDGGGVASGGFRELIPCIARTAVAVGVDGIFMEVHDDPLSAPCDGPTQWPLRHLEELLEELIAIAKVSKGKQQFAIDLTPFRD

SEQ ID NO: 23314 - protein, 290 aa, Sesamum indicum
MDSSTLLYNRLKTAEPFFLLAGPNVIESEEHILHMAKQIKAISSKLGLPLVFKSSFDKANRTSSKSFRGPGLAEGLKILERVKTTYDLPVITDVHETVQCEAVGRVADIIQIPAFLCRQTDLLVAAAKTGRIINIKKGQFCAPSVMVNSAEKIRMAGNENVMVCERGTMFGYNDLIVDPRNLEWLREANCPVVADITHSLQQPAGRKLEGGGVASGGLRELIPCIARTAVAVGVDGIFMEVHDDPLNAPVDGPTQWPLRHLEELLEELMAIARVSKGKKQFQIDLTPFRP

SEQ ID NO: 23315 - protein, 289 aa, Cirsium arvense
MDPAALYNQLKEAQPFFVLAGPNVIESEEHIFYMAKHIKAVTTKLGLPLVFKSSFDKANRTSSKSFRGPGLAEGLKILEKVKVAYDLPIVTDVHESSQCEAVGKVADIIQIPAFLCRQTDLLVAAAKTGKIINIKKGQFCASSVMANSAEKVRLAGNQNVMVCERGTMFGYNDLIVDPRNFEWLREANCPIVADVTHALQQPAGKKLEGGGVASGGLRELIPCVARTAVAVGVDGLFMEVHNDPLNAPVDGPTQWPLRHLEELLEELVGIARVTKGKQQYKIDLTPFRE

SEQ ID NO: 23316 - protein, 291 aa, Echinochloa colona
MEAPPVALFDSLKAAKPFFLLAGPNVIESEEHVLKMAKHIKGITAKLGIPLVFKSSFDKANRTSSKSFRGPGLEEGLKILEKVKATYDLPIVTDVHESHQCEAVGRVADIIQIPAFLCRQTDLLVAAAKTGKIINIKKGQFCAPSVMANSAEKIRLAGNPNVMVCERGTMFGYNDLIVDPRNLEWLREANCPVVADITHALQQPAGRKLDGGGVASGGFRELIPCIARTSVAVGVDGIFMEVHDDPLNAPCDGPTQWPLRNLEELLEELIAIARVTKGKTPFKIDLTPFQE

SEQ ID NO: 23317 - protein, 291 aa, Pennisetum glaucum
MEGPPVALFDSLKAAKPFFLLAGPNVIESEEHVLKMAKHIKGITTKLGIPLVFKSSFDKANRTSSKSFRGPGLEEGLKILEKVKATYDLPVVTDVHESHQCEAVGRVADIIQIPAFLCRQTDLLVAAAKTGKIINIKKGQFCAPSVMANSAEKIRLAGNPNVMVCERGTMFGYNDLIVDPRNLEWLREANCPVVADITHALQQPAGKKLDGGGVASGGLRELIPCIARTCVAVGVDGIFMEVHDDPLNAPCDGPTQWPLRNLEELLEELLAIARVTKGKKPFEIDLTPFQE

SEQ ID NO: 23318 - protein, 291 aa, Sorghum bicolor
MEAPPVALFDSLKAAKPFFLLAGPNVIESEEHVLKMAKHIKGITTKLGIPLVFKSSFDKANRTSSKSFRGPGLEEGLKILEKVKATYDLPVVTDVHESHQCEAVGRVADIIQIPAFLCRQTDLLVAAAKTGKIINIKKGQFCAPSVMMNSAEKVRLAGNPNVMVCERGTMFGYNDLIVDPRNFEWLREANCPVVADVTHALQQPAGRKLDGGGVASGGLRELIPCIARTSVAVGVDGIFMEVHDDPLNAPCDGPTQWPLRNLEELLEELIAIARVTKGKKPFKIDLTPFQE

SEQ ID NO: 23319 - protein, 286 aa, Eutrema parvulum
MAATSPLYNQLKAAEPFFLLAGPNVIESEEHILRMAKHIKDIATKVGLPLVFKSSFDKANRTSSKSFRGPGMAEGLKILEKVKVAYDLPIVTDVHESIQCEEVGKVADIIQIPAFLYLLVAAAQTGKIINIKKGQFCAPSVMENSAEKIRLAGNPNVMVCERGTMFGYNDLIVDPRNFEWMREANCPVVADITHALQQPAGKKLDGGGVASGGLRELIPCIARTAVAVGVDGIFMEVHDDPLSAPVDGPTQWPLRHLEELLEELIAISRVTKGKQRFQIDLTPYRD

SEQ ID NO: 23320 - protein, 290 aa, Chrysanthemum coronarium
MDSSTLLYNQLKEAKPFFVLAGPNVIESEEHIMYMAKQIKAVTTKLGLPLVFKSSFDKANRTSSKSFRGPGLAEGLKILEKVIVTYDLPIVTDVHESSQCEAVGRVADIIQIPAFLCRQTDLLVAAAKTGKIVNIKKGQFCAPSVMTNSAEKVRLAGNQNVMVCERGTMFGYNDLIVDPRNFEWMREANCPVVADITHALQQPAGKKLEGGGVASGGLRELIPCIARTAVAVGVDGLFMEVHDDPLSAPVDGPTQWPLRHFEELLEELVAIARVTKGKQQFKIHLTPFRK

SEQ ID NO: 23321 - protein, 290 aa, Chrysanthemum coronarium
MNSSTLLYNQLKEAKPFFVLAGPNVIESEEHIMYMAKQIKAVTTKLGLPLVFKSSFDKANRTSSKSFRGPGLAEGLKILEKVKVTYDLPIVTDVHESSQCEAVGRVADIIQIPAFLCRQTDLLVAAAKTGKIVNIKKGQFCAPSVMTNSAEKVRLAGNQNVMVCERGTMFGYNDLIVDPRNFEWMREANCPVVADITHALQQPAGKKLEGGGVASGGLRELIPCIARTAVAVGVDGLFMEVHDDPLSAPVDGPTQWPLRHFEELLEELVAIARVTKGKQQFKIHLTPFRE

SEQ ID NO: 23322 - protein, 290 aa, Cichorium intybus
MDSSTALYNQLKGAQPFFVLAGPNVIESEEHILHMAKQIKAVTSKLGLPLVFKSSFDKANRTSSKSFRGPGLAEGLKILEKVKATYDLPIVTDVHESSQCEAVGRVADIIQIPAFLCRQTDLLVAAAKTGKIVNIKKGQFCASSVMTNSAEKVRLAGNQNVMVCERGTMFGYNDLIVDPRNFEWMREANCPVVADVTHALQQPAGKKLEGGGVASGGLRELIPCVARTAVAVGVDGLFMEVHDDPLNAPVDGPTQWPLRHLEELLEELVAIARVTKGKKKYEIDLTPFRE

SEQ ID NO: 23323 - protein, 290 aa, Cirsium arvense
MDSSTALYNQLKGAQPFFVLAGPNVIESEEHIFYMAKHIKAVTSKLGLPLVFKSSFDKANRTSSKSFRGPGLAEGLKILEKVKVAYDLPIVTDVHEASQCEEVGKVADIIQIPAFLCRQTDLLVAAAKTGRIINIKKGQFCASSVMTNSAEKVRLAGNQNVMVCERGTMFGYNDLIVDPRNFEWMREANCPVVADVTHALQQPAGKKLEGGGVASGGLRELIPCVARTAVAVGVDGLFMEVHNDPLSAPVDGPTQWPLRHLEELLEELVAIARVTKGKQQYKIDLTPFRE

SEQ ID NO: 23324 - protein, 290 aa, Cocos nucifera
MESSVALYNQLKAAEPFFLLAGPNVIESEEHILYMAKHIKNVTSKLGLPLVFKSSFDKANRTSSKSFRGPGLEEGLKILEKVKLTYDLPIVTDVHESNQCEAVGRVADIIQIPAFLCRQTDLLVAAAKTGKIINIKKGQFCASSVMSNSAEKVRLAGNQNVMVCERGTMFGYNDLIVDPRNLEWMREANCPIVADITHSLQQPAGKKLEGGGVASGGLRELIPCIARTAVAVGVDGIFMEVHDNPLKAPVDGPTQWPLRHLEEILEELIAIARVSNGKKPFKIDLTPYQD

SEQ ID NO: 23325 - protein, 290 aa, Cocos nucifera
MESSVALYNQLKAAEPFFLLAGPNVIESEEHILYMAKHIKNVTSKLGLPLVFKSSFDKANRTSSKSFRGPGLEEGLKILEKVKLTYDLPIVTDVHESNQCEAVGRVADIIQIPAFLCRQTDLLVAAAKTGKIINIKKGQFCAPSVMLNSAEKVRLAGNQNVMVCERGTMFGYNDLIVDPRNLEWMREANCPVVADVTHSLQQPAGKKLEGGGVASGGLRELIPCIARTSVAVGVDGIFMEVHDNPLKAPVDGPTQWPLRHLEELLEELIAIARVSKGKKPFKIDLTPHED

SEQ ID NO: 23326 - protein, 290 aa, Echinacea purpurea
MDSSTLLFNQLKEAQPFFVLAGPNVIESEEHVLHMAKQIKAVTSKLGLPLVFKSSFDKANRTSSKSFRGPGLAEGLKILEKVKTTYDLPIVTDVHESDQCEAVGRVADIIQIPAFLCRQTDLLVAAAKTGKIVNIKKGQFCAPSVMTNSAEKVRLAGNQNVMVCERGTMFGYNDLIVDPRNFEWLREANCPVVADVTHALQQPAGKKLEGGGVASGGLRELIPCIARTAVAVGVDGLFMEVHDDPLNAPVDGPTQWPLRHFEELLEELMEIARVTKGKKQYKIDLTPFRE

SEQ ID NO: 23327 - protein, 290 aa, Flaveria ramosissima
MDSSTALFNQLKEAQPFFVLAGPNVIESEEHILHMAKQIKAVTSKLGLPLVFKSSFDKANRTSSKSFRGPGLAEGLKILEKVKTTYDLPIVTDVHESDQCEAVGRVADIIQIPAFLCRQTDLLVAAAKTGKIVNIKKGQFCAPSVMTNSAEKVRLAGNQNVMVCERGTMFGYNDLIVDPRNFEWLREANCPVVADVTHALQQPAGKKLEGGGVASGGLRELIPCIARTAVAVGVDGLFMEVHDDPLNAPVDGPTQWPLRHFEELLVELMAIARVTKGKKQYKIDLTPFRE

SEQ ID NO: 23328 - protein, 290 aa, Phalaenopsis aphrodite
MDGSVELFNHLKAADPFFLLAGPNVIESEEHTLKLAKLIKIIASKFGLPLVFKSSFDKANRTSSKSYRGPGLEEGLKILEKVKVTYDLPIVTDVHESSQCEAVGRVADIIQIPAFLCRQTDLLVAAAKTGKIINIKKGQFCAPSVMVNSAEKIRLAGNQNVMVCERGTMFGYNDLIVDPRNLEWLREANCPVVADITHSLQQPAGKKLEGGGVASGGLRELIPCIARTAVAVGVDGLFMEVHDDPLNAPVDGPTQWPLRHLEELLEELIAIARITKGKKPFEIDLAPFLE

SEQ ID NO: 23329 - protein, 291 aa, Oryza sativa
MDASSVALYGQLKAAQPFFLLAGPNVIESEEHVLKMAKHIKGITTKLGLPLVFKSSFDKANRTSSKSFRGPGLEEGLKILEKVKATYDIPVVTDVHESHQCEAVGRVADIIQIPAFLCRQTDLLVAAAKTGKIINIKKGQFCAPSVMANSAEKIRLAGNQNVMVCERGTMFGYNDLIVDPRNFEWLREANCPVVADVTHALQQPAGKKLDGGGVASGGLRELIPCIARTSVAVGVDGIFMEVHDDPLNAPCDGPTQWPLRNLEELLEELIAIARVTKGKKPLKIDLTPFKE

SEQ ID NO: 23330 - protein, 291 aa, Arabidopsis thaliana
MANSASLLYDQLKVAEPFFLLAGPNVIESEEHVLRMAKSIKDISTKLGLPLVFKSSFDKANRTSSKSFRGPGMAEGLKILEKVKVAFDLPIVTDVHESSQCEAVGKVADIIQIPAFLCRQTDLLVAAAQSGKIINIKKGQFCGHSVMRNSAEKVRLAGNPNVMVCERGTMFGYNDLIVDPRNLEWMREADCPVVADITHSLQQPAGKKLDGGGVASGGLRELIPCIARTAVAVGVDGIFMEVHDDPLNAPVDGPTQWPLRHLEELLEELIAIASVTKGKQQFQIDLTPYRD

SEQ ID NO: 23331 - protein, 290 aa, Raphanus sativus
MATTSPLYDQLKAAEPFFLLAGPNVIESEEHILRMAKHIKDIATKVGLPLVFKSSFDKANRTSSKSFRGPGMAQGLKILEKVKVAYDLPIITDVHEPFQCEEVGKVADIIQIPAFLCRQTDLLVAAAQTGKIINIKKGQFCAPSVMENSAEKIRLAGNPNVMVCERGTMFGYNDLIVDPRNLEWMREANCPVLADITHSLQQPCGRKLDGGGVASGGLRELIPCIARTAVAVGVDGIFMEVHDDPLSAPVDGPTQWPLRHLEELLEELIAIARVTKEKQGFQIDLTPYRD

SEQ ID NO: 23332 - protein, 290 aa, Spinacia oleracea
MDSSVSLYTQLKAAQPFFVMAGPNVIESEEHVMKMAKHIKAITTKVGVPLIFKSSFDKANRTSSKSFRGPGMAEGLKILEKVKVAYDLPIVTDVHESSQCEAVGKVADIIQIPAFLCRQTDLLVAAAKTGKIINIKKGQFCGANVMVNSAEKVRGAGNENVMVCERGTMFGYNDLIVDPRNLEWMREANCPVVADITHSLQQPAGQKLDGGGVASGGFRELIPCIARTSVAVGVDGIFMEVHDDPLSAPCDGPTQWPLRHLEELLEELVAIAKVSKGKQQFAIDLTPFRD

SEQ ID NO: 23333 - protein, 290 aa, Ambrosia trifida
MDSSTALFNQLLEAQPFFVLAGPNVIESEEHVLHMAKQIKAVTTKLGLPLVFKSSFDKANRTSSKSFRGPGLAEGLKILEKVKTTYDLPIVTDVHESDQCEAVGRVADIIQIPAFLCRQTDLLVAAAKTGKIVNIKKGQFCAPSVMTNSAEKVRLAGNQNVMVCERGTMFGYNDLIVDPRNFEWMREANCPVVADVTHALQQPAGKKLEGGGVASGGLRELIPCIARTAVAVGVDGLFMEVHDDPLNAPVDGPTQWPLRHFEELLEELMAIARVTKGKKQYKIDLTPFRE

SEQ ID NO: 23334 - protein, 290 aa, Chrysanthemum coronarium
MDSSTLLYNHLKEAQPFFVLAGPNVIESEEHIMYMAKQIKAVTTKLGLPLVFKSSFDKANRTSSKSFRGPGLAEGLKILEKVKVTYDLPIVTDVHESSQCEAVGRVADIIQIPAFLCRQTDLLVAAAKTGKIVNIKKGQFCASSVMTNSAEKVRLAGNQNVMVCERGTMFGYNDLIVDPRNFEWMREANCPVVADITHALQQPAGKKLEGGGVASGGLRELIPCIARTAVAVGIDGLFMEVHDDPVSAPVDGPTQWPLRHFEELLEELVAIARVTKGKQQYKIDLTPYRE

SEQ ID NO: 23335 - protein, 294 aa, Aquilegia formosa
MNSSAVLLYDQIKSTEPFFVLAGPNVIESEEHIFRMAKHIKAITSKLGLPLVFKSSFDKANRTSSQSFRGPGMDQGLKILEKVKLAYDIPIVTDVHEANQCEAVGKVADIIQIPAFLCRQTDLLIAAAKTGKIINIKKGQFCAPSVMVNSAEKVRLAGNPNVMVCERGTMFGYNDLIVDPRNLEWMREANCPIVADITHSLQQPAGKKLEGGGVASGGLRELIPCIARTAVAVGVDGIFMEVHDDPLQAPVDGPTQWPLRHFEELLKELMEIARVTKGKQQFKIDLTPYRDQDS

SEQ ID NO: 23336 - protein, 292 aa, Humulus lupulus
MDSSSSALLYSHLKAADPFFLMAGPNVIESEGHVMRMAARIKAVASKVGLPLVFKSSFDKANRTSSKSFRGPGLTEGLKILEKVKLAYDLPIITDVHEASQCEAVGKVADIIQIPAFLCRQTDLLVAAAKTGKIINVKKGQFCAPSVMENSVEKIRLAGNSNVMVCERGTMFGYNDLIVDPRNLEWMREANCPVVADVTHSLQQPAGRKLAGGGVASGGLRELIPCIARTAVAVGVDGVFMEVHDDPLNAPVDGPTQWPLRHLEELLEELVAIARVSKGKQPFNIDLTPYRD

SEQ ID NO: 23337 - protein, 291 aa, Brachypodium distachyon
MDASSVALFNQLKAAQPFFLLAGPNVIESEEHVMKMAKHIKAITTKVGVPLVFKSSFDKANRTSSKSFRGPGLEEGLKILEKVKAAYDLPVVTDVHESYQCEAVGRVADIIQIPAFLCRQTDLLVAAAKTGKIINIKKGQFCAPSVMANSAEKIRLAGNQNVMVCERGTMFGYNDLIVDPRNFEWLREANCPVVADVTHALQQPAGKKLDGGGVASGGLRELIPCIARTSVAVGVDGIFMEVHDDPVNSPCDGPTQWPLRNLEELLEELIEIAHVTKGKKPFKIDLTPFHE

SEQ ID NO: 23338 - protein, 291 aa, Avena sativa
MDASSVALFGQLKAAQPFFLLAGPNVIESEEHVMKMAKHIKAITTKLGVPLVFKSSFDKANRTSSKSFRGPGLEEGLKILEKVKTAYGIPVVTDVHESWQCEAVGRVADIIQIPAFLCRQTDLLVAAAKTGKIINIKKGQFCAPSVMANSAEKIRLAGNQNVMVCERGTMFGYNDLIVDPRNFEWLREANCPVVADVTHALQQPAGKKLDGGGVASGGLRELIPCIARTAVAVGVDGIFMEVHDDPVNSPCDGPTQWPLRNLEELLEELIAIARVTKGKKPFNIDLTPFKE

SEQ ID NO: 23339 - protein, 291 aa, Panicum virgatum
MEGPPVALFDSLKAAKPFFLLAGPNVIESEEHVLKMAKHIKGITTKLGIPLVFKSSFDKANRTSSKSFRGPGLEEGLKILEKVKATYDLPVVTDVHESHQCEAVGKVADIIQIPAFLCRQTDLLVAAAKTGKIINIKKGQFCAPSVMVNSAEKIRLAGNPNVMVCERGTMFGYNDLIVDPRNFEWLREANCPVVADITHALQQPAGRKLDGGGVASGGFRELIPCIARTSVAVGVDGIFMEVHDDPLNAPCDGPTQWPLRNLEELLEELLAIARVTKGKKPFKIDLTPFQE

SEQ ID NO: 23340 - protein, 291 aa, Zostera marina
MDSSATSLFEQLKGAAPFFILAGPNVIESEEHVLKMAKHIKGITSKLGLQLVFKCSFDKANRTSSKSFRGPGLEEGLRILEKVKLMYDLPIVTDVHEVSQCEAVGKVADIIQIPAFLCRQTDLLVAAAKTGKIVNIKKGQFCAPSVMANSAEKVRLAGNSNVMVCERGTMFGYNDLIVDPRNLEWMREANCPVVADITHSLQQPAGKKLEGGGVASGGLRELIPCIARTAVAVGVDGIFMEVHDNPLSAPVDGPTQWPLRHLEELLVELIALAKVSKGKHSFNIDLTPFQD

SEQ ID NO: 23341 - protein, 290 aa, Beta vulgaris
MESSTALYTQLKEAQPFFVMAGPNVIESEEHIMKMAKHIKAITTKLGVPLIFKSSFDKANRTSSKSFRGPGMAEGLKILEKVKVAYDLPIVTDVHESIQCESVGKVADVIQIPAFLCRQTDLLVAAAKTGKIINIKKGQMCATTVMVNSAEKVRGAGNQNVMVCERGTMFGYNDLIVDPRNLEWMREANCPVVADITHSLQQPAGRKLDGGGVASGGFRELIPCIARTAVAVGVDGIFMEVHDDPLSAPVDGPTQWPLRHLEELLEELIAIAKVSKGKQQFAIDLTPFRD

SEQ ID NO: 23342 - protein, 290 aa, Lactuca sativa
MDSSTALYNQLKGAQPFFVLAGPNVIESEEHILHMAKQIKAITSKLGLPLVFKSSFDKANRTSSKSFRGPGLAEGLKILEKVKVTYDLPIVTDVHESSQCEAVARVADIIQIPAFLCRQTDLLVAAAKTGKIVNIKKGQFCASSVMTNSAEKVRLAGNQNVMVCERGTMFGYNDLIVDPRNFEWLREANCPVVADVTHALQQPAGKKLEGGGVASGGLRELIPCVARTAVAVGVDGLFMEVHDDPLNAPVDGPTQWPLRHLEELLEELVAIARVTKGKHKYDIDLTPYRE

SEQ ID NO: 23343 - protein, 290 aa, Carthamus tinctorius
MNSSTALYNQLKEAQPFSVLAGPNVIESEEHIFYMAKHIKAITSKLGLPLVFKSSFDKANRTSSKSFRGPGLAEGLKILEKVKVAYDLPIVTDVHESSQCEAVGKVADIIQIPAFLCRQTDLLVAAAKTGKIINIKKGQFCASSVMTNSAEKVRLAGNQNVMVCERGTMFGYNDLIVDPRNFEWLREANCPVVADVTHALQQPAGKKLEGGGVASGGLRELIPCVARTAVAVGVDGLFMEVHDDPLNAPVDGPTQWPLRHLEELLEELVGIARVSKGKKQYKIDLTPFRD

SEQ ID NO: 23344 - protein, 290 aa, Tabernaemontana elegans
MDASTVLYNELKTADPFFVMAGPNVIQSEEHIFFMAKHIKAVTTKLGLPLVFKSSFDKANRTSSKSFRGPGLTQGLKILEKVKAAYDIPIITDVHETIQCKAVGQVADIIQIPAFLCRQTDLLVAAAQTGKIINIKKGQFCASSVMLNSAEKVRLAGNQNVMVCERGTMFGYNDLIVDPRNLEWIREANCPVVADVTHSLQQPAGKKLEGGGVASGGLRELIPCIARTAVAVGVDGIFMEVHNDPLNAPVDGPTQWPLRHLEELLEELISIAKASKGKQQFKIDLTPFLD

SEQ ID NO: 23345 - protein, 291 aa, Arabidopsis lyrata
MANSASLLYDQLKVAEPFFLFAGPNVIESEEHVLRMAKSIKEISTTLGLPLVFKSSFDKANRTSSKSFRGPGMPEGLKILEKVKVAYDLPIVTDVHESSQCEAVGKVADVIQIPAFLCRQTDLLVAAAQTGKIINIKKGQFCGHSVMRNSAEKVRLAGNPNVMVCERGTMFGYNDLIVDPRNLEWMREADCPVVADITHSLQQPAGKKLDGGGVASGGLRELIPCVARTAVAVGVNGIFMEVHDDPLNAPVDGPTQWPLRHLEELLEELIAIASVTKGKQQFQIDLTPYRD

SEQ ID NO: 23346 - protein, 291 aa, Hordeum vulgare
MDAPSVALYSQLKAAQPFFLFAGPNVIESEEHVMKMAKHIKAITTKLGVPLVFKSSFDKANRTSSKSFRGPGLEQGLKILEKVKAAYDLPVVTDVHESSQCEAVGRVADIIQIPAFLCRQTDLLVAAAKTGKIINIKKGQFCAPSVMVNSAEKIRLAGNQNVMVCERGTMFGYNDLIVDPRNFEWLREANCPVVADVTHALQQPAGKKLDGGGVASGGLRELIPCIARTAVAVGVDGIFMEVHDDPLNSPCDGPTQWPLRNLEELLEELIAIARVSKGKKPLKIDLTPFKE

SEQ ID NO: 23347 - protein, 291 aa, Setaria italica
MEGPPVALFDSLKAAKPFFLLAGPNVIESEEHVLKMAKHIKGITTKLGIPLVFKSSFDKANRTSSKSFRGPGLEEGLRILEKVKATYDLPIVTDVHESHQCEAVGRVADIIQIPAFLCRQTDLLVAAAKTGKIINIKKGQFCASSVMVSSAEKIRLAGNPNVMVCERGTMFGYNDLIVDPRNLEWLREANCPVVADITHALQQPAGRKLDGGGVASGGLRELIPCIARTSVAVGVDGIFMEVHDDPLNAPCDGPTQWPLRNLEELLEELLAIARVTKGKKPFKIDLTPFQE

SEQ ID NO: 23348 - protein, 291 aa, Oryza sativa
MDASSVALYGQLKAAQPFFLLAGPNVIESEEHVLKMAKHIKGITTKLGLPLVFKSSFDKANRTSSKSFRGPGLEEGLKILEKVKATYDLPVVTDVHESHQCEAVGRVADIIQIPAFLCRQTDLLVAAAKTGKIINIKKGQFCAPSVMANSAEKIRLAGNQNVMVCERGTMFGYNDLIVDPRNFEWLREANCPVVADVTHALQQPAGKKLDGGGVASGGLRELIPCIARTSVAVGIDGIFMEVHDDPLNAPCDGPTQWPLRNLEELLEELIAIARVTKGKKPLKIDLTPFKE

SEQ ID NO: 23349 - protein, 290 aa, Centaurea maculosa
MNSSTALYNQLKEAQPFFVLAGPNVIESEEHIFYMAKHIKAVTTKLGLPLVFKSSFDKANRTSSKSFRGPGLAEGLKILEKVKVAYDLPIVTDVHESSQCEEVGKVADIIQIPAFLCRQTDLLVAAAKTGKIINIKKGQFCASSVMANSAEKVRLAGNQNVMVCERGTMFGYNDLIVDPRNFEWLREANCPVVADVTHALQQPAGKKLEGGGVASGGLRELIPCVARTAVAVGVDGLFMEVHNDPLNAPVDGPTQWPLRHLEELLEELVGIARVTKGKQQYKIDLTPFRE

SEQ ID NO: 23350 - protein, 291 aa, Lolium multiflorum
MDASSVALYGQLKAAQPFFLLAGPNVIESEEHVMKMAKHIKAITTKLGVPLVFKSSFDKANRTSSKSFRGPGLEEGLKILEKVKMAYDLPVVTDVHESWQCEAVGRVADIIQIPAFLCRQTDLLVAAAKTGKIINIKKGQFCAPSVMANSAEKIRLAGNQNVMVCERGTMFGYNDLIVDPRNFEWLREANCPVVADVTHALQQPAGKKLDGGGVASGGLRELIPCIARTSVAVGVDGIFMEVHDDPVNSPCDGPTQWPLRNLEELLEELIAIARVTKGKKPFNIDLTPFKE

SEQ ID NO: 23351 - protein, 291 aa, Zea mays
MEAPPVALFDTLKAAKPFFLLAGPNVIESEEHVLKMAKHIKAITTKLGIPLVFKSSFDKANRTSSKSFRGPGLEEGLKILQKVKATYDLPIVTDVHESHQCEAVGRVADIIQIPAFLCRQTDLLVAAAKTGKIINIKKGQFCAPSVMVNSTEKVRLAGNPNVMVCERGTMFGYNDLFVDPRNLEWLRESNCPVVADVTHALQQPAGRKLDGGGVASGGLRELIPCIARTSVAVGVDGIFMEVHDDPLNAPCDGPTQWPLRNLEELLEELIAIARVTKGKKPFKIDLTPFQE

SEQ ID NO: 23352 - protein, 291 aa, Triticum aestivum
MDAPSVALYNQLKAAQPFFLLAGPNVIESEEHVMKMAKHIKAITTKLGVPLVFKSSFDKANRTSSKSFRGPGLEQGLKILEKVKAAYDLPVVTDVHESCQCEAVGRVADIIQIPAFLCRQTDLLVAAAKTGKIINIKKGQFCAPSVMANSTEKIRLAGNQNVMVCERGTMFGYNDLIVDPRNFEWLREANCPVVADVTHALQQPAGKKLDGGGVASGGLRELIPCIARTAVAVGVDGIFMEVHDDPLNSPCDGPTQWPLRNLEELLEELIAIARVTKGKKPLKIDLTPFKE

SEQ ID NO: 23353 - protein, 288 aa, Amaranthus tuberculatus
MESSAALFTQLKAAQPFFLMAGPNVIESEEHTMQMANHIKAITNKLGVPLIFKSSFDKANRTSAKSFRGPGMDEGLKILEKVKVAYDLPIVTDVHETIQCEAVGKVADVIQIPAFLCRQTDLLVAAAKTGKIINIKKGQFCAPTVMVNSAEKVRGAGNQNVMVCERGTMFGYNDLIVDPRNLEWLREAKCPVVADITHSLQQPAGRKLDGGGVASGGFRELIPCIARTAVAVGVDGIFMEVHNDPLRAPVDGPTQWPLRHLEELLEELIAIAKVSKGKQQYEIDLTPF

SEQ ID NO: 23354 - protein, 277 aa, Vinca minor
ADPFFIMAGPNVIESEEHIFYMANHIKAITAKLELPLIFKSSFDKANRTSSKSFRGPGLTQGLKILEKVKAAYDIPIVTDVHETIQCEAVGQVADIIQIPAFLCRQTDLLVAAAQTGKIINIKKGQFCAPSVMLNSAEKIRLAGNQSVMVCERGTMFGYNDLIVDPRNFEWMREANCPVVADITHSLQQPAGKKLEGGGVASGGLRELIPCIARTAVAVGVDGIFMEVHNDPQNAPVDGPTQWPLRHLEELLEELISIAKASKGKQQFKIDLTPFRD

SEQ ID NO: 23355 - protein, 294 aa, Thalictrum flavum
MNSSAVMLYEQFKSSEPFFVLAGPNVIESEEHIFRMAKNIKAITSKLGLPLVFKSSFDKANRTSSQSFRGPGMEQGLKILEKVKIAFDIPIVTDVHEASQCEAVGKVADIIQIPAFLCRQTDLLIAAAKTGKIINIKKGQFCAPSVMVNSAEKVRLAGNPNVMVCERGTMFGYNDLIVDPRNLEWMREANCPIVADITHSLQQPAGKKLEGGGVASGGLRELIPCIARTAVAVGVDGIFMEVHNDPLQAPVDGPTQWPLRHFEELLEELMQIARVTKGKRQFKIDLTPYRDQDS

SEQ ID NO: 23356 - protein, 291 aa, Secale cereale
MDASSVALYNQLKAAQPFFLLAGPNVIESEEHVMKMAKHIKAITTKLGVPLVFKSSFDKANRTSSKSFRGPGLEQGLKILEKVKAAYDLPVVTDVHESCQCEAVGRVADIIQIPAFLCRQTDLLVAAAKTGKIINIKKGQFCAPSVMANSAEKIRLAGNQNVMVCERGTMFGYSDLIVDPRNFELLREANCPVVADVTHALQQPAGKKLDGGGVASGGLRELIPCIARTAVAVGVDGIFMEVHDDPLNSPCDGPTQWPLRNLEELLEELIAIARVTKGKKPLKIDLTPFKE

SEQ ID NO: 23357 - protein, 291 aa, Secale cereale
MDASSVALYNQLKAAQPFFLLAGPNVIESEEHVMKMAKHIKAITTKLGVPLVFKSSFDKANRTSSKSFRGPGLEQGLKILEKVKAAYDLPVVTDVHESCQCEAVGRVADIIQIPAFLCRQTDLLVAAAKTGKIINIKKGQFCAPSVMANSTEKVRLAGNQNVMVCERGTMFGYNDLIVDPRNFELLREANCPVVADVTHALQQPAGKKLDGGGVASGGLRELIPCIARTAVAVGVDGIFMEVHDDPLNSPCDGPTQWPLRNLEELLEELIGIARVTKGKKPLKIDLTPFKE

SEQ ID NO: 23358 - protein, 286 aa, Antirrhinum majus
MDSSTMLYNQLKTAEPFFVLAGPNVIESEDHVMYMAEHIKAITSKLGLPLVFKSSFDKANRTSSKSFRGPGLAEGLKVLERVKATYDIPIVTDVHESAQCEAVGRVADIIQIPAFLCRQTDLLVAAAKTGKIINIKKGQFCAPSVMANSAEKIRMAGNDNVMLCERGTMFGYNDLIVDPRNLEWMREANCPVVADITHSLQQPAGKKLEGGGVASGGLRELIPCIARTAVAVGVDGIFMEVHDNPLEAPVDGPTQWPLRHFEELLEELIAIARVSKGKQTYHIDLT

SEQ ID NO: 23359 - protein, 289 aa, Chrysanthemum coronarium
MDSSTLLYNQLKEAKPFFVLAGPNVIESEEHIMYMAKQIKAVTTKWLASVFKSRFDKPNRTSPKSFRGPGLAEGLKILEKVKVTYDLPIVTDVHESSQCEAVGRVADIIQIPAFLCRQTDLLVAAAKTGKIVNIKKGQFCAPSVMTNSAEKVRLAGNQNVMVCERGTMFGYNDLIVDPRNFEWMREANCPVVADITHALQQPAGKKLEGGGVASGGLRELIPCIARTAVSVGVDGLFMEVHDDPLSAPVDGPTQWPLRHFEELLEELVAIARVTKGKQQFKIHLTPFRE

SEQ ID NO: 23360 - protein, 280 aa, Centaurea maculosa
LKEAQPFFVLAGPNVIESEEHIFYMAKHIKAVTTRLGLPLVFKSSFDKANRTSSKSFRGPGLAEGLKILEKVKVAYDLPIVTDVHESSQCEEVGKVADIIQIPAFLCRQTDLLVAAAKTGKIINIKKGQFCASSVMANSAEKVRLAGNQNVMVCERGTMFGYNDLIVDPRNFEWLREANCPIVADVTHALQQPAGKKLEGGGVASGGLRELIPCVARTAVAVGVDGLFMEVHNDPLKAPVDGPTQWPLRHLEELLEELVGIARVTKGKQQYKIDLTPFHE

SEQ ID NO: 23361 - protein, 276 aa, Daucus carota
MDSSALLYNKLKSAEPFFVLAGPNVIESEEHVLRMASHIKTITSKLGLPLVFKSSFDKANRTSSKSFRGPGLAEGLKILEKVKLAYDLPIVTDVHEAGQCDAVGRVADVIQIPAFLCRQTDLLVAAAQTGKIINIKKGQFCAPSVMTNSAEKVRLAGNQNVMVCERGTMFGYSDLIVDPRNLEWMREADCPIVADITHSLQQPAGKKLEGGGVASGGLRELIPCIARTAVAVGVDGIFMEVHDDPLSAPVDGPTQWPLRHLEELLEELVAIARVTK

SEQ ID NO: 23362 - protein, 305 aa, Musa acuminata
MDSSVALFNQLKAAEPFFVLAGPNVIESEEHILKMAKHIKAITSRQAYNNACNAYLMVLQLGLPLVFKSSFDKANRTSLKSFRGPGLEQGLKILEKVKVAYDLPIVTDVHESSQCELVGRVADIIQIPAFLCRQTDLLVAAAKTGKIINIKKGQFCAPSVMVNSAEKVRLAGNPNVMVCERGTMFGYNDLIVDPRNLEWMREANCPVVADVTHSLQQPAGKKLDGGGVASGGLRELIPCIARTAVVVGVDGIFMEVHDDPLSAPVDGPTQWPLRNLEELLEELIAIARVTKGKKAFKIDLTPFRD

SEQ ID NO: 23363 - protein, 257 aa, Trifolium pratense
MDPSLLYDQLKAADPFFLLAGPNVIESEEHIMRMAKHIKTISSKFGIPLVFKSSFDKANRTSSKSFRGPGMVEGLKILEKVKIAYDLPIVTDVHEAIQCEPVGKVADIIQIPAFLCRQTDLLVAAAKTGKIINIKKGQFCAPSVMTNSAEKVRLAGNPNVMVCERGTMFGYNDLIVDPRNLEWMREANCPTVADITHSLQQPAGKKLDGGGVASGGLRELIPCIARTSVAVGVDGIFMEVHDDPLNAPVDGPTQWPL

SEQ ID NO: 23364 - protein, 259 aa, Chelidonium majus
MNSHTDLFNQLEGAEPFFLLAGPNVIESEEHIFRMAKHIKAISTKVGVPLVFKSSFDKANRTSSKSFRGPGMVEGLKILEKVKIAYDIPIVTDVHDASQCEAVGKVADIIQIPAFLCRQTDLLVAAAKTGKIINIKKGQFCAPSVMANSAEKVRLAGNQNVMVCERGTMFGYNDLIVDPRNLEWMREANCPIVADVTHSLQQPAGKKLEGGGVASGGLRELIPCIARTSVAVGVDGIFMEVHDDPLNAPVDGPTQWPLR

SEQ ID NO: 23365 - protein, 290 aa, Festuca arundinacea
MDASSVALYSQLKAAQPFFLLAGPNVIESEEHVMKMAKHIKAITTKLGVPLVFKSSFDKANRTSSKSFRGPGLEEGLKILEKVKTAYDLPVVTDVHESWQCEAVGRVADIIQIPAFLCRQTDLLVAAAKTGKIINIKKGQFCAPSVMANSAEKIRLAGNQNVMVCERGTMFGYNDLIVDPRNFEWLREANCPVVADVTHALQQPAGKKLDGGGVASGGLRELIPCIARTSVAVGVDGIFMEVHDDPVNSPCDGPTQWPLRNLEELLEELIAIARVTKERSRPNRSNSIQE

SEQ ID NO: 23366 - protein, 406 aa, Gossypium hirsutum
CTSKAKVTTGTTHVEITPPAVARINGRPVLQPTCNRVPSLDRRNSLKKIPPISPPPPASLPFTPSATSTTTVANGSRAKASLTPPLSPSSKFTTTKRWSDPNALNSSSEKVAIPRNTTKTLDRKKSKSFKEGMGNNGLSSYIEPSLSYSSSLLVEAPGSIAAVRREQVALQQAQRKMKIAHYGRSKSAKFESKVVPLDNTKPAEEKKRCSFITPNSDPIYVAYHDEEWGVPIHDDSMLFELLVLSGAQVGSDWTSILKKRQDFRDAFSGFDAETVANFTEKQMTTISSEYGIDISRVRGVVDNANRILEVKREFGSFDKYIWGFVNHKPMSTQYKFDHKIPVKTSKSESISKDMVRRGFRFVGPTVVHSFMQAAGLTNDHLITCHRHLPCALLAIQRPPVHSLPDL

SEQ ID NO: 23367 - protein, 409 aa, Theobroma cacao
MCSSNAKVTAGVEITPAVARINGRPVLQPTCNRVPSLDRRNSLKKIPPLSPPTPPSLASTLPATSATVGNGGRAKASLTPPISPKSKSPRPAAIKRGSDPNALNTSSEKVMTPRNITKTLERKKSKSFKEGMGNGLSSWIEPSLSYSSSLIVEAPGSIAAVRREQMALQQAQRKMKIAHYGRSKSAKFESKVVPLNTSSAMTKPDEEEKRCSFITPNSDPVYVAYHDEEWGVPVHDDSMLFELLVLSGAQVGSDWISILKKRQDFRDAFSGFDAETVAKFTDKEMTTISSEYGIDISRVLGVVDNSNRILEVKGQFGSFDKYIWGFVNHKAISTQYKFGHKIPVKTSKSESISKDMLRRGFRCVGPTVVHSFMQAAGLTNDHLITCHRHLPCTLLAASSIDGLTFKRRQ

SEQ ID NO: 23368 - protein, 172 aa, Zea mays
MAASATAARPLAGTAVPLPLSTRTRPARVALLSLIPPAPAQRLALRRGAWLSPPERSRSVRCLAAMSPEMRATLDKVVGSSKVVLFMKGTKDFPQCGFSHTVVQILRSLDVPFETLDVLANEALRQGLKEYSSWPTFPQLYIDGEFFGGCDITVEAYKSGELQETLEKAMCS

SEQ ID NO: 23369 - protein, 171 aa, Setaria italica
MAASATASRPLAGAYVPLPLPARGLPSRVALLPRAPPAVQGLTLDRPAQLSVRARGRSVRCLAGLSPEMRATLDKVVGSSKVVLFMKGTKDFPQCGFSHTVVQILRSLDVPFETLDVLANEALRQGLKEYSSWPTFPQLYIDGEFFGGCDITVEAYKSGELQETLEKAMCS

SEQ ID NO: 23370 - protein, 536 aa, Sorghum bicolor
MDSPLMEPLLVPKDHAPAVAATPGDHGGAAADENSTVVDTTSGPGRALGDAEEKTNDDGEVEGDELSASVQRRLDESSGGVEKEDEEEEEEIGDDAGADDMAARMARRLAALPGKAHESEPFTIFRVAGSMRERNRHLFDPQMISIGPFHRGAGRHLAAMEAHKWRYLRDILSRPGGATLATYARAARAMEARARRRYAEPVALPPAEFAEMLLLDGCFVVEFFLKGHDSEEDALIDATWAIQNVYNDMLLLENQLPFFVLERFYDLATGGLGRDYFVTNVLVNYLTVDMTSGPRDPESTRPPDGEIHHLLHLYYYWFLPPEQRFGSGAASKSEDEALEEMTSRSMDDERSPSLLPPASELQDSGVTFRVKKSPRSMVDVTFDRRSGTLEIPAVESYTNHAVFANLLAYEQSRGRWELQRLVSYVLLMASVVDARRDVEALQRAGVLARGDEETAAFYANLGELCPPPEFVDNCYAALLRDVREYCGRSWNRHRAVLVHDYFSNPWTSMSAAAAVFLLVLTVVQTVYTVLPYYSPN

SEQ ID NO: 23371 - protein, 812 aa, Sorghum bicolor
MVKFSREYEASIIPEWKAAFVDYKGLKKLVKRIKIARRDAAPLLAAGAGGGRRSSDASSGSYGFSVLDPVRALAAHFAATPASPTTQVGDDDGDSDSGLESDSGELVRATDKHEQEFLEKADEELEKVNKFYAAQEADMLARGEALIEQLRILADVKRILADHAAASRRGRSRLARTAASSPPPSVNGSNSGRHLLSSPFVVASPQSMSDGSVELQQARVAEGAAVAEEVMAALERNGVSFVGGGLGKAKKDGSGKQLMGRAALLQLPATVRIDIPPTSPGRAALKVWEELVNVLRKDGADPAAAFVHRKKVQHAEKNIRDAFLALYRGLELLKKFSSLNVKAFTKILKKFVKVSEQQRKTDLFSEKVKRSPFSSSDKVLQLADEVESIFLRHFAGNDRKVAMKYLKPQQPRNTHMITFLVGLFTGTFVSLFIIYSVLAHVAGIFSSTGNTAYMEIVYHVFSMFALISLHVFLYGCNLFMWKSTRISHNFIFDFSSSTALTHRDAFLMSASIMCTVVAALVINLFLRNAGATYANALPGALLLLSAVVLFCPFNVFYRSTRYCFMRVMRNIMLSPFYKVLMADFFMADQLTSQIPLLRHLEFTGCYFMAGTFRTHEYGSCTSSSLYKNLAYVLSFLPYYWRAMQCLRRYLEEGHDLNQLANAGKYISAMVAAAVRFKYAATPTPFWMWMVIISSTGATIYQLYWDFVMDWGFLNPKSKNFWLRDQLILKNKSVYYASMMLNLVLRLAWAQSVMKLHLGMVESRLLDFSLASLEIIRRGHWNFYRLENEHLTNAGKFRAVKTVPLPFRELETD

SEQ ID NO: 23372 - protein, 806 aa, Zea mays
MVKFSREYEASIIPEWKAAFVDYKGLKKLVKRIKIARRDRAARSTSNDHDDATTTTYGFSVLDPVRALASHFNNATPPASPEGGSDDALRSLESDSGELVRATDKHEQEFVERADEELEKVNKFYAAQEADMLARGDALIEQLRILADVKRILADHAAASSRRGRARLARTGGNSSPPSVDGSNSGRHLLSSPFVASSPQSMSDGSVQLQQARVAEGAAVAEEVMAALERNGVSFVGGGLGKAKKDGSGKQLMGRAALLQLPATVRIDIPPTSPGRAALKVWEELVNVLRKDGADPAAAFVHRKKVQHAEKSIRDAFLALYRGLDLLKKFSSLNVKAFTKILKKFVKVSEQHRKGDLFSEKVKRSPFSSSDKVLQLADEVECIFLRHFAGNDRKVAMKYLKPQQPRNTHMVTFLVGLFTGTFVSLFIIYSVLAHVAGIFSSTGNTAYMEIVYHVFSMFALISLHVFLYGCNLSMWKGTRINHNFIFDFSSSTALTHRDAFLMSASIMCTVVAALVVNLFLRNAGATYANALPGALLLLSAGVLFCPFNIFYRSTRFCFMRVMRNIVLSPFYKVLMADFFMADQLTSQIPLLRHLEFTGCYFMAETFRTHAYGSCTSSSQYKNLAYVLSFLPYYWRAMQCLRRYLEEGHDMNQLANAGKYVSAMVAAAVRFKYAATPTPFWMWMVIASSTGATIYQLYWDFVMDWGFLNPKSKNFWLRDQLILKNKSIYYASMMLNLVLRLAWAESVMKLRLGMVESRLLDFSLASLEIIRRGHWNFYRLENEHLNNAGKFRAVKTVPLPFRELETD

SEQ ID NO: 23373 - protein, 802 aa, Setaria italica
MVKFSREYEASIIPEWKAAFVDYKCLKKLIKRIKVARRDAGPPPPLLAGGTTTAGYGFSVLDPVRALTARFARSTAASPEGEEESLESDSGELVRATDKHEQEFLEQADEELEKVNKFYASQEGELLARGDALIEQLRILADVKRILADHVAASRRGGPAGRRALGRAASMPPPSHSPSVNGSSGRHLLSGLASPQSMSDGSVELQQARVAEGAAVAEEVMAALERNGVSFVGGGLAKAKKDGSGKQLMGRGALLQLPATVRIDIPPTSPGRAALKVWEELVNVLRKDGADPAAAFVHRKKVQHAEKNIRDAFLALYRGLELLKKFSSLNVKAFTKILKKFVKVSEQQRATDLFSEKVKRSPFSSSDKVLQLADEVECIFLRHFAGNDRKVAMKYLKPQQPRNTHMITFLVGLFTGTFVSLFIIYSVLAHVAGIFSSTGSPAYMDIVYHVFSMFALISLHVFLYGCNLFMWKSTRINHNFIFDFASNTALTHRDAFLMSASIMCTVVLSLVINLFLRNAGATYTDALPGALLLLSTGVLFCPFNIFYRSTRYCFMRVMRNIIFSPFYKVLMADFFMADQLTSQIPLLRHMEFAACYFMAGTFRNQAYETCTSSPQYTHLAYVISFLPYYWRAMQCLRRYLEEGHDINQLANAGKYVSAMVAAAVRFKYAATPTPLWMWMVVISSSGATIYQLYWDFVMDWGFLNPKSKNLWLRDQLILKNKSIYYVSMMLNLALRLAWAQSVMKLKLGRVESRLLDFSLASLEIIRRGHWNFYRLENEHLNNAGKFRAVKTVPLPFRELETD

SEQ ID NO: 23374 - protein, 882 aa, Oryza sativa
MSASEFRIPYQQVSSSQTAENAGQYKICRCGEGDPNTSETGDSSPTSCPNCQVLKSGHLLLSSKGIGWTTWKKRWFILTRASLVFFRSDPNAPVRGNEPVVTLGGIDLNNTGSVVVKEDRKLLTVLFPDSRDGRTFTLKAETTEELNEWKSALENALAQAPAVANAVGQNPIFSTDIAEPAEAPAEQPDDKSVIGRPAEFALVDADGSPSFLEKALKFIEDYGVKVEGILRQSADVEEVKRRVQDYEKGKNEFSPEEDAHVIGDCIKYVLREMPSSPVPAPCCTALVGAYRTDKTKRLDAMSKVIYEVFPEPNQQLLQRILKMMQIVGSHKAVNRMSPSALAACMAPLLLRPLLLGECEIDSDFSMAGDGSFQLLQAAAAANHAQAIVIIMLEEYDEIFDDLEDGSCSSDAYTDSEDGDVDKEYSTDNDVDGSYDSGEDNIEEDMEDDTEYSSGGSECDDKVKRNNSGKASNGNDKGFQPPKKAARTEHGVLREDTNQISSVPPVENTSQMESNDPSHRKLHESNGSTDQIEKSNVRASSSRAKFMEKSSSRNKSKKTLLGRASARRDLSADETDFCSDDETLIEKLENNKTDLQSKITKEVKENSILQASLGRRKEELHERRLALEKEVENLRDQLQKERKLRASLESGLMNLRRGQTKADLEEVATAEADILNLKQKVSDLRGQLNNNVQMSSTSLCDSCNKRLLSTDKLFEDEQNTSPSNVGPNSMSDMASATDMADIEQSRKQTTQHSSSSIDKPTLHKHQKSIASNEQSSTISQRAQRILSSKGGIMKDGQDGSFTSKWNLAQKQYSNNPLLGRLGSNAYSSTRTEESGAVPFALAKLTNRLNFLKERRAILASEMQNLNLARPPGPTAPAPKKDST

SEQ ID NO: 23375 - protein, 624 aa, Nicotiana benthamiana
VSNLGILQNVFDFRYLCLQVVAVAVFLALGFAFYVFFAPFAGKKLFQYIVMGLYTPLIISAFGLYIWCAGADPADPGVFKSKKYIKKLDNKKQVQLKESKLGCETNSSIQDANAASIGENASVKSNKGAEPSADHNATQKKIAATHRRGLLALLPRARTGRHEESSQQQLSEDGMFYCSLCEVEVFKYSKHCRVCDKCVDQFDHHCRWLNNCIGKRNYRKFFTLMVSAVLLLILQWSTGIFVLIYCFIEKKFSVEITSKLGSSFSLVPFVIVVAVCTILAMIATLPLAQLFFFHILLIKKGISTYDYIIALRDQEQQGVAGQQSPQMSTVSSLTGLSSASSFNTFHRAAWCTPPRLFVEDQYDVVAPDTVSVSSLGKRSMVEEPIKKRNPAAVKISPWTLARLNAEDVSKAAAEARKKSKILQPVVRNKEPYTLETNSSLGSSGRRMVPRPDNNRRRASKRVRLPTELPFENLSKIPSDIAQNSRNAIMSETSSSLAPLQLEARSDFRTSRGLSSGGVAASSPESSLDSPDMHPLRVSSSGVEDTTCFVGLSSGMTLQKDTPLSRSTSDGYEASGGEDSDRVPTRIVQRSTRWSSILFGSDQQDDRVRRLMVPSSSSQANIRKH

SEQ ID NO: 23376 - protein, 418 aa, Secale cereale
LAAIAGRIGVVGSVALNIVALAIYLRGRAAAEKQASKKVKKAAAVAPSSGKPPVLSNSVVNLDHGDPTMFETFWRGPIGESATLVIPGWQTMSYFSDVGNLCWFLEPSFEREVRRLHRLVGNAATEGYHVLVGTGSSQLFQAALYALAPPTADAPVSVVSPTPFYSMYPPLTDFLNSGLYRWAGDPNTFDGDDYIEVVCSPSNPDGGIREAVLKSKSGKDIHDLAYYWPQYTPITHMLAHDIMLFTVSKCTGHAGTRIGWALVKDKEVAQKMNKFMEINTIGVSKDAQLRAAKVLGAVTDGYERQLATDAGGDTNLLFHYARRKMAHRWRALRSAVAASGIFSLPDEVAGFCTFTKDTVTANPAFAWLRCGKQEVEDLESFLRETRSYRGGTKSELIQRWSRTQYGSTLDEAVRHISY

SEQ ID NO: 23377 - protein, 437 aa, Hordeum vulgare
MARDHGDGLAAIAGRIGVVGSVALNLVALVIYLRGHFFSSVGTVVEKRPSKKEELAVVAPSCGKPSVLSDSMISLDHGDPTMFETFWRGPIGKSATLVIPGWQTMSYFSDVGNLCWFLEPGLEREVRRLHRLIGNAAVEGYHVLVGTGSMQLFQSALYALAPPIADSPISVVSHTPFYSSYPSVTDFLDSRLYRWAGDANTFDGDNYIEVVCSPNNPDGAIRETILKSKTGKAIHDLAYYWPQYTPITQMLAHDIMLFTVSKCTGHAGTRIGWALVKDKQVAQKMNKFMELNTIGVSKDAQLRAAKILGAVADGYEFQLTIPSGGDVNLLFHYARRQMAHRWRALRAAVAVSGIFSLPGEVGGFCTFTKDMVIANPAFAWLRCEKEEVEDLESFLREHKIITRSGTKFGVDRKVVRISMVDTDEAFNIFVDRLATMK

SEQ ID NO: 23378 - protein, 1049 aa, Setaria italica
MVAAEYSIDRKLSKLVEEARLSAAALRAAAQAADAVAELIKRVPQQQATPEAARGFIRDLGLEAEKLAFTFRPPEEVRLAGSHAAGAVARPDVAADLLVRLPKECFHEKDFLNHRYHAKRCLYLCVIEKNLRSSRLIRKVLWSTFQDEARKPVLHVYPATEIADLPGFYVRIIPTANSLFNVSKLNVSTRNNVRAYTKDGINLPTAKYNCSILEDMFLEENAEFISSTVADWKALQEALVLVKVWARQRTSIYTHDCLNGYLISAILVFLTVDSGGSIITRSMTTRQIFRVVMNFLATSKVWAKGLVIQSMKKRTITKEDIANCLKTFDVAICDISGHVNLSFRMTKSAFLELQDEAACALNCLDKCRDGGFEELFMTKVDFGAKFDSCLRINLKGNSKVTALSCCVDDESWRILEKDVQSLLQQGLTDRTKMIRVLWRSTPSEWKIMDGFSEFGSSPLLVGIMLSSLEKSFRLVDIGPNPENRSEAIKFRKFWGEKAELRRFKDGNIAESTVWESESWERHTIIKRIADYVLMKHLSLQKDDLTHVVDQLDFCLLVDGQDPVSSSGALLEAFDTLSKQLRLLDDVPLKISTVQPLDSAFRHTSVFPPEPHPLAYGKNSQRLPNFATTCIRSMEVMIQLEGSGNWPLDPVAMEKTKTAFLLKIGESLEDRGMYVSASEDEVNVLTSGYSFLLKIFHERGLVLQKQAGDDNTQSALSQDKVLFQRSQHSSMINGLHGRYQMYGPVVRLAKRWISAHLFSSIISEEAVELVVAYLFLKPFPFHAPSSRVAGFLRFLRLLSSFDWTFSPMVIDINNDFNLKDEKEINENFMMSRKSYEQNPHDIEPAMFLATSYDKASEAWTKQSPSKSVLKRMAVYAKSSAELLTNLILNGQSGQYTWECLFQTPMGNYDAVVLLHQEKLCRPHHVLFPAEIPNGKLVIWGKPSKDFHPYMPLNKGVVKSLHDARDKLLVNFDPTTYFLRDLKCAFPKTFKLWYGSEGGDAVGLTWENPKKRGREEADETMPELTSILKEVGDVGKGLVRGVYLLKAPKLQ

SEQ ID NO: 23379 - protein, 1054 aa, Panicum virgatum
MAAAAAAAEYSIDHKLSKLVEEARPSAAALRAAAQAADAVAELIKRVPQQQTTPEAARGFVRDLGMEEEKLAFTFRPPEMVRLAGSHAAGAVARPDVAADLLVRLPKECFHEKDFLNHRYHAKRCLYLCVIEKNLRSSQLIREVSWSTFQDEARKPVLHVYPATEIADLPGFYIRIIPTANSLFNVSKLNVSTRNNVRAHIKDDGVTLPTPKYNCSILEDMLLEENAEFMSSTFADWKALQEALVLVKVWARQRTSIYTHDCLNGYLISAILVFLTVDSGGSIITKSMTTRQIFRVVMNFLATSKVWAKGLVIQSMKKRTITKEDLANCLKTFDVAIWDISGHVNLAFRMTKSAFVELQDEAACALSCLDKCRDGGLEELFMTKVDFGAKFDSCLRINLKENSKVTSLSYCVDDESWRILEKDVQSLLQQGLTDRTKMIRVLWRSTPSEWKIMDGFSEFSNSPLLVGIMLSSLEKSFRLVDIGPNPENRNEAIEFRRFWGEKAELRRFKDGNIAESTVWECESWERHTIIKRIADYVLMKHLALQKDDLIHIVDQLDFCLLVDGQDPVSSSGALLEAFDTLSKQLRLLDDVPLKISTVQPLDPAFRHTSVFPPEPHPLAYGKSSQRLPNFATTCIRSMEVMIQLEGSGNWPLDNVAMEKTKTAFLLKIGESLEDRGMFVSASEDEVNVLTSGYSFLLKIFHERGLVLQKQAGDDNIQTALSQDKVLFQWSQHSSMINGLHGRYQMYGPVVRLAKRWISAHLFSSFISEEAVELVVAYLFLKPFPFHAPSSRVAGFLRFLRLLSTFDWTFSPMVLDINNDFNLKDEKEINENFMMSRKSYEQNPHDIEPAMFLATSYDKASEAWTKQSPSKSVLKRMAAYAKSSAELLTNLILNGQSGQYTWECLFRTPMSNYDAVILLHHEKLCCPSHVLFPAETPNGKLVIWGKPSKDFHPYMPLNKGAVKSLHDAREKLLVNFDPTTYFLRDLKGAFPKTFKLWYGSIGGDAVGLTWDNPKKRGREEADETMPEPTSILKEVGDVGKGLVRGVYLLKAPKLQ

SEQ ID NO: 23380 - protein, 1050 aa, Brachypodium distachyon
MASADYSLDRKLSALLTEARPSAASLRAAGEAADAVAALVKSVPPQQANPTAASGFVADLGLLAEAHKLAFDFRAPEVVRLAGSHAAGGSVARPDVAADLLVRLPKECFHEKDFLNHRYHVRRCLYLCVIEKSLLSSPLIRKVSWSTFQDEARKPILHVYPATEIAELPGFYVRIIPTASSLFDVSKLNLSTRNNVRAYTKDGINQPTPKYNSSILEDMFLEENAESISSTFANWKNLQEALVLLKVWARQRTSIYTHDCLNGYLISAVLVFLTMDSGGSIINRSMTTRQIFRVAINFFATSKMWPKGLVMQPMKKRTITKEDIAHLLKTFDVVICDVSGHVNLAFRMKKTAFLELQDEAASALNCLDKCRDGGLEELFMTKVDFGAKFDSCVRINLKGNSKVTALSFCLDDESWRVLENNVQSLLQQGLTDRTKMIRVLWRSTPSEWNIKDGFSKFGSSPVIVGIMLSSLEKSYRLVDIGPNPENRDEAVKFRKFWGEKAELRRFKDGVIAESTVWETEPWKRHTIVKRIADYVLSKHLLLQKEDLVHVVDQLDFCLLVAGQDPVSSSGDLLVAFDTLSKQLRLLDDVPLKISTVQPLDPAFRHTSVFPPEPHPLAYEKSSQRLPNFAATCVRSLEVMIQLEGSGNWPLDPVAMEKTKSAFLLRIGESLEGRGMFVKASEDEVNVFTSGYSFLLKIFHERGLVQKQAGDVNTQSAPSEDKELFLRSQHSSMINGLHGRYQVYGPVVRLAKRWMSAHLFSSFISEEAVELVVAYLFLKPFPFHAPSSRVVGFLRFLRLLSSFDWTFTPMVVDINNDFNLKDEKDINENFMLSRKSYEQNPHDIEPAMFLATSYDKASEAWTKHSPSKSVLKRMAAYAKSSAELLTNLIIHGQSGQYTWECLFRTPLSNYDAVVLLHQEKLCRPHHVLFPAETPNGKLVIRGNPSNSFHPYMSLNSTVMRSLHDARDKLLVNFDPTAYFLRDLKCAFPVTFKLWYDSNGGDAVGLTWENSKKRGRDEADEAMPDPTSILKEVGDVGKGLVRGVYLLKAPKL

SEQ ID NO: 23381 - protein, 1049 aa, Secale cereale
MVSAEYSIDLKLSELLKQARPSAISLRAAGEATDAVAELIKSVLPQQAAPEAASGFVRDLGLAAEKLAFSFRPPEVVRLAGSHAAGAVTRPDVAADLLVRLPKECFHEKDFLNHRYHAKRCLYLCVIEKSLRSSPLIRKVSWSTFQDEARKPVLHVYPATEIAELPGFYVRIIPTASSLFDVSKLNLSTRNNVRAYTIDGINQPTPRYNNSILEDMFLEENAECTGSTFANWKTLQEALVLLKVWARQRTSIYSHDCLNGYLISAILVFLTMDSGGSIINRSMTTRQIFRVAINFFATSKMWSKGLVIQPMKKRTISKEGIAHLLKTFDVAICDVSGHVNLAFRMTKSAFSELQDEAACTLNCLDKCRDGGFEELFMTKVDFGAKFDSCLRINLKGNSKVTALGFCSDDESWRVLEKDVQSLLQQGLADRTKMIRVLWRSTPSEWNIMDGFSEFGSSPLIVGVMLSLLEKSYRLVDIGPNPENRDEAIKFRKFWGEKAELRRFKDGAIAESTVWETETWERHTIIKKIADYVLTKHLLLRQEDLTHVVDQLDFCLLVGGQDPVSSSGALLEAFDTLAKQLRLLDDVPLKISTVQPLDSAFRHTSVFPPEPHPLAYEKNSQRLPKFAATCVRSLEVMIQLEGSGNWPLDPVAMEKTKSAFLLRIGESLEDRGMFVTASEDEVNVLTSGYSFLLKIFHERGLVVQKQAGDSNTQSAPSEDKELFFRSQHSSMINGLHGIYQAYGPVVRLAKRWISAHLFSSFISEEAVELVVAYLFLRPFPFHAPSSRVTGFLRFLRLLSSFDWTFSPMIVDINNDFNLKDEKEINENFMLSRRSYEQNPHDIEPAMFLATSYDKSSEAWTKQSPSKSVLKRIASYAKSSAELLTNLIMHGQSGQYTWECLFRTPLSNYDAVILLHKEKLCRPHHVLFPAEIPNGKLVIQGKPSNDFHPYMPLSKSVVRSLHDTRDKLLVNFDPTAYFLRDLKCAFPVTFKLWHDSIGGDAIGLTWESSKKRGRDEGDEAMADPTSILKEIGDVGKGLVRSVYLLKAPKLE

SEQ ID NO: 23382 - protein, 1053 aa, Sorghum bicolor
MATTTAASEYSVDRKLSALVEQARPSAAAMRAAAEAVDAVAELVKRVPQQQATPDAARGFVRDLGLGAEKLSFTFRPPEVVRLAGSHAAGAVARPDVAADLLVRLPKECFHEKDFLNHRYHAKRCLYLCVVEKNLRCSKLIHKVSWSTLQDEARKPVLHVYPATEIADLPGFYVRIIPTADSLFNVSKLNVSTRNNVRAYTKDGVNLPTPKYNCSILEDMFLEENADFISSTFANWKALQEALVLVKVWARQRTSIYTHDCLNGYLISAILVFLTVDSGGSMITRSMTTRQIFRVLMNFLATSKVWAKGLVIQSMKKRTITKEDIATCLKTFDVTVFDISGHVNLAFRMTKSAFLELQDEAACALSCLDKCRDGGLEELFMTKVDFCAKFDSCLRINLKGNSKVTELNYCVDDESWRILEKDVQSLLQRGLTDRTKMIRVLWRSTPSEWKIVEGFSEFGSSPLLVGMMVSSLEKSFRLVDIGPNPENRVEAIKFRKFWGEKAELRRFKDGNIAESTVWECQSWEKHTIIKRIADYVLMKHLSLQKDDLIHVVDQLDFCLLVDGQDPVSSSGALLEAFDTISKQLRILDDIPLKISTVQPLDSAFRHTSVFPPEPHPLAYGRNSQRLPKFATTCIRSLEVMIQLEGSGNWPLDPVAMEKTKAAFLLKIGESLEDRGMFVSASEDEVNVLTSGYSFLLKIFHERGLALQKPVGDDKTQSALSEDKMLFQRSQHSSMINGLHGRYQMYGPVVRLAKRWISAHLFSSFISEEAVELVVAYIFLKPFPFHAPSSRVAGFLRFLRLLSSFDWTFSPMVIDINNDFNLKDEKEINDNFMLSRKSYEQSPHDIEPAMFLATSYDKASEAWTKQSPSKSVLKRMAAYAKSSAQLLTNLILHGQSGEYTWECLFRTPMSNYDAVILLHQEKLCCPHHVLFPAETPEGKLVVWGKPSKDFCPYMPLNKGAVKGFHDARDKLLVNFDPTTYFLRDLKCEFSKTFKLWYGSIGGDAVGLTWENPKKRGREEADETEPEPTSILKEVGDVGKGLVRGVYLVKAPKLQ

SEQ ID NO: 23383 - protein, 978 aa, Glycine max
MASATSFLGLGLRPSVPICANRNNGIRFSQFQVSFGFRENSTSLKTLNSTPLKKREAFSNGSSRTRRNPLFSVRCTVSSSGKITQQEFTEMAWQAIISAPEVAKENKHQIVETEHLMKALLEQKNGLARRIFSKVGVDNTRLLEATDKHIQRQPKVVGESAGSMLGRDLEALIQRARDFKKEYGDSFVSVEHFVLGFAQDKRFGKILFRDFQISQQALKSAIESIRGRQSVIDQDPEGKYEALEKYGKDLTAMAKAGKLDPVIGRDDEIRRCIQILSRRTKNNPVLIGEPGVGKTAISEGLAQRIVQGDVPQALMNRRLISLDMGALIAGAKYRGEFEDRLKAVLKEVTESDGQTILFIDEIHTVVGAGASNGAMDAGNLLKPMLGRGELRCIGATTLDEYRKYIEKDPALERRFQQVYVDQPSVEDTISILRGLRERYELHHGVRISDSALVDAAILSDRYISGRFLPDKAIDLVDEAAAKLKMEITSKPTALDEINRSVLKLEMERLSLMNDTDKASKDRLNRLETELSLLKEKQDELTGQWEHEKSVMTNLQSIKEEIDRVNLEIQQAEREYDLNRAAELKYGSLNSLQRQLESAEKELHEYMNSGKSMLREEVTGNDIADIVSKWTGIPISKLQQSDREKLLYLEEELHKRVVGQDPAVKAVAEAIQRSRAGLSDPHRPIASFMFMGPTGVGKTELAKALASYLFNTEEALVRIDMSEYMEKHTVSRLIGAPPGYVGYEEGGQLTETVRRRPYAVILFDEIEKAHSDVFNVFLQILDDGRVTDSQGRTVSFTNTVIIMTSNVGSQYILNTDDDTVPKESAYETIKQRVMDAARSIFRPEFMNRVDEYIVFQPLDRNQISSIVRLQLERVQKRIADRKMKIQVTEAAIQLLGSLGYDPNYGARPVKRVIQQNVENELAKGILRGEFKEEDTILVDTEVTVFANGQLPQQKLVFRRVEADSNSTVEDRREGFPQIL

SEQ ID NO: 23384 - protein, 978 aa, Glycine max
MASATSFSGPTLRPSVPICAHRNNDTRFSQLRVSFNFPANPTSLKGLNSTPLKKREAFSNGSSRTRRNPLFFVRCTVSSSGKITQQEFTEMAWQAIISAPEVAKENKHQIVETEHLMKALLEQKNGLARRIFSKVGVDNTRLLETTDKHIQRQPKVVGESTGSMLGRDLEALIQRARDFKKEYGDSFVSVEHFVLGFAQDKRFGKILFRDFQISQQALKSAIESIRGRQSVIDQDPEGKYEALEKYGKDLTAMAKAGKLDPVIGRDDEIRRCIQILSRRTKNNPVLIGEPGVGKTAISEGLAQRIVQGDVPQALMNRRLISLDMGALIAGAKYRGEFEDRLKAVLKEVTESDGQTILFIDEIHTVVGAGASNGAMDAGNLLKPMLGRGELRCIGATTLDEYRKYIEKDPALERRFQQVYVDQPSVEDTISILRGLRERYELHHGVRISDSALVDAAILSDRYISGRFLPDKAIDLVDEAAAKLKMEITSKPTALDEINRSVLKLEMERLSLMNDTDKASKDRLNRLETELSLLKEKQDELTGQWEHEKSVMTNLQSIKEEIDRVNLEIQQAEREYDLNRAAELKYGSLNSLQRQLESAEKELHEYMNSGKSMLREEVTGNDIAEIVSKWTGIPISKLQQSDREKLLYLEEELHKRVVGQDPAVKAVAEAIQRSRAGLSDPHRPIASFMFMGPTGVGKTELAKALASYLFNTEEALVRIDMSEYMEKHTVSRLIGAPPGYVGYEEGGQLTETVRRRPYAVILFDEIEKAHSDVFNVFLQILDDGRVTDSQGRTVSFTNTVIIMTSNVGSQYILNTDDDTVPKESTYEAIKQRVMDAARSIFRPEFMNRVDEYIVFQPLDRDQISSIVRLQLERVQKRIVDRKMKIQVTEAAIQLLGSLGYDPNYGARPVKRVIQQNVENELAKGILRGEFKEEDTILVDTEVTVLANGQIPQQKLVFRRVEADSSSAAEDRREGFPQIL

SEQ ID NO: 23385 - protein, 978 aa, Glycine max
MASATSFSGPTLRPSVPICAHRNNDTRFSQLRVSFNFPANPTSLKGLNSTPLKKREAFSNGSSRTRRNPLFFVRCTVSSSGKITQQEFTEMAWQAIISAPEVAKENKHQIVETEHLMKALLEQKNGLARRIFSKVGVDNTRLLETTDKHIQRQPKVVGESTGSMLGRDLEALIQRARDFKKEYGDSFVSVEHFVLGFAQDKRFGKILFRDFQISQQALKSAIESIRGRQLVIDQDPEGKYEALEKYGKDLTAMAKAGKLDPVIGRDDEIRRCIQILSRRTKNNPVLIGEPGVGKTAISEGLAQRIVQGDVPQALMNRRLISLDMGALIAGAKYRGEFEDRLKAVLKEVTESDGQTILFIDEIHTVVGAGASNGAMDAGNLLKPMLGRGELRCIGATTLDEYRKYIEKDPALERRFQQVYVDQPSVEDTISILRGLRERYELHHGVRISDSALVDAAILSDRYISGRFLPDKAIDLVDEAAAKLKMEITSKPTALDEINRSVLKLEMERLSLMNDTDKASKDRLNRLETELSLLKEKQDELTGQWEHEKSVMTNLQSIKEEIDRVNLEIQQAEREYDLNRAAELKYGSLNSLQRQLESAEKELHEYMNSGKSMLREEVTGNDIAEIVSKWTGIPISKLQQSDREKLLYLEEELHKRVVGQDPAVKAVAEAIQRSRAGLSDPHRPIASFMFMGPTGVGKTELAKALASYLFNTEEALVRIDMSEYMEKHTVSRLIGAPPGYVGYEEGGQLTETVRRRPYAVILFDEIEKAHSDVFNVFLQILDDGRVTDSQGRTVSFTNTVIIMTSNVGSQYILNTDDDTVPKESTYEAIKQRVMDAARSIFRPEFMNRVDEYIVFQPLDRDQISSIVRLQLERVQKRIVDRKMKIQVTEAAIQLLGSLGYDPNYGARPVKRVIQQNVENELAKGILRGEFKEEDTILVDTEVTVLANGQIPQQKLVFRRVEADSSSAAEDRREGFPQIL

SEQ ID NO: 23386 - protein, 975 aa, Cajanus cajan
MASATSFSGLALRHTAPTRARRNHARFAPFQVSFSFPANPTCVKTLNSVALKKREAFSNGSSRARRNPTRFSVRCTASSSGKEFTEMAWQAIISSPEVAKENKHQIVETEHLMKALLEQKNGLARRIFSKVGVDNTRLLEATDKHIRRQPKVLGESAGSMLGRDLEALIQRARDFKKEYGDSFVSVEHLVLGFAQDQRFGKILFRDFQISQQALKSAIESIRGRQSVIDQDPEGKYEALEKYGKDLTAMAKAGKLDPVIGRDDEIRRCIQILSRRTKNNPVLIGEPGVGKTAISEGLAQRIVQGDVPQALMNRRLISLDMGALIAGAKYRGEFEDRLKAVLKEVTESDGQTILFIDEIHTVVGAGATNGALDAGNLLKPMLGRGELRCIGATTLDEYRKYIEKDPALERRFQQVYVDQPSVEDTISILRGLRERYELHHGVRISDSALVDAAILSDRYISGRFLPDKAIDLVDEAAAKLKMEITSKPTALDEINRSVLKLEMERLSLVNDTGKASKDRLNRLDAELSLLKEKQDELTEQWEHEKSVMTRLQSIKEEIDRVNLEIQQAEREYDLNRAAELKYGSLNSLQRQLESAEKELHEYMNSGKSMLREEVSGNDIAEIVSKWTGIPISKLQQSEREKLLYLEEELHKRVVGQDPAVKAVAEAIQRSRAGLSDPHRPIASFMFMGPTGVGKTELAKALASYLFNTEEALVRIDMSEYMEKLSVSRLIGAPPGYVGYEEGGQLTETVRRRPYAVILFDEIEKAHSDVFNVFLQILDDGRVTDSQGRTVSFTNTVIIMTSNVGSQYILNTDDDTVPKESAYETIKQRVMDAARSIFRPEFMNRVDEYIVFRPLDRDQISSIVRLQLDRVQKRIADRKMKIQVTEAAIQLLGSLGYDPNYGARPVKRVIQQNVENELAKGILRGEFKEEDIILVDTEVTAFSNGQLPQQKLVFRRVEADSESSSIKDSWEGFSQIL

SEQ ID NO: 23387 - protein, 974 aa, Medicago truncatula
MASTTSFSSLILHHSVPIFRNGNNAQLGPFQASCTSQLKPTSLNSIPLKKREAFSNGFSRRRRNSKQFIVRCTDSSGKVSQQEFTEMAWQAIVSSPEVAKENKHQIVETEHLMKALLEQKNGLARRIFTKVGVDNTRLLEATDKHIQRQPKVLGESAGSMLGRDLEALIQRAREFKKEYGDSFVSVEHLVLGFAQDRRFGKILFRDFQISQQALKTAIESVRGRQSVIDQDPEGKYEALEKYGKDLTAMAKAGKLDPVIGRDDEIRRCIQILSRRTKNNPVLIGEPGVGKTAISEGLAQRIVQGDVPQALMNRRLISLDMGALIAGAKYRGEFEDRLKAVLREVTESDGQTILFIDEIHTVVGAGATNGAMDAGNLLKPMLGRGELRCIGATTLDEYRKYIEKDPALERRFQQVYVDQPSVENTISILRGLRERYELHHGVRISDTALVDAAILSDRYISGRFLPDKAIDLVDEAAAKLKMEITSKPTALDEINRSVLKLEMERLSLMNDTDKASKDRLNRLETELSLLKEKQGELTEQWEHEKSVMTRLQSIKEEIDRVNLEIQQAEREYDLNRAAELKYGSLNSLQRQLEGAEKELHEYMSSGKSMLREEVTGNDIGEIVSKWTGIPISKLQQSEREKLLYLEDELHKRVVGQDPAVKAVAEAIQRSRAGLSDPHRPIASFMFMGPTGVGKTELAKALASYMFNTEEALVRIDMSEYMEKHTVSRLIGAPPGYVGYEEGGQLTETVRRRPYAVILFDEIEKAHSDVFNVFLQILDDGRVTDSQGRTVSFTNTVIIMTSNVGSQYILNMDDDSVPKDSAYETMKQRVMDAARSIFRPEFMNRVDEYIVFRPLDRDQISSIVRLQLERVQKRVADRKMKIRVTEPAIQLLGSLGYDPSYGARPVKRVIQQNVENELAKGILRGEFKEEDTILIDTEVTVLANGQRPQQKLVFRRVEADSESTAKDSRESFPQIL

SEQ ID NO: 23388 - protein, 977 aa, Trifolium pratense
MASTTSFSSLILHHSVPIFRNGNNPQSSPFQASFNSSLKPISLKSLNSLPLKKREDFSNGFSRIRRNPKKFTVSCTSSSGKVSQQEFTEMAWQAIVSSPEVAKENKHQIVETEHLMKALLEQKNGLARRIFSKVGIDNTRLLEATDKHIQRQPKVLGESAGSMLGRDLEALIQRARDFKKEYGDSFVSVEHLVLGFAQDRRFGKILFRDFQISEKSLKTAIESVRGRQSVIDQDPEGKYEALEKYGKDLTAMAKAGKLDPVIGRDDEIRRCIQILSRRTKNNPVLIGEPGVGKTAISEGLAQRIVQGDVPQALMNRRLISLDMGALIAGAKYRGEFEDRLKAVLREVTESDGQIILFIDEIHTVVGAGATNGAMDAGNLLKPMLGRGELRCIGATTLDEYRKYIEKDPALERRFQQVYVDQPSVENTISILRGLRERYELHHGVRISDTALVDAAILSDRYISGRFLPDKAIDLVDEAAAKLKMEITSKPTALDEINRSVLKLEMERLSLMNDTDKASKDRLNRLETELSLLKGKQDELTEQWEHEKSVMTRLQSIKEEIDRVNLEIQQAEREYDLNRAAELKYGSLNSLQRQLEGAEKELHEYMSSGKSMLREEVTGNDIGEIVSKWTGIPISKLQQSEREKLLYLEDELHKRLVGQDPAVKAVAEAIQRSRAGLSDPHRPIASFMFMGPTGVGKTELAKALASYMFNTEEALVRIDMSEYMEKHTVSRLIGAPPGYVGYEEGGQLTETVRRRPYAVILFDEIEKAHSDVFNVFLQILDDGRVTDSQGRTVSFTNTVIIMTSNVGSAYILNTDDDTTPKDLAYETIKQRVMDAARSIFRPEFMNRVDEYIVFRPLDRDQISRIVRLQLERVQKRIADRKMKLRVTEAAIQLLGSLGYDPNYGARPVKRVIQQNVENELAKGILRGDFKEEDTILVDTEVTVLANGQIPQQKLTFRRVEADSESSAKNSRESSPQIL

SEQ ID NO: 23389 - protein, 978 aa, Cicer arietinum
MPSTSSFSTLILNHSVPIFRNLNYFQFSPFHFSVASSLKSNSLKTLNSLPFKNKEHFSNGYLRIRRNPKQFTVRCTDSTGKVTQQEFTEMAWQAIVSSPEVAKQNKHQIVETEHLMKALLEQKNGLARRIFSKAGVDNTRLLEATDKHIQRQPKVLGESAGAMLGRDLEALIQRARDFKKEYGDSFVSVEHLVLGFAQDRRFGKILFRDFQISQQALKAAIESIRGKQSVIDQDPEGKYEALEKYGKDLTAMAKAGKLDPVIGRDDEIRRCIQILSRRTKNNPVLIGEPGVGKTAISEGLAQRIVQGDVPQALMNRRLISLDMGALIAGAKYRGEFEDRLKAVLKEVTESDGQTILFIDEIHTVVGAGATNGAMDAGNLLKPMLGRGELRCIGATTLDEYRKYIEKDPALERRFQQVYVDQPSVENTISILRGLRERYELHHGVRISDTALVDAAILSDRYISGRFLPDKAIDLVDEAAAKLKMEITSKPTALDEINRSVLKLEMERLSLMNDTDKASKDRLNRLETELSLLKEKQDELTQQWEHEKSVMTRLQSIKEEIDRVNLEIQQAEREYDLNRAAELKYGSLNSLQRQLEGAEKELHEYMSSGKSMLREEVTGNDIAEIVSKWTGIPISKLQQSEREKLLYLEDELHKRVVGQDPAVKAVAEAIQRSRAGLSDPHRPIASFMFMGPTGVGKTELAKALASYLFNTEEALVRIDMSEYMEKHTVSRLIGAPPGYVGYEEGGQLTETVRRRPYAVILFDEIEKAHSDVFNVFLQILDDGRVTDSQGRTISFTNTVIIMTSNVGSQYILNPDDDTAPKDSAYETMKNRVMDAARSIFRPEFMNRVDEYIVFRPLDRDQISSIVRLQLERVQKRIADRKMKIHVTEAAIQLLGSLGYDPNYGARPVKRVIQQNVENELAKGILRGEFKDEDTILVDTEVTILANGQIPQQKLVFKRVEAGSGSNSTKDSREGFPQML

SEQ ID NO: 23390 - protein, 977 aa, Trifolium pratense
MASTTSFSSLILHHSVPIFRNGNNPQSAPFQASFNSSLKPISLKSLNSLPLKKREDFSNGFSRIRRNPKKFTVSCTSSSGKVSQQEFTEMAWQAIVSSPEVAKENKHQIVETEHLMKALLEQKNGLARRIFSKVGIDNTRLLEATDKHIQRQPKVLGESAGSMLGRDLEALIQRARDFKKEYGDSFVSVEHLVLGFAQDRRFGKILFRDFQISEQSLKTAIESVRGRQSVIDQDPEGKYEALEKYGKDLTAMAKAGKLDPVIGRDDEIRRCIQILSRRTKNNPVLIGEPGVGKTAISEGLAQRIVQGDVPQALMNRRLISLDMGALIAGAKYRGEFEDRLKAVLKEVTESDGQTILFIDEIHTVVGAGATNGAMDAGNLLKPMLGRGELRCIGATTLDEYRKYIEKDPALECRFQQVYVDQPSVENTISILRGLRERYELHHGVRISDTALVDAAILSDRYISGRFLPDKAIDLVDEAAAKLKMEITSKPTALDEINRSVLKLEMERLSLMNDTDRASKDRLNRLETELSLLKGKQDELTQQWEHEKSVMTRLQSIKEEIDRVNLEIQQAEREYDLNRAAELKYGSLNSLQRQLEGAEKELHEYMSSGKSMLREEVTGNDIGEIVSKWTGIPISKLQQSEREKLLYLEDELHKRVVGQDPAVKAVAEAIQRSRAGLSDPHRPIASFMFMGPTGVGKTELAKALASYMLNTEEALVRIDMSEYMEKHTVSRLIGAPPGYVGYEEGGQLTEVVRRRPYAVILFDEIEKAHSDVFNIFLQILDDGRVTDSQGRTVSFTNTVIIMTSNVGSSYILNTDDDTTPKDIAYETIKQRVMDAARSIFRPEFMNRVDEYIVFRPLDRDQISRIVRLQLERVQKRIADRKMKLRVTEAAIQLLGSLGYDPNYGARPVKRVIQQNVENELAKGILRGDFKEEDTILVDTEVTVLANGQIPQQKLTFRRVEADSESSTKNNRESSPQIL

SEQ ID NO: 23391 - protein, 974 aa, Lupinus angustifolius
MASTTSFSRLTFPLSSHRNDARFSHFQSFLHFPSKPTSLKTLNTVPFNKREPFSNGFHRIRRNPKQFSVLCATASNGKITQQEFTEMAWQAIVSSPEVAKENKHQIVETEHLMKALLEQKNGLARRIFSKVGVDNTRLLEATDKHIQRQPKVLGDSGGSMLGRDLEALIQRARDFKKEYGDSFVSVEHLLLGFAEDKRFGKILFRDFQITQQALKSAIESIRGRQSVIDQDPEGKYEALEKYGKDLTAMAKAGKLDPVIGRDDEIRRCIQILSRRTKNNPVLIGEPGVGKTAISEGLAQRIVQGDVPQALMNRKLISLDMGALIAGAKYRGEFEDRLKAVLKEVTESDGQTVLFIDEIHTVVGAGATNGAMDAGNLLKPMLGRGELRCIGATTLDEYRKYIEKDPALERRFQQVYVDQPTVEDTISILRGLRERYELHHGVRISDSALVEAAILSDRYISGRFLPDKAIDLVDEAAAKLKMEITSKPTALDEINRSVLKLEMERLSLMNDTDKASKDRLNRLETELSLLKKKQDELTQQWEHEKSVVTRFQSIKEEIDRVNLEILQAEREYDLNRAAELKYGSLNSLQRKLESAEKELQEYMNSGKSMLREEVTGSDIAEIVSKWTGIPISKLQESEREKLLHLEEELHNRVVGQDPAVKAVAEAIQRSRAGLSDPHRPIASFMFMGPTGVGKTELAKALASYLFNTEEALVRIDMSEYMEKHTVSRLIGAPPGYVGYEEGGQLTETVRRRPYAVILFDEIEKAHSDVFNVFLQVLDDGRVTDSQGRTVSFTNTVIIMTSNVGSQYILNTDDDTVPKELAYETIKQRVMDAARSIFRPEFMNRVDEYIVFQPLDRDQISSIVRLQLERVQTRIAYRKMKIQVTEAATQLLANLGYDPNYGARPVKRVIQQNVENELAKGILRGDFKDEDTILIDTEVTAFSNGQLPQQKLSFRRLDTDSESTTRDSEKSFKQIL

SEQ ID NO: 23392 - protein, 973 aa, Cajanus cajan
MASTTSFSLSHAVPFSCTTNVPRFSHRLSFTSPPKPVSLKPLQSLPFNKRHHFANGFQTIRRNSSPFIVRCEASSGRITQQEFTEMAWQAIVSSPEVAKENKHQIVETEHLMKALLEQKNGLARRIFSKVGVDNTRLLEATDKYIQRQPKVLGESPGSMLGRDLEALVQRARDHKKKYGDSFVSVEHLVLAFTQDQRFGKQFFRDFQISESALKSAIESIRGNQSVIDQDPEGKYEALEKYGKDLTAMAKAGKLDPVIGRDDEIRRCIQILSRRTKNNPVLIGEPGVGKTAISEGLAQRIVQGDVPQALMNRRLISLDMGALIAGAKYRGEFEDRLKAVLKEVTESDGQTILFIDEIHTVVGAGATNGAMDAGNLLKPMLGRGELRCIGATTLDEYRKYIEKDPALERRFQQVYVDQPTVEDTISILRGLRERYELHHGVRISDSALVEAAILSDRYISGRFLPDKAIDLVDEAAAKLKMEITSKPTALDEINRSVLKLEMERLSLMNDTDKASKDRLNRLEAELSLLKEKQVELTEQWEHEKSVMTRIQSIKEEIDRVNLEIQQAEREYDLNRAAELKYGSLNSLQRQLESAEKELDEYMNSGKSMLREEVTGNDIAEIVSKWTGIPVSKLQQSEREKLLYLEEVLHKRVVGQDPAVKAVAEAIQRSRAGLSDPHRPIASFMFMGPTGVGKTELAKALAAYLFNTEEALVRIDMSEYMEKHAVSRLIGAPPGYVGYEEGGQLTETVRRRPYAVILFDEIEKAHADVFNVFLQILDDGRVTDSQGRTVSFTNTVIIMTSNVGSQYILNTEDETVPKELAYETIKQRVMDAARSIFRPEFMNRVDEYIVFQPLDRDQISSIVRLQLERVQKRIADRKMKIQVTDAAIQLLGNLGYDPNYGARPVKRVIQQNVENELAKGILRGEIKEEDAILIDTELTAFTNGQLPQQKLVFKKLAADSEPTTQDSLEPFPQAP

SEQ ID NO: 23393 - protein, 974 aa, Glycine max
MASTSSFSLSHAVVPFSCNTKHGHLSHNLLYLSFAKPISLKPLQSLPFNKRHPFANGFQRIRRNSSPFIVRCEASSGRITQQEFTEMAWQAIVSSPEVAKENKHQIVETEHLMKALLEQKNGLARRIFSKVGVDNTRLLEATDKYIQRQPKVLGESSGSMLGRDLEALIQRARDHKKKYGDSFVSVEHLVLAFTQDQRFGKQFFRDFQISEPALKSAIESVRGRQSVIDQDPEGKYEALEKYGKDLTAMAKAGKLDPVIGRDDEIRRCIQILSRRTKNNPVLIGEPGVGKTAISEGLAQRIVQGDVPQALMDRRLISLDMGALIAGAKYRGEFEDRLKAVLKEVTESDGQTILFIDEIHTVVGAGATNGAMDAGNLLKPMLGRGELRCIGATTLDEYRKYIEKDPALERRFQQVYVDQPTVEDTISILRGLRERYELHHGVRISDSALVEAAILSDRYISGRFLPDKAIDLVDEAAAKLKMEITSKPTALDEINRSVLKLEMERLSLMNDTDKASKDRLNRLEAELSLLKEKQAELTEQWEHEKSVMTRIQSIKEEIDRVNLEIQQAEREYDLNRAAELKYGSLNSLQRQLESAEKELDEYMNSGKSMLREEVTGNDIAEIVSKWTGIPVSKLQQSEREKLLHLEEVLHKRVVGQDPAVKAIAEAIQRSRAGLSDPHRPIASFMFMGPTGVGKTELAKALAAYLFNTEEALVRIDMSEYMEKHAVSRLIGAPPGYVGYEEGGQLTEIVRRRPYAVILFDEIEKAHADVFNVFLQILDDGRVTDSQGRTVSFTNTVIIMTSNVGSQYILNTDDDTTPKELAYETIKQRVMDAARSIFRPEFMNRVDEYIVFQPLDREQISSIVRLQLERVQKRIADRKMKIQVTDAAVQLLGSLGYDPNYGARPVKRVIQQNVENELAKGILRGEFKEEDAIIIDTELTAFTNGQLPQQKLVFKKLAADSESTPQDTLEPFPQAP

SEQ ID NO: 23394 - protein, 974 aa, Glycine max
MASTTSFSLSHAVVPFSCNTKHGHLSHNRHYLSLPKPISLKPLRSPSFNKRHSFANGFQTIRRNSSPFTVRCEASSGRITQQEFTEMAWQAIVSSPEVAKENKHQIVETEHLMKALLEQKNGLARRIFSKVGVDNTRLLEATDKYIQRQPKVLGESSGSMLGRDLEALIQRARDHKKKYGDSFVSVEHLVLAFTQDQRFGKQFFRDFQISEPALKSAIESVRGRQSVIDQDPEGKYEALEKYGKDLTAMAKAGKLDPVIGRDDEIRRCIQILSRRTKNNPVLIGEPGVGKTAISEGLAQRIVHGDVPQALMNRRLISLDMGALIAGAKYRGEFEDRLKAVLKEVTESDGQTILFIDEIHTVVGAGATNGAMDAGNLLKPMLGRGELRCIGATTLDEYRKYIEKDPALERRFQQVYVDQPTVEDTISILRGLRERYELHHGVRISDSALVEAAILSDRYISGRFLPDKAIDLVDEAAAKLKMEITSKPTALDEINRSVLKLEMERLSLMNDTDKASKDRLNRLEAELSLLKEKQAELTEQWEHEKSVMTRIQSIKEEIDRVNLEIQQAEREYDLNRAAELKYGSLNSLQRQLESAEKELDEYMNSGKSMLREEVTGNDIAEIVSKWTGIPVSKLQQSEREKLLYLEEVLHKRVVGQDPVVKAVAEAIQRSRAGLSDPHRPIASFMFMGPTGVGKTELAKALAAYLFNTEEALVRIDMSEYMEKHAVSRLIGAPPGYVGYEEGGQLTEIVRRRPYAVILFDEIEKAHADVFNVFLQILDDGRVTDSQGRTVSFTNTVIIMTSNVGSQYILNTDDDTTPKELAYETIKQRVMDAARSIFRPEFMNRVDEYIVFQPLDREQISSIVRLQLERVQKRIADRKMKIQVTDAAVQLLGSLGYDPNYGARPVKRVIQQNVENELAKGILRGEFKEEDAILIDTELTAFTNGQLPQQKLVFKKLAADSESTPQGTLEPFPQAP

SEQ ID NO: 23395 - protein, 978 aa, Medicago truncatula
MASTTSFSLPYSTPISFNRRNSAIYFSHHHRVSLSFSAKRVSLKSSLPLNQRRFLANGICRTQTNSKRFSVRCEASSTGTGRITQQEFTEMAWQAIVSSPEVAKENKHQIVETEHLMKALLEQKNGLARRIFTKVGVDNTQLLEATDKFIQRQPKVIGESAGSMLGRDLEGLIQRARDFQKEYGDSFVSVEHLVLGFIQDQRFGKQLFKDFQISQQGLKSAIESIRGRQSVIDQDPEGKYEALEKYGKDLTAMAKAGKLDPVIGRDDEIRRCIQILSRRTKNNPVLIGEPGVGKTAISEGLAQRIVQGDVPQALMNRRLISLDMGALIAGAKYRGEFEDRLKAVLKEVTESDGQTILFIDEIHTVVGAGATNGAMDAGNLLKPMLGRGELRCIGATTLDEYRKYIEKDPALERRFQQVYVDQPTVEDTISILRGLRERYELHHGVRISDSALVEAAILSDRYISGRFLPDKAIDLVDEAAAKLKMEITSKPTALDEINRSVLKLEMERLSLTNDTDKASKDRLSRLEAELSLLKHKQAELTEQWEHEKSVMTRLQSIKEEIDRVNLEIQQAEREYDLNRAAELKYGSLNSLQRQLESAEKELDEYMNSGKSMLREEVTGSDIAEIVSKWTGIPVSKLQQSEREKLLYLEEVLHKRVVGQDPAVKAVAEAIQRSRAGLSDPHRPIASFMFMGPTGVGKTELAKTLASYMFNTEEALVRIDMSEYMEKHAVSRLIGAPPGYVGYEEGGQLTETVRRRPYAVILFDEIEKAHSDVFNVFLQILDDGRVTDSQGRTVSFTNTVIIMTSNVGSQYILNTDDDTAPKELAYETIKQRVMDAARSIFRPEFMNRVDEYIVFQPLDRDQISSIVRLQLERVQKRITDRKMKIQVTDAAIQLLGSLGYDPNYGARPVKRVIQQNVENELAKGILRGEFKDEDTILVDTELTALANNQLPQQKLVFRKIEVDSRSTPQESLEHSSQAP

SEQ ID NO: 23396 - protein, 973 aa, Cicer arietinum
MASTTSFSIPHSVPISCYRNSSRNSHHYNVSLSFSAKPFSLKSLPLNQRYKHANGFCGIQTNSTRFSVRCEASSAGRITQQEFTEMAWQAIVSSPEMAKENKHQIVETEHLMKALLEQKNGLARRIFSKVSVDNTRLLEATDKYIQRQPKVIGESAGSMLGRDLEALIQRARDYKKEYGDSFVSVEHLVLGFTEDQRFGKQLFRDFQISQQGLKSAIESIRGHQSVIDQDPEGKYEALEKYGKDLTAMAKAGKLDPVIGRDDEIRRCIQILSRRTKNNPVLIGEPGVGKTAISEGLAQRIVQGDVPQALMNRRLISLDMGALIAGAKYRGEFEDRLKAVLKEVTESDGQTILFIDEIHTVVGAGATNGAMDAGNLLKPMLGRGELRCIGATTLDEYRKYIEKDPALERRFQQVYVDQPTVEDTISILRGLRERYELHHGVRISDSALVEAAILSDRYISGRFLPDKAIDLVDEAAAKLKMEITSKPTALDEINRSVLKLEMERLSLMNDTDKASKDRLYRLEAELSLLKEKQVELTEQWEHEKSVMTRIQSIKEEIDRVNLEIQQAEREYDLNRAAELKYGSLNSLTRQLESAEKELVEYMNSGKSMLREEVSGNDIAEIVSKWTGIPVSKLQQSEREKLLYLEEVLHKRVVGQDPAVTAVAEAIQRSRAGLSDPHRPIASFMFMGPTGVGKTELAKALASYMFNTEEALVRIDMSEYMEKHAVSRLIGAPPGYVGYEEGGQLTETIRRRPYAVILFDEIEKAHSDVFNVFLQILDDGRVTDSQGRTVSFTNTVIIMTSNVGSQYILNTDDDTAPKELAYETIKHRVMDAARSIFRPEFMNRVDEYIVFQPLDRDQISHIVRLQLERVQKRIADRKMKIRVTDAAIQHLGSLGYDPNYGARPVKRVIQQNVENELAKGILRGEFKDEDTILVDTELKAFSNNQLPQQKLVFRKIEADSQSTPKENFEPSPQAP

SEQ ID NO: 23397 - protein, 973 aa, Lupinus angustifolius
MASTTSFSSLFFSHSVPISSNRNHHPQISLAFYAKPSFPNHLKSLSLNKRNVFSNGFQRILRNSTPFSVRCEASSSGRITQQEFTEMAWQSIVSSPEVAKENKHQIVETEHLMKALLEQKNGLARRIFSKVGVDNTRLLEATDKYIQRQPKVLGESAGSMLGRDLEALIQRARDYKKEYGDSFVSVEHLVLGFAQDQRFGKQFFKDFQISQQALKSAIESVRGRQSVIDQDPEGKYEALEKYGKDLTAMAKAGKLDPVIGRDDEIRRCIQILSRRTKNNPVLIGEPGVGKTAISEGLAQRIVQGDVPQALMNRRLISLDMGSLIAGAKYRGEFEDRLKAVLKEVTESDGQTILFIDEIHTVVGAGATNGAMDAGNLLKPMLGRGELRCIGATTLDEYRKYIEKDPALERRFQQVYVDQPTVEDTISILRGLRERYELHHGVRISDSALVEAAILSDRYISGRFLPDKAIDLVDEAAAKLKMEITSKPTVLDEINRSVLKLEMERLSLMNDTDKASKDRLSRLDAELSLLKEKQVELTEQWEHEKSVMTRIQSIKEEIDRVNLEIQQAEREYDLNRAAELKYGSLNSLQRQLESAEKELDEYMNSGKSMLREEVTENDIAEIVSKWTGIPVSKLQQSEREKLLYLEQVLHKRVVGQNPAVKAVAEAIQRSRAGLSDPHRPIASFMFMGPTGVGKTELAKALASYLFNTEEALVRIDMSEYMEKHAVSRLIGAPPGYVGYEEGGQLTETVRRRPYAVILFDEIEKAHSDVFNVFLQILDDGRVTDSQGRTVSFTNTVIIMTSNVGSQYILNTDDDTVAKELAYETIKQRVMDAARSVFRPEFMNRVDEYIVFQPLDRDQISNIVRLQLERVQKRIADRKMKVQVTDAAIQLLGSLGYDPNYGARPVKRVIQQNVENELAKGILRGEFKDEDAILIDTELTPFGNGQLPQQKLVFKKLEADSKSTTQDSLERAQAP

SEQ ID NO: 23398 - protein, 980 aa, Arachis hypogaea
MASTTSFPGLSSLSHSVPISCSRNHRALLSNPRYSSLAFPSKPFNLLRSLPITKRNHFANGFRTTTHRNPQRFSVRCEASSGRITQQEFTEMAWQAIVSSPEVAKENKHQIVETEHLMKALLEQKNGLARRIFSKAGVDNTRLLEATDKYIQRQPKVLGESAGSMLGRELEALIQRARDYKKEYGDSFVSVEHFLLGFTQDQRFGKQLFRDFQISQQTLKSAIESVRGRQSVIDQDPEGKYEALEKYGKDLTAMAKAGKLDPVIGRDDEIRRCIQILSRRTKNNPVLIGEPGVGKTAISEGLAQRIVQGDVPQALMNRRLISLDMGALIAGAKYRGEFEDRLKAVLKEVTESEGQTILFIDEIHTVVGAGATNGAMDAGNLLKPMLGRGELRCIGATTLDEYRKYIEKDPALERRFQQVYVDQPTVEDTISILRGLRERYELHHGVRISDSALVEAAILSDRYISGRFLPDKAIDLVDEAAAKLKMEITSKPTALDEINRSVLKLEMERLSLTNDTDKASRDRLNRLETELSLLKEKQAELTEQWEHEKSVMTRIQSIKEEIDRVNLEIQQAEREYDLNRAAELKYGSLNSLQRQLETAEKELDEYMSSGQSMLREEVTGNDIAEIVSKWTGIPVSKLQQSEREKLLYLEDVLHKRVVGQDPAVRAVAEAIQRSRAGLSDPHRPIASFMFMGPTGVGKTELAKALASYLFNTEEALVRIDMSEYMEKHAVSRLIGAPPGYVGYEEGGQLTETVRRRPYAVILFDEIEKAHADVFNVFLQILDDGRVTDSQGRTVSFTNTVIIMTSNVGSQYIINTDDETESKESTYETIKQRVLDAARAVFRPEFMNRVDEYIVFQPLDREQISSIVRLQLERVQKRISDKKMKIKVTDAAIELLGSLGYDPNYGARPVKRVIQQNVENELAKGILRGEFKDEDTILIDTEVTAFSNGQLPQQKLTFRKIEPDSAEPSTQDSLEPFPQTS

SEQ ID NO: 23399 - protein, 972 aa, Trifolium pratense
MASTTSFSLPYSVPISCYRNSSRRNVSLSFSAKPISIESSLQFNQRKLLANGFCRTIQTNSSRFSVRCEASATGTGRITQQEFTEMAWQAIVLSPEVAKENKHQIVETEHLLKALLEQKNGLARRIFSKVGVDNTRLLEATDKYIQRQPKVIGESAGSMLGRDLEALIQRARDYKKEYGDSFVSVEHLVLGFIQDQRFGKQLFKEFQISQQGLKSAIESIRGRQAVIDQDPEGKYEALEKYGKDLTAMAKAGKLDPVIGRDDEIRRCIQILSRRTKNNPVLIGEPGVGKTAISEGLAQRIVQGDVPQALMNRRLISLDMGALIAGAKYRGEFEDRLKAVLKEVTESDGQTILFIDEIHTVVGAGATNGAMDAGNLLKPMLGRGELRCIGATTLDEYRKYIEKDPALERRFQQVYVDQPTVEDTISILRGLRERYELHHGVRISDSALVEAAILSDRYISGRFLPDKAIDLVDEAAAKLKMEITSKPTALDEINRSVLKFEMERLSLMNDTDKASKDRLNRLETELSLLKEKQSELTEQWEHEKSVMTRIQSIKEEIDRVNLEIQQAEREYDLNRAAELKYGSLNSLQRQLESAEKELDEYMNSGKSMLREEVTGSDIAEIVSKWTGIPVSKLQQSEREKLLYLEEVLHKRVVGQDPAVKAVAEAIQRSRAGLSDPHRPIASFMFMGPTGVGKTELAKTLASYMFNTEEALVRIDMSEYMEKHAVSRLIGAPPGYVGYEEGGQLTETVRRRPYAVILFDEIEKAHSDVFNIFLQILDDGRVTDSQGRTVSFTNTVIIMTSNVGSQYILNTDDDTTPKELAYETIKQRVMDAARSIFRPEFMNRVDEYIVFQPLDRDQISSIVRLQLERVQKRIADRKMKIRVTDAAIQLLGSLGYDPSYGARPVKRVIQQNVENELAKGILRGEFMEEDTILVDTELTAFANNQLPQQKLVFRKIEADSQSTPQEMEPSAQAP

SEQ ID NO: 23400 - protein, 982 aa, Phaseolus vulgaris
MLSSSSPIASMTSLSLSHLAVPFSCNTNRARFYHRRSPSFSKPISLKPLQSLPFNKRHPFANGFWTIRRNSSPLTVRCEASSGRITQQEFTEMAWQAIVSSPEVAKENKHQIVETEHLMKALLEQKNGLARRIFSKVGVDNTRLLEATDKYIQRQPKVLGESSGSMLGRDLEALIQRARDHKKQFGDSFVSVEHLVLAFTQDQRFGKQFFRDFQISEPALKSAVESIRGPQSVIDQDPEGKYEALEKYGKDLTAMAKAGKLDPVIGRDDEIRRCIQILSRRTKNNPVLIGEPGVGKTAISEGLAQRIVQGDVPQALMNRRLISLDMGALIAGAKYRGEFEDRLKAVLKEVTDSDGQTILFIDEIHTVVGAGATNGAMDAGNLLKPMLGRGELRCIGATTLDEYRKYIEKDPALERRFQQVYVDQPTVEDTISILRGLRERYELHHGVRISDSALVEAAILSDRYISGRFLPDKAIDLVDEAAAKLKMEITSKPTALDEINRSVLKLEMERLSLVNDTDKATKDRLNRLETELSLLKEKQAELTEQWEHEKSVMTRIQSIKEEIDRVNLEIQQAEREYDLNRAAELKYGSLNSLQRQLESAEKELNEYMNTGKSMLREEVSGSDIAEIVSKWTGIPVSKLQQSEREKLLYLEEVLHKRVVGQNPAVKAVAEAIQRSRAGLSDPHRPIASFMFMGPTGVGKTELAKALAAYLFNTEEALVRIDMSEYMEKHAVSRLIGAPPGYVGYEEGGQLTEIVRRRPYAVILFDEIEKAHSDVFNVFLQILDDGRVTDSQGRTVSFTNTVIIMTSNVGSQYILNTDDDTVPKELAYETIKQRVMDAARSIFRPEFMNRVDEYIVFQPLDREQIGSIVRLQLERVQKRVADRKMKIQVTDAALQLLGSLGYDPNYGARPVKRVIQQNVENELAKGILRGEFKEEDAVLIDTELTAFTNGQLPQQKLVFKKLAAESESPTAEDSSLEPSPQAP

SEQ ID NO: 23401 - protein, 971 aa, Citrullus lanatus
MASTTAASYAIGIRFPSHSSSISSTTNTLILKPPLALSLTVKPKSPLLLKSNGGCQRFGRNSRFVVRCDASNGRITQQEFTEMAWQAVVSSPEIAKENKHQIVETEHLMKTLLEQKNGLARRIFSKIGVDNTRLLEATDKFIKRQPKVLGESAGSMLGRDLEALIQRAREFKKEYGDSFVSVEHLVLGFVQDQRFGKQLFKDFQISLQTLKSAIESIRGRQSVIDQDPEGKYESLEKYGKDLTALAKAGKLDPVIGRDDEIRRCIQILSRRTKNNPVLIGEPGVGKTAISEGLAQRIVQGDVPQALMNRRLISLDMGALIAGAKYRGEFEDRLKAVLKEVTESDGQIILFIDEIHTVVGAGATNGAMDAGNLLKPMLGRGELRCIGATTLDEYRKYIEKDPALERRFQQVYVDQPTVENTISILRGLRERYELHHGVRISDSALVEAAILSDRYISGRFLPDKAIDLVDEAAAKLKMEITSKPTALDEINRAVLKLEMERLSLTNDTDRASRDRLSRLETELSLLKEKQAQLTEQWEHEKSVMTRLQSIKEEIDRVNLEIQQAEREYDLNRAAELKYGSLNSLQRQLADAEKELDEYMNSGKSMLREEVTGSDIAEIVSKWTGIPVSKLQQSEREKLLHLEEELHKRVVGQDPAVKSVADAIQRSRAGLSDPNRPIASFMFMGPTGVGKTELAKALASYLFNTEEALVRIDMSEYMEKHAVSRLIGAPPGYVGYEEGGQLTETVRRRPYAVILFDEIEKAHSDVFNVFLQILDDGRVTDSQGRTVSFTNTVIIMTSNVGSQYILNTDDDTLTKETTYETIKRRVLEAARSIFRPEFMNRVDEYIVFQPLDRDQISSIVRLQLQRVQKRVADKKMKIEVSDAAIQLLGSLGYDPNYGARPVKRVIQQNVENEIAKGILKGEFKDEDTILIDTEVSAFSNGQLPQQKLVFRRMENKATENPNADSREASAQVL

SEQ ID NO: 23402 - protein, 973 aa, Citrus clementina
MAARASLSGVSLCTPPPSQKRNVVVFGQPQCLLSFPRRANSFKGLNFNSVQLKKRNGLFSKGHDKSFLIRCEATSGRITQQDFTDMAWQAIVSSPDVAKENKHQIVETEHLLKALLEQKNGLARRIFSKVGVDNTRLLEATEKFIQRQPKVLGETAGSMLGRDLEALIQRSREYKKEYGDSFVSVEHLVLGFTQDQRFGKQLFRDFQISLPTLKSAIEAIRGRQSVIDQDPEGKYEALEKYGKDLTAMASAGKLDPVIGRDDEIRRCIQILSRRTKNNPVLIGEPGVGKTAISEGLAQRIVQGDVPQALMNRKLISLDMGALIAGAKYRGEFEDRLKAVLKEVTESEGQIILFIDEIHTVVGAGATNGAMDAGNLLKPMLGRGELRCIGATTLDEYRKYIEKDPALERRFQQVYVDQPTVEDTISILRGLRERYELHHGVRISDSALVEAAILSDRYISGRFLPDKAIDLVDEAAAKLKMEITSKPTALDEINRSVLKLEMERLSLTNDTDKASKDRLNRLEAELSLLKERQAQLTEQWEHEKTVMTRIQSIKEEIDRVNLEIQQAEREYDLNRAAELKYGSLNALQRQLESAEKELNEYISSGKSMLREEVTGSDIAEIVSKWTGIPVSKLQQSEREKLLHLEEELHKRVVGQDPAVKSVAEAIQRSRAGLSDPHRPIASFMFMGPTGVGKTELAKALASYMFNTEEALVRIDMSEYMEKHAVSRLIGAPPGYVGYEEGGQLTEVVRRRPYAVILFDEIEKAHSDVFNVFLQILDDGRVTDSQGRTVSFTNTVIIMTSNVGSQYILNMDDETFPKETAYETIKQRVMDAARSIFRPEFMNRVDEYIVFQPLDRDQISSIVRLQLDRVQKRIADRKMKMQVTDAAIQLLGSLGYDPNYGARPVKRVIQQYVENELAKGILRGEFKDDDTIVTDTEVTAFSNGQLPQQKLVFRRLDTSSDASAADNQEAFSQTA

SEQ ID NO: 23403 - protein, 973 aa, Citrus sinensis
MAARASLSGVSLCTPPPSQKRNVVVFGQPQCLLSFPTRANFFKGLNFNSVQLKKRNGLFSKGHDKLFLIRCEATSGRITQQDFTDMAWQAIVSSPDVAKENKHQIVETEHLLKALLEQKNGLARRIFSKVGVDNTRLLEATEKFIQRQPKVLGETAGSMLGRDLEALIQRSREYKKEYGDSFVSVEHLVLGFTQDQRFGKQLFRDFQISLPTLKSAIEAIRGRQSVIDQDPEGKYEALEKYGKDLTAMASAGKLDPVIGRDDEIRRCIQILSRRTKNNPVLIGEPGVGKTAISEGLAQRIVQGDVPQALMNRKLISLDMGALIAGAKYRGEFEDRLKAVLKEVTESEGQIILFIDEIHTVVGAGATNGAMDAGNLLKPMLGRGELRCIGATTLDEYRKYIEKDPALERRFQQVYVDQPNVEDTISILRGLRERYELHHGVRISDSALVEAAILSDRYISGRFLPDKAIDLVDEAAAKLKMEITSKPTALDEINRSVLKLEMERLSLTNDTDKASKDRLNRLEAELSLLKERQAQLTEQWEHEKTVMTRIQSIKEEIDRVNLEIQQAEREYDLNRAAELKYGSLNALQRQLESAEKELNEYISSGKSMLREEVTGSDIAEIVSKWTGIPVSKLQQSEREKLLHLEEELHKRVVGQDPAVKSVAEAIQRSRAGLSDPHRPIASFMFMGPTGVGKTELAKALASYMFNTEEALVRIDMSEYMEKHAVSRLIGAPPGYVGYEEGGQLTEVVRRRPYAVILFDEIEKAHSDVFNVFLQILDDGRVTDSQGRTVSFTNTVIIMTSNVGSQYILNMDDETFPKETAYETIKQRVMDAARSIFRPEFMNRVDEYIVFQPLDRDQISSIVRLQLDRVQKRIADRKMKMQVTDAAIQLLGSLGYDPNYGARPVKRVIQQYVENELAKGILRGEFKDEDTIVIDTEVTAFSNGQLPQQKLVFRRLDTSSDASAADNQEAFSQTA

SEQ ID NO: 23404 - protein, 924 aa, Trifolium pratense
MAFPEQFKPIHHVSLFAVKLLEPTGTGRITQQEFTEMAWQAIVLSPEVAKENKHQIVETEHLLKALLEQKNGLARRIFSKVGVDNTRLLEATDKYIQRQPKVIGESAGSMLGRDLEALIQRARDYKKEYGDSFVSVEHLVLGFIQDQRFGKQLFKEFQISQQGLKSAIESIRGRQAVIDQDPEGKYEALEKYGKDLTAMAKAGKLDPVIGRDDEIRRCIQILSRRTKNNPVLIGEPGVGKTAISEGLAQRIVQGDVPQALMNRRLISLDMGALIAGAKYRGEFEDRLKAVLREVTESDGQTILFIDEIHTVVGAGATNGAMDAGNLLKPMLGRGELRCIGATTLDEYRKYIEKDPALERRFQQVYVDQPSVENTISILRGLRERYELHHGVRISDTALVDAAILSDRYISGRFLPDKAIDLVDEAAAKLKMEITSKPTALDEINRSVLKLEMERLSLMNDTDKASKDRLNRLETELSLLKGKQDELSKQWEHEKSVMTRLQSIKEEIDRVNLEIQQAEREYDLNRAAELKYGSLNSLQRQLEGAEKELHEYMSSGKSMLREEVTGNDIGEIVSKWTGIPISKLQQSEREKLLYLEDELHKRVVGQDPAVKAVAEAIQRSRAGLSDPHRPIASFMFMGPTGVGKTELAKALASYMFNTEEALVRIDMSEYMEKHTVSRLIGAPPGYVGYEEGGQLTEVVRRRPYAVILFDEIEKAHSDVFNVFLQILDDGRVTDSQGRTVSFTNTVIIMTSNVGSSYILNTDDDTTPKDIAYETIKQRVMDAARSIFRPEFMNRVDEYIVFRPLDRDQISRIVRLQLERVQKRIADRKMKLRVTEAAIQLLGSLGYDPNYGARPVKRVIQQNVENELAKGILRGDFKEEDTILVDTEVTVLANGQIPQQKLTFRRVEADSESSAKNSRESSPQIL

SEQ ID NO: 23405 - protein, 976 aa, Vitis vinifera
MAATTSFSRVHLRFPTNCSNGPALSPHPRLSLNLSARRRSLKALNSLRLKQNDVFLSKRFAGSGKCPRSFVVRCDASGGRITQQDFTEMAWQAIVSSPEVAKENKHQIVETEHLMKALLEQKNGLARRIFSKAGVDNTRLLDATDKFIQRQPKVIGESAGSMLGRDLESLIQRAREYKKEYGDSFVSVEHLVLAFAQDQRFGKQLFKDFQISQKALKSAIEAIRGRQQVIDQDPEGKYEALEKYGKDLTAMAKAGKLDPVIGRDDEIRRCIQILSRRTKNNPVLIGEPGVGKTAISEGLAQRIVQGDVPQALMNRKLISLDMGALIAGAKFRGEFEDRLKAVLKEVTESDGQTILFIDEIHTVVGAGATNGAMDAGNLLKPMLGRGELRCIGATTLDEYRKYIEKDPALERRFQQVYVDQPTVEDTISILRGLRERYELHHGVRISDSALVEAAILSDRYISGRFLPDKAIDLVDEAAAKLKMEITSKPTALDEINRSVLKLEMERLSLTNDTDKASKDRLSRLEAELSLLKEKQAELSEQWEHEKSVMTRLQSIKEEIDRVNLEIQQAEREYDLNRAAELKYGSLNSLQRQLENAEKELDEYMKSGKSMLREEVTGNDIAEIVSKWTGIPVSKLQQSEREKLLHLEEELHKRVVGQDPAVRSVAEAIQRSRAGLSDPHRPIASFMFMGPTGVGKTELAKALASYMFNTEEALVRIDMSEYMEKHAVSRLIGAPPGYVGYEEGGQLTETVRRRPYAVILFDEIEKAHSDVFNVFLQILDDGRVTDSQGRTVSFTNTVIIMTSNVGSQYILNMDDETLPKETAYETIKQRVMDAARSIFRPEFMNRVDEYIVFQPLDRDQISSIVKLQLERVQLRLADRKMKLQVTETAIQLLGSLGYDPNYGARPVKRVIQQNVENELAKGILRGEFKDEDTVLIDTEVTAFSNGQLPQQKLILRKLESDSDTPAAEGQEAFSQTI

SEQ ID NO: 23406 - protein, 981 aa, Prunus persica
MASATSFASGVGLPLPQSVSSKWCNKAAIFARPHISLSFHARTESFRALTSRQLSQNGAFRTGLRRNSRSSRPFVVRCDASTGRITQQDFTEMAWQSIVSSPEVAKENKHQIVETEHLMKALLEQKNGLARRIFSKAGIDNTRLLEATDKYIQRQPKVLGESAGSMLGRDLEALIQRARDYKKEYGDSFVSVEHLVLGFTQDQRFGKQLFRDFQISKETLKSAIESIRGRQSVIDQDPEGKYEALEKYGKDLTAMAKAGKLDPVIGRDDEIRRCIQILSRRTKNNPVLIGEPGVGKTAISEGLAQRIVQGDVPQALMNRKLISLDMGSLIAGAKYRGEFEDRLKAVLKEVTESEGQIILFIDEIHTVVGAGATNGAMDAGNLLKPMLGRGELRCIGATTLDEYRKYIEKDPALERRFQQVYVDQPTVEDTISILRGLRERYELHHGVRISDGALVEAAILSDRYISGRFLPDKAIDLVDEAAAKLKMEITSKPTALDEINRSVLKLEMERLSLTNDTDKASKERLNRLEAELSLLKEKQAELAEQWEHEKSVMTRIQSIKEEIDRVNLEIQQAEREYDLNRAAELKYGSLNSLQRQLVGAEKELDEYMKSGKSMLREEVTGNDIAEIVSKWTGIPVSKLQQSEIEKLLHLEDELHKRVVGQDPAVKSVAEAIQRSRAGLSDPHRPIASFMFMGPTGVGKTELAKALASYMFNTEEALVRIDMSEYMEKHAVSRLIGAPPGYVGYEEGGQLTETVRRRPYSVILFDEIEKAHSDVFNVFLQILDDGRVTDSQGRTVSFTNTVIIMTSNVGSQYILNTDDDTMPKDLAYDTIKKRVMEAARSIFRPEFMNRVDEYIVFQPLDRDQISRIVKLQLNRVQKRIADRKMKVKVSDAAIQLLASLGYDPNYGARPVKRVIQQYVENELAKGILRGDFGEEDTVFIDTEVTAFSNGQLPQQKLLFKRLETDDSESPAAENQEAFSETL

SEQ ID NO: 23407 - protein, 981 aa, Prunus mume
MASATSFASGVGLPLPQSVSSKWCNKAAIFARPHLSLSFHARPGSFRALTSRQLSQNGAFRTGLRRNSRSSRPFVVRCDASTGRITQQDFTEMAWQSIVSSPEVAKENKHQIVETEHLMKALLEQKNGLARRIFSKAGIDNTRLLEATDKYIQRQPKVLGESAGSMLGRDLEALIQRARDYKKEYGDSFVSVEHLVLGFTQDQRFGKQLFRDFQISKETLKSAIESIRGRQSVIDQDPEGKYEALEKYGKDLTAMAKAGKLDPVIGRDDEIRRCIQILSRRTKNNPVLIGEPGVGKTAISEGLAQRIVQGDVPQALMNRKLISLDMGSLIAGAKYRGEFEDRLKAVLKEVTESEGQIILFIDEIHTVVGAGATNGAMDAGNLLKPMLGRGELRCIGATTLDEYRKYIEKDPALERRFQQVYVDQPTVEDTISILRGLRERYELHHGVRISDGALVEAAILSDRYISGRFLPDKAIDLVDEAAAKLKMEITSKPTALDEINRSVLKLEMERLSLTNDTDKASKERLNRLEAELSLLKEKQAELAEQWEHEKSVMTRIQSIKEEIDRVNLEIQQAEREYDLNRAAELKYGSLNSLQRQLGGAEKELDEYLKSGKSMLREEVTGNDIAEIVSKWTGIPVSKLQQSEIDKLLHLEDELHKRVVGQDPAVKSVAEAIQRSRAGLSDPHRPIASFMFMGPTGVGKTELAKALASYMFNTEEALVRIDMSEYMEKHAVSRLIGAPPGYVGYEEGGQLTETVRRRPYSVILFDEIEKAHSDVFNVFLQILDDGRVTDSQGRTVSFTNTVIIMTSNVGSQYILNADDDTMPKDLAYDTIKKRVMEAARSIFRPEFMNRVDEYIVFQPLDRDQISRIVKLQLNRVQKRIADRKMKMKVSDAAIQLLASLGYDPNYGARPVKRVIQQYVENELAKGILRGDFREEDTVFVDTEVTAFSNGQLPQQKLLFKRLETDDSESPAAEKQEAFSETL

SEQ ID NO: 23408 - protein, 976 aa, Cannabis sativa
MASTASFASGVSFHLSSNRCSKTAFFARPQLSLIFPPKPNSFRALKSLQLKRNGAFSNGFQRVGRSSRRLVVRCDASTGTGRITQQEFTEMAWQAIVPEVAKENKHQIVETEHLMKALLEQKNGLARRIFSKVGVDNTRLLETTDKFIQRQPKVLGESAGSMLGRDLEALIQRARDYKKEYGDSFVSVEHLVLGFIQDQRFGKQLLKDFQVSTQSLKTAIESIRGRQTVIDQDPEGKYEALEKYGKDLTAMAKAGKLDPVIGRDDEIRRCIQILSRRTKNNPVLIGEPGVGKTAISEGLAQRIVQGDVPQALMNRKLISLDMGALIAGAKYRGEFEDRLKAVLKEVTDSEGQIVLFIDEIHTVVGAGATNGAMDAGNLLKPMLGRGELRCIGATTLDEYRKYIEKDPALERRFQQVYVDQPTVEDTISILRGLRERYELHHGVRISDGALVEAAILSDRYISGRFLPDKAIDLVDEAAAKLKMEITSKPTALDEINRSVLKLEMERLSLTNDTDKASKDRLSRLDAELSLLKEKQAQLTQQWEHEKSVMTGLQSIKEEIDRVNLEIQQAEREYDLNRAAELKYGSLNSLQRQLAAAEKELDEYMKSGKSMLREEVTGNDIAEIVSKWTGIPVSKLQQSEREKLLHLEEELHKRVVGQNPAVTAVAEAIQRSRAGLSDPHRPIASFMFMGPTGVGKTELAKALASYMFNTEEALVRIDMSEYMEKHAVSRLIGAPPGYVGYEEGGQLTETVRRRPYAVILFDEIEKAHSDVFNVFLQILDDGRVTDSQGRTVSFTNTVIIMTSNVGSQYILNTDDDTSPKELAYETIKQRVMEAARSVFRPEFMNRVDEYIVFQPLDREQINSIVRLQLARVQKRIADRKMKITVSDAAIELLGSLGYDPNYGARPVKRVIQQYVENELAKGILRGDFKEEDCVAIDTEVTAFTNGQLPQHKLVFQRQEPETEPQASEGQEALSGTV

SEQ ID NO: 23409 - protein, 981 aa, Lactuca sativa
MATTTSFPGVRIHVTSSTGIDRTTLFAQPSVSLNSFSKPRTTTLRSLKLRSRSNDVLLLARTGDRFGGKSSRSFVVRCDASSNGRITQQEFTEMAWQAIVSSPEVAKENKHQIVETEHLMKALLEQKNGLARRIFSKAGVDNTRLLEATDKYIQRQPKVLGESAGSMLGRDLEGLMQRARDYKKEYGDSFVSVEHLVLGFVQDNRFGKQLFKDFQISLKTLKNAIESIRGRQTVIDQDPEGKYESLEKYGKDLTAMARAGKLDPVIGRDDEIRRCIQILSRRTKNNPVLIGEPGVGKTAISEGLAQRIVQGDVPQALMNRKLISLDMGALIAGAKYRGEFEDRLKAVLKEVTESDGQIVLFIDEIHTVVGAGATNGAMDAGNLLKPMLGRGELRCIGATTLDEYRKYIEKDPALERRFQQVYVDQPTVEDTVSILRGLRERYELHHGVRISDSALVEAAILSDRYISGRFLPDKAIDLVDEAAAKLKMEITSKPTALDEINRSVLKLEMERLSLTSDTDKASKDRLSRLEAELALLKERQAELNQQWEHEKGVMTNMQSIKEEIDRVNLEIQQAEREYDLNRAAELKYGSLNSLLRQLETAEKELVEYMSSGKSMLREEVTGDDIAEIVSKWTGIPLSKLKQSEREKLLHLEEELHNRVVGQDPAVTAVAEAIQRSRAGLSDPHRPIASFMFMGPTGVGKTELAKALASYLFNTEEALVRIDMSEYMEKHAVSRLIGAPPGYVGYEEGGQLTETVRRRPYAVILFDEIEKAHADVFNVFLQILDDGRVTDSQGRTVSFTNTVIIMTSNVGSQYILDTDDDSMPKERAYETIKQRVMDAARSIFRPEFMNRVDEYIVFQPLDRSQINRIVRLQLERVQKRIADRKLKINVSEAAIELLGSLGYDPNYGARPVKRVIQQHVENELAKGILRGEFKDEDRISVDTEVTAFSNGQLPQQKLVFKRVEMSSPGDAPKDEQAFSQAL

SEQ ID NO: 23410 - protein, 969 aa, Ambrosia trifida
MSTMSTLFHLPSSICTDRTITSPFAQPSVSVNSFSKPRRVSLRSLKLKTRSNDVLLRKSSRSLVVRCDASSSGRITQQEFTEMAWQAIVSSPEVAKENKHQIVETEHLMKALLEQKNGLARRIFSKAGVDNTRLLEATDKFIQRQPKVIGESAGSMLGRDLESLMQRARDYKKEYGDSFVSVEHLVLGFVQDNRFGKQLFKEFQISLKTLKSAIESIRGRQTVIDQDPEGKYESLEKYGKDLTAMARAGKLDPVIGRDDEIRRCIQILSRRTKNNPVLIGEPGVGKTAISEGLAQRIVQGDVPQALMNRKLISLDMGALIAGAKYRGEFEDRLKAVLKEVTESDGQIILFIDEIHTVVGAGATNGAMDAGNLLKPMLGRGELRCIGATTLDEYRKYIEKDPALERRFQQVYVDQPTVEDTISILRGLRERYELHHGVRISDSALVEAAILSDRYISGRFLPDKAIDLVDEAAAKLKMEITSKPTALDEINRAVLKLEMERLSLTSDTDKASKDRLNRLETELALLKERQAELTEQWEHEKSVMTNIQSIKEEIDRVNLEIQQAEREYDLNRAAELKYGSLNSLLRQLETAEKELVEYMSSGKSMLREEVTGDDIAEIVSKWTGIPLSKLKQSEREKLLYLEDELHKRVVGQDPAVTSVAEAIQRSRAGLSDPHRPIASFMFMGPTGVGKTELAKALASYLFNTEESLVRIDMSEYMEKHAVSRLIGAPPGYVGYEEGGQLTEIVRRRPYAVILFDEIEKAHADVFNVFLQILDDGRVTDSQGRTVSFTNTVIIMTSNVGSQYILDTDDDSAPKEQAYETIKRRVMDAARSVFRPEFMNRVDEYIVFQPLDRSQINRIVRLQLERVQKRIADKKLKIEVSEAAVELLGSLGYDPNYGARPVKRVIQQYVENELAKGILRGEFKDEDTISVDTEVTAFSNGQLPQQKLVFKRVDSPSGDTAEGQEAVPQSI

SEQ ID NO: 23411 - protein, 974 aa, Theobroma cacao
MAAAASSSTASFSGVSLCATRSISNKNNLFLAPPRLSLSFPSKPNSLKSLQFKRNGGFRRFPKTSSSSFIVRCDASTGRITQQEFTEMAWQAIVSSPDVAKENKHQIVETEHLMKALLEQKNGLARRIFSKVGVDNTRLLEATDKFIQRQPKVLSESAGSMLGRDLEALIQRARECKKEYGDSFVSVEHLVLGFTQDQRFGKQLFRDFQISHLSLKSAIESIRGRQSVIDQDPEGKYEALEKYGKDLTEMAKEGKLDPVIGRDDEIRRCIQILSRRTKNNPVLIGEPGVGKTAISEGLAQRIVQGDVPQALMNRKLISLDMGALIAGAKYRGEFEDRLKAVLREVTESEGQIILFIDEIHTVVGAGATNGAMDAGNLLKPMLGRGELRCIGATTLDEYRKYIEKDPALERRFQQVYVDQPSVEDTISILRGLRERYELHHGVRISDSALVEAAILSDRYISGRFLPDKAIDLVDEAAAKLKMEITSKPTALDEINRSVLKLEMERLSLTNDTDKASRDRLSRLEAELSLLKEKQAELTEQWEHEKTVMTRIQSIKEEIDRVNLEIQQAEREYDLNRAAELKYGSLNSLQRQLADAEKELDEYIKSGKSMLREEVTGNDIAEVVSKWTGIPVSKLQQSEREKLLHLEEELHKRVVGQDPAVRSVAEAIQRSRAGLSDPRRPIASFMFMGPTGVGKTELAKALASYLFNTEEALVRIDMSEYMEKHAVSRLIGAPPGYVGYEEGGQLTEIVRRRPYAVILFDEIEKAHGDVFNVFLQILDDGRVTDSQGRTVSFTNTVIIMTSNVGSQYILNSDEDTPKDIAYDTIKQRVMEAARAVFRPEFMNRVDEYIVFQPLDREQINSIVKLQLERVQKRIGDRKIKLQVTDGAIQLLGSLGYDPNYGARPVKRVIQQNVENELAKGILRGEFKDEDSILVDTELTAFANGQLPQQKLIFRRLDRDSETQATDSEEALSQTV

SEQ ID NO: 23412 - protein, 982 aa, Vinca minor
MAATTTSFVGVQFHVPPPTSTSTTRVASLFSQSPPISVNFTANRKFIKSFNSLQLKRNNAFFTRNSPQFGRSSRSLVVRCQTSSSGKITQTEFTEMAWQAIVSSPEVAKENNHQIVETEHLMKALLEQKNGLARRIFSKIGVDNTRLLEATDKFIQRQPKVLGETAGSMLGRDLEALFQRARDYKKEYGDSFVSVEHLVLGFIQDNRFGKQLFKDFQISLTALKDAIQSIRGRQTVIDQDPEGKYESLEKYGKDLTAMARAGKLDPVIGRDDEIRRCIQILSRRTKNNPVLIGEPGVGKTAISEGLAQRIVQGDVPQALMNRRLISLDMGALIAGAKYRGEFEDRLKAVLKEVTDSDGQIVLFIDEIHTVVGAGATNGAMDAGNLLKPMLGRGELRCIGATTLDEYRKYIEKDPALERRFQQVYVDQPTVEDTISILRGLRERYELHHGVRISDSALVEAAILSDRYISGRFLPDKAIDLVDEAAAKLKMEITSKPTALDEINRTVLKLEMERLSLTNDTDKASRERFNRLEAELSLLKARQSELTEQWEHEKSVMTRIQSIKEEIDRVNVEIQQAEREYDLNRAAELKYGSLNSLQRQLEAAEKELVEYMKSGKSMLREEVSGSDIAEIVSKWTGIPVSKLQQTEREKLLHLEEELHKRVIGQDPAVRSIAEAIQRSRAGLSDPHRPIASFMFMGPTGVGKTELAKALASYMFNTEEALVRIDMSEYMEKHAVSRLIGAPPGYVGYEEGGQLTETVRRRPYSVILFDEIEKAHADVFNVFLQILDDGRVTDSQGRTVSFTNTVIIMTSNVGSQYILNTDDENLPKEMAYETIKQRVMEAARGIFRPEFMNRVDEYIVFQPLDRDQISSIVRLQLERVQKRIADRKMKLEVSDAALQLLGSLGYDPNYGARPVKRVIQQHVENELAKGILRGEFKDEDTILVDTEVTAFGNGQLPQQKLVFRKLESGSDTSSETKEEVTQTL

SEQ ID NO: 23413 - protein, 980 aa, Solanum lycopersicum
MSTVTSFSGVQFCVPSSSSNSSNRVALFSSHSAPYLNFSGKSRVLGKCNSLKLKRKDVFFSRKTEKLSQGSRLTVRCDASNGRITQQDFTEMAWQAIVASPEIAKENKHQIVETEHLMKALLEQKNGLARRIFSKAGVDNTRLLEATDKFIRQQPKVIGETAGSMLGRELEGLMQRAREYKKEYGDSFVSVEHLVLGFIQDKRFGKQLFNDFQISLKTLKTAIESIRGRQNVIDQDPEGKYESLEKYGKDLTAMARAGKLDPVIGRDDEIRRCIQILSRRTKNNPVLIGEPGVGKTAISEGLAQRIVQGDVPQALMNRRLISLDMGALIAGAKYRGEFEDRLKAVLKEVTESEGQIILFIDEIHTVVGAGATNGAMDAGNLLKPMLGRGELRCIGATTLDEYRKYIEKDPALERRFQQVYVDQPTVEDTVSILRGLRERYELHHGVRISDTALVDAAILSDRYISGRFLPDKAIDLVDEAAAKLKMEITSKPTALDEINRAVLKLEMERLSLTNDTDRASKDRLNRLETELSLLKERQAELTEQWEHEKSVMTRLQSIKEEIDRVNLEIQQAEREYDLNRAAELKYGSLNTLQRQLEASEKELSDYMKSGKSMLREEVTGNDIAEIVSKWTGIPVSKLQQSEREKLLHLEEELHKRVVGQDPAVRAVAEAIQRSRAGLSDPHRPIASFMFMGPTGVGKTELAKALANYLFNTEEALVRIDMSEYMEKHAVSRLIGAPPGYVGYEEGGQLTEIVRRRPYAVILFDEIEKAHSDVFNVFLQILDDGRVTDSQGRTVSFTNTVIIMTSNVGSQYILNTDDNDDDSSKEATYQTIKQRVMDAARAVFRPEFMNRVDEYIVFQPLDRDQISSIVRLQLERVQQRLADRKMKIQVSEAAIQLLGSLGYDPNYGARPVKRVIQQNVENELAKGILRGEFKDEDTILVDTEVSAFSNGQLPQQKLVFKRQESGSDSPAENQEAFSQKL

SEQ ID NO: 23414 - protein, 973 aa, Ricinus communis
MAATPTMASFNGVTICPPHQSNRNTLFAQFLTLPSKPSSLNSLHLKKKHRNPSLNYHRVSTNTPRRSFIVRCDASSNGRITQQEFTELAWQGIVSSPDVAKENKHQIVETEHLMKALLEQKNGLARRIFSKVGVDNTRLLEATDKFIQRQPKVLGESAGSMLGRDLEALIQRARDYKKEYGDSFVSVEHLVLAFAQDQRFGKQLFRDFQISLQTVKSAVESIRGRQSVIDQDPEGKYEALEKYGKDLTAMAKAGKLDPVIGRDDEIRRCIQILSRRTKNNPVLIGEPGVGKTAISEGLAQRIVQGDVPQALMNRKLISLDMGALIAGAKYRGEFEDRLKAVLKEVTESDGQIILFIDEIHTVVGAGATNGAMDAGNLLKPMLGRGELRCIGATTLDEYRKYIEKDPALERRFQQVYVDQPSVEDTISILRGLRERYELHHGVRISDSALVEAAILSDRYISGRFLPDKAIDLVDEAAAKLKMEITSKPTALDEIDRSVLKLEMEKLSLTNDTDRASRDRLSRLDAELSLLKKKQAELTEQWEHEKTVMTRIQSIKEEIDRVNLEIQQAEREYDLNRAAELKYGSLNSLQRQLEIAEKELDEYMRSGKSMLREEVTGDDIAEVVSKWTGIPLSKLKQSEREKLLHLEEELHKRVVGQDPAVKAVAEAIQRSRAGLSDPRRPIASFMFMGPTGVGKTELAKALASYMFNTEEALVRIDMSEYMEKHAVSRLIGAPPGYVGYEEGGQLTETVRRRPYAVILFDEIEKAHADVFNVFLQILDDGRVTDSQGRTVSFTNTVIIMTSNVGSQYILDTDDDMPKEVAYETIKQRVMEAARSVFRPEFMNRVDEYIVFQPLDRSQINSIVKLQLERVQQRVADRKMKLRVTEAAVDLLGSLGYDPNYGARPVKRVIQQYVENELAKGILRGEFKDEDAVLIDTEVTAFSNGQLPQQKLVFKRIESDADTAAADNRALSQTL

SEQ ID NO: 23415 - protein, 978 aa, Gossypium raimondii
MAASSSTTSMASVNGFSFCATRSVSNINNLLLTHPRLSLSFPSKPNSLKSFKPLQLRKNGVFERFSRTSSRPFVVRCEASTGKITQQDFTEMAWQAIVSSPDVAKENKHQIVETEHLMKALLEQKNGLARRIFLKVGVDNTRLLEATDKFIQRQPKVLGESAGSMLGRDLEALIQRAREYKKEYGDSFVSVEHLVLGFTQDRRFGKQLFKDFQISNQALKSAIESIRGRQSVTDQDPEGKYEALEKYGKDLTAMAREGKLDPVIGRDDEIRRCIQILSRRTKNNPVLIGEPGVGKTAISEGLAQRIVQGDVPQALMNRKLISLDMGALIAGAKYRGEFEDRLKAVLREVTDSEGQIILFIDEIHTVVGAGATNGAMDAGNLLKPMLGRGELRCIGATTLDEYRKYIEKDPALERRFQQVYVDQPTVEDTISILRGLRERYELHHGVRISDSALVEAAILSDRYISGRFLPDKAIDLVDEAAAKLKMEITSKPTALDEINRSVLKLEMERLSLTNDTDKASRDRLSRLEAELALLKERQSELTEQWEHEKSVMTNIQSIKEEIDRVNVEIQQAEREYDLNRAAELKYGSLNSLQRQLADAEKELDEYMKSGKSMLREEVTGNDIAEVVSKWTGIPVSKLQQSEREKLLYLEEVLHKRVVGQDPAVRSVAEAIQRSRAGLSDPRRPIASFMFMGPTGVGKTELAKALASYLFNTEEALVRIDMSEYMEKHAVSRLIGAPPGYVGYEEGGQLTETVRRRPYAVILFDEIEKAHGDVFNVFLQILDDGRVTDSQGRTVSFTNTVIIMTSNVGSQYILNSDEDTPKDLAYETIKQRVMEAARAIFRPEFMNRVDEYIVFQPLDREQISSIVRLQLERVQNRIADRKIKLQVTDSAIQLLGNLGYDPNYGARPVKRVIQQNVENELAKGILRGEFKDEDTILVDTELTAFANGQLPQQKLVFKKLNNDSDTQATGSQEALSQTV

SEQ ID NO: 23416 - protein, 945 aa, Gossypium hirsutum
HPRLSLSFPSKPNSLKSFKPLQLRKNGVFERFSRTSSRPFVVRCEASTGKITQQDFTEMAWQAIVSSPDVAKENKHQIVETEHLMKALLEQKNGLARRIFLKVGVDNTRLLEATDKFIQRQPKVLGESAGSMLGRDLEALIQRAREYKKEYGDSFVSVEHLVLGFTQDRRFGKQLFKDFQISNQALKSAIESIRGRQSVTDQDPEGKYEALEKYGKDLTAMAREGKLDPVIGRDDEIRRCIQILSRRTKNNPVLIGEPGVGKTAISEGLAQRIVQGDVPQALMNRKLISLDMGALIAGAKYRGEFEDRLKAVLREVTDSEGQIILFIDEIHTVVGAGATNGAMDAGNLLKPMLGRGELRCIGATTLDEYRKYIEKDPALERRFQQVYVDQPTVEDTISILRGLRERYELHHGVRISDSALVEAAILSDRYISGRFLPDKAIDLVDEAAAKLKMEITSKPTALDEINRSVLKLEMERLSLTNDTDKASRDRLSRLEAELALLKERQSELTEQWEHEKSVMTNIQSIKEEIDRVNVEIQQAEREYDLNRAAELKYGSLNSLQRQLAEAEKELDEYMKSGKSMLREEVTGNDIAEVVSKWTGIPISKLQQSEREKLLYLEEVLHKRVVGQDPAVRSVAEAIQRSRAGLSDPRRPIASFMFMGPTGVGKTELAKALASYLFNTEEALVRIDMSEYMEKHAVSRLIGAPPGYVGYEEGGQLTETVRRRPYAVILFDEIEKAHGDVFNVFLQILDDGRVTDSQGRTVSFTNTVIIMTSNVGSQYILNSDEDTPKDLAYETIKQRVMEAARAIFRPEFMNRVDEYIVFQPLDREQISSIVRLQLERVQNRIADRKIKLQVTDSAIQLLGNLGYDPNYGARPVKRVIQQNVENELAKGILRGEFKDEDTILVDTELTAFANGQLPQQKLVFKKLNNDSDTQATGSQEALSQTV

SEQ ID NO: 23417 - protein, 977 aa, Flaveria ramosissima
MATSPATFSGVRIHRPSAVCTDTTSSFAHPSVSVNSFAKPGRSNLRLVKLKRSSDVVLSTRVSGRRSSRSFVVRCDASSNGRITQQEFTEMAWQAIVSSPEVAKDNKHQIVETEHLMKALLEQKNGLARRIFSKAGVDNTRLLEATDKFIQRQPKVISESAGSMLGRDLESLMQRARDYKKEYGDSFVSVEHLVLGFVQDNRFGKQLFKDFQISLKTLKSAIESIRGRQTVIDQDPEGKYESLEKYGKDLTAMAREGKLDPVIGRDDEIRRCIQILSRRTKNNPVLIGEPGVGKTAISEGLAQRIVQGDVPQALMNRKLISLDMGALIAGAKYRGEFEDRLKAVLKEVTESDGQIILFIDEIHTVVGAGATNGAMDAGNLLKPMLGRGELRCIGATTLDEYRKYIEKDPALERRFQQVYVDQPTVEDTVSILRGLRERYELHHGVRISDSALVEAAILSDRYISGRFLPDKAIDLVDEAAAKLKMEITSKPTALDEINRAVLKLEMERLSLTSDTDKASKDRLNRLEAELALLKERQAELNEQWEHEKNVMTNIQSIKEEIDRVNLEIQQAEREYDLNRAAELKYGSLNSLLRQLETAEKELVEYMSSGKSMLREEVTGDDIAEIVSKWTGIPLSKLKQSEREKLLYLEDELHKRVVGQDPAVRSVAEAIQRSRAGLSDPHRPIASFMFMGPTGVGKTELAKALASYLFNTEEALVRIDMSEYMEKHAVSRLIGAPPGYVGYEEGGQLTEIVRRRPYAVILFDEIEKAHADVFNVFLQILDDGRVTDSQGRTVSFTNTVIIMTSNVGSQYILDTDDDSMPKEQAYETIKRRVMDAARSIFRPEFMNRVDEYIVFQPLDRSQINRIVRLQLERVQKRIADRKLKIEVSEAAVELLGSLGYDPNYGARPVKRVIQQYVENELAKGILRGDFKDEDTISVDTEVTAFSNGQLPQQKLVFKRVDSQPGDAPEGQEALSQTF

SEQ ID NO: 23418 - protein, 980 aa, Capsicum annuum
MSTVTSFSGVQLCVPSSSNSSNRVGLFSSHSPPYVNFSGKSRVLGKCNSLKLKRKDVFFFTRKTEKLSKGSRFTVRCDASSGRITQQEFTEMAWQAIVSSPEIAKENKHQIVETEHLMKALLEQKNGLARRIFSKAGVDNTRLLESTDKFIQRQPKVIGESAGSMLGRDLEGLMQRAREYKKEYGDSFVSVEHLVLGFVQDKRFGKQLFNDFQISLKTLKAAIESIRGRQNVIDQDPEGKYESLEKYGKDLTAMARAGKLDPVIGRDDEIRRCIQILSRRTKNNPVLIGEPGVGKTAISEGLAQRIVQGDVPQALMNRRLISLDMGALIAGAKYRGEFEDRLKAVLKEVTESEGQIILFIDEIHTVVGAGATNGAMDAGNLLKPMLGRGELRCIGATTLDEYRKYIEKDPALERRFQQVYVDQPTVEDTVSILRGLRERYELHHGVRISDTALVDAAILSDRYISGRFLPDKAIDLVDEAAAKLKMEITSKPTALDEINRAVLKLEMERLSLTNDTDRASKDRLNRLETELSLLKERQAELTEQWEHEKTVMTRIQSVKEEIDRVNLEIQQAEREYDLNRAAELKYGSLNTLQRQLEAAEKELDDYMKSGKSMLREEVTGNDIAEIVSKWTGIPVSKLQQSEREKLLHLEEELHKRVVGQDPAVRSVAEAIQRSRAGLSDPHRPIASFMFMGPTGVGKTELAKALANYLFNTEEALVRIDMSEYMEKHAVSRLIGAPPGYVGYEEGGQLTEIVRRRPYAVILFDEIEKAHSDVFNVFLQILDDGRVTDSQGRTVSFTNTVIIMTSNVGSQYILNADDDDDSSKEATYQTIKQRVMDAARAVFRPEFMNRVDEYIVFQPLDRDQISSIVRLQLERVQQRLADRKMKIQVSDAAIQLLGSLGYDPNYGARPVKRVIQQNIENELAKGILRGDFKDEDTVLIDTEVSAFSNGQLPQQKLVFRRQESGGSDSPAENEEAFSQKL

SEQ ID NO: 23419 - protein, 984 aa, Malus domestica
MASATSLSSGVALVHLPQSGFPKCCDKASVFARPHHSLSFNSRADSFQAFISRQLTPNGSFRTGLWRTNRNSRPFVVRCEASTGRGRITQQDFTEMAWQAIVSSPEVAKENKHQIVETEHLLKALLEQKNGLARRIFSKVGVDNARLLEATDKYIQRQPKVFGESAGSMLGRDLEALIQRARDYKKEYGDSFVSVEHLVLGFSQDQRFGKQLFRDFQISKEALKSAIESIRGRQSVIDQDPEGKYEALEKYGKDLTAMAKVGKLDPVIGRDDEIRRCIQILSRRTKNNPVLIGEPGVGKTAISEGLAQRIVQGDVPQALMNRKLISLDMGALIAGAKYRGEFEDRLKAVLREVTESEGQIILFIDEIHTVVGAGATNGAMDAGNLLKPMLGRGELRCIGATTLDEYRKYIEKDPALERRFQQVYVDQPTVEDTVSILRGLRERYELHHGVRISDGALVEAAILSDRYISGRFLPDKAIDLVDEAAAKLKMEITSKPTALDEINRSVLKLEMERLSLTNDTDKSSKERLNRLEAELALLKEKQSELSEQWEHEKSVMTRIQSIKEEIDRLNLEIQQAEREYDLNRAAELKYGSLNSLQRQLVDAEKELDEYMRSGKSMLREEVTGSDIAEIVSKWTGIPVSKLQQSEMEKLLHLEDELHKRVVGQEPAVRSVAEAIQRSRAGLSDPHRPIASFMFMGPTGVGKTELAKALASYLFNTEETLVRIDMSEYMEKHAVSRLIGAPPGYVGYEEGGQLTEVVRRRPYSVILFDEIEKAHSDVFNVFLQILDDGRITDSQGRTVSFTNTVIIMTSNVGSQYILNADDDDTPKELAYDTIKHRVLEAARSIFRPEFMNRVDEYIVFQPLDRDQISRIVKLQLDRVRKRIADRKMKIKVSDAAIELLGSLGYDPNYGARPVKRVIQQYVENELAKCILRGEFREEDTVAIDTEVTAFSSGQLPQQKLVFRRLETTDSESPATENQEAFSEAR

SEQ ID NO: 23420 - protein, 977 aa, Flaveria ramosissima
MATSPATFSAVRIHRPSAVCTDTTSSFAHPSVSVNSFAKPGRSALRLVKLKRSSDVVLSTRVSGGRSSRSFVVRCDASSNGRITQQEFTEMAWQAIVSSPEVAKENKHQIVETEHLMKALLEQKNGLARRIFSKAGVDNTRLLEATDKFIQRQPKVISESAGSMLGRELESLMQRARDYKKEYGDSFVSVEHLVLGFVQDNRFGKQLFKDFQISLKTLKTAIESIRGRQTVIDQDPEGKYESLEKYGKDLTAMAREGKLDPVIGRDDEIRRCIQILSRRTKNNPVLIGEPGVGKTAISEGLAQRIVQGDVPQALMNRKLISLDMGALIAGAKYRGEFEDRLKAVLKEVTESDGQIILFIDEIHTVVGAGATNGAMDAGNLLKPMLGRGELRCIGATTLDEYRKYIEKDPALERRFQQVYVDQPTVEDTVSILRGLRERYELHHGVRISDSALVEAAILSDRYISGRFLPDKAIDLVDEAAAKLKMEITSKPTALDEINRAVLKLEMERLSLTSDTDKASKDRLNRLEAELALLKERQAELNEQWEHEKNVMTNIQSIKEEIDRVNLEIQQAEREYDLNRAAELKYGSLNSLLRQLETAEKELVEYMSSGKSMLREEVTGDDIAEIVSKWTGIPLSKLKQSEREKLLYLEDELHKRVVGQDPAVRSVAEAIQRSRAGLSDPHRPIASFMFMGPTGVGKTELAKALASYLFNTEEALVRIDMSEYMEKHAVSRLIGAPPGYVGYEEGGQLTEIVRRRPYAVILFDEIEKAHADVFNVFLQILDDGRVTDSQGRTVSFTNTVIIMTSNVGSQYILDTDDDSMPKEQAYETIKRRVMDAARSIFRPEFMNRVDEYIVFQPLDRSQINRIVRLQLERVQKRIADRKLKIEVSEAAVELLGSLGYDPNYGARPVKRVIQQHVENELAKGILRGDFKDEDTISVDTEVTAFSNGQLPQQKLVFKRVDSQPGDAPEGQEALSQTF

SEQ ID NO: 23421 - protein, 974 aa, Populus trichocarpa
MATTATAASFTGVSLCPSSSSPLSHSASIRNALLPQKSLISFAGRRISVKSLELKRNGARFQRTSRPTSFVVRCDASNGRITQQEFTDMAWQGIVSSPDVAKENKHQIVETEHLMKVLLEQKNGLARRIFSKVGVDNTRLLEATDKFIQRQPKVLSDSAGSMLGRDLEALIQRAREYKKEYGDSFVSVEHLVLAFTQDQRFGKQLFKDFQISLQTLKPAIESIRGRQSVIDQDPEGKYEALEKYGKDLTAMAKAGKLDPVIGRDDEIRRCIQILSRRTKNNPVLIGEPGVGKTAISEGLAQRIVEGDVPQALMNRKLISLDMGALIAGAKYRGEFEDRLKAVLREVTDSDGQIILFIDEIHTVVGAGATNGAMDAGNLLKPMLGRGELRCIGATTLDEYRKYIEKDPALERRFQQVFVDQPTVADTVSILRGLRERYELHHGVRISDSALVEAAILSDRYISGRFLPDKAIDLVDEAAAKLKMEITSKPTALDGINRSVLKLEMERLSLKNDTDKASKDRLSRLDAELSLLKKKQAELTEQWEHEKSVMTRIQSIKEEIDRVNLEIQQAEREYDLNRAAELKYGSLNSLQRQLGSAEKELDEYMKSGKSMLREEVTGDDIAEIVSKWTGIPVSKLKQSEKEKLLHLEEELHKRVVGQDPAVKAVAEAIQRSRAGLSDPRRPIASFMFMGPTGVGKTELAKALASYMFNTEEALVRIDMSEYMEKHAVSRLIGAPPGYVGYEEGGQLTETVRRRPYAVILFDEIEKAHSDVFNIFLQILDDGRVTDSQGRTVSFTNTVIIMTSNVGSQYILDTDDDLPKEVAYETIKRRVMDAARSVFRPEFMNRVDEYIVFQPLDRDQINSIVRLQLERVQQRLADRKIRVLVTDAAGDLLGTLGYDPNYGARPVKRVIQQYVENELAKGILRGEFKDEDSVLIDTEVTAFANGQLPQQKLVFKRLETSEEKAAAENRVFSRTV

SEQ ID NO: 23422 - protein, 977 aa, Sesamum indicum
MALASSFAAVQVNVPPADCAVGTALFSRPPVCVHFSNKTGGLKPLSLVKLRRRDVGFARRSDKFTRSSRSFRIRCEASAGGRITQTEFTEMAWQAIVASPEVAKDKQHQIVETEHLMKALLEQKNGLARRIFSKAGVDNTRLLEATDKYIQRQPKVMGDSAGSMLGRDLEGLIQRAREYKKEFGDSYISVEHLVLGFMQDNRFGKQLFKDFQLSPKMLKDAVQAIRGHQTVIDQDPEGKYEALEKYGKDLTAMARAGKLDPVIGRDDEIRRCIQILSRRTKNNPVLIGEPGVGKTAISEGLAQRIVQGDVPQALMNRRLISLDMGALIAGAKYRGEFEDRLKAVLKEVTDSDGQIILFIDEIHTVVGAGATNGAMDAGNLLKPMLGRGELRCIGATTLDEYRKYIEKDPALERRFQQVYVDQPTVEDTVSILRGLRERYELHHGVRISDSALVEAAILSDRYISGRFLPDKAIDLVDEAAAKLKMEITSKPTALDEINRAVLKLEMERLSLTNDTDKASKDRLNRLEAELSLLKQRQAELTEQWEHEKTVMTRIQSIKEEIDRVNVEIQQAEREYDLNRAAELKYGSLNSLQRQLETAEKELDEYMRSGKSMLREEVTGNDIAEIVSKWTGIPVSKLQQSEREKLLHLEQELHKRVVGQDPAVTAVAEAIQRSRAGLSDPHRPIASFMFMGPTGVGKTELAKALASYLFNTEEALVRIDMSEYMEKHAVSRLIGAPPGYVGYEEGGQLTETVRRRPYAVILFDEIEKAHSDVFNVFLQILDDGRVTDSQGRTVSFTNTVIIMTSNVGSQYILNTEDDEASKEMAYETIKRKVMEAARSIFRPEFMNRVDEYIVFQPLDRDQISSIVRLQLERVQKRIADRKMKIQVSDAAVQLLGSLGYDPNYGARPVKRVIQQYVENELAKGILRGDFKDEDSVLIDTEVTAFANGQLPQQKLVFRKMGSGSDISSETREPFPQTT

SEQ ID NO: 23423 - protein, 975 aa, Panax ginseng
MASTTSFSAAHLRLQPPSTCSDRAALFSHSLLSVVNLSSSKSNTVLKSSNYSVSSKRLNRNNNAMRKNSRSFVVHCEAGRITQAEFTEMAWQAIVSSPEVAKENKHQIVETEHLMKALLEQKNGLARRIFSKAGVDNTRLLEATDKFINLQPKVLGESGGSMLGRDLEALIQQARDYKKEYNDSFVSVEHLVLGFAQDKRFGKQLFKDFQISLKTLKNAVEAIRGSQTVIDKDPEGKYEALEKYGKDLTAMAREGKLDPVIGRDDEIRRCIQILSRRTKNNPVLIGEPGVGKTAISEGLAQRIVQGDVPQALMNRKLISLDMGALIAGAKYRGEFEDRLKAVLKEVTESDGQIVLFIDEIHTVVGAGATNGAMDAGNLLKPMLGRGELRCIGATTLDEYRKYIEKDPALERRFQQVYVDQPTVEDTISILRGLRERYELHHGVRISDGALVEAAILSDRYISGRFLPDKAIDLVDEAAAKLKMEITSKPTALDEINRSVLKLEMERLSLTNDTDKASKDRLNRLEAELDLLKKRQAELNEQWEHEKSVMTRLQSIKEEIDRVNLEIQQAEREYDLNRAAELKYGSLNSLQRQLETAEKELDEYMRSGKSMLREEVTGSDIAEIVSKWTGIPVSKLQQSEREKLLHLEEELHKRVVGQDPAVKSVAEAIQRSRAGLSDPHRPIASFMFMGPTGVGKTELAKALANYMFNTEDALVRIDMSEYMEKHAVSRLIGAPPGYVGYDEGGQLTETVRRRPYAVILFDEIEKAHSDVFNVFLQILDDGRVTDSQGRTVSFTNTVIIMTSNVGSQYILNTDDDASSKETTYETIKQRVMDAARSVFRPEFMNRVDEYIVFQPLDRDQINAIVRIQLERVQKRIADRKIKLQVTDAAVELLGSLGYDPSYGARPVKRVIQQNVENELAKGILRGEFKDEDTVLIDTEVTVLSNGQRPQQRLVFRKLDSGSDVAAEKTQTFSRTV

SEQ ID NO: 23424 - protein, 984 aa, Chrysanthemum coronarium
MATPASFSGVLAPLSDITTTLFAQPSVSVHSFSYKPTSSSSSLRLLKLKTRNTSIYSGGAILRTHTSHRFGGKKPFVVRAAAGDASSNGRISQQEFTEMAWQAIVSSPEVAKENKHQIVETEHLLKALLEQKNGLARRIFSKAGVDNTRLLEATDKFIQRQPKVIGESAGSMLGRDLEGLMNRARDYKKEYGDSFVSVEHLVLGYVQDNRFGKQLFKDFQISLKTLKNAIESIRGRQTVIDQDPEGKYESLEKYGKDLTAMAREGKLDPVIGRDDEIRRCIQILSRRTKNNPVLIGEPGVGKTAISEGLAQRIVQGDVPQALMNRKLISLDMGALIAGAKYRGEFEDRLKAVLKEVTESDGQIILFIDEIHTVVGAGATNGAMDAGNLLKPMLGRGELRCIGATTLDEYRKYIEKDPALERRFQQVYVDQPTVEDTVSILRGLRERYELHHGVRISDSALVEAAILSDRYISGRFLPDKAIDLVDEAAAKLKMEITSKPTALDEINRSVLKLEMERLSLTSDTDKASKDRLSRLEAELALLKEKQAQLNEQWEHEKSVMTNMQSIKEEIDRVNLEILQAEREYDLNRAAELKYGSLNSLLRQLETAEKELVEYMSSGKSMLREEVTGDDIAEIVSKWTGIPLSKLKQSEREKLLHLEEELHKRVVGQNPAVTAVAEAIQRSRAGLSDPHRPIASFMFMGPTGVGKTELAKALASYLFNTEEALVRIDMSEYMEKHAVSRLIGAPPGYVGYEEGGQLTETVRRRPYAVILFDEIEKAHADVFNVFLQILDDGRVTDSQGRTVSFTNTVIIMTSNVGSQYILDTEDSSMPKERAYETIKQRVMDAARSIFRPEFMNRVDEYIVFQPLDRSQINRIVRLQLERVQKRIADRKLKIMVSEAAVELLGSLGYDPNYGARPVKRVIQQHVENELAKGILRGDFKDEDTISVDTEVTAFSNGQLPQQKLVFKRVDSPGGAPEGQQALSQTF

SEQ ID NO: 23425 - protein, 967 aa, Daucus carota
MATTPSFPTLRLQPLSNKTTTLSPLYSRPSLSLSSTSTPHKLALKTRPNNALFAAPSRTFRNNSSFVVRCEASGGRITQEEFTEMAWQAIVSSPEVAKENKHQIVETEHLLKALLEQKNGLARRIFSKAGVDNTRLLEATDKFINLQPKVLGESAGSMLGRDLESLIQRARDYKKEYNDSFVSVEHLVLGYVEDRRFGKQLCKDFQISLKALKNAIEAIRGRQTVIDKDPEGKYEALEKYGKDLTAMARAGKLDPVIGRDDEIRRCIQILSRRTKNNPVLIGEPGVGKTAISEGLAQRIVEGDVPQALMNRKLISLDMGALIAGAKYRGEFEDRLKAVLKEVTESDGQTILFIDEIHTVVGAGATNGAMDAGNLLKPMLGRGELRCIGATTLDEYRKYIEKDPALERRFQQVYVDQPTVEDTISILRGLRERYELHHGVRISDGALVEAAILSDRYISGRFLPDKAIDLVDEAAAKLKMEITSKPTALDEINRSVLKLEMERLSLTNDTDKASKDRLDRLEAELDLLKKKQTELNEQWEHEKTVMTRLQSIKEEIDRVNLEIQQAEREYDLNRAAELKYGSLNSLQRQLETAEKELDEYMRSGKSMLREEVSGSDIAEIVSKWTGIPVSKLQQSEREKLLHLEEELHKRVVGQNPAVTSVAEAIQRSRAGLSDPHRPIASFMFMGPTGVGKTELAKALASYMFNTEDALVRIDMSEYMEKHTVSRLIGAPPGYVGYDEGGQLTETVRRRPYAVILFDEIEKAHSDVFNVFLQILDDGRVTDSQGRTVSFTNTVIIMTSNVGSQYILGMDGEETSYETIKRRVLDAARSVFKPEFMNRVDEYIVFQPLDRDQINSIVRIQLERVQKRIADRKMKLKVTDAAVELLGSLGYDPSYGARPVKRVIQQNVENELAKGILRGEFKDDDTVLVDTEVTAFLDGQLPQQKLVFRKLDPGTDVEANNKKVVSQTF

SEQ ID NO: 23426 - protein, 980 aa, Centaurea maculosa
MATMPSSFSGVLPSSTCIDRTALFAQPSLSFNSISKPRRTAVRSLKLKTRSNDVLLLKRTADRFGGKSSRSFVVRCDASSSGRITQQEFTEMAWQAIVSSPEVAKENKHQIVETEHLMKALLEQKNGLARRIFSKAGVDNTRLLEATDKYIQRQPKVIGESAGSMLGRDLEALMQRARDYKKEYGDSFVSVEHLVLGYVQDNRFGKQLFKDFQISLKTLKSAIESIRGRQTVIDQDPEGKYESLEKYGKDLTAMAREGKLDPVIGRDDEIRRCIQILSRRTKNNPVLIGEPGVGKTAISEGLAQRIVQGDVPQALMNRKLISLDMGALIAGAKYRGEFEDRLKAVLKEVTDSDGQIVLFIDEIHTVVGAGATNGAMDAGNLLKPMLGRGELRCIGATTLDEYRKYIEKDPALERRFQQVYVDQPTVEDTVSILRGLRERYELHHGVRISDSALVEAAILSDRYISGRFLPDKAIDLVDEAAAKLKMEITSKPTALDEINRSVLKLEMERLSLTSDTDKASKDRLSRLEAELALLKERQAELNEQWEHEKSVMTNLQSIKEEIDRVNLEIQQAEREYDLNRAAELKYGSLNALQRQLDTAEKDLVEYMSTGKSMLREEVTGDDIAEIVSKWTGIPLSKLKQSEREKLLHLEEELHKRVVGQNPAVTAVAEAIQRSRAGLSDPHRPIASFMFMGPTGVGKTELAKALASYLFNTEEALVRIDMSEYMEKHAVSRLIGAPPGYVGYEEGGQLTETVRRRPYAVILFDEIEKAHADVFNVFLQILDDGRVTDSQGRTISFTNTVIIMTSNVGSQYILDTEDDSMPKGRAYETIKQRVMDAARSVFRPEFMNRVDEYIVFQPLDRSQINRIVWLQLDRVQKRIADRKLKIVVSEAAVELLGSLGYDPNYGARPVKRVIQQYVENELAKGILRGEFKDEDTISIDTEVTAFSNGQLPQQKLAFKRLDSSSGDAPEGQEALSQSYRA

SEQ ID NO: 23427 - protein, 979 aa, Panax ginseng
MASMSSFSGVHLGLRPPPSTYCDSCRITQSLLSVNLSSKSAAHKNLNFFSLKLNRNNAFLTTRAGKLGKNSRSFVVRCQASSGKIGQEEFTEMAWQAIVSSPEVAKENKHQIVETEHLMKALLEQKNGLARRIFSKAGVDNTRLLEAADKFIKRQPKVLGESAGSMLGRDLEALMQRARDYKKEYNDSFVSVEHLVLGFMQDKRFGKQLYKDFQISLKTLTNAVQAIRGRQTVIDQDPEGKYEALEKYGKDLTAMARAGKLDPVIGRDDEIRRCIQILSRRTKNNPVLIGEPGVGKTAISEGLAQRIVQGDVPQALMNRKLISLDMGALIAGAKYRGEFEDRLKAVLKEVTESDGQTILFIDEIHTVVGAGATSGAMDAGNLLKPMLGRGELRCIGATTLDEYRKYIEKDPALERRLQQVYVDQPTVEDTISILRGLRERYELHHGVRISDSALVEAAILSDRYISGRFLPDKAIDLVDEAAAKLKMEITSKPTALDEINRAVLKLEMERLSLTNDTDKASRDRLTRLEAELDLLKERQAELNEQWEHEKTVMTRLQSIKEEIDRVNLEIQQAEREYDLNRAAELKYGSLNTLQRQLETAEKELDEYMRSGKSMLREEVTGSDIAEIVSKWTGIPVSKLQQSEREKLLHLEEELHKRVVGQDPAVKSVAEAIQRSRAGLSDPHRPIASFMFMGPTGVGKTELAKALANYMFNTEEALVRIDMSEYMEKHAVSRLIGAPPGYVGYDEGGQLTETVRRRPYAVILFDEIEKAHSDVFNVFLQILDDGRVTDSQGRTVSFTNTVIIMTSNVGSQYILNTDDDASSKETTYETIKQRVMDAARSVFRPEFMNRVDEYIVFQPLDRDQINAIVRIQLERVQKRIADRKIKLQVTDAAVELLGSLGYDPSYGARPVKRVIQQNVENELAKGILRGEFKDEDTVLIDTEVTVLSNGQRPQQRLVFRKLDSGSDVAAEKTQTFSRTV

SEQ ID NO: 23428 - protein, 981 aa, Spinacia oleracea
MATATTSFLGAYLRVPPNNGVRNGLFSQPFPSLRIKSKRTKSLNSLKFTGDSSKILLFKCSRPFEKGLKSGSFVVRCDAAGGSRITQQDFTEMAWQAIVSCPEVAKENKHQIVETEHLLKALLEQKNGLARRIFSKAGVDNTRLLEATDKFIQRQPKVLGESAGSMLGRDLEALIQRGRDFRKEYGDSFVSVEHLVLAFAQDKRFGKQLFGDFRLSEKSLRSAIQAVRGRQSVIDQDPEGKYEALEKYGKDLTAMAREGKLDPVIGRDDEIRRCIQILSRRTKNNPVLIGEPGVGKTAIAEGLAQRIVEGDVPQALMNRKLISLDMGALIAGAKYRGEFEDRLKAVLKEVTDADGQTILFIDEIHTVVGAGATNGAMDAGNLLKPMLGRGELRCIGATTLDEYRKYIEKDPALERRFQQVYVDQPSVEDTISILRGLRERYELHHGVRISDGALVEAAMLSDRYISGRFLPDKAIDLVDEAAAKLKMEITSKPTALDEINRSVLKFEMERLSLTNDTDKASKERLSRLDTELSLLKEKQAELTEQWEHEKSVMTRIQSIKEEIDRVNIEIQQAEREYDLNRAAELKYGSLNSLQRQLESAEKELDEYMKSGKSMLREEVTGNDIAEIVSKWTGIPVSKLQQSEREKLLNLEEELHKRVVGQDPAVTAIAEAIQRSRAGLSDPHRPIASFMFMGPTGVGKTELAKALASYLFNTEDALVRIDMSEYMEKFAVSRLTGAPPGYVGYEEGGQLTEVVRRRPYAVILFDEIEKAHADVFNVFLQILDDGRVTDSQGRTVSFTNTVIIMTSNVGSQLILNAGDDDETSSKEATYEIIKQRVMDAARSIFRPEFMNRVDEYIVFQPLDRDQINSIVRLQLQRVQTRIADRKMTIKVTDAAVELLGSLGYDPNYGARPVKRVIQQHVENEIAKGILRGDFKEDDCILVDTELTAFSNGQLPQQKLMFRKLDLQSGSSSQEPKEAVSPF

SEQ ID NO: 23429 - protein, 926 aa, Cichorium intybus
DVLLLTRTGDRFGGKSSRSFVVRCDASSNGRITQQEFTEMAWQAIVSSPEVAKENKHQIVETEHLMKALLEQKNGLARRIFSKAGVDNTRLLEATDKYIQRQPKVIGESAGSMLGRDLEALMQRARDYKKEYGDSFVSVEHLVLGFVQDNRFGKQLFKDFQISLKTLKNAIESIRGRQTVIDQDPEGKYESLEKYGKDLTAMARAGKLDPVIGRDDEIRRCIQILSRRTKNNPVLIGEPGVGKTAISEGLAQRIVQGDVPQALMNRKLISLDMGALIAGAKYRGEFEDRLKAVLKEVTESDGQIILFIDEIHTVVGAGATNGAMDAGNLLKPMLGRGELRCIGATTLDEYRKYIEKDPALERRFQQVYVDQPTVEDTVSILRGLRERYELHHGVRISDSALVEAAILSDRYISGRFLPDKAIDLVDEAAAKLKMEITSKPTALDEINRAVLKLEMERLSLTSDTDKASKDRLSRLEAELALLKERQAELNAQWEHEKGVMTNMQSIKEEIDRVNLEIQQAEREYDLNRAAELKYGSLNSLLRQLETAEKELVEYMSSGKSMLREEVTGDDIAEIVSKWTGIPLSKLKQSEREKLLHLEEELHKRVVGQDPAVTAVAEAIQRSRAGLSDPHRPIASFMFMGPTGVGKTELAKALASYLFNTEEALVRIDMSEYMEKHAVSRLIGAPPGYVGYEEGGQLTETVRRRPYAVILFDEIEKAHADVFNVFLQILDDGRVTDSQGRTVSFTNTVIIMTSNVGSQYILDTDDDSISKERTYETIKNRVMDAARSIFRPEFMNRVDEYIVFQPLDRSQINRIVRLQLERVQKRIADRKLKINVSEAAVELLGSLGYDPNYGARPVKRVIQQHVENELAKGILRGDFKDEDTISVDTEVTAFSNGQLPQQKLVFKRVDTSPGDTPKDQEAFSQTF

SEQ ID NO: 23430 - protein, 975 aa, Panax ginseng
MAYTTSFSAVHLRLQPPPTCSDRAALFSHSLLSVVNLSSSKSNTVLKSSSYSVSSIRLNRNNNAMRKNSRSFVVQCEAGRITQEEFTEMAWQAIVSSPEVAKENKHQIVETEHLMKALLEQKNGLARRIFSKAGVDNTRLLEATDKFINLQPKVLGESGGSMLGRDLEALIQAARDYKKEYNDSFVSVEHLVLGFAQDKRFGKQLFKDFQISLKTLKNAVEAIRGSQTVIDKDPEGKYEALEKYGKDLTAMAREGKLDPVIGRDDEIRRCIQILSRRTKNNPVLIGEPGVGKTAISEGLAQRIVQGDVPQALMNRKLISLDMGALIAGAKYRGEFEDRLKAVLKEVTESDGQIILFIDEIHTVVGAGATNGAMDAGNLLKPMLGRGELRCIGATTLDEYRKYIEKDPALERRFQQVYVDQPTVEDTISILRGLRERYELHHGVRISDGALVEAAILSDRYISGRFLPDKAIDLVDEAAAKLKMEITSKPTALDEINRSVLKLEMERLSLTNDTDKASKDRLNRLEAELDLLKKRQAELNEQWEHEKSVMTRLQSIKEEIDRVNVEIQQAEREYDLNRAAELKYGSLNTLQRQLETAEKELDEYMRSGKSMLREEVTGSDIAEIVSKWTGIPVSKLQQSEREKLLHLEEELHKRVVGQDPAVKSVAEAIQRSRAGLSDPHRPIASFMFMGPTGVGKTELAKALANYMFNTEEALVRIDMSEYMEKHAVSRLIGAPPGYVGYDEGGQLTETVRRRPYAVILFDEIEKAHSDVFNVFLQILDDGRVTDSQGRTVSFTNTVIIMTSNVGSQYILNTDDDASSKETTYETIKQRVMDAARSVFRPEFMNRVDEYIVFQPLDRDQINTIVRIQLERVQKRIADRKIKLQVTAAAVELLGSLGYDPSYGARPVKRVIQQNVENELAKGILRGEFKDEDTVLIDTEVTVLSNGQRPQQRLVFRKLDSGSDVAAEKTQTFSRTV

SEQ ID NO: 23431 - protein, 967 aa, Populus trichocarpa
MATTTATAASFSLCPFYSDSISNGLLPRKSLISFPVKRNSVKSLELNKRNGAFSTRAKPSSFVVRCAASSNGRVTQQEFTDMAWQGIVSSLDVAKENKHQIVETEHLMKALLEQKNGLARRIFSKVGVDNTRLLEATDKSIQRQPKVHSESTSSMLGRDLETLIQRAREYKKEYGDSFVSVEHLVLGFAQDQRFGKQLFKDFQISLQTLKSAIESIRGRQSVIDQDPEGKYEALEKYGKDLTAMAKAGKLDPVIGRDEEIRRCIQILSRRTKNNPVLIGEPGVGKTAISEGLAQRIVEGDVPQALMNRKLISLDMGSLIAGAKYRGEFEDRLKAVLKEVTDSDGQIILFIDEIHTVVGAGATNGAMDAGNLLKPMLGRGELRCIGATTLDEHRKYIEKDPALERRFQQVFVDQPTVEDTISILRGLRERYELHHGVRISDSALVEAAVLSDRYISGRFLPDKAIDLVDEAAAKLKMEITSKPTALDEINRSVLKLEMERLSLMNDTDKASKDRLSRLDTELSLLKKKQAELTEQWEHEKSVMTCIQSIKEEIDRVNLEIQQAEREYDLNRAAELKYRSLSSLQRQLESAEKELDEYIKSGKSMLREEVTGDDIAEIVSKWTGIPISKLKQSEREKLLHLEDELHKRVVGQDPAVKAVAEAIQRSRAGLSDPHRPIASFMFMGPTGVGKTELAKALASYMFNTEEALVRIDMSEYMEKHSVSRLVGAPPGYVGYEEGGQLTETVRRRPYAVILFDEIEKAHSDVFNIFLQVLDDGRVTDSQGRTVSFTNTVIIMTSNVGSQYILDTDDNLPKEVANETIKRRVMDAARSVFRPEFMNRVDEYIVFQPLDRDQINSIVRLQLGRVQQRLADRKIKLLVTDAAVEFLGTLGYDPNYGARPVKRVIQQHVENELAKGILRGELKDEDSVAIDTQVTAFANGHLPQQKLVFKRLETSEDKAAAESRAFSQTV

SEQ ID NO: 23432 - protein, 980 aa, Mimulus guttatus
MASTSSLAAVQLNLRRPDTPGTSTTALFPRPMVSINLSAKLRHLRNLNSLKLRPKDAAFTRKSDEFTRNSRSFRVRCDASSNGRITQAEFTEMAWQAIVASPEVAKENKHQIVETEHLMKALLEQKNGLARRIFSKAGVDNTRLLEATDKYIQRQPKVLGDSAGSMLGRELEGLIQRAREYKKELGDSFVSVEHLVVGFAQDNRFGKQLFKDFQLSLKSVKDAIQSVRGRQTVIDQDPEGKYEALEKYGKDLTAMARAGKLDPVIGRDDEIRRCIQILSRRTKNNPVLIGEPGVGKTAISEGLAQRIVQGDVPQALMNRRLISLDMGALIAGAKYRGEFEDRLKAVLKEVTDSDGQIVLFIDEIHTVVGAGATSGAMDAGNLLKPMLGRGELRCIGATTLDEYRKYIEKDPALERRFQQVYVDQPTVEDTISILRGLRERYELHHGVRISDSALVEAAILSDRYISGRFLPDKAIDLVDEAAAKLKMEITSKPTALDEINRTVLKLEMERLSLTNDTDKATKDRLNRLEAELSLLKQRQAELNQQWEHEKNVMTNIQSIKEEIDRVNLEIQQAEREYDLNRAAELKYGSLNSLQRQLATAEKELGEYMRSGKSMLREEVSGSDIAEIVSKWTGIPVSKLQQSERDKLLNLEQELHNRVVGQNPAVKAVAEAIQRSRAGLSDPHRPIASFMFMGPTGVGKTELAKALAAYLFNTEESLVRIDMSEYMEKHAVSRLIGAPPGYVGYEEGGQLTEIVRRRPYAVILFDEIEKAHADVFNVFLQILDDGRVTDSQGRTVSFTNTVIIMTSNVGSQYILNTEDDDSPKEMAYETIKRRVMEAARSIFRPEFMNRVDEYIVFQPLDRDQIGSIVKLQLARVQKRIADRKMKIQVSDAAVQLLSSLGYDPNYGARPVKRVIQQYVENELAKGILRGDFKDEETIYVDTEVTAFSNGQLPQQKLVFRKLDSSSGASSEDQEAAFSQTM

SEQ ID NO: 23433 - protein, 970 aa, Petroselinum crispum
MASTTSFSTVRLQPLSTRYSNRTTKPASFYLRSPFSLNSTPRLTLKTNPNNALFTKPSRTFRNNSSSFVVRCEASGGRITQEEFTEMAWQAIVSSPEVAKENKHQIVETEHLLKALLEQKNGLARRIFSKAGVDNTRLLEATEKFINLQPKVLSESAGSMLGRDLESLIQRARDYKKEYNDSFVSVEHLVLGYVEDRRFGKQLCKDFKISLKALKNAIEAIRGRQTVIDKDPEGKYEALEKYGKDLTAMARSGKLDPVIGRDDEIRRCIQILSRRTKNNPVLIGEPGVGKTAISEGLAQRIVEGDVPQALMNRKLISLDMGALIAGAKYRGEFEDRLKAVLKEVTESDGQTILFIDEIHTVVGAGATNGAMDAGNLLKPMLGRGELRCIGATTLDEYRKYIEKDPALERRFQQVYVDQPTVGDTISILRGLRERYELHHGVRISDGALVEAAILSDRYISGRFLPDKAIDLVDEAAAKLKMEITSKPTALDEINRSVLKLEMERLSLTNDTDKASKDRLDRLESELDLLKKRQTELNEQWEHEKTVMTRLQSIKEEIDRVNLEIQQAEREYDLNRAAELKYGSLNSLQRQLETAEKELDEYMRSGKSMLREEVSGSDIAEIVSKWTGIPVSKLQQSDREKLLHLEEELHKRVVGQDPAVTSVAEAIQRSRAGLSDPHRPIASFMFMGPTGVGKTELAKALASYMFNTEDALVRIDMSEYMEKHTVSRLIGAPPGYVGYDEGGQLTETVRRRPYAVILFDEIEKAHSDVFNVFLQILDDGRVTDSQGRTVSFTNTVIIMTSNVGSQYILGTDDEETSYETIKRRVLDAARSVFKPEFMNRVDEYIVFQPLDRDQINSIVRIQLERVQKRIADRKMKLKVTDAAVELLGSLGYDPSYGARPVKRVIQQNVENELAKGILRGEFNDDDTVLVDTEVTAYSDGQLPQQKLVFRKLDSGTDVEANNREVVSQTML

SEQ ID NO: 23434 - protein, 964 aa, Petroselinum crispum
MASFSGIHLPLLRPPTNKTSLFSHSLSCTAPPTLTCSVSFKFNSNTSPNYSFPCFSTPPLVRCQASSGKVSQEEFTEKAWQAIVSSPQVAKENNHQIVETEHLIKALLEQKNGLARRIFSKAGVDNTRLLDATHKFIKRQPKVIGDSAGSMLGRDLEALLQRARDYKKEYNDSFVAVEHLVLGYVQDKRFGKQLFKDFQISMKALTDAVQAIRGRQTVIDQDPEGKYEALEKYGKDLTAMAKAGKLDPVIGRDDEIRRCIQILSRRTKNNPVLIGEPGVGKTAISEGLAQRIVQGDVPQALMNRKLISLDMGALIAGAKYRGEFEDRLKAVLKEVTESDGQTILFIDEIHTVVGAGATSGAMDAGNLLKPMLGRGELRCIGATTLDEYRKYIEKDPALERRFQQVLVDQPTVGDTVSILRGLRERYELHHGVRISDGALVDAAILSDRYISGRFLPDKAIDLVDEAAAKLKMEITSKPTALDEINRSVLKLEMERLSLTNDTDKASRDRLSRLEGELDSLKVTQAELNEQWEHEKTVMTRLQSIKEEIDRVNLEIQQAEREYDLNRAAELKYGSLNSLQRQLETAEKELDEYMKSGKSMLREEVSGSDIAELVSKWTGIPVSKLQQSEREKLLHLELELHKRVVGQDPAVTSIADAIQRSRAGLSDPNRPIASFMFMGPTGVGKTELAKALASYMFNTEEALVRIDMSEYMEKHAVSRLIGAPPGYVGYEEGGQLSETVRRRPYAVILFDEIEKAHSDVFNVFLQILDDGRVTDSQGRTVSFTNTVIIMTSNVGSQYILNTDDDSVSKETTYETIKQRVMDAARSVFRPEFMNRVDEYIVFQPLDRDQINRIVRIQLERVQKRIADRKMKLQVSDAAIKLLGSLGYDPSYGARPVKRVIQQNVENELAKGILRGDFKDEDTVFIDTEVTAFSNGQLPQQKLVFKRLDSDSGTTAEKSEAFSQTI

SEQ ID NO: 23435 - protein, 963 aa, Brassica rapa
MATTATSAFSGVIGVGSESRKVSTFSHLQPSVAFPAKPSSFKSLKLKHSARLTRRLEHRPFVVRCEASSNGRLTQQEFTEMAWQSIVSSPDVAKENKQQIVETEHLMKALLEQKNGLARRIFSKIGVDNTKVLEATEKFIQRQPKVYGESAGSMLGRDLEGLFERARKYKKDLGDSYVSVEHLVLAFAQDKRFGKQLFKDFQISEKSLKTAIESIRGKQSVIDQDPEGKYEALEKYGKDLTAMAREGKLDPVIGRDDEIRRCIQILSRRTKNNPVLIGEPGVGKTAISEGLAQRIVQGDVPQALMNRKLISLDMGALIAGAKYRGEFEDRLKAVLKEVTDSEGQIILFIDEIHTVVGAGATNGAMDAGNLLKPMLGRGELRCIGATTLDEYRKYIEKDPALERRFQQVYVDQPTVEDTISILRGLRERYELHHGVRISDSALVEAAILSDRYISGRFLPDKAIDLVDEAAAKLKMEITSKPTALDELDRAVIKLEMERLSLTNDTDKASRERLSRIETELLSLKEKQAELTQQWEHERSVMSRLQSIKEEIDRVNLEIQQAEREYDLNRAAELKYGSLNSLQRQLNEAEKELDEYLSSGKSMFREEVLGSDIAEIVSKWTGIPVSKLQQSERDKLLHLEEELHKRVVGQNPAVTAVAEAIQRSRAGLSDPGRPIASFMFMGPTGVGKTELAKALASYLFNTEEALVRIDMSEYMEKHAVSRLIGAPPGYVGYEEGGQLTETVRRRPYSVILFDEIEKAHGDVFNVFLQILDDGRVTDSQGRTVSFTNTVIIMTSNVGSQFILNNTDDDAKELAYETIKQRVMDAARSIFRPEFMNRVDEYIVFQPLDRDQINSIVRLQLARVQKRIADRKMKIEVTDAAVDLLGSLGYDPNYGARPVKRVIQQNIENELAKGILRGDFKEEDGILIDTEVTAFSNGQLPQQKLIFKKIESETADAGKEEAFSK

SEQ ID NO: 23436 - protein, 964 aa, Brassica napus
MATTATSAFSGVIGVGSESRKVSTFSHLQPSVAFPAKPNSFKSLKLKHSARLTRRLEHRPFVVRCEASSNGRLTQQEFTEMAWQSIVSSPDVAKENKQQIVETEHLMKALLEQKNGLARRIFSKIGVDNTKVLEATEKFIQRQPKVYGESAGSMLGRDLEGLFERARKYKKDLGDSYVSVEHLVLAFAQDKRFGKQLFKDFQISEKSLKTAIESIRGKQSVIDQDPEGKYEALEKYGKDLTAMAREGKLDPVIGRDDEIRRCIQILSRRTKNNPVLIGEPGVGKTAISEGLAQRIVQGDVPQALMNRKLISLDMGALIAGAKYRGEFEDRLKAVLKEVTDSEGQIILFIDEIHTVVGAGATNGAMDAGNLLKPMLGRGELRCIGATTLDEYRKYIEKDPALERRFQQVYVDQPTVEDTISILRGLRERYELHHGVRISDSALVEAAILSDRYISGRFLPDKAIDLVDEAAAKLKMEITSKPTALDELDRAVIKLEMERLSLTNDTDKASRERLSRIETELLSLKEKQAELTQQWEHERSVMSRLQSIKEEIDRVNLEIQQAEREYDLNRAAELKYGSLNSLQRQLNEAEKELDEYLSSGKSMFREEVLGSDIAEIVSKWTGIPVSKLQQSERDKLLHLEEELHKRVVGQNPAVTAVAEAIQRSRAGLSDPGRPIASFMFMGPTGVGKTELAKALASYLFNTEEALVRIDMSEYMEKHAVSRLIGAPPGYVGYEEGGQLTETVRRRPYSVILFDEIEKAHGDVFNVFLQILDDGRVTDSQGRTVSFTNTVIIMTSNVGSQFILNNTDDDAKELAYETIKQRVMDAARSIFRPEFMNRVDEYIVFQPLDRDQINSIVRLQLARVQKRIADRKMKIEVTDAAVDLLGSLGYDPNYGARPVKRVIQQNIENELAKGILRGDFKEEDGILIDTEVTAFSNGQLPQQKLIFKKIESETADAGKEEEVFSK

SEQ ID NO: 23437 - protein, 978 aa, Tabernaemontana elegans
MAATSSLVGVPFHLRPSNSASRASLFSQPPPLSVNFIANPRALKSPKSLKLKRKDAFSTRKVEEFGRSSRSLVVRCEASSGKQITQTEFTDMAWQGIVSSPEVAKENKHQIVETEHLMKSLLEQKNGLARRIFSKVGVDNTRLLEATDKFIQRQPKVLGESAGSMLGRDLEALIQRARDYKKEYGDSFISVEHLVLGFAQDNRFGKQLFKDFQISLTALKDAIQAIRGRQTVIDQDPEGKYEALEKYGQDLTAMARAGKLDPVIGRDDEIRRCIQILSRRTKNNPVLIGEPGVGKTAISEGLAQRIVQGDVPQALMNRRLISLDMGALIAGAKYRGEFEDRLKAVLREVTDSDGQIILFIDEIHTVVGAGATNGAMDAGNLLKPMLGRGELRCIGATTLNEYRKYIEKDAALERRFQQVYVDQPTVEDAISILRGLRERYELHHGVRISDSALVAAAVLSDRYISGRFLPDKAIDLVDEAAAKLKMEITSKPTALDEIDRAVLKLEMERLSLTNDTDKASKERLNRLEAELTLLKARQAELTEQWEHEKTVMMRIQSIKEEIDRVNLEIQQAEREYDLNRAAELKYGSLNSLQRQLEAAEKELDEYMKSGKSMLREEVTEGDIAEIVSKWTGIPVSKLQQSEKEKLLLLEEELHKRVVGQDPAVKSVADAIQRSRAGLSDPHRPIASFMFMGPTGVGKTELAKALASYLFNTEEALVRIDMSEYMEKHAVSRLIGAPPGYVGYEEGGQLTEAVRRRPYSVILFDEIEKAHSDVFNVFLQILDDGRVTDSQGRTVSFTNCVIIMTSNVGSQYILNSDDEDLPKEMAYERIKQRVMEAARAIFRPEFMNRVDEYIVFQPLDRDQINKIVRLQLERVLKRIAERKMKLEVTDAAVELLGSLGYDPNYGARPVKRVIQHYVENELAKGILRGEFKDEDIIEIDTGVTAFSNGQLPQQKLVFRRLEAGSDASAENKEAVSQTF

SEQ ID NO: 23438 - protein, 971 aa, Euphorbia peplus
MAAAAATTPAYLAGVTLCQSQNTRNAFFSPKLLNFPLKHSTLNSLHFKKSSSAARGGRRPAFVVRCVGDSTSSGRITQQEFTEMAWQGIVSSPDVAKDNKHQIVETEHLLKSLLEQKNGLARRIFSKVGVDNTRLLEATDKFIQRQPKVLGESAGSMLGRDLEALIQRARDYKKEYNDSFVSVEHLVLAYAQDSRFGKQLFKDFQISLPTLKSAVESIRGRQSVIDQDPEGKYEALEKYGKDLTAMAKAGKLDPVIGRDDEIRRCIQILSRRTKNNPVLIGEPGVGKTAISEGLAQRIVQGDVPQALMNRKLISLDMGALIAGAKYRGEFEDRLKAVLKEVTDSDGQIILFIDEIHTVVGAGATNGAMDAGNLLKPMLGRGELRCIGATTLDEYRKYIEKDPALERRFQQVYVDQPTVEDTVSILRGLRERYELHHGVSISDSALVEAAILSDRYISGRFLPDKAIDLVDEAAAKLKMEITSKPTALDEIDRSVLKLEMEKLSLKNDTDRASKDRLSRLDAELSLLKTKQAELTEQWEHEKTVMTRIQSIKEEIDRVNLEIQQAEREYDLNRAAELKYGSLNSLQRQLEGAEKELDEYMKSGKSMLREEVTGDDIAEIVSKWTGIPLSKLKQSEREKLLHLEEELHKRVVGQNPAVTAVAEAIQRSRAGLSDPRRPIASFMFMGPTGVGKTELAKALASYMFNTEEALVRIDMSEYMEKHAVSRLIGAPPGYVGYEEGGQLTEIVRRRPYAVILFDEIEKAHADVFNVFLQILDDGRVTDSQGRTVSFTNTVIIMTSNVGSQYILDTDDDMPKEAAYESIKRRVMEAARSVFRPEFMNRVDEYIVFQPLDRDQINRIVSLQLARVQQRVADRKMKIQVTEAAVELLGNLGYDPNYGARPVKRVIQQYVENELAKGILRGEFKDEDIILVDTEVTAFSNGQLPQQKLIFKKLEVDADAKAADAENQAVSQTF

SEQ ID NO: 23439 - protein, 985 aa, Chrysanthemum coronarium
MATPASFSGVNINNVPLDRTTALFAQPSVSVHSFSYKPRTTTSVRSLKLRSRSSYGGGVLLTTRTTGGVRFGSKRCNRSFVVRADTSSNGRISQQEFTEMAWQAIVSSPEVAKENKHQIVETEHLLKALLEQKNGLARRIFSKAGVDNTRLLEATDKFIQRQPKVIGESAGSMLGRDLEGLMNRARDYKKEYGDSFVSVEHLVLGYVQDNRFGKQLFKDFQISLKTLKNAIESIRGRQTVIDQDPEGKYESLEKYGKDLTAMAREGKLDPVIGRDDEIRRCIQILSRRTKNNPVLIGEPGVGKTAISEGLAQRIVQGDVPQALMNRKLISLDMGALIAGAKYRGEFEDRLKAVLKEVTESDGQIILFIDEIHTVVGAGATNGAMDAGNLLKPMLGRGELRCIGATTLDEYRKYIEKDPALERRFQQVYVDQPTVDDTVSILRGLRERYELHHGVRISDSALVEAAILSDRYISGRFLPDKAIDLVDEAAAKLKMEITSKPTALDEINRSVLKLEMERLSLTSDTDKASKDRLSRLEAELALLKEKQAQLTEQWEHEKSVMTNIQSIKEEIDRVNLEILQAEREYDLNRAAELKYGSLNSLLRQLETADKELAEYMSSGKSMLREEVTGDDIAEIVSKWTGIPLSKLKQSEREKLLHLEEELHKRVVGQNPAVTAVAEAIQRSRAGLSDPHRPIASFMFMGPTGVGKTELAKALASYLFNTEEALVRIDMSEYMEKHAVSRLIGAPPGYVGYEEGGQLTETVRRRPYAVILFDEIEKAHADVFNVFLQILDDGRVTDSQGRTVSFTNTVIIMTSNVGSQYILDTEDDSMPKERAYETIKQRVMDAARSIFRPEFMNRVDGYIVFQPLDRSQINRIVRLQLERVQKRIADRKLKIMVSEAAVELLGSLGYDPNYGARPVKRVIQQHVENELAKGILRGDFKDEDTISVDTEVTAFSNGQLPQQKLVFKKVDTPGGAPEGQQALSQTV

SEQ ID NO: 23440 - protein, 958 aa, Daucus carota
LVSHSSTLSVNLSPPYPPLPALTCSLSFKFNAHSASFTRKTRPVFSPANPRPSLVRCQASSGKVSQEEFTEMAWQAIVSSPEVAKENKHQIVETEHLMKALLEQKNGLARRIFSKAGVDNTRLLDATDKFIKRQPKVIGDSAGSMLGRDLETLLQRARDYKKEYNDSFVAVEHLVLGFVQDKRFGKQLFKDFQISMKALTDAVQAIRGRQTVIDQDPEGKYEALEKYGKDLTAMAKAGKLDPVIGRDDEIRRCIQILSRRTKNNPVLIGEPGVGKTAISEGLAQRIVQGDVPQALMNRKLISLDMGALIAGAKYRGEFEDRLKAVLKEVTESDGQTILFIDEIHTVVGAGATSGAMDAGNLLKPMLGRGELRCIGATTLDEYRKYIEKDPALERRFQQVLVDQPTVGDTVSILRGLRERYELHHGVRISDGALVDAAILSDRYISGRFLPDKAIDLVDEAAAKLKMEITSKPTALDEINRAVLKLEMERLSLTNDTDKASRDRLSRLEGELNLLKETQAELNEQWEHEKTVMTRLQSIKEEIDRVNLEIQQAEREYDLNRAAELKYGSLNSLQRQLETAEKELDEYMKSGKSMLREEVSGSDIAELVSKWTGIPVSKLQQSEREKLLHLELELHKRVVGQDPAVTSVADAIQRSRAGLSDPNRPIASFMFMGPTGVGKTELAKALASYMFNTEEALVRIDMSEYMEKHAVSRLIGAPPGYVGYEEGGQLSETVRRRPYAVILFDEIEKAHSDVFNVFLQILDDGRVTDSQGRTVSFTNTVIIMTSNVGSQYILNTDDDSVSKETTYETIKQKVMDAARSVFRPEFMNRVDEYIVFQPLDRDQINSIVRIQLERVQKRIADRKMKLQVSDAAIKLLGSLGYDPSYGARPVKRVIQQNVENELAKGILRGQFKDEDTVLIDTEVTAFSNGQLPQQKLVFKRLDSDSDTTAEKAERFSKTV

SEQ ID NO: 23441 - protein, 944 aa, Daucus carota
PLYSRPSLSLSSTSTPHKLALKTRPNNALFAAPSRTFRNNSSFVVRCEASGGRITQEEFTEMAWQAIVSSPEVAKENKHQIVETEHLLKALLEQKNGLARRIFSKAGVDNTRLLEATDKFINLQPKVLGESAGSMLGRDLESLIQRARDYKKEYNDSFVSVEHLVLGYVEDRRFGKQLCKDFQISLKALKNAIEAIRGRQTVIDKDPEGKYEALEKYGKDLTAMARAGKLDPVIGRDDEIRRCIQILSRRTKNNPVLIGEPGVGKTAISEGLAQRIVEGDVPQALMNRKLISLDMGALIAGAKYRGEFEDRLKAVLKEVTESDGQTILFIDEIHTVVGAGATNGAMDAGNLLKPMLGRGELRCIGATTLDEYRKYIEKDPALERRFQQVYVDQPTVEDTISILRGLRERYELHHGVRISDGALVEAAILSDRYISGRFLPDKAIDLVDEAAAKLKMEITSKPTALDEINRSVLKLEMERLSLTNDTDKASKDRLDRLEAELDLLKKKQTELNEQWEHEKTVMTRLQSIKEEIDRVNLEIQQAEREYDLNRAAELKYGSLNSLQRQLETAEKELDEYMRSGKSMLREEVSGSDIAEIVSKWTGIPVSKLQQSEREKLLHLEEELHKRVVGQNPAVTSVAEAIQRSRAGLSDPHRPIASFMFMGPTGVGKTELAKALASYMFNTEDALVRIDMSEYMEKHTVSRLIGAPPGYVGYDEGGQLTETVRRRPYAVILFDEIEKAHSDVFNVFLQILDDGRVTDSQGRTVSFTNTVIIMTSNVGSQYILGMDGEETSYETIKRRVLDAARSVFKPEFMNRVDEYIVFQPLDRDQINSIVRIQLERVQKRIADRKMKLKVTDAAVELLGSLGYDPSYGARPVKRVIQQNVENELAKGILRGEFKDDDTVLVDTEVTAFLDGQLPQQKLVFRKLDSGTDVEANNKKVVSQTF

SEQ ID NO: 23442 - protein, 985 aa, Chrysanthemum coronarium
MATPASFSGVNINNVPLDRTTALFAQPSVSVHSFSYKPRTTTSVRSLKLRSRSSYGGGVLLTTRTTGGVRFGSKRCNRSFVVRADTSSNGRISQQEFTEMAWQAIVSSPEVAKENKHQIVETEHLLKALLEQKNGLARRIFSKAGVDNTRLLEATDKFIQRQPKVIGETAGSMLGRDLEALMNRARDYKKEYGDSFVSVEHLVLGYVQDNRFGKQLFKDFQISLKTLKNAIESIRGKQTVIDQDPEGKYESLEKYGKDLTAMAREGKLDPVIGRDDEIRRCIQILSRRTKNNPVLIGEPGVGKTAISEGLAQRIVQGDVPQALMNRKLISLDMGALIAGAKYRGEFEDRLKAVLKEVTESDGQIILFIDEIHTVVGAGATNGAMDAGNLLKPMLGRGELRCIGATTLDEYRKYIEKDPALERRFQQVYVDQPTVDDTVSILRGLRERYELHHGVRISDSALVEAAILSDRYISGRFLPDKAIDLVDEAAAKLKMEITSKPTALDEINRSVLKLEMERLSLTSDTDKASKDRLSRLEAELALLKEKQAQLTEQWEHEKSVMTNIQSIKEEIDRVNLEILQAEREYDLNRAAELKYGSLNSLLRQLETADKELAEYMSSGKSMLREEVTGDDIAEIVSKWTGIPLSKLKQSEREKLLHLEEELHKRVVGQNPAVTAVAEAIQRSRAGLSDPHRPIASFMFMGPTGVGKTELAKALASYLFNTEEALVRIDMSEYMEKHAVSRLIGAPPGYVGYEEGGQLTETVRRRPYAVILFDEIEKAHADVFNVFLQILDDGRVTDSQGRTVSFTNTVIIMTSNVGSQYILDTEDDSMPKERAYETIKQRVMDAARSIFRPEFMNRVDGYIVFQPLDRSQINRIVRLQLERVQKRIADRKLKIMVSEAAVELLGSLGYDPNYGARPVKRVIQQHVENELAKGILRGDFKDEDTISVDTEVTAFSNGQLPQQKLVFKKVDTPGGAPEGQQALSQTV

SEQ ID NO: 23443 - protein, 977 aa, Valeriana officinalis
MASAKTISSIANFSISSCSRSTAQPPISVTFSAKPVAFKALKSVNLKSSNVLNNQRVQRSGRSSSSRSFVVRCEASNGNDRITQQEFTEMAWQAIVSSPEVAKENKHQIVETEHLMKALLEQRNGLARRIFSKAGVDNTRLLEATEKYIQRQPKVIGESSGSMLGRDLESLVQRAREYKKEYKDSFVSVEHLVLGFLQDNRFGKQLFKDFQISLKTLTDAIQAIRGTQTVIDQDPEGKYESLEKYGKDLTAMARAGKLDPVIGRDDEIRRCIQILSRRTKNNPVLIGEPGVGKTAISEGLAQRIVQGDVPQALMNRRLISLDMGALIAGAKYRGEFEDRLKAVLKEVTESDGQTILFIDEIHTVVGAGATSGAMDAGNLLKPMLGRGELRCIGATTLDEYRKYIEKDPALERRFQQVYVDQPTVEDTVSILRGLRERYELHHGVRISDGALVEAAILSDRYISGRFLPDKAIDLVDEAAAKLKMEITSKPTALDEIDRAVLKLEMEKLSLKNDTDKGSKDRLSRLESELDLLKKRQTELNEQWDHEKNVMTRLQSIKEEIDRVNLEIQQAEREYNLNRAAELKYGSLNSLQRQLETAEKELDEYMNSGKSMLREEVTGSDIAEIVSKWTGIPVSKLQQSDREKLLYLEDELHRRVVGQDPAVRSVAEAIQRSRAGLSDPHRPIASFMFMGPTGVGKTELAKALASYMFNTEEALVRIDMSEYMEKHAVSRLIGAPPGYVGYEEGGQLTEIVRRRPYAVILFDEIEKAHSDVFNVFLQILDDGRVTDSQGRTVSFNNTVIIMTSNVGSQFILNTDDEDLPNGSAYETIKRRVMDAARSVFRPEFMNRIDEYIVFQPLDREQINSIVRLQLDRVQKRIADRKMSLKVTDSAVELLGSLGYDPNYGARPVKRVIQQNVENELAKGILRGEFKEEDSILIDTEVGLFSNGQLPQQKLVFKRISDSDTAEANNKEAFSQQTI

SEQ ID NO: 23444 - protein, 964 aa, Brassica oleracea
MATTATSAFSGVIGVGSESRKVSTFSHLQPSVAFPAKPNSFKSLKLKHSARLTRRLEHRPFVVRCEASSNGRLTQQEFTEMAWQSIVSSPDVAKENKQQIVETEHLMKALLEQKNGLARRIFSKIGVDNTKVLEATEKFIQRQPKVYGESAGSMLGRDLEGLFERARKYKKDLGDSYVSVEHLVLAFAQDKRFGKQLFKDFQISEKSLKAAIESIRGKQSVIDQDPEGKYEALEKYGKDLTAMAREGKLDPVIGRDDEIRRCIQILSRRTKNNPVLIGEPGVGKTAISEGLAQRIVQGDVPQALMNRKLISLDMGALIAGAKYRGEFEDRLKAVLKEVTDSEGQIILFIDEIHTVVGAGATNGAMDAGNLLKPMLGRGELRCIGATTLDEYRKYIEKDPALERRFQQVYVDQPTVEDTVSILRGLRERYELHHGVRISDSALVEAAILSDRYISGRFLPDKAIDLVDEAAAKLKMEITSKPTALDELDRAVIKLEMERLSLTNDTDKASRERLSRIETELLSLKEKQAELTQQWEHERSVMSRLQSIKEEIDRVNLEIQQAEREYDLNRAAELKYGSLNSLQRQLNEAEKELDEYLSSGESMFREEVLGSDIAEIVSKWTGIPVSKLQQSERDKLLHLEEELHKRVVGQNPAVTAVAEAIQRSRAGLSDPGRPIASFMFMGPTGVGKTELAKALASYLFNTEEALVRIDMSEYMEKHAVSRLIGAPPGYVGYEEGGQLTETVRRRPYSVILFDEIEKAHGDVFNVFLQILDDGRVTDSQGRTVSFTNTVIIMTSNVGSQFILNNTDDDAKELAYETIKQRVMDAARSIFRPEFINRVDEYIVFQPLDRDQINIIVRLQLARVQKRIADRKMKIEITDAAVDLLGSLGYDPNYGARPVKRVIQQNIENELAKGILRGDFKEEDGILIDTEVTAFSNGQLPQQKLIFKKIESETADAGKEEEAFSK

SEQ ID NO: 23445 - protein, 960 aa, Brassica napus
MATTTTSAFSGVIGVGSESRKVSSFSHLQPSVAFPAKPNSFKSLKLKHSARLTRRLEHRPFVVRCEASSNGRLTQQEFTEMAWQSIVSSPDVAKENKQQIVETEHLMKALLEQKNGLARRIFSKIGVDNTKVLEATEKFIQRQPKVYGESAGSMLGRDLEGLFERARKYKKDLGDSYVSVEHLVLAFAQDKRFGKQLFKDFQISEKSLKTAIESIRGKQSVIDQDPEGKYEALEKYGKDLTAMAREGKLDPVIGRDDEIRRCIQILSRRTKNNPVLIGEPGVGKTAISEGLAQRIVQGDVPQALMNRKLISLDMGALIAGAKYRGEFEDRLKAVLKEVTDSEGQIILFIDEIHTVVGAGATNGAMDAGNLLKPMLGRGELRCIGATTLDEYRKYIEKDPALERRFQQVYVDQPTVEDTISILRGLRERYELHHGVRISDSALVEAAILSDRYISGRFLPDKAIDLVDEAAAKLKMEITSKPTALDELDRAVIKLEMERLSLTNDTDKASRERLSRIETELLSLKEKQAELTQQWEHERSVMSRLQSIKEEIDRVNLEIQQAEREYDLNRAAELKYGSLNSLQRQLNEAEKELDEYLSSGKSMFREEVLGSDIAEIVSKWTGIPVSKLQQSERDKLLHLEEELHKRVVGQNPAVTAVAEAIQRSRAGLSDPGRPIASFMFMGPTGVGKTELAKALASYLFNTEEALVRIDMSEYMEKHAVSRLIGAPPGYVGYEEGGQLTETVRRRPYSVILFDEIEKAHGDVFNVFLQILDDGRVTDSQGRTVSFTNTVIIMTSNVGSQFILNNTDDDAKELAYETIKQRVMDAARSIFRPEFMNRVDEYIVFQPLDRDQINSIVRLQLARVQKRIADRKMKIEVTDAAVDLLGSLGYDPNYGARPVKRVIQQNIENELAKGILRGDFKEEDGILIDTEVTAFSNGQLPQQKLIFKKIESETADAGKEEE

SEQ ID NO: 23446 - protein, 964 aa, Brassica napus
MATTATSAFSGVIGVGSESRKVSTFSHLQPSVAFPAKPNSFKSLKLKHSARLTRRLEHRSFVVRCEASSNGRLTQQEFTEMAWQSIVSSPDVAKENKQQIVETEHLMKALLEQKNGLARRIFSKIGVDNTKVLEATEKFIQRQPKVYGESAGSMLGRDLEGLFERARKYKKDLGDSYVSVEHLVLAFAQDKRFGKQLFKDFQISEKSLKAAIESIRGKQSVIDQDPEGKYEALEKYGKDLTAMAREGKLDPVIGRDDEIRRCIQILSRRTKNNPVLIGEPGVGKTAISEGLAQRIVQGDVPQALMNRKLISLDMGALIAGAKYRGEFEDRLKAVLKEVTDSEGQIILFIDEIHTVVGAGATNGAMDAGNLLKPMLGRGELRCIGATTLDEYRKYIEKDPALERRFQQVYVDQPTVEDTVSILRGLRERYELHHGVRISDSALVEAAILSDRYISGRFLPDKAIDLVDEAAAKLKMEITSKPTALDELDRAVIKLEMERLSLTNDTDKASRERLSRIETELLSLKEKQAELTQQWEHERSVMSRLQSIKEEIDRVNLEIQQAEREYDLNRAAELKYGSLNSLQRQLNEAEKELDEYLSSGESMFREEVLGSDIAEIVSKWTGIPVSKLQQSERDKLLHLEEELHKRVVGQNPAVTAVAEAIQRSRAGLSDPGRPIASFMFMGPTGVGKTELAKALASYLFNTEEALVRIDMSEYMEKHAVSRLIGAPPGYVGYEEGGQLTETVRRRPYSVILFDEIEKAHGDVFNVFLQILDDGRVTDSQGRTVSFTNTVIIMTSNVGSQFILNNTDDDAKELAYETIKQRVMDAARSIFRPEFINRVDEYIVFQPLDRDQINIIVRLQLARVQKRIADRKMKIEITDAAVDLLGSLGYDPNYGARPVKRVIQQNIENELAKGILRGDFKEEDGILIDTEVTAFSNGQLPQQKLIFKKIESETADAGKEEEAFSK

SEQ ID NO: 23447 - protein, 943 aa, Panax ginseng
SVVNLSSSKSNTVLKSSSYSVSSIRLNRNNNAMRKNSRSFVVHCEAGRITQAEFTEMAWQAIVSSPEVAKENKHQIVETEHLMKALLEQKNGLARRIFSKAGVDNTRLLEATDKFINLQPKVLGESGGSMLGRDLEALIQAARDYKKEYNDSFVSVEHLVLGFAQDKRFGKQLFKDFQISLKTLKNAVEAIRGSQTVIDKDPEGKYEALEKYGKDLTAMAREGKLDPVIGRDDEIRRCIQILSRRTKNNPVLIGEPGVGKTAISEGLAQRIVQGDVPQALMNRKLISLDMGALIAGAKYRGEFEDRLKAVLKEVTESDGQIVLFIDEIHTVVGAGATNGAMDAGNLLKPMLGRGELRCIGATTLDEYRKYIEKDPALERRFQQVYVDQPTVEDTISILRGLRERYELHHGVRISDGALVEAAILSDRYISGRFLPDKAIDLVDEAAAKLKMEITSKPTALDEINRSVLKLEMERLSLTNDTDKASKDRLNRLEAELDLLKKRQAELNEQWEHEKSVMTRLQSIKEEIDRVNLEIQQAEREYDLNRAAELKYGSLNSLQRQLETAEKELDEYMRSGKSMLREEVTGSDIAEIVSKWTGIPVSKLQQSEREKLLHLEEELHKRVVGQDPAVKSVAEAIQRSRAGLSDPHRPIASFMFMGPTGVGKTELAKALANYMFNTEEALVRIDMSEYMEKHAVSRLIGAPPGYVGYDEGGQLTETVRRRPYAVILFDEIEKAHSDVFNVFLQILDDGRVTDSQGRTVSFTNTVIIMTSNVGSQYILNTDDDASSKETTYETIKQRVMDAARSVFRPEFMNRVDEYIVFQPLDRDQINIIVRIQLERVQKRIADRKIKLQVTDAAVELLGSLGYDPSYGARPVKRVIQQHVENELAKGILRGEFKDEDTVLIDTEVTVLSNGQRPQQRLVFRKLDSGSDVAAEKTQTFSRTV

SEQ ID NO: 23448 - protein, 973 aa, Brassica oleracea
MATAKTTATAAFSSIVGGVGSDSRKVSSFSHLQPSVAFPAKPTSFKSLKLKQSARLTRRLQHQPFVVRCEASSNGRLTQQEFTEMAWQSIVSSPDVAKENKQQIVETEHLMKALLEQKNGLARRIFSKIGVDNTKVLEATDKFIQRQPKVYGEAAGSMLGRDLEGLFQRARQYKKDLGDSYVSVEHLVLAFVDDKRFGKQLFRDFQISEKSLKTAIESIRGKQSVIDQDPEGKYEALEKYGKDLTAMAREGKLDPVIGRDDEIRRCIQILSRRTKNNPVLIGEPGVGKTAISEGLAQRIVQGDVPQALMNRKLISLDMGALIAGAKYRGEFEDRLKAVLKEVTDSEGQTILFIDEIHTVVGAGATNGAMDAGNLLKPMLGRGELRCIGATTLDEYRKYIEKDPALERRFQQVYVDQPTVEDTVSILRGLRERYELHHGVRISDSALVEAAILSDRYISGRFLPDKAIDLVDEAAAKLKMEITSKPTALDELDRAVIKLEMERLSLTNDTDKASRERLNRIETELVLLKEKQAELTEQWEHERSVMSRLQSIKEEIDRVSLEIQQAEREYDLNRAAELKYGSLNSLQRQLNEAEKELNEYLSSGKSMFREEVLGSDIAEIVSKWTGIPVSKLQQSERDKLLHLEEELHRRVIGQNPAVTAVAEAIQRSRAGLSDPGRPIASFMFMGPTGVGKTELAKALASYLFNTEEALVRIDMSEYMEKHAVSRLIGAPPGYVGYEEGGQLTEVVRRRPYSVILFDEIEKAHGDVFNVFLQILDDGRVTDSQGRTVSFTNTVIIMTSNVGSQYILNSNADDEGSELGYETIKQRVMDAARSIFRPEFMNRVDEYIVFQPLDREQINSIVRLQLARVQKRIADRKMKIEITDAAVDLLGSLGYDPNYGARPVKRVIQQNIENELAKGILRGDFKEEDGILIDTEVTAFSNGQLPQQKLTFKKIASETADAEKEEEEAFSKQSN

SEQ ID NO: 23449 - protein, 981 aa, Phalaenopsis aphrodite
MAYALHSHYLCLPPPLPRSLRRITFSSAIPLSAKSMKTLNPLNSAETLGKSGFFVVKRAGRFSTGRNRQQGVRCDATSKDGRITQQEFTEMAWQGIVSSPEVAKESKHQIVETEHLMKALLEQKNGLARRIFSKAGVDNTRLLEATDSYIQRQPKVLGESAGSMLGRDLESLIQRAREFKKEYGDSFVSVEHLVLGFVEDKRFGKQLLKDFRVSLQMLKSAIQSIRGRQTVIDQDPEGKYEALEKYGKDLTAMAREGKLDPVIGRDDEIRRCIQILSRRTKNNPVLIGEPGVGKTAISEGLAQRIVEGDVPQALMNRRLISLDMGALIAGAKFRGEFEDRLKAVLKEVTDSDGQTILFIDEIHTVVGAGATNGAMDAGNLLKPMLGRGELRCIGATTLDEYRKYIEKDPALERRFQQVYVDQPTVEDTISILRGLRERYELHHGVRINDSALVDAAVLSDRYISGRFLPDKAIDLVDEAAAKLKMEITSKPTALDEINRSVIKLEMERLSLTNDTDKASKERLARLDAELSLLKKRQAELTEQWEHEKSVMTRIQSIKEEIDRVNIEIQQAEREYDLNRAAELKYGSLNSLQRQLQETEKELNEYQSSGKSMLREEVTGNDIAEIVSKWTGIPVSKLQQSEKEKLLHLEEELHKRVVGQDPAVQAVAEAIQRSRAGLSDPHRPIASFMFMGPTGVGKTELAKALASYMFNTEEALVRIDMSEYMEKHAVSRLIGAPPGYVGYEEGGQLTETVRRRPYAVILFDEIEKAHFDVFNVFLQILDDGRVTDSQGRRVSFTNTVIIMTSNVGSQYILNVNDEIGSGVSAYESIKQRVMEAARAIFRPEFMNRVDEYIVFQPLDQQQINSIVRLQLERVQNRLADRKIKIQVTDAAVILLGRLGYDPNYGARPVKRVIQQNVENELAKGILRGDFRDEEIIEVDTELTAFSNGQLPQQKLVFRSLGAGSSSDKQQSTETQEAVLPSR

SEQ ID NO: 23450 - protein, 976 aa, Gossypium raimondii
MAAASSSVASFSGVSLCATRSFSNKNNLFSLHPCISLSFPSKPNSLKSFKPLHLRKNGVLDKFSRTSSRPFVVRCEASAGRITQQEFTEMAWQAIVSSPDVARENKHQIVETEHLMKALLEQKNGLARRIFAKVGVDNTRLLEATDKFIQRQPKVLGESAGSMLGRDLEVLIQRAREYKKDYGDSFVSVEHLVLGFTQDQRFGKQLFTDFQISDQSLKSAVESIRGRQSVIDQDPEGKYEALEKYGKDLTAMAREGKLDPVIGRDDEIRRCIQILSRRTKNNPVLIGEPGVGKTAISEGLAQRIVAGDVPQALTDRKLVSLDMGALIAGAKYRGEFEDRLKAVLKEVTESDGQIILFIDEIHTVVGAGATNGAMDAGNLLKPMLGRGELRCIGATTLDEYRKYIEKDPALERRFQQVYVGQPSVEDTVSILRGLRERYELHHGVRVSDSALVEAAILSDRYISGRFLPDKAIDLVDEAAAKLKMEITSKPTALDEINRSVLKLEMERLSLTNDTDKASRDRLSRLESELSLLKKRQAELTEQWEHEKTVMTRIQSIKEEIDRVNVEIQQAEREYDLNRAAELKYGSLNSLQRQLADAENELDEYMKSGKSMLREEVTGNDIAEVVSKWTGIPVSKLQQSEKEKLLHLEEVLHKRVVGQDPAVRSVAEAIQRSRAGLSDPRRPIASFMFMGPTGVGKTELAKALASYLFNTEEALVRVDMSEYMEKHAVSRLIGAPPGYVGYEEGGQLTEIVRRRPYAVILFDEIEKAHGDVFNVFLQILDDGRVTDSQGRTVSFTNTVIIMTSNVGSQYILNSDEDTPKNIAYGTIKQRVMEAARAVFRPEFMNRVDEYIVFQPLDREEISSIVRLQLERVQKRLSDKKIKLQITDAAVQLLGNLGYDPNYGARPVKRVIQQNVENELAKGILRGEFKDEDTILVDTEQTAVPNGPIPQQKLVFKRLNGDLDTQAIGSQEALSKTV

SEQ ID NO: 23451 - protein, 985 aa, Musa acuminata
MAAVFCAPHHHLPVLPLPSRKSGIRSFSGSLALPSPSKGRASVRPLRVLKWSETLGRSDLFVSKRAGRVGNRSRSVVVRCEANKDGRITQQEFTEMSWQAIVSAPEIAKESKHQIVETEHLMKSLLEQKNGLARRIFSKAGVDNTKLLEATDRFIQRQPKVLGETAGSMLGRDIETLIQRAREYKKEYGDSFVSVEHIVLSYADDRRFGRQLFKDFQISINTLKSAVQAIRGRQNVIDQDPEGKYEALEKYGKDLTAMAREGKLDPVIGRDDEIRRCIQILSRRTKNNPVLIGEPGVGKTAISEGLAQRIVQGDVPQALMNRRLISLDMGALIAGAKYRGEFEDRLKAVLREVTDSEGQIVLFIDEIHTVVGAGATNGAMDAGNLLKPMLGRGELRCIGATTLDEYRKYIEKDPALERRFQQVYVDQPTVEDTVSILRGLRERYELHHGVRISDSALVEAAILSDRYISGRFLPDKAIDLVDEAAAKLKMEITSKPTALDEINRSVLKLEMERLSLTNDTDKASKDRLNRLEAELSLLKEKQAELTEQWEHEKSVMTRIQSIKEEIDRVNLEIQQAEREYDLNRAAELKYGSLNSLQRQLQQAEKELTEYQNSGKSMLREEVTGNDIAEIVSKWTGIPVSKLQQSEREKLLHLEEELHKRVVGQDPAVRAVAEAIQRSRAGLSDPNRPIASFMFMGPTGVGKTELAKTLASYMFNTEEALVRIDMSEYMEKHAVSRLIGAPPGYVGYEEGGQLTETVRRRPYAVILFDEIEKAHSDVFNVFLQILDDGRVTDSQGRTVSFTNTVIIMTSNVGSQYILNMNDETESRDSTYESIKQRVMDAARSLFRPEFMNRVDEYIVFQPLDREQINSIVKLQLERVQKRVADRKIKIEVTDAAVEFLGNLGYDPNYGARPVKRVIQQNVENELAKGILRGDFKDEDTVLVDTEVTVFSNGQRPQQKLVFRKLLDADSSDKPSSEDQKAFLPSR

SEQ ID NO: 23452 - protein, 999 aa, Aquilegia formosa
METIHTGLQFRIPPISSKSCSGRSVLFARSQFSLNPKTVIKPLKTSKALNLKKNDMLFTTSRGGGGIQRFGKKKNSAFVVRCETQSNGRITQQEFTEMAWQGIVSSPEVAKENKHQIVETEHLMKALLEQKNGLARRIFTKAGVDNTRLLEATDKFIQRQPKVLGESSGSMLGRDLEALIQRARDFKKEYGDSFVSVEHLVLGFVQDQRFGKQLFKDFKISLKALKTAIESVRGRQKVIDQDPEGKYEALEKYGKDLTAMAQAGKLDPVIGRDDEIRRCIQILSRRTKNNPVLIGEPGVGKTAISEGHRRVIFFFRDVDYYRLAQRIVEGDVPQALMNRKLISLDMGALIAGAKYRGEFEDRLKAVLKEVTDSDGQIILFIDEIHTVVGAGATNGAMDAGNLLKPMLGRGELRCIGATTLDEYRKYIEKDPALERRFQQVYVDQPTVEDTVSILRGLRERYELHHGVSISDGALVEAAILSDRYISGRFLPDKAIDLVDEAAAKLKMEITSKPTALDEINRSVLKMEMERLSLTNDTDKASKDRLDRLEAELSLLKTKQKELTEQWEHEKSVMTRIQSIKEEIDRLNLEIQQAEREYDLNRAAELKYGSVMTLQRQLVDAEKELDEYLKSGKSMLREEVTGSDIAEIVSKWTGIPVSKLQQSEREKLLHLEEELHKRVVGQNPAVTSVAEAIQRSRAGLSDPHRPIASFMFMGPTGVGKTELAKALASYMFNTEEALVRIDMSEYMEKHAVSRLIGAPPGYVGYEEGGQLTEVVRRRPYSVILFDEIEKAHSDVFNVFLQILDDGRVTDSQGRTVSFTNSVLIMTSNVGSQYILNTDDESSAKDYETIKNRVMEAARSIFRPEFMNRVDEYIVFQPLDRDQINSIVRLQLERVQKRIGDRKMKIQVTEAAVQLLGSLGYDPNYGARPVKRVIQQNVENELAKGILRGEFKDEDTILIDTEVSAFANGQLPQQKLVFKKVNSDSEAPAEKDEKAFSESSI

SEQ ID NO: 23453 - protein, 926 aa, Gossypium hirsutum
PLHLRKNGVLDKFPGLLQDLFVVRCEASAGRITQQEFTEMAWQAIVSSPDVARENKHQIVETEHLMKALLEQKNGLARRIFAKVGVDNTRLLEATDKFIQRQPKVLGESAGSMLGRDLEALIQRARQYKKDYGDSFVSVEHLVLGFTQDQRFGKQLFTDFQISDQSLKSAVESIRGRQSVIDQDPEGKYEALEKYGKDLTAMAREGKLDPVIGRDDEIRRCIQILSRRTKNNPVLIGEPGVGKTAISEGLAQRIVAGDVPQALTDRKLISLDMGALIAGAKYRGEFEDRLKAVLKEVTESDGQIILFIDEIHTVVGAGATNGAMDAGNLLKPMLGRGELRCIGATTLDEYRKYIEKDPALERRFQQVYVGQPSVEDTVSILRGLRERYELHHGVRVSDSALVEAAILSDRYISGRFLPDKAIDLVDEAAAKLKMEITSKPTALDEINRSVLKLEMERLSLTNDTDKASRDRLSRLESELSLLKKRQAALTEQWEHEKTVMARIQSIKEEIDRVNVEIQQAEREYDLNRAAELKYGSLNSLQRQLADAENELDEYMKSGKSMLREEVTGNDIAEVVSKWTGIPVSKLQQSEKEKLLHLEEVLHKRVVGQDPAVRSVAEAIQRSRAGLSDPRRPIASFMFMGPTGVGKTELAKALASYLFNTEEALVRIDMSEYMEKHAVSRLIGAPPGYVGYEEGGQLTEIVRRRPYAVILFDEIEKAHGDVFNVFLQILDDGRVTDSQGRTVSFTNTVIIMTSNVGSQYILNSDEDTPKNIAYGTIKQRVMEAARAVFRPEFMNRVDEYIVFQPLDREEISSIVRLQLERVQKRISDKKIKLQITDAAVQLLGNLGYDPNYGARPVKRVIQQNVENELAKGILRGEFKDEDTILVDTEQTAVPNGPIPQQKLVFKRLNGDLDTQATGSQEALSKIV

SEQ ID NO: 23454 - protein, 888 aa, Eucalyptus grandis
MAWQGIVSSPDIAKENKHQIVETEHLMKALLEQKNGLARRIFSKAAVDNTRLLEATDKFIQRQPKVLGESAGSMLGRDLEALISRAREFKKQYGDSFVSVEHLVLGFAQDQRFGKQLFRDFQITEQKLKSAVEAVRGRQSVIDQDPEGKYEALEKYGKDLTAMARAGKLDPVIGRDDEIRRCIQILSRRTKNNPVLIGEPGVGKTAISEGLAQRIVQGDVPQALMDRKLISLDMGALIAGAKYRGEFEDRLKAVLKEVTESEGQIILFIDEIHTVVGAGATNGAMDAGNLLKPMLGRGELRCIGATTLDEYRKYIEKDPALERRFQQVYVDQPSVENTISILRGLRERYELHHGVRISDSALVEAAILSDRYISGRFLPDKAIDLVDEAAAKLKMEITSKPTALDEINRSVLKLEMEKLSLANDTDRASKDRLSRLEAELALLKERQAQLTEQWEHEKSVMTRIQSIKEEIDRVNLEIQQAEREYDLNRAAELKYGSLIALQRQLEDAEKELDEYMRSGKSMLREEVTGSDIAEIVSKWTGIPVSKLQQSEREKLLHLEEELHKRVVGQDPAVISVAEAIQRSRAGLSDPHRPIASFMFMGPTGVGKTELAKALAAYLFNTEEALVRIDMSEYMEKHAVSRLIGAPPGYVGYEEGGQLTETVRRRPYAVILFDEIEKAHSDVFNVFLQILDDGRVTDSQGRTVSFTNTVIIMTSNVGSQYILNTDDDTMPKETAYETIKQRVMDAARSIFRPEFMNRVDEYIVFQPLDREQINSIVKLQLERVQKRIADRKIKLVVTDGAIQLLGSLGYDPNYGARPVKRVIQQHVENELAKGILRGDFKDEDTIVVDTEVTAFANGQLPQQKLVFRKQDGDSDMAATGDREAISPSA

SEQ ID NO: 23455 - protein, 887 aa, Nicotiana benthamiana
MAWQAIVSSPEIAKENKHQIVETEHLMKALLEQKNGLARRIFSKAGVDNTRLLEATDKFIQRQPKVLGESAGSMLGRDLEGLIQRAREFKKEYNDSFVSVEHLVLGFAQDKRFGKQLFSDFQITQKTLKDAIQSIRGRQNVIDQDPEGKYEALEKYGKDLTAMARAGKLDPVIGRDDEIRRCIQILSRRTKNNPVLIGEPGVGKTAISEGLAQRIVQGDVPQALMNRRLISLDMGALIAGAKYRGEFEDRLKAVLKEVTDSEGQIILFIDEIHTVVGAGATNGAMDAGNLLKPMLGRGELRCIGATTLDEYRKYIEKDPALERRFQQVYVDQPTVENTISILRGLRERYELHHGVRISDTALVDAAVLSDRYISGRFLPDKAIDLVDEAAARLKMEITSKPTALDEINRAVLKLEMERLSLTNDTDKASKDRLNRLEAELSLLKEKQAELTEQWEHEKTVMTRIQSVKEEIDRVNLEIQQAEREYDLNRAAELKYGSQNSLQRQLAAAEKELDEYMKSGKSMLREEVTGNDIAEIVSKWTGIPVSKLQQSEREKLLHLEEELHKRVVGQDPAVRAVAEAIQRSRAGLSDPHRPIASFMFMGPTGVGKTELAKALATYLFNTEEALVRIDMSEYMEKHAVSRLIGAPPGYVGYEEGGQLTEIVRRRPYAVILFDEIEKAHADVFNVFLQILDDGRVTDSQGRTVSFTNTVIIMTSNVGSQYILNTDDDDLPKETTYQTIKQRVMEAARAVFRPEFMNRVDEYIVFQPLDRHQICSIVRLQLERVQQRLADRKMKIQVSDAAIQLLGNLGYDPNYGARPVKRVIQQNIENELAKGILRGDFKDEDTVLIDTEVTAFSNGQLPQQKLVFRRSGSGSDSPAENEKAFSQKL

SEQ ID NO: 23456 - protein, 886 aa, Manihot esculenta
MAWQGIVSSPDVAKENKHQIVETEHLMKALLEQKNGLARRIFSKIGVDNTRLLEATDKFIQRQPKVLGESAGSMLGRDLEALIQRAREYKKDYGDSFVSVEHLVLAFTQDRRFGRQLFRDFQISLQTLKSAVESIRGRQSVIDQDPEGKYEALEKYGKDLTAMAKAGKLDPVIGRDDEIRRCIQILSRRTKNNPVLIGEPGVGKTAISEGLAQRIVQGDVPQALMNRKLISLDMGSLIAGAKYRGEFEDRLKAVLKEVTESDGQIILFIDEIHTVVGAGATNGAMDAGNLLKPMLGRGELRCIGATTLDEYRKYIEKDPALERRFQQVYVDQPSVEDTISILRGLRERYELHHGVRISDSALVEAAILSDRYISGRFLPDKAIDLVDEAAAKLKMEITSKPTALDEIDRSVLKLEMEKLSLANDTDRASKDRLNRLEAELSVLKKKQEELTEQWEHEKTVMTRIQSIKEEIDRVNLEIQQAEREYDLNRAAELKYGSLNSLQRQLEVAEKELDEYMRSGKSMLREEVTGDDIAEVVSKWTGIPVSKLKQSEKEKLLHLEEELHKRVVGQDPAVKSVAEAIQRSRAGLSDPRRPIASFMFMGPTGVGKTELAKALASYMFNTEEALVRIDMSEYMEKHAVSRLIGAPPGYVGYEEGGQLTETVRRRPYAVILFDEIEKAHADVFNVFLQILDDGRVTDSQGRTVSFTNTVIIMTSNVGSQYILDTDDDMPKEVAYETIKKRVLEAARSIFRPEFMNRVDEYIVFQPLDRNQINSIVRLQLERVQQRISDRKMKLQVTDTAVELLGSLGYDPNYGARPVKRVIQQYVENELAKGILRGEFKDEDTVFIDTEVTAFSNGQLPQQKLVFQRLEIDANASAAESQAVSQAL

SEQ ID NO: 23457 - protein, 987 aa, Amborella trichopoda
MASAAAGFAFNQQIPQISLSNLSLRHKNNQSFCSRSSLKIPHCPLSSRRALSTLKTGVTHHRNSLFSTRNVERFKRNSRFVVRCEAPKDGRITQQEFTEMAWQAIVSSPEVAKESKQQIVETEHLMKALLEQKNGLARRIFSKAGVDNTRLLEATESFIQRQPKVLGETSGSMLGRDLEALIQRSRDYKKEYGDSFVSVEHLVLAFAQDQRFGKQLYKEFQIFLKTLTSAIQSIRGRQTVIDQDPEGKYEALDKYGVDLTAMAKEGKLDPVIGRDDEIRRCIQILSRRTKNNPVLIGEPGVGKTAIAEGLAQRIVQGDVPQALMNRKLISLDMGALIAGAKFRGEFEDRLKAVLKEVTQSDGQIILFIDEIHTVVGAGATNGAMDAGNLLKPMLGRGELRCIGATTLDEYRKYIEKDPALERRFQQVYVDQPSVEDTISILRGLRERYELHHGVRISDGALVEAAILADRYISGRFLPDKAIDLVDEAAAKLKMEITSKPTALDEINRSVLKLEMERLSLTNDTDRASKDRLARLEAELTLLKAKQEELTQQWEHEKSVMTRIQSIKEEIDRVNLEIQQAERDYDLNRAAELKYGSLMSLQHQLEVAEKELDEYQSSGKSMLREEVTADDIAEIVSKWTGIPVSKLQQSEREKLLYLEEELHKRVVGQNEAVRAVAEAIQRSRAGLSDPHRPIASFMFMGPTGVGKTELAKALASYLFNTEEALVRIDMSEYMERHTVSRLIGAPPGYVGYEEGGQLTEVVRRRPYAVILFDEIEKAHSDVFNIFLQILDDGRVTDSQGRKVSFTNTVIIMTSNVGSQYILNADDEPFSGDSAYEVIKRRVMEAARSIFKPEFMNRVDEFIVFRPLDREQINKIVRLQLERVQERLNDRKITLKVSDSAVELLGSLGYDPNYGARPVKRVIQQYVETELAKRILRGEFKDEDKILVDTEITSLSNGQLPQQKLVFKRVTPDSDSSSVVGQRTLSTSL

SEQ ID NO: 23458 - protein, 926 aa, Brassica napus
LKLKQSARLTRRLQHQPFVVRCEASSNGRLTQQEFTEMAWQSIVSSPDVAKENKQQIVETEHLMKALLEQKNGLARRIFSKIGVDNTKVLEATDKFIQRQPKVYGEAAGSMLGRDLEGLFQRARQYKKDLGDSYVSVEHLVLAFVDDKRFGKQLFRDFQISEKSLKTAIESIRGKQSVIDQDPEGKYEALEKYGKDLTAMAREGKLDPVIGRDDEIRRCIQILSRRTKNNPVLIGEPGVGKTAISEGLAQRIVQGDVPQALMNRKLISLDMGALIAGAKYRGEFEDRLKAVLKEVTDSEGQTILFIDEIHTVVGAGATNGAMDAGNLLKPMLGRGELRCIGATTLDEYRKYIEKDPALERRFQQVYVDQPTVEDTVSILRGLRERYELHHGVRISDSALVEAAILSDRYISGRFLPDKAIDLVDEAAAKLKMEITSKPTALDELDRAVIKLEMERLSLTNDTDKASRERLNRIETELVLLKEKQAELTEQWEHERSVMSRLQSIKEEIDRVSLEIQQAEREYDLNRAAELKYGSLNSLQRQLNEAEKELNEYLSSGKSMFREEVLGSDIAEIVSKWTGIPVSKLQQSDRDKLLHLEEELHRRVIGQNPAVTAVAEAIQRSRAGLSDPGRPIASFMFMGPTGVGKTELAKALASYLFNTEEALVRIDMSEYMEKHAVSRLIGAPPGYVGYEEGGQLTEVVRRRPYSVILFDEIEKAHGDVFNVFLQILDDGRVTDSQGRTVSFTNTVIIMTSNVGSQYILNSNADDEGSELGYETIKQRVMDAARSIFRPEFMNRVDEYIVFQPLDREQINSIVRLQLARVQKRIADRKMKIEITDAAVDLLGSLGYDPNYGARPVKRVIQQNIENELAKGILRGDFKEEDGILIDTEVTAFSNGQLPQQKLTFKKITSETADAEKEEEEAFSKQSN

SEQ ID NO: 23459 - protein, 872 aa, Cichorium intybus
NKHQIVETEHLMKALLEQKNGLARRIFSKAGVDNTRLLEATDKYIQRQPKVIGESAGSMLGRDLEALMQRARDYKKEYGDSFVSVEHLVLGFVQDNRFGKQLFKDFQISLKTLKNAIESIRGRQTVIDQDPEGKYESLEKYGKDLTAMARAGKLDPVIGRDDEIRRCIQILSRRTKNNPVLIGEPGVGKTAISEGLAQRIVQGDVPQALMNRKLISLDMGALIAGAKYRGEFEDRLKAVLKEVTESDGQIILFIDEIHTVVGAGATNGAMDAGNLLKPMLGRGELRCIGATTLDEYRKYIEKDPALERRFQQVYVDQPTVEDTVSILRGLRERYELHHGVRISDSALVEAAILSDRYISGRFLPDKAIDLVDEAAAKLKMEITSKPTALDEINRSVLKLEMERLSLTSDTDKASKDRLSRLEAELALLKERQAELNQQWEHEKGVMTNMQSIKEEIDRVNLEIQQAEREYDLNRAAELKYGSLNSLLRQLETAEKELVEYMSSGKSMLREEVTGDDIAEIVSKWTGIPLSKLKQSEREKLLHLEEELHKRVVGQDPAVTAVAEAIQRSRAGLSDPHRPIASFMFMGPTGVGKTELAKALASYLFNTEEALVRIDMSEYMEKHAVSRLIGAPPGYVGYEEGGQLTETVRRRPYAVILFDEIEKAHADVFNVFLQILDDGRVTDSQGRTVSFTNTVIIMTSNVGSQYILDTDDDSISKERTYETIKNRVMDAARSIFRPEFMNRVDEYIVFQPLDRSQINRIVRLQLERVQKRIADRKLKINVSEAAVELLGSLGYDPNYGARPVKRVIQQHVENELAKGILRGDFKDEDTISVDTEVTAFSNGQLPQQKLVFKRVDTSPGDTPKDQEAFSQTF

SEQ ID NO: 23460 - protein, 919 aa, Papaver somniferum
YLVVVSGSSTSTYRRFFFLLLLVCEAPKDRKDYPNKNLQEMAWQAIVSSPEVAKDNKHQIVETEHLMKALLEQKNGLARRIFAKVGVDNTRLLEATDKFIQRQPKVFGESAGSMLGRDLEALIQRSRDYKKEYNDSFVSVEHLLLGYVQDQRFGKQLFKDFQISLKSLKSAIEAIRGSQKVMDQDPEGKYEALEKYGKDLTAMARAGKLDPVIGRDDEIRRCIQILSRRTKNNPVLIGEPGVGKTAISEGLAQRIVQGDVPQALMNRKLVSLDMGALIAGAKFRGEFEDRLKAVLREVTESDGQTVLFIDEIHTVVGAGATNGAMDAGNLLKPMLGRGELRCIGATTLDEYRKYIEKDPALERRFQQVYVDQPTVEDTISILRGLRERYELHHGVRISDNALVEAAILSDRYISGRFLPDKAIDLVDEAAAKLKMEITSKPTALDEINRTVLKLEMERLSLVNDTDKASKDRLSRLDTELSILKEKQTELTEQWEHEKNVMTRIQSIKEEVDRVNLEIQQAEREYDLNRAAELKYGSLNALQRQLEVAEQELSEYLKSGKSMLREEVAGSDIAEIVSNWTGIPVSKLQQSERQKLLHLEEELHKRVVGQDPAVQAVAEAIQRSRAGLSDPHRPIASFMFMGPTGVGKTELAKTLASYMFNTEESLVRIDMSEYMEKHSVSRLIGAPPGYVGYEEGGQLTETVRRRPYAVILFDEIEKAHSDVFNVFLQILDDGRVTDSQGRTINFNNTVIIMTSNVGSQYLLNTDDDETSMGFAYETIKQRVMDAARSVFRPEFMNRVDEYIVFQPLDREQINSIVKLQLERVQKRIADKKMKIKVTEAAVQLLGSLGYDPSYGARPVKRVIQQNVENELAKGILRGDFKDEDTILIDTEVSVSNGQLPQQKLIFRRVDSSDSNISSPD

SEQ ID NO: 23461 - protein, 664 aa, Fagus grandifolia
MAGVDHLASERSKARFDVGEMKIVWAGSRHTFEVSDRISRLVASDPVFRKDNRAMLGRKELFKNTLRKASHAWKRILELRLSEEEASRLRFLLDEPAFTDLHWGMFVPAIKGQGTDEQQQKWLPLAYKMQIIGCYAQTELGHGSNVQGLETTATFDPQTDEFIIHSPTLTSSKWWPGGLGKVSTHAVVYARLITDGKDYGVNGFIVQLRSLDDHLPLPGITIGDIGMKFGNGAYNSMDNGVLKFDHVRIPRGQMLMRVSQVTREGKFVQSDVPRQLVYGTMVYVRQTIVADASCALSRAVCIATRYSAVRRQFGSNNDGVETQVIDYKTQQSRLFPLLASAYAFRFVGEWLKWLYTDVTQRLSANDFSTLPEAHACTAGLKSLTTSATADGIEACRKLCGGHGYLCSSGLPELFAVYVPACTYEGDNVVLLLQVARFLMKTVSQLGSGKKPVGTTAYMGRVEQLMQSRCDVQRAEDWLKPSVILEAFEARSARMSVACAQNLAKFENQEEGFAELSATLAEAAVAHCQLIVVSKFIEKLQQDIPGKGVKEQLEILCNIYALFLLHNHLGDFLSTGSITSKQGSLANDQLRSLYSQARPNAVALVDAFNYTDHYLGSVLGRYDGNVYPKLYEEAWKDPLNDSVVPDGYHEYIRPLLKQQLHNARL

SEQ ID NO: 23462 - protein, 664 aa, Castanea mollissima
MARVDQLASERSKAQFDVDEMKIVWAGSRHTFEISDRISRLVASDPAFRKDNRAMLGRKELFKNTLRKAAHAWKRIIELRLTDEEASRLRFYVDEPAFTDLHWGMFIPAIKGQGTDEQQQKWLPLAYKMQIIGCYAQTELGHGSNVQGLETTATFDPQTDEFIIHSPTLTSSKWWPGGLGKVSTHAVVYARLITDGKDYGVNGFIVQLRSMDDHSPLPGITIGDIGMKFGNGAYNTMDNGVLQFDHVRIPRDQMLMRVSQVTREGKFVQSNVPRQLVYGTMVYVRQTIVSDASCALSRAVCIATRYSAVRRQFGSNNDGVETQVIDYKTQQNRLFPLLASAYAFRFVGEWLKWLYTDVTQRLQANDFSTLPEAHACTAGLKSLTTSATADAIEECRKLCGGHGYLCSSGLPELFAVYVPACTYEGDNVVLLLQVARFLMKTVSQLGSGKKPVGTTAYMGRVEHLMQSSCDARKAEDWLKPSVILEAFEARSARMSVACAQNLAKFANPEEGFAELSADLTEASVAHCQLIVVSKFIEKLQQDIPGKGVKEQLEILCNIYALSLLHKYQGDFLSTGSITSKQASLANDQLRSLYSQVRPNAVALVDAFNYTDHYLGSVLGRYDGNVYPKLYEEAWKDPLNDSVVPDGYHEYIRPLLKQQLRNARL

SEQ ID NO: 23463 - protein, 664 aa, Castanea mollissima
MARVDQLASERSKAQFDVDEMKIVWAGSRHTFEISDRISRLVASDPAFRKDNRAMLGRKELFKNTLRKAAHAWKRIIELRLTDEEASRLRFYVDEPAFTDLHWGMFIPAIKGQGTDEQQQKWLPLAYKMQIIGCYAQTELGHGSNVQGLETTATFDPQTDEFIIHSPTLTSSKWWPGGLGKVSTHAVVYARLITDGKDYGVNGFIVQLRSMDDHSPLPGITIGDIGMKFGNGAYNTMDNGVLQFDHVRIPRDQMLMRVSQVTREGKFVQSNVPRQLVYGTMVYVRQTIVSDASCALSRAVCIATRYSAVRRQFGSNNDGVETQVIDYKTQQNRLFPLLASAYAFRFVGEWLKWLYTDVTQRLQANDFSTLPEAHACTAGLKSLTTSATADAIEECRKLCGGHGYLCSSGLPELFAVYVPACTYEGDNVVLLLQVARFLMKTVSQLGSGKKPVGTTAYMGRVEHLMQSSCDARKAEDWLKPSVILEAFEARSARMSVACAQNLAKFANPEEGFAELSADLTEASVAHCQLIVVSKFIEKLQQDIPGKGVKEQLEILCNIYALSLLHRYQGDFLSTGSITSKQASLANDQLRSLYSQVRPNAVALVDAFNYTDHYLGSVLGRYDGNVYPKLYEEAWKDPLNDSVVPDGYHEYIRPLLKQQLRNARL

SEQ ID NO: 23464 - protein, 664 aa, Citrus clementina
MDGVDQLAPERKKAQFDVDEMKIVWAGSRHAFQVSDRIARLVASDPAFRKDNRAMLSRKELFKNTLRKAAYAWKRIIELRLSEEEASMLRSSVDEPAFTDLHWGMFVPAIKGQGTDEQHQKWLPLAYKMEIIGCYAQTELGHGSNVQGLETTATFDPQTDEFVVHSPTLTSSKWWPGGLGKVSTHAVVYARLITDGQDHGVNGFIVQLRSLEDHSPLPGITIGDIGMKFGNGAYNTMDNGVLRFEHVRIPRNQMLMRVSQVTREGKYVQSNVPRQLLYGTMVYVRQTIVADASCALSRAVCIATRYSAVRRQFGSKNGGPETQVIDYKTQQNRLFPLLASAYAFRFVGEWLKWLYTDVTQRLQANDFSTLPEAHACTAGLKSLTTTATADGIEECRKLCGGHGYLCSSGLPELFAVYVPACTYEGDNIVLLLQVARFLMKTVSQLGSGNMPVGTTTYMGRAEQLMQCHCGVQKAEDWLNPSAILEAFEARAIRMSVACAQNLSKFTNQEEGFAELAADLVEAAVAHCQLIVVSKFIEKLQQDIPGKGVKPILEILCNIYALHLVHKHLGDFVSTGCITAKQASLANEQLRSLYSQVRPNAIALVDAFNYTDHYLGSVLGRYDGNVYPKLYEEAWKDPLNDSVVPDGYHEYIRPLLKQQLRNARL

SEQ ID NO: 23465 - protein, 663 aa, Vaccinium corymbosum
MERVDHLAHERNKSEFDVDAMKIVWAGSPHAFEVSDRISKLVASDPGFRKDNRTMLSRKDLFKNTLRKAAYAWKTIVDLHLSEEEAAKLRFYVDEPAYTDLHWGMFVPAIKGQGTDEQQQKWLPLAYKMQIIGCYAQTELGHGSNVQGLETTATFDPQTDEFIIHSPTLTSSKWWPGGLGKVATHAIAYARLIVGGRDYGVNGFIVQLRSLEDHSPLPGITVGDIGMKFGNGAYNTMDNGVLQFDHVRIPRDQMLMRVSQVTREGKYKPSDVPRQLVYGTMVYVRQTIVADASCALSRAVCIATRYSAVRRQFGSQNGGPETQVIDYKTQQSRLFPLLASAYAFRFIGEWLKWLYTDVTQRLQANDFSTLPEAHACTAGLKSLTTTATADGIEECRKLCGGHGYLCSSGLPELFAVYVPACTYEGDNTVLLLQVARFLMKTVSQLGVKKPVGTIGYMTRVDHLMQCRCGVQRAEDWLNPSALLEAFEARAARMSVACAQNLSNFDNPEEGFAELSADLVEAAVAHCQLIIVSKFIEKLQQEIPGKGVKQQLEVLCNIYALFLLHKHQGDFLSTGCITPKHASLANDQLRSLYSQVRPNAIALVDAFNYTDHFLGSILGCYDGNVYPKLYEAAWKDPLNDSVVPDGYHQYIRPLLKQQIRTARL

SEQ ID NO: 23466 - protein, 664 aa, Actinidia deliciosa
MEGVDHLANERNKAQFDVDSMKIVWAGSRHAFEVSDRISKLVASDPAFRKDNRAMLERKELFKNTLRKTAHAWKTIIDLRLSEEEASRLRFYIDEPAYTDLHWGMFIPAIKGQGTDEQQQKWLPLAHKMQIIGCYAQTELGHGSNVQGLETTATFDPQTDEFVIHSPTLTSSKWWPGGLGKVSTHAVAYARLITDGQDHGVHGFIVQLRSLEDHSPLPGITVGDIGMKFGNGAYNTMDNGVLRFDHVRIPRDQMLMRVSQVTREGKYMQSNVPRQLVYGTMVYVRQTIVADASCALSKAVCIATRYSAVRRQFGSHNGGPETQVIDYKTQQSRLFPLLASAYAFRFVGEWLKWLYTDVTQRLQANDFSTLPEAHACTAGLKSLTTSATADGIEECRKLCGGHGYLCTSGLPELFAVYVPACTYEGDNIVLLLQVARFLMKTVSQLGSGKHPVGTIAYMKRVEHLMQCRCNVQRAEDWLKPSVVLEAFEARATRMSVACAQNLSKFANPEEGFAELSADLVDAAVAHCQLIVVSKFIAKLQQDIPGKGVKEQLDALCYVYALFLLHKHQRDFLSTGCITPKQASLANDQLRSLYSKVRPNAIALVDSFNYTDHFLGSILGCYDGNVYPKLYDAAWKDPLNESVVPNGYHEYIKPVLKQQIRTARL

SEQ ID NO: 23467 - protein, 669 aa, Vinca minor
MAAEIDYLGDERKKAEFDVDAMKIVWAGSLHNFQLSDRISKLVASDPGFAKDGRTMLPRKELFKNTLRKAAYAWKRINELRLSEEEASKLRFYVDEPAFTDLHWGMFVPFIKGQGTDEQQKKWLSLAYKMQIIGCYAQTELGHGSNVQGLETTAMFDPQTDEFVIHSPTLTSSKWWPGGLGKVSTHAVAFARLITDGKDYGVHGFIVQIRSLDDHNPLPGVTVGDIGIKFGNGAYNTMDNGVLRFDHVRIPRNQLLMRFSQVTRDGKYKQSDVPRQLVYGTMVYVRQTIVQDASSALSRAVCIATRYSAVRRQFGSQNGGPEIQVIDYKTQQSRLFPLLASAYAFRFVGEWLNWLYTDVTKRLQANDFSTLPEAHACTAGLKSLTTSFTADAIEECRKLCGGHGYLCSSGLPELFAVYVPACTYEGDNTVMLLQVARFLMKTVSQTVSQLGSGKQLVGTIAYMGRLEHLMQCRCNVQNAEDWLNPSAVVEAFEARAVRMSVSCAKRLTQFTNQEEGFAEISADLVEAAVAHCQLIVVSKFIEKLQQDIPGKGVKEQLKALCGIYYLFILHKHQGDFLATNCITPNQASLANDLLRSLYSQIRPNAIALVDAFNYTDHFLGSILGRYDGNVYPKLYEAAWKDPLNDSVVTDGYHEYIRPLLKQQLRTAKL

SEQ ID NO: 23468 - protein, 664 aa, Trifolium pratense
MEGVDHLAFERNKAEFDVDAMKIVWAGSSHAFEVSDRMSRLVASDPAFRKDHRPMLGRKELFKSTLKKAAYAWKRIIELRLSEEEASMLRSFVDEPAFTDLHWGMFIPAIKGQGTDEQQQKWLPLAQKMQIIGCYAQTELGHGSNVQGLETTATFDPKTDEFVIHSPTLTSSKWWPGGLGKVSTHAVVYARLITDGQDHGVHGFIVQLRSLDDHLPLPGITVGDIGMKFGNGAYNTMDNGVLRFEHVRIPRDQMLMRVSRITREGKYVQSNVPRQLVYGTMVYVRQTIVSDASTAMSRAVCIATRYSAVRRQFGASNGGLESQVIDYKTQQARLFPLLASAYAFRFVGEWLKWLYTDVMKRLQANDFSTLPEAHACTAGLKSLTTSATSDGIEECRKLCGGHGYLCTSGLPELFAVYVPTCTYEGDNIVLLLQVARYLMKIISQLGSGKKPVGTTAYMGRVQQLMESRSDVQKAEDWLNPNAVLGAFEARAARKSVACAKNLSKFSNPEEGFQELSNDLVEAARAHCQLIVVSKFIEKLQQDIPGKGVKQQLQILCSIYALFHLHKHLGDFLSTGCITPKQGSLANDQLRSLYSQVRPNAIALVDAFNYTDHYLSSILGCYDGNVYPKLYEAAWKDPLNDSVVPDGFQEYIRPMLKQQLRNARL

SEQ ID NO: 23469 - protein, 664 aa, Tropaeolum majus
MDGVDYLADERSKSEFDVEEMKIVWAGSRHVFEVSDRMARLVASDPIFRKDNRVDLGRKELFKNTMRKAAHAWKRIIELRLSEEEASKLRHFVDQPAYTDLHWGMFVPAIKGQGTDEQQRKWLPLAYKMQIIGCYAQTELGHGSNVQGLETTATFDPETDEFVIHSPTLTSSKWWPGGLGKVSTHAVVYARLVLDGKENGVHGFIVQLRSLDDHSPLPGITVGDIGMKFGNGAYNSMDNGVLRFDHVRIPRDQMLMRVSQVTRQGKYQQSDVPRQLVYGTMVYVRKTIVVDASNALSRAVCIATRYSAVRRQFGSKNGGAETQVIDYKTQQSRLFPLLASAYAFRFVGEWLSWLYTDVTQRLQANDFSTLPEAHACTAGLKSLTTSATADGIEECRKLCGGHGYLCSSGLPELFAVYVPACTYEGDNVVLQLQVARFLMKTVAQLGSGRKPVGTTAYMGRAEHLLQCPCDVQNAEDWLKPKIVVEAFEARAIRMSVACAKKLSKFANQEDGFLELSADLVEAAIAHCQLIVVSKFIEKLQQDIPGKGVKRQLEVLCYVYALYTLHKHQGDFLATSSITPKQSSLANEQLRSLYSQVRPNAITLVDAFNYTDHFLGSILGRYDGNVYPKLYEQAWKEPLNDSDVPDGYQEYVRPLLKQQLRSARL

SEQ ID NO: 23470 - protein, 664 aa, Medicago truncatula
MEGVDHLAFERNKAEFDVNEMKIVWAGSRQEFELSDRISRLVASDPAFRKDNRTSLDRKELFKNTLRKTAYAWKRIIELRLNEQEASKLRSFVDEPAFTDLHWGMFVPAIKGQGTDEQQEKWLPLAYKMQIIGCYAQTELGHGSNVQGLETTATFDPKTDEFIIHSPTLTSSKWWPGGLGKISTHAIVYARLITEGQDQGVHGFIVQLRSLDDHLPLPGITVGDIGMKFGNAAYNTMDNGVLRFDHVRIPRNQMLMRVSQVTREGKYVQSNVPRQLIYGTMVYVRQAIVADASTALSRAVCIATRYSAVRRQFGSQKGGPETQVIDYKTQQARLFPLLASAYAFRFVSEWLKWLYTDVTQRLQANDFSTLPEAHACTAGLKSLTTSATADGIEECRKLCGGHGYLCSSGLPELFAVYVPACTYEGDNTVLLLQVARYLVKTISQLGSGKKPVGTTAYLGRVEQLMQYQSDVKRAEDWLKPNVVIEAFEARAARMSVAVAQNISKFSNPEEGFQELSVDLVEAAAAHCQLIVVSKFIEKLQQNIPGKGVKQQLEVLCSIYALFLLHKHLGDFLSTGSITEEQGSLANEQLRSLYSQVRPNAITLVDAFNYTDHLLGSVLGRYDGNVYPKLYEEAWKDPLNDSVVPDGFKEFVQPMLRQQLHNARL

SEQ ID NO: 23471 - protein, 664 aa, Cicer arietinum
MEGEDHLAFERNKAQFDVDAMKIVWAGSSHAFEVTDRMSRLVASDPAFRKDNRPMLGRKELFKSTLKKAAYAWKRIIELRLTEEEAGKLRSFVDEPAFTDLHWGMFIPAIKGQGTEEQQQKWLPLAHKMQIIGCYAQTELGHGSNVQGLETTATFDPKTDEFVIHSPTLTSSKWWPGGLGKVSTHAVVYARLITDGKDHGVHGFIVQLRSLDDHLPLPGITIGDIGMKFGNGAYNTMDNGVLRFEHVRIPRNQMLMRVSQITREGKYVQSNVPRQLVYGTMVYVRQTIVSDASTALSRAVCIATRYSAVRRQFGANNGGLETQVIDYKTQQARLFPLLASAYAFRFVGEWLKWLYTDVMKRLQANDFSTLPEAHACTAGLKSLTTSATADGIEECRKLCGGHGYLCSSGLPELFAVYVPTCTYEGDNIVLLLQVARHLVKIVSKLGSGKKPVGTAAYMGRVEQLMEFRSDVQKAEDWLNPNAVLAAFEARAARKSVACAKNLSKFTNPEEGFQELSADLAEAAVAHCQLIVVSKFIEKLQQDIPGKGVKQQLEILCSIYALFHLHKHLGDFLSTGCITPKQGSLANDQLRSLYSQVRPNAIALVDSFNYTDHYLSSVLGRYDGNVYPKLYEEAWKDPLNDSVVPDGFEEYVRPMLKQQLRNARL

SEQ ID NO: 23472 - protein, 664 aa, Phaseolus vulgaris
MDGVDHLAFERNKAQFDVEEMKIVWAGSREDFELSDRISRLVASDPVFRKDDRTVLDRKELFKNTLRKAAHAWKRVIELRLSEQEAYKLRSFVDQPAFTDLHWGMFVPAIKGSGTDEQQQKWLPLAYRMQIIGCYAQTELGHGSNVQGLETTATFDPKTDEFVIHSPTLTSSKWWPGGLGKVSTHAVVYARLIIDGQDYGVHGFIVQLRSLDNHLPLPGITVGDIGMKFGNAAYNTMDNGVLTFDHVRIPRSQMLMRVSQVTREGKYVHSNVPKQLVYGTMVNVRQKIVADASVALSRAVCIATRYSAVRRQFGSHNGGLETQVIDYKTQQSRLFPLLASAYAFRFVGEWLLWLYTDVTERLKANDFSTLPEAHACTAGLKSLTTTATADGIEECRKLCGGHGYLCSSGLPELFAVYVPACTYEGDNIVLLLQVSRHLMKTVSQLGTGNKPVGTTAYMARMEQLMQYHSDVKKAEDWLKPNVVLEAFEARAARMCVACAQNLSKFSNPEEGFQELAADLVEAAVAHCQLIVVSKFIEKLQQDIPGKGVKEILEVLCSVYALFLLHKHLGDFISTGCIDPKQGSLASEQLRNLYSQVRPNAVALVDAYNYTDHYLGSILGRYDGNVYPKLYEEAWKDPLNDSVVPDGFKEYVQPMLKQQLRNARL

SEQ ID NO: 23473 - protein, 665 aa, Glycine max
MEDSIDHLAFERNKAQFDVDEMKIVWAGSRQDFELSDRISRLVASDPAFRKDDRTTLGRKELFKNTLRKAAYAWKRINELRLNEQEAYKLRSFVDQPAFTDLHWGMFVPAIQGQGTDEQQQKWLPLAYRMQIIGCYAQTELGHGSNVQGLETTATFDPKTDEFVIHNPTLTSSKWWPGGLGKISTHAVVYARLIIGGEDHGVHGFIVQLRSLDDHLPLSGITIGDIGMKFGNAAYNTMDNGVLRFDHVRIPRNQMLMRVSQVTREGKYVHSNVPRQLVYGTMVNVRQKIVADASVALSRAVCIATRYSAVRRQFGSHNGGLETQVIDYKTQQARLFPLLASAYAFRFVGEWLKWLYMDVTKRLQANDFSTLPEAHACTAGLKSLTTTATADGIEECRKLCGGHGYLCSSGLPELFAVYVPACTYEGDNIVLLLQVARYLMKTVSQLGSGNKPVGTTAYMARVEQLMQYHSDVKKAEDWLKPNVVLEAFEARAARMSVACAQNLSKFTNPEEGFQELAADLVDAAVAHCQLIVVSKFIEKLQQDIPGKGVKKQLEVLCSIYALFLLHKHLGDFLSTGCINPKQGSLASEQLRNLYSQVRPNAIALVDAFNYTDHYLGSILGRYDGNVYPKLYEEAWKDPLNDSVVPDGFKEYIQPMLKQQLRNARL

SEQ ID NO: 23474 - protein, 664 aa, Trifolium pratense
MEGVDHLAFERNKAEFDVDAMKIVWAGSSHAFEVSDRMSRLVASDPAFRKDHRPMLGRKELFKSTLKKAAYAWKRIIELRLSEEEASMLRSFVDEPAFTDLHWGMFIPAIKGQGTDEQQQKWLPLAQKMQIIGCYAQTELGHGSNVQGLETTATFDPKTDEFVIHSPTLTSSKWWPGGLGKVSTHAVVYARLITDGKDHGVHGFIVQLRSLDDHLPLPGITVGDIGMKFGNGAYNTMDNGVLRFEHVRIPRDQMLMRVSRITREGKYVQSNVPRQLVYGTMVYVRQTIVSDASTAMSRAVCIATRYSAVRRQFGASNGGLESQVIDYKTQQARLFPLLASAYAFRFVGEWLKWLYTDGMKRLQANDFSTLREAHACTAGLKSLTTSATADGIQECRKLCGGHGDVCGGGRRELFAVYVPTCTYEGDNIVLLLQVARYLMKIISQLGSGKKPVGTTAYMGRVQQLMESRSDVQKAEDWLNPNAVLGAFEARAARKSVACAKNLSKFSNPEEGFQELSNDLVEAARAHCQLIVVSKFIEKLQQDIPGKGVKQQLQILCSIYALFHLHKHLGDFLSTGCITPKQGSLANDQLRSLYSQVRPNAIALVDAFNYTDHYLSSILGCYDGNVYPKLYEAAWKDPLNDSVVPDGFQEYIRPMLKQQLRNARL

SEQ ID NO: 23475 - protein, 663 aa, Trigonella foenum-graecum
MEGEDHLAFERNKAEFDVDSMKIVWAGSAHALEVSDRMSRLVASDPAFRKDHRPMLGRKDLFKSTLKKAAYAWKRIIELRLTEEEASMLRSFVDEPAFTDLHWGMFIPAIKGQGTEEQQQKWLPLAQRMQIIGCYAQTELGHGSNVQGLETTATFDTKTDEFIIHSPTLTSSKWWPGGLGKVSTHAVVYARLITDGRDHGVHGFIVQLRSLDDHLPLPGITVGDIGMKFGNGAYNTMDNGVLRFEHVRIPRNQMLMRVSQVTKEGKYVQSNVPRQLVYGTMVYVRQTIVSDASTALSRAVCIAARYSAVRRQFGGNNGLESQVLDYKTQQARLFPLLASAYAFRFVGEWLKWLYTDVMKRLQANDFSTLPEAHACTAGLKSLTTSATSDGIEECRKLCGGHGYLCSSGLPELFAVYVPTCTYEGDNIVLLLQVARHLMKVISQLGSGKKPVGTTAYMGRVEQLMESRSDVQKAEDWLNPNAVLRAFEARAARMSVACAKNLSKFSNTEEGFQELLADLVDAARAHCQLIVVSKFIEKLQQDIPGKGVKQQLEILCSIYALFHLHKHLGDFLSTGCITPKQGSLANDQLRSLYSQVRPNAIALVDAFNYTDHYLGSVLGRYDGNVYPKLYEEAWKDPLNDSVVPDGFQEYIRPMLKQQLRNARL

SEQ ID NO: 23476 - protein, 664 aa, Medicago truncatula
MEGEDHLAFERNKAEFDVDAMKIVWAGSAHALEVSDRMSRLVASDPAFRKDHRPMLGRKELFKSTLKKAAYAWKRIIELRLTEEEASMLRSFVDEPAFTDLHWGMFIPAIKGQGTEEQQQKWLPLAQRMQIIGCYAQTELGHGSNVQGLETTATFDPKTDEFVIHSPTLTSSKWWPGGLGKVSTHAVVYARLITDGRDHGVHGFIVQLRSLDDHLPLPGITVGDIGMKFGNGAYNTMDNGVLRFEHVRIPRDQMLMRVSQVTREGKYVQSNVPRQLVYGTMVYVRQTIVSDASTAMSRAVCIAARYSAVRRQFGGNNGSLESQVIDYKTQQARLFPLLASAYAFRFVGEWLKWLYTDVMKRLQANDFSTLPEAHACTAGLKSLTTSATSDGIEECRKLCGGHGYLCSSGLPELFAVYVPTCTYEGDNIVLLLQVARHLMKVISRLGSGKKPVGTTAYMGRVEQLLEARSDVQKAEDWLNPNTVLRAFEARAARMSVACAKNLTKFSNPEEGFQELLADLVDAARAHCQLIVVSKFIEKLQQDIPGKGVKRQLEILCNIYALFHLHKHLGDFLSTGCITPKQGSLANDQLRSLYSQVRPNAIALVDAFNYTDHYLSSVLGRYDGNVYPKLYEEAWKDPLNDSVVPDGFQEYIRPMLKQQLRNARL

SEQ ID NO: 23477 - protein, 665 aa, Glycine max
MEDGVDHLAFERNKAQFDVEDMKIIWAGSRQDFELSDRISRLVASDPAFRKDDRTTLDRKELFKNTLRKAAYAWKRINELRLNEQEAYKLRSFVDQPAFTDLHWGMFVPAIQGQGTDEQQQKWLPLAYRMQIIGCYAQTELGHGSNVQGLETTATFDPKTDEFVIHSPTLTSSKWWPGGLGKISTHAVAYARLIIGGEDHGVHGFIVQLRSLDDHLPLPGITIGDIGMKFGNAAYNTMDNGVLRFDHVRIPRNQMLMRVSQVTREGKYVSSNVPRQLVYGTMVNVRQKIVADASVALSRAVCIATRYSAVRRQFGSHNGGLETQVIDYKTQQARLFPLLASAYAFRFVGGWLKWLYMDVTERLQANDFSTLPEAHACTAGLKSLTTTATADGIEECRKLCGGHGYLCSSGLPELFAVYVPACTYEGDNVVLLLQVARHLMKTVSQLGSGNKPVGTTAYMARVEQLMQYHSDVEKAEDWLKPNVVLEAFEARASRMSVACAQNLSKFANPEEGFQELAADLVDAAVAHCQLIVVSKFIEKLQQDIPGKGVKKQLEVLCSIYALFLLHKHLGDFLSTGCINPKQGSLASEQLRNLYSQVRPNAIALVDAFNYTDHYLGSILGRYDGNVYPKLYEEAWKDPLNDSVVPDGFKEYIQPMLKQQLRNARL

SEQ ID NO: 23478 - protein, 665 aa, Lupinus angustifolius
MEGGVDHLAPERNKSEFDVDAMKIVWAGSSHVLEVSERMARLVASDPVFRKDNRSMLGRKELFKNTLRKATYAWKRIIELRLNEEEASMLRSFVDEPAFTDLHWGMFIPAIKGQGTEEQQRKWLPLAQKMQIIGCYAQTELGHGSNVQGLETTATFDPKTDEFVIHSPTLTSSKWWPGGLGKVSTHAIVYARLITDGHDHGVNGFIVQLRSLDDHLPLPGITVGDIGMKFGNGAYNTMDNGVLRFDNVRIPRDQMLMRVSQVTREGKLVQSNVPRQLVYGTMVYVRQTIVADASVALSRAVCIATRYSAVRRQFGSHNGGPETQVIDYKTQQARLFPLIASAYAFRFVGEWLKWLYMDVMQRLQASDFSTLPEAHACTAGLKSLTTSATADGIEECRKLCGGHGYLCSSGLPELFAVYVPTCTYEGDNVVLQLQVARHLMKTISQLGSGKKPIGTTAYIGRLEQLMQYRSDVQKAEDWLKPDVVLGAFEARAARKSVAVAQNLSKFSNPEEGFQELSADLAEAAVAHCQLIVVSKFIEKLQKDIPGKGVKQQLERLCSIYALFLLHKHLGDFLSTGCITPKQGYLANEQLRSLYSQVRPNAIALVDAFNYTDHYLGSVLGRYDGNVYQMLYDEAWKDPLNDSVVPDGYQEHIRPMLKQQLRNARL

SEQ ID NO: 23479 - protein, 664 aa, Manihot esculenta
MDGVDHLAHERNKAQFDVDEMKIVWAGSRHAFHVSDRMARLVASDPVFRKDNRAMLSRKELFKNTLKKAAHAWKRIIELRLSEEEAGKLRFYVDEPAFTDLHWGMFVPAIKGQGTDEQQQKWLPLAYKMQIIGCYAQTELGHGSNVQGLETTATFDPETDEFIIHSPTLTSSKWWPGGLGKISTHAVVYARLITDGQEHGVHGFIVQLRSLDDHMPLPGITVGDIGMKFGSGAYNTMDNGVLRFDHVRIPRNQMLMRVMQVTREGKCVQSNVPRQLIYGTMVFVRQTIVADASSALSRAVCIATRYSAVRRQFGSQDGGIETQVIDYKTQQNRLFPLLASAYAFRFVGEWLKWLYTDVTQRLQANDFSTLPEAHACTAGLKSLTTSATADAIEECRKLCGGHGYLSSSGLPELFAVYVPACTYEGDNVVLLLQVARFLMKTVSQLGSGKRPIGTTAYMAQAEDLLQCRCRVQKAEDWLKPSILLEAFEARAVRICVARAESLSKFPNPEEGFAELSADLVEAAIAHCQLIVVSKFIEKLQQDIPGKGVKQQLQILCNIYALNLLHKHLGDFLSTGCITPEQASLANDQLRSLYSQIRPNAIALVDAFNYTDHYLGSVLGCYDGNVYPKLYEEAWKDPLNDSVVPDGFHEYVRPMLKQQLRNARL

SEQ ID NO: 23480 - protein, 665 aa, Glycine max
MEGMVDHLAFERNNSQFDVDEMKIVWAGSRHAFEVSDKMARLVASDPAFRKDDRVVLDRKALFKNTLRKAAYAWKRIIELRLSEEEAAMLRSFVDQPAFTDLHWGMFVPAIKGQGTEEQQKKWLPLAHKMQIIGCYAQTELGHGSNVQGLETTATFDPRTDEFVIHSPTLTSSKWWPGGLGKVSTHAVVYARLITDGQDHGVHGFIVQLRSLDDHLPLPGITVGDIGMKFGNGAYNSMDNGMLRFDHVRIPRNQMLMRVSQVTREGKYVQSSVPRQLVYGTMVYVRQTIVSDASVALSRAVCIATRYSAVRRQFGSKEGGLETQVIDYKTQQARLFPLLASAYAFRFVGEWLKWLYMDVMKRLQASDFSTLPEAHACTAGLKSLTTSATADGIEECRKLCGGHGYLCSSGLPELFAVYIPTCTYEGDNTVLLLQVARHLIKTISQLGSRNKPVGTTSYIGRVEQLMQYRSDVQKVEDWLKPNAVLGAFEARAAKKVVACAQNLSKFTNPEEGFQELSVDLVEAAVAHCQLIVVSKFIEKLQQDIPGKGVKQQLELLCSIYALFLLHKHLGDFLATGCITPKQGSLANELLRSLYSQVRPNAIALVDAFNYTDHYLGSVLGRYDGDVYPKLYEEAWKDPLNDSVVPDGFQEYIRPMLKQQLRNARL

SEQ ID NO: 23481 - protein, 664 aa, Manihot esculenta
MEGVDYLAHERNKAQFDVDEMKIVWAGSRHAFDVSDRMARLVASDPVFQKDNRAMLSRKVLFKNTLRKAAHAWKRIIELRLSEEEANQLRSYVDEPAFTDLHWGMFVPAIKGQGTEDQQQKWLPLAHKMQIIGCYAQTELGHGSNVQGLETTATFDPATDEFVIHSPTLTSSKWWPGGLGKVSTHAVVYARLITGGQEHGVHGFIVQLRSLDDHMPLPGITVGDIGMKFGSGAYNTMDNGVLRFDHVRIPRNQMLMRVMQVTREGKCVQSNVPRQLIYGTMVYVRQTIVSDASSALSRAVCIATRYSAVRRQFGSQDGGIETQVIDYKTQQSRLFPLLASAYAFRFVGEWLKWLYLDVTQRLQASDFSTLPEAHACTAGLKSLTTSATADAIEECRKLCGGHGYLTSSGLPELFAVYVPACTYEGDNVVLLLQVARFLMKTVSQLGSGKKPVGTTAYMARAEDLLQCHCIVQRAEDWSKPSVILEAFEARAFRMCVARAQSLSKFPNPEEGFAELSADLAEAAIAHCQLIVVSKFIEKLEQDIPGKGVKQQLEILCNIYALNLLHKHLGDFLSTGCITPKQASLANDHLRSLYSQVRPNAIALVDAFNYTDHYLGSVLGRYDGNVYQKLYEAAWKDPLNDSVVPDGYQEYIRPMLKQQLRNARL

SEQ ID NO: 23482 - protein, 664 aa, Cicer arietinum
MAGVDHLDFERNKAQFDVADMKIVWAGSRQEFELSDRISRLVASDPEFRKDNRTSLDRKELFKNTLRKTAHAWKRINELGLNEQEATKFRSFVDEPAFTDLHWGMFVPAIKGQGTDEQQEKWLPLAYKMQIIGCYAQTELGHGSNVQGLETTATFDPKTDEFIIHSPTLTSSKWWPGGLGKISTHAVVYARLITDGQYHGVHGFIVQLRSLNDHLPLPGITVGDIGMKFGNAAYNSMDNGVLRFDNVRIPRNQMLMRVSQVTREGKFVQSNVPRQLVYGTMVFVRQAIVADASTALSRAVCIATRYSAVRRQFGSHNGGLETQVIDYKTQQARLFPLLASAYAFRFVGEWLKWLYTDVTQRLQANDFSTLPEAHACTAGLKSLTTSATADGIEECRKLCGGHGYLCSSGLPELFAVYVPACTYEGDNTVMLLQVARFLMKTISQLASGNKPVGTTAYLGRVEQLIQYRSDVKTAEDWLKPNVVIGAFEARAARMSVAVAQNLSKFANPEEGFQELSADLVEAAAAHCQLIVVSKFIEKLQQDIPGKGVKQQLEVLCSIYALYLLHKHLGDFLSTGCINQKQGSLANDLLRSLYSQVRPNAIALVDAFNYTDHLLGSVLGRYDGNVYPKLYEEAWKDPLNDSVVPDGFKEYVQPILRQQIRNARL

SEQ ID NO: 23483 - protein, 664 aa, Aquilegia formosa
MEVIDQLAPERSKSQFDVDAMKIVWAGSQHAFDISDRMARLVASDPAFRKDYRVTLGRKELFKNTLRKAAHAWKRIIELRLTEEEASKLRTFVDEPAFTDLHWGMFVPAIKGQGTEEQQQKWLPLAYKMQIIGCYAQTELGHGSNVQGLETTATFDPATDEFVIHSPTLTSSKWWPGGLGKVSTHAVVYARLITDGKDYGVHGFIVQLRSLDDHSALPGITVGDIGMKFGNGAYNTMDNGVLHFDHVRIPREQMLMRVSQVTREGKFKQSDVPRQLLYGTMVYVRQTIVADASSALSRAVCIATRYSCVRRQFGSQDGGPETQVIDYKTQQSRLFPLLATAYAYRFVGEWLNWLYTDVTQRLQANDFSTLPEAHACTAGLKSLTTSFTADGIEECRKLCGGHGYLCSSGLPELFAVYVPACTYEGDNTVLLLQVARFLMKTVSQLGSDKKPVGTTSYMGRIEHLMQCRCDVQRAEDWSKPGVILEVFEARAARMNVACAQNVSKMPNPEEGFSELSSDLVEAAVAHCQLIVVSKFMEKLQQDIAGKGVKEQLQLLCSIYALSLVHKHQGDFLSTGTITAKQASLVNAQLRSFNAQLRPNAVALVDAFNYTDHYLGSVLGRYDGNVYPKLYEEAWKDPLNDSVVPDGYHEYIYPMLKQQLRTARL

SEQ ID NO: 23484 - protein, 664 aa, Papaver somniferum
MEELDYLANERQSAEFDVEAMKIVWAGSQQSFEISDRMSRLVASDPAFRKDNRTMLPRKELFKNTLRKAAHAWKRIIELCLSEAEAAKLRFFVDEPAFTDLHWGMFVPAIKGQGTQEQQDKWLPLAYRMQIIGCYAQTELGHGSNVQGLETTATFDSETDEFVLHSPTLTSSKWWPGGLGKVSTHAVVYARLLINGKDYGVNGFIVQLRSLDDHLPLPGITVGDIGMKFGSGAYNTMDNGVLQFDHVRIPRTQMLMRVSQVTREGKYVQSDVPRQLVYGTMVYVRQTIVADASCALSRAVCIATRYSAVRRQFGSQDGGPETQVIDYKTQQSRLFPLLATAFAYRFVGEWLSWLYTDVTQRLQANDFSTLPEAHACTAGLKSLTTSTTADAIEECRKLCGGHGYLSSSGLPELFAVYIPACTYEGDNTVLLLQVARFLMKTVSQLGSNKKPVGTTAYMGRIEHLMQCQCNAQRAEDWLKPSVVIEAFEARAARMSVACAKNISKMPSPEAGFAELSPDLAEAAVAHCQLIVVSKFIEKLQQDIAGKGVKEQLEVLCSIYALSLLHKHQGDFLSTGSITPKQASLANDQLRSLYAQARPNAVALVDSFNYTDHFLGSVLGRYDGNVYPKLYEEAWKDPLNDTVVPDGYHEYIRPLLKNQLRTARL

SEQ ID NO: 23485 - protein, 664 aa, Theobroma cacao
MEALDYHAGERSKAEFDVEEMKIVWAGSRHAYEISDRIARLVASDPVFRKDNRTMLSRKDLFKDTLKKAAHAWKRIIELRLSEEEASRMRFFVDQPAFTDLHWGMFIPAIKGQGTEEQQQKWLPVAYKMQIIGCYAQTELGHGSNVQGLETTATFDPQTDEFVIHSPTLTSSKWWPGGLGKASTHAVVYARLITDGQDHGVHGFIVQLRSLDDHLPLPGITVGDIGMKFGSGAYNSMDNGVLRFDHVRIPRDQMLMRVSQVTREGKYMHSDVPRQLVYGTMVYVRQQIVLDASCALSRAVCIATRYSAVRRQFGSQNGGPETQVINYKTQQSRLFPLLASAYAFRFVGEWLNWLYTDVTQRLQANDFSTLSEAHACTAGLKSLTTTATADAIEECRKLCGGHGYLSSSGLPELFAVYVPACTYEGDNIVLLLQVARFLMKTVAQLGSEKKPVGTTAYMGRAEYLMQCHCDVQRAEDWLKPSVIVEAFEARAARMSVACAKSLSKFSNPEEGFAELSADLVEAAVAHCQLIVVSKFIEKLQRDIPGKGVKRQMEILCNVYALSILHKHLGDFVSTGCITPKQGALANEQLRLLYTQVRPNAIALVDAFNYTDHYLSSVLGRYDGNVYAKLYEEAWKDPLNDTVVPDGYHEYIRPILKQQLRTARL

SEQ ID NO: 23486 - protein, 665 aa, Cajanus cajan
MEDGVDHLAFERSKAQFDVDEMKIVWAGSRQEFELSDRISRLVASDPAFRKDDRITLDRKELFKNTLRKAAYAWKRITELRLNEQEAYKLRSFVDQPAFTDLHWGMFVPAIQGQGTEEQQQKWLPLAYKMQIIGCYAQTELGHGSNVQGLETTATFDPKTDEFIIHSPTLTSSKWWPGGLGKISTHGVVYARLIIDGQDHGVHGFIVQLRSLDDHYPLPGITIGDIGMKFGNGAYNTMDNGLLRFDHVRIPRNQMLMRVSQVTREGKFVHSDVPRQLVYGTMVNVRQKIVSDASVALSRAVCIATRYSAVRRQFGSHNGGLETQVIDYKTQQARLFPLLASAYAFRFAGEWLKWLYRDVTERLQANDFSTLPEAHACTAGLKSLTTTATADAIEECRKLCGGHGYLCSSGLPELFAVYVPACTYEGDNTVLLLQVARHLMKTISQLGSGRKPVGTTAYMGRLDQLTQYHSDVKKAEDWLKPNVVLEAFEARAARMSVACAQNLSKFANPEEGFQELLADLAEAAVAHCQLIVVSKFIEKLQQDIPGKGVRQQLEVLCSIYALSLLHKHLGDFLSTGCINPKQGSLASEQLRYLYSQVRPNAIALVDAFNYTDHYLGSILGRYDGNVYPKLYEEAWKDPLNDSVVPDGFKEYVQPMLKQQLRNARL

SEQ ID NO: 23487 - protein, 664 aa, Ricinus communis
MEGVDHLAEERNKAQFDVDEMKIVWAGSRHAFDVADRMARLVASDPAFRKDNRAMLSRKELFKNTLRKAAHAWKRIIELRLSEEEASKLRTFVDEPAYTDLHWGMFVPAIKGQGTEEQQKKWLPLAHKMQIIGCYAQTELGHGSNVQGLETTATFDLETDEFVIHSPTLTSSKWWPGGLGKVSTHAVVYARLITEGREHGVHGFIVQLRSLDDHMPLPGITVGDIGMKFGSGAYNTMDNGVLRFDHVRIPRNQMLMRVMQVTREGKCVQSKVPRQLIYGTMVYVRQTIVADASAALSRAVCIATRYSAVRRQFGSNDGGVETQVIDYKTQQSRLFPLLASAYAFRFVGEWLKWLYTDVTQRLQANDFSTLPEAHACTAGLKSLTTSFTADAIEECRKLCGGHGYLTASGLPELFAVYVPACTYEGDNVVLLLQVARFLMKTVSQLGSGKKPVGTTAYMARVEHLLQCRCGAQKAEDWLKPNVILEAFEARAARMCVTRAQSLSHYPNPEEGFAELSADLVEAAVAHCQLIVVSKFIEKLQQEIPGKGVKQQLQILCYMYALNLLHKHQGDFLSTGCITPKQASLANDQLRSLYSQVRPNAIALVDAFNYTDHYLGSVLGCYDGNVYPKLYEEAWKDPLNDSVIPDGYNEYVRPMLKQQLRNARL

SEQ ID NO: 23488 - protein, 664 aa, Populus trichocarpa
MKGVDHLAHERNKTEFDVDAMKIVWAGSRHAFELSDRMARLVASDPAFQKDGRTRLGRKELFKNTLRKAAHAWKRILELRLTEEEAGWLRSFVDEPSFTDLHWGMFIPAIKGQGTDEQQQKWLPLAYKMQIIGCYAQTELGHGSNVQGLETTATFDPETDEFVIHSPTLTSSKWWPGGLGKVSTHAIVYARLITNGQEHGVHGFIVQLRSLDDHMPIPGITIGDIGMKFGNGAYNTMDNGVLTFDHIRIPRNQMLMRVLQVTREGKCVQSNVPRQLIYGTMVFVRQTIVADASTALSRAVCIATRYSAVRRQFGSQDGGMETQVIDYKTQQSRLFPLLASAYAFRFVGEWLKWLYTDVTQRLQANDFSILPEAHACTAGLKSLTTTATADAIEECRKLCGGHGYLCASGLPELFAVYVPACTYEGDNVVLLLQVARFLMKTVSQLGSGKKPVGTTAYLGRVQDLLQCCCDVQTAEDWLKPSVVLEAFEARSARMCVARAQNLSKFENPEDGFAELSADLVEASVAHCQLIVVSKFIDKLQQDIPGKGVNRQLQNLCYIYALNLLHKYLGDFLSTGCITPKQASLANDQLRSLYSQIRPNAIALVDAFNYTDHYLGSVLGRYDGNVYPKLYEEAWKDPLNDSVVPDGYHEYVHPMLKQQLRNARL

SEQ ID NO: 23489 - protein, 664 aa, Trifolium pratense
MEGVDHLAFERKKAQFDVNDMKIVWAGSRQEFELSDRISRLVASDPVFQKDNRTALDRKELFKNTLRKAAHAWKRIIELRLNEQEASKLRSFVDQPAFTDLHWGMFVPAIKGQGTDEQQEKWLPLANNMQIIGCYAQTELGHGSNVQGLETTATFDPKTDEFIIHSPTLTSSKWWPGGLGKISTHAIVYARLITDGQDHGVHGFIVQLRSLDDHLPLPGITVGDIGMKFGNAAYNSMDNGVLRFDHVRIPRNQMLMRVSQVTREGKFVHSGVPRQLIYGTMVYVRQAIVADASIALSRAVCIATRYSAVRRQFGSQKGGPETQVIDYKTQQARLFPLLASAYAFRFVSEWLKWLYTDVTQKLQANDFSTLPEAHACTAGLKSLTTSATADGIEECRKLCGGHGYLCSSGLPELFAVYVPACTYEGDNTVLLLQVARYLIKTITQLGSGNKPVGTTAYFARVEQLMQYQSDVKRAEDWLKPNVVIEAFEARAARMSVAVAQNLSKFTDPEEGFQELSADLVEAAAAHCQLIVVSKFIEKLQQDIPGNGVKQQLEVLCSVYALFLLHNHLGDFLSTGCITQKQGSLANEQLRSLYSQVRPNAIALVDAFNYTDHLLGSVLGRYDGNVYPKLYEEAWKDPLNDSVVPDGFKDHVQPILRQQLHNARL

SEQ ID NO: 23490 - protein, 664 aa, Eutrema halophilum
MEGVDHLADERNKAEFDVDEMKIVWAGSRHAFEVSDRISRLVASDPVFEKSDRARLSRKELFKSTLKKCAHAWKRIIELRLTEEEAGRLRFFVDQPAFVDLHWGMFVPAIKGQGTEEQQQKWLSLANKMQIIGCYAQTELGHGSNVQGLETTATFDPKTDEFVIHSPTQTSSKWWPGGLGKVSTHAVVYARLITDGKDYGVHGFIVQLRSLEDHSPLPNIIVGDIGTKMGNGAYNSMDNGFLMFDQVRIPRDQMLMRLAKVTREGKYVPSDVPKQLMYGTMVFVRQTIVADASNALSRAVCIATRYSAVRRQFGARNGGIETQVIDYKTQQNRLFPLLASAYAFRFVGEWLKWLYTDVTERLQASDFATLPEAHACTAGLKSLTTTATADGIEECRKLCGGHGYLWCSGLPELFAVYVPACTYEGDNVVLQLQVARFLMKTVSQLGSGKAPVGTTAYMARAEHLLQCRSGVQKAEDWLNPGAVLEAFEARALRMAVTCAKNLSKFENQEQGFSELLAELVEAAIAHCQLIVVSKFIAKLEQDIGGKGVKKQLNNLCYIYALYILHKHLGDFLSTNSITPKQASLANDQLRSLYSQVRPNAVALVDAFNYTDHYLNSVLGRYDGNVYPKLFEEAWKDPLNDSVVPDGYHEYIRPLLKQQLRTARL

SEQ ID NO: 23491 - protein, 664 aa, Trifolium pratense
MEGVDHLAFERNKAQFDVNDMKIVWAGSRQEFELSDRISRLVASDPVFQKDNRTALDRKELFKNTLRKAAHAWKRVIELRLNEQEASKLRSFVDQPAFTDLHWGMFVPAIKGQGTDEQQEKWLPLANNMQIIGCYAQTELGHGSNVQGLETTATFDPKTDEFIIHSPTLTSSKWWPGGLGKISTHAIVYARLITDGQDHGVHGFIVQLRSLDDHLPLPGITVGDIGMKFGNAAYNSMDNGVLRFDHVRIPRNQMLMRVSQVTREGKFVHSGVPRQLIYGTMVYVRQAIVADASIALSRAVCIATRYSAVRRQFGSQKGGPETQVIDYKTQQARLFPLLASAYAFRFVSEWLKWLYTDVTQKLQANDFSTLPEAHACTAGLKSLTTSATANGIEECRKLCGGHGYLCSSGLPELFAVYVPACTYEGDNTVLLLQVARYLIKTISQLGSGNKPVGTTAYLARVEQLIQYQSDVKRAEDWLKPNVVIEAFEARAARMSVAVAQNLSKFTDPEEGFQELSADLVEAAAAHCQLIVVSKFIEKLQQDIPGNGVKQQLEVLCSVYALFLLHNHLGDFLSTGCITQKQGSLANEQLRSLYSQVRPNAIALVDAFNYTDHLLGSVLGRYDGNVYPKLYEEAWKDPLNDSVVPDGFKEHVQPILRQQLRNARL

SEQ ID NO: 23492 - protein, 665 aa, Phaseolus vulgaris
MEGVVDHLAFERNKTQFDVEEMKIIWAGSRHALEVSDKMARLVASDPAFRKDDRPRLGRKELFKNTLKKTVYAWKRIIELRLSEEEASKLRSFVDQPAFTDLHWGMFIPAIKGQGTEEQQQKWLPLAQKMQIIGCYAQTELGHGSNVQGLETTATFDPKTDEFVIHSPTLTSSKWWPGGLGKVSTHAIVYARLITDGQDHGVHGFIVQLRSLDDHLPLPGITVGDIGMKFGNGAYNSMDNGVLRFDHVRIPRNQMLMRVSQVTREGKYAQSSVPRQLVYGTMVYVRQTIVSDASLAMSRAVCIATRYSAVRRQFGSKQGSLETQVIDYKTQQARLFPLLASAYAFRFVGEWLKWLYMDVMKRLQANDFSTLPEAHACTAGLKSLTTSATADGIEECRKLCGGHGYLCSSGLPELFAVYIPTCTYEGDNIVLLLQVARHLIKSISQLRSGKKPVGTTSYIGRVEQLMLYRSDVQKEEDWLKPNAVLGAFEARAAKKSVACAQNLSKFTNPEEGFQELSVDLVEAAVAHCQLIVVSKFIEKLQKDIPGKGVKHQLELLCSIYALSLLHKHLGDFLSTGCITPTQGSLANDMLRSLYSQLRPNAIGLVDAFNYTDHYLGSVLGRYDGDVYPKLYEEAWKDPLNDSVVPDGFQEYIRPMLKQQLRNARL

SEQ ID NO: 23493 - protein, 665 aa, Cajanus cajan
MEGVVDHLAFERNKAQFDVEEMKIVWAGSRQALEISDKMARLVASDPVFKKDNRAMLDRKELFKNTLRKTAYAWKRIIELRLSEQEAAMLRFFVDQPAFTDLHWGMFVPAIKGQGTEEQQQKWLPLAYKMQIIGCYAQTELGHGSNVQGLETTARFDPKTDEFVIHSPTLTSSKWWPGGLGKVSTHGIVYARLITDGRDYGVHGFIVQLRSLDDHLPLPGITVGDIGMKFGNGAYNSMDNGVLRFDHVRIPRNQMLMRVSQVTREGKYVQSNVPRQLVYGTMVFVRQTIVSDASTAMSRAVCIATRYSAVRRQFGSNNGGIETQVIDYKTQQARLFSLLASAYAFRFVGEWLKWLYMDVMKRLQANDFSTLPEAHACTAGLKSLTTSATADGIEECRKLCGGHGYLCSSGLPELFAVYVPTCTYEGDNTVLLLQVARHLLKTISQLGSGKKPVGTTSYIGRVEQLMRYRSNVQKGEDWLNPNAVLGAFEARAAKKVVLCAQNLSRFTNPEEGFQELSVDLVEAAVAHCQLIVVSKFIEKLQQDIPGKGVKQQLEVLCSIYALSLLCKHLGEFLSTGSINPKQASLANDQLRSLYSQVRPNAVALVDAFNYTDHFLGSVLGRYDGDVYPKLYEEAWKDPLNDSVVPDGYQEYVRPMLKQQLRNARL

SEQ ID NO: 23494 - protein, 664 aa, Humulus lupulus
MEGVDHLAHERSKAQFDVDELKIVWAGSRHEFEVSDRIARLVASDPVFRKDNRTMLARKDLFKNTLRKAAHAWKRIIELRLTEEEAKKLRFFVDEPSFTDLHWGMFVPAIQGQGTDEQQDKWLPLAYKMQIIGCYAQTELGHGSNVQGLETTATFDPQADEFIINSPTLTSSKWWPGGLGKISTHAVVYARLITDGQDHGVHGFIVQLRSLDDHLPLPGITVGDIGMKFGSGAYNSMDNGVLRFDHVRIPRDQMLMRVSQVTREGKYVQSNVPRQLVYGTMVFVRKAIVLDASCALSRAVCIATRYSAVRRQFGSQNDGVETQVIDYKTQQNRLFPLLASAYAFRFVGEWLSWLYTDVTQRLQAKDFSTLPEAHACTAGLKSLTTSATADAIEECRKLCGGHGYLSSSGLPELFAVYVPACTYEGDNVVLHLQVARFLMKTVSQLVSGKKPIGTTFYLGRVEHLMQSQPKVQKAEDWLQPNVVVEVFEARATRMSVACAQNLNKFPNQEEGFSELSADLVEASVAHCQLIVVSKFIEKLQQDIPGKGVKEQLQSLCYIYALSLIHKHLGDFVVTGCITPKQASLANEQLRSLYSKVRPNAVALVDAFNYTDHFLSSVLGRYDGNVYQNLYDEAWKDPLNESVVPDGYQEYIRPLLKQQLRNARL

SEQ ID NO: 23495 - protein, 664 aa, Fragaria vesca
MEGVDHLAHERSKAQFDVDHMKVVWAGSRHTLEVSDRIARLVASDPVFKKDDRTRLSRKDLFKDTLRKAAHVWKRITELKLTEEEASKLRFYVDQPAYMDLHWGMFIPFIKGSGTEEQQKKWLPLAYKMQIIGCYAQTELGHGSNVQGLETTANFDPKTDEFVIHSPTLTSSKWWPGGLGKVSTHAVVFARLITDGQDHGVNGFIVQLRSLDDHLPLPGVTVGDIGMKFGSGAYNSMDNGVLRFDHVRIPRDHMLMRVSQVTREGKVVQSNVPRQLLYGTMVFVRQTIVADASSALSRAVCIATRYSAVRRQFGSNDGGVETQVIDYKTQQSRLFPLLASAYAFRFVGEWLKWLYTDVTQKLQANDFSTLPEAHACTAGLKSLTTSATADAIEECRKLCGGHGYLSSSGLPELFAVYIPACTYEGDNIVLLLQVARFLMKTVSQLPSGKKPIGTTSYMGRAEHLLQSCCNVQKAEDWLKPSVILEAFEARAMRMSVACAKDLSKFTNPEEGFAELSPNLVDAAVAHCQLIVVSKFIEKLQQDIPGKGVKEQLQILCNVYALFLVHKHLGDFLSTGSITAKQGSLANDQLRSLYSQVRPNAIALVDAFNYTDHYLSSILGRYDGNVYPKLYEEAWKDPLNDTVVPEGYHEYIQPLLKQQLRNSRL

SEQ ID NO: 23496 - protein, 665 aa, Lotus japonicus
MEGGVDHLAFERNKAQFDVDDMKIIWAGSRSEFELSDRISRLVASDPAFRKDDRTTLGRKDLFKNTLRKTAYAWKRILELRLNEKEAAKLRSFVDEPAFTDLHWGMFVPAIKGQGTDEQQQKWLPLAYKMQIIGCYAQTELGHGSNVQGLETTATFDPKTDEFVIHSPTLTSSKWWPGGLGKISTHAVVYARLITDGQEQGVHGFIVQLRSLDDHLPLPGITVGDIGMKFGSGAYNTMDNGVLRFDHVRIPRNQMLMRVSQVTREGKYVQSNVPRQLVYGTMVYVRQAIVSDASIALSRAVCIATRYSAVRRQFGSHNGGLESQVIDYKTQQARLFPLLASTYAFRFVSEWLSWLYTDVTQRLQAGDFSTLPEAHACTAGLKSLTTSIAADGIEECRKLCGGHGYLNSSGLPELFAVYVPACTYEGDNTVLLLQVARHLVKTISQLGSGNKPGGTTAYLARVEQLMQYHSDVKKAEDWLKPNVVVAAFEARAARMSVACAQNLSKFTNPEEGFQELTADLVEAATAHCQLIIVSKFIDKLQKDIPGKGVKQQLEVLCSIYALSLLHKHLGDFLSAGCINPLQGSLANEQLRSLYSQVRPNAIALVDAFNYTDHYLGSVLGRYDGNVYPKLYEEAWKDPLNDSVIPDGFHQYVQPILKQQLRNARL

SEQ ID NO: 23497 - protein, 664 aa, Brassica oleracea
MEGIDHLADERNKAEFDVDEMKIVWAGSRHAFEVSDRIARLVATDPVFEKSDRARLSRKELFKSTLKKCAHAWKRIIELRLTEEEAGRLRFFVDQPAFVDLHWGMFVPAIKGQGTEEQQEKWLSLANKMQIIGCYAQTELGHGSNVQGLETTATFDPKTDEFVIHSPTQTSSKWWPGGLGKVSTHAVVYARLITDGKDYGVHGFIVQLRSLEDHSPLPNIIVGDIGTKMGNGAYNSMDNGFLMFDQVRIPRDQMLMRLARVTREGKYVPSDVPKQLMYGTMVYVRQTIVADASNALSRAVCIATRYSAVRRQFGAQNGGIETQVIDYKTQQNRLFPLLASAYAFRFVGEWLKWLYTDVTARLQASDFSTLPEAHACTAGLKSLTTTATADGIEECRKLCGGHGYLWCSGLPELFAVYVPACTYEGDNIVLQLQVARFLMKTVSQLGSGKAPVGTTAYMARAQHLLQCRSGVQKAEDWLNPAVVVEAFEARALRMAVACAKNLSKFENQEQGFSELLAELVEAAIAHCQLIVVSKFIAKLEQDIGGKGVKKQLNNLCYIYALHILHKHLGDFLSTNSITPKQASLANDQLRSLYSQVRPNAVALVDAFNYTDHYLNSVLGRYDGNVYPKLFEEAWKDPLNDSVVPDGYQEYIRPLIKQQLRTARL

SEQ ID NO: 23498 - protein, 666 aa, Eucalyptus grandis
MEGVGVDHLADERQKARFDVEEMKVVWAGSSHAVEVSDRMARLVASDPAFRKDNRTMLSRKDLFKNTLRKAAYAWRRIMELRLTEEEASRLRFFIDEPAYTDLHWGMFIPAIKGQGTEEQQQKWLPLAYKMQIIGCYAQTELGHGSNVQGLETTATFDPQTDEFIVDSPTLTSSKWWPGGLGKVSTHAVAYARLIVKGQDHGVHGFIVQLRSLDDHMPLPGITVGDIGMKFGSGAYNSMDNGLLRFDHVRIPRDQMLKGVLQVTREGKVVQSNVPRQLIYGTMVYVRQTIVADASCALSRAVCIATRYSAVRRQFGSQNGGPETQVIDYKTQQSRLFPLLASAYAFRFVGEWLKWLYTDVTQRLQANDFSTLPEAHACTAGLKSLTTSATADAIEECRKLCGGHGYLSSSGLPELFAVYIPACTYEGDNTVLLLQVARFLMKTVSQLGSGKQPVGSTAYMSRAEHLMQCRCSAQRVEDWLKPNVVLEAFEARALRMSVACAQNLGKFSNPEEGFAELSADLVEAATAHCQLIVVSKFIEKLQQDIPGKGVKQQLQTLCSVYALHLLHKHQGDFLSTSCVTPKQVALANEQLRSLYSQVRPNAIALVDAFNYTDHYLGSVLGRYDGNVYPKLYEEAWKDPLNDSVVPDGYHEYIRPVLKQQLRNARL

SEQ ID NO: 23499 - protein, 665 aa, Euonymus alatus
MDGVVDHLAHERNKAQFDVEEMKIVWAGSRHVFEVSDRMARLVASDPAFKKDNRATLDRKALFKNTLRKATYAWKRILELRLTEEEASKLRYYIDESAFTDLHWGMFVPAIKGQATEEQQQKWLPLAYKMQIIGCYAQTELGHGSNVQGLETTATFDPQTDEFVIHSPTLTSSKWWPGGLGKVSTHAVVYARLITDGQEHGVHGFIVQLRSLDDHLPLPGITIGDIGMKFGNGAYNTMDNGVLRFDHVRIPRDQMLMRVMQVTRKGECVQSNVPRQLIYGTMVFVRQTIVSDASSALSRAVCIATRYSAVRRQFGSQNGGIETQVIDYKTQQNRLFPLLAAAYAFRFVAEWLKLLYTDVTQRLQANDYSTLPEAHACTAGLKSLTTSFTADAIEECRKLCGGHGYLCSSGLPELFAVYVPACTYEGDNVVMLLQVARFLMKTVSQLGSEKKPIGTTAYMGRVEHLMQCRSSVQKAEDWLNPNTILEAFEARAARMSVAVAQKLAQFANPEEGFLELSPNLVEASVAHCQLIVVSKFIEKLQQDIPGKGVKELLEMLCNIYALNLLHKHLGDFLSTGSITSKQGSLAYDQLRSLYSQVRPNAIALVDAFNYTDHYLSSVLGRYDGNVYPKLYEEAWKDPLNDSVVADGYHEYIRPMLKNQLRNARL

SEQ ID NO: 23500 - protein, 664 aa, Gossypium raimondii
MEALDYHAEERRKAEFDVEEMKIVWAGSRQAYEISDRVARLVASDPVFRKDNRTMLSRKDLFKDTLRKAAHAWKRIIELRLSEEEASKLRFFVDQPVFTDLHWGMFIPAIKGQGNEEQQQKWLPMAYKMQIIGCYAQTELGHGSNVQGLETTATFDPETDEFVIHSPTLTSSKWWPGGLGKVSTHALVYARLITDGQDHGVHGFIVQLRSLDDHLPLPGITVGDIGMKFGSGAYNSMDNGVLRFDHVRIPRDQMLMGVSQVTREGKFMQSDVPRQLVYGTMVYVRQKIVADASCALSRAVCIATRYSVVRRQFGSHNGGPETQVIDYKTQQSRLFPLLASAYAFRFVGEWLKWLYTDVTQRLQASDFSTLPEVHACTAGLKSVTTSATADAIEECRKLCGGHGYLSSSGLPELFAVYVPACTYEGDNVVLLLQVARFLMKTVSQLGSGKKPVGTIAYMGRSEHLLQCRCEVERAEDWLKPNVILEAFEARAARMSVTCAKNLNNFPNQEEGFAQLATDLAEAAVAHVQLIIVSKFIEKLQQDIPGKGVKRQLEILFNVYALSLLHKHLGDFVASGCITPKQGALANEQLRLLYSQVRPNAIALVDAFNYTDHYLGSVLGRYDGNVYPKLYEEAWKDPLNETVVPDGYHEYIRPILKQHIRVARL

SEQ ID NO: 23501 - protein, 664 aa, Brassica napus
MEGIDHLADERNKAEFDVDEMKIVWAGSRHAFEVSDRIARLVATDPVFEKSDRARLSRKELFKSTLKKCAHAWKRIIELRLTEEEAGRLRFFVDQPAFVDLHWGMFVPAIKGQGTEEQQEKWLSLANKMQIIGCYAQTELGHGSNVQGLETTATFDPKTDEFVIHSPTQTSSKWWPGGLGKVSTHAVVYARLITDGKDYGVHGFIVQLRSLEDHSPLPNIIVGDIGTKMGNGAYNSMDNGFLMFDQVRIPRNQMLMRLAKVTREGKYVPSDVPKQLMYGTMVYVRQTIVADASNALSRAVCIATRYSAVRRQFGAQNGGIETQVIDYKTQQNRLFPLLASAYAFRFVGEWLKWLYTDVTARLQASDFSTLPEAHACTAGLKSLTTTATADGIEECRKLCGGHGYLWCSGLPELFAVYVPACTYEGDNIVLQLQVARFLMKTVSQLGSGKAPVGTTAYMARAQHLLQCRSGVQKAEDWLNPAVVVEAFEARALRMAVACAKNLSKFENQEQGFSELLAELVEAAIAHCQLIVVSKFIAKLEQDIGGKGVKKQLNNLCYIYALHILHKHLGDFLSTNSITPKQASLANDQLRSLYSQVRPNAVALVDAFNYTDHYLNSVLGRYDGNVYPKLFEEAWKDPLNDSVVPDGYQEYIRPLIKQQLRTARL

SEQ ID NO: 23502 - protein, 664 aa, Eutrema parvulum
MEGVDNLAGERNKAEFDVDEMKIVWAGSRHAFEVSDRIARLVASDPVFVKSDRARLSRKELFKSTLKKCAHAWKRIIELRLTEEEAGRLRFFVDQPAFVDLHWGMFVPAIKGQGTEEQQQKWLSLANKMQIIGCYAQTELGHGSNVQGLETTATFDPKTDEFVIHSPTQTSSKWWPGGLGKVSTHAVVYARLITDGKDYGVHGFIVQLRSLEDHSPLPNIIVGDIGTKMGNGAYNSMDNGFLMFDQVRIPRDQMLMRLAKVTREGKYVPSDVPKQLMYGTMVFVRQTIVADASNALSRAVCIATRYSAVRRQFGARNGGIETQVIDYKTQQNRLFPLLASAYAFRFVGEWLKWLYTDVTERLQASDFATLPEAHACTAGLKSLTTTATADGIEECRKLCGGHGYLWCSGLPELFAVYVPACTYEGDNIVLQLQVARFLMKTVSQLGSGKAPVGTTAYMACAEHLLQCRSGVQKAEDWLNPGAVLEAFEARALRMAVACAKNLSKFENQEQGFSELLAELVEAAIAHCQLIVVSKFIAKVEQDIGGKGVKKQLNNLCYIYALYILHKHLGDFLSTNSITPKQASLANDQLRSLYSQVRPNAVALVDAFNYTDHYLSSVLGRYDGNVYPKLFEEAWKDPLNDSVVPDGYHEYIRPLIKQQLRTARL

SEQ ID NO: 23503 - protein, 664 aa, Gossypium hirsutum
MEALDYHAEERRKAEFDVEEMKIVWAGSRQAYEISDRVARLVASDPVFRKDNRTMLSRKDLFKDTLRKAAHAWKRIIELRLSEEEASKLRFFVDQPVFTDLHWGMFIPAIKGQGNEEQQQKWLPMAYKMQIIGCYAQTELGHGSNVQGLETTATFDPETDEFVIHSPTLTSSKWWPGGLGKVSTHALVYARLITDGQDHGVHGFIVQLRSLDDHLPLPGITVGDIGMKFGSGAYNSMDNGVLRFDHVRIPRDQMLMGVSQVTREGKFMQSDVPRQLVYGTMVYVRQKIVADASCALSRAVCIATRYSAVRRQFGSHNGGPETQVIDYKTQQSRLFPLLASAYAFRFVGEWLKWLYTDVTRRLEANDFSTLPEVHACTAGLKSVTTSATADAIEECRKLCGGHGYLSSSGLPELFAVYVPACTYEGDNVVLLLQVARFLMKTVSQLGSGKKPVGTIAYMGRSEHLLQCRCEVERAEDWLKPNVILEAFEARAARMSVTCAKNLNNFPNQEEGFAQLATDLAEAAVAHVQLIIVSKFIEKLHQDIPGKGVKRQLEILFNVYALSLLHKHLGDFVASGCITPKQGALANEQLRLLYSQVRPNAIALVDAFNYTDHYLGSVLGRYDGNVYPKLYEEAWKDPLNETVVPDGYHDYIRPILKQHIRVARL

SEQ ID NO: 23504 - protein, 664 aa, Brassica rapa
MEGIDHLADERNKAEFDVDEMKIVWAGSRHAFEVSDRIARLVATDPVFEKSDRARLSRKELFKSTLKKCAHAWKRIIELRLTEEEAGRLRFFVDQPAFVDLHWGMFVPAIKGQGTEEQQQKWLSLANKMQIIGCYAQTELGHGSNVQGLETTATFDPKTDEFVIHSPTQTSSKWWPGGLGKVSTHAVVYARLITDGKDYGVHGFIVQLRSLEDHSPLPNIIVGDIGTKMGNGAYNSMDNGFLMFDQVRIPRDQMLMRLARVTREGKYVPSDVPKQLMYGTMVYVRQTIVADASNALSRAVCIATRYSAVRRQFGARNGGIETQVIDYKTQQNRLFPLLASAYAFRFVGEWLKWLYTDVTARLQASDFSTLPEAHACTAGLKSLTTTATADGIEECRKLCGGHGYLWCSGLPELFAVYVPACTYEGDNIVLQLQVARFLMKTVSQLGSGKAPVGTTAYMARAQHLLQCRSGVQKAEDWLNPAAVVEAFEARALRMAVACAKNLSKFENQEQGFSELLAELVEAAIAHCQLIVVSKFIAKLEQDIGGKGVKKQLNNLCYIYALHILHKHLGDFLSTNSITPKQASLANDQLRSLYSQVRPNAVALVDAFNYTDHYLNSVLGRYDGNVYPKLFEEAWKDPLNDSVVPNGYQEYIRPLIKQQLRTARL

SEQ ID NO: 23505 - protein, 665 aa, Lupinus angustifolius
MGGGVDHLAPERNKAEIDVDSLKIVWAGSSHDLQLSERMARLVASDPAFRKDNRPILGRKELFKSTLRKATYAWKRISELRLNEEEALRLRSFVDEPAFTDLHWGMFVPAIKGQGTDEQQKKWLPLAHKMQIIGCYAQTELGHGSNVQGLETTATFDPKTDEFVIHSPTLTSSKWWPGGLGKVSTHAVVYARLITDGQDHGVNGFIVQLRSLDDHLPLPGITIGDIGAKFGNGAYNTMDNGVLRFNNVRIPRDQMLMRISQVTREGKLVKSSVPRQLVYGTMVFVRQAIVADASVALSRAVCIATRYSAVRRQFGSHNGGPETQVIDYKTQQARLFPLLASAYAFRFVGEWLKWLYTDVTQRLQAGDFSTLPEAHACTAGLKSLTTSVTADGIEECRKLCGGHGYLCSSGLPELFAVYVPSCTYEGDNVVLQLQVARHLIKTISQLGSGKKPIGTTAYLGRLEQLLQYRSDVEKAEDWLKPNVVLGAFEARAAKKSVAVAQNLSKFSNPEDGFQELSADLVEAAVAHCQLIVVSKFIEKLQKDIPGKGVKQQLEHLSSIYALFLLHKNLGDFLSTGSITPKQGHLANEQLRSLYSQVRPNAIALVDAFNHTDHYLGSVLGRYDGNVYPQLYEEAWKDPLNDSVVPDGYQEYIRPLLKQQLRNARL

SEQ ID NO: 23506 - protein, 664 aa, Prunus persica
MEGVDHLAHERSKAQFDVDQMKVVWVGSRHALQVSDRIARLVASDPVLRKDDRTMMTRKELFKNTLRKAAHGWKRINELRLSEEEASWFRHYVDQPAYTDLHWGMFVPFIKGSGTEEQQKKWLPLAYKMQIIGCYAQTELGHGSNVQGLETTATFDPKTDEFVLNSPTLTSSKWWPGGLGKAATHAVAFARLITDGKDHGVNGFIVQLRNLDDHLPLPGITVGDIGMKFGNGAYNSMDNGVLRFDNVRIPRDQMLMRVAQVTREGKYVQSNVPRQLLYGTMVFVRQTIVADASTALSRAVCIATRYSAVRRQFGSENGGVETQVIDYKTQQSRLFPLLASAYAFRFVGEWLKWLYTDVTQKLQANDFSTLPEAHACTAGLKSLTTSATADAIEECRKLCGGHGYLSNSGLPELFAVYVPACTYEGDNIVLLLQVARFLMKTVSQLPSGKKPVGTTSYMGRAEHLIQCRCNVQKVEDWLKPSVILEAFEARAIRMSIACAQDLSKFSNQEEGFAELSSNLAEAAVAHCQLIVVSKFIEKLQQDIPGKGVKEQLQNLCNIYALYIIHKHLGDFLSTGSITAKQASLANDQLRSLYSKLRPNAIALVDAFNYTDHYLGSVLGRYDGDVYPNLYAEAWKDPLNESVVPDGYREYIQPLLKNQLRNARL

SEQ ID NO: 23507 - protein, 664 aa, Arabidopsis lyrata
MEGVDHLADERNKAEFDVEEMKIVWAGSRHAFEVSDRIARLVASDPVFEKSNRARLSRKELFKSTLRKCAHAFKRIIELRLNEEEAGRLRHFIDQPAYVDLHWGMFVPAIKGQGTEEQQKKWLSLASKMQIIGCYAQTELGHGSNVQGLETTATFDPKTDEFVIHTPTQTASKWWPGGLGKVSTHAVVYARLITNGKDYGIHGFIVQLRSLEDHSPLPNITVGDIGTKMGNGAYNSMDNGFLMFDHVRIPRDQMLMRLSKVTREGKYVPSDVPKQLVYGTMVYVRQAIVADASIALSRAVCIATRYSAVRRQFGAHNGGIETQVIDYKTQQNRLFPLLASAYAFRFVGEWLKWLYTDVTERLAASDFATLPEAHACTAGLKSLTTTATADAIEECRKLCGGHGYLWCSGLPELFAVYVPACTYEGDNVVLQLQVARFLMKTVAQLGSGKVPVGTTAYMGRAAHLLQCRSGVQKAEDWLNPDAVLEAFEARALRMAVTCAKNLSKFENQEQGFQELLADLVEAAIAHCQLIVVSKFIAKLEQDIGGKGVKKQLNNLCYIYALYLLHKYLGDFLSTNSITPKQASLANDQLRSLYSQVRPNAVALVDAFNYTDHYLNSVLGRYDGNVYPKLFEEAWKDPLNDSVVPDGYHEYLRPVLKQQLRTARL

SEQ ID NO: 23508 - protein, 644 aa, Chelidonium majus
MKIVWAGSQHALEVSDRIARLVASDPAFRKDNRTMLSRKELFKNTLRKAAHAWKRIIELHLSEEEASKLRFYVDEPAFTDLHWGMFVPAIKGQGTKEQLEKWLPLAYKMQIIGCYAQTELGHGSNVQGLETTATFDPKSDEFVINSPTLTSSKWWPGGLGKVSTHAIVYARLLIDGQDHGVHGFIVQLRSLDDHLPLPGITVGDIGMKFGSGAYNTMDNGVLRFDHVRIPRSQMLMRVSQVTRDGKYLQSDVPRQLVYGTMVYVRQTIVADASCALSRAVCIATRYSAVRRQFGSQDGGPETQVIDYKTQQSRLFPLLATAYAYRFVGEWLKWLYTDVTERLQANDFSTLPEAHACTAGLKSLTTSTTADAIEECRKLCGGHGYLNSSGLPELFAVYVPACTYEGDNTVLLLQVARFLMKTVSLLGSGKQPVGTIAYMGRAEHLMQYRCDVQRAEDWLKPSVVLEAFEARAMRMSVACAQNISKMANPEAGFAELSADLVEAAVAHCQLIVVSKFIEKLEQDIPGKGVKEQLEVLCSIYALSLLHKHQGDFLSTGSITPKQASLANDQLRSLYAQARPNAIALVDSFNYTDYYLGSVLGRYDGNVYPKLYEEAWKDPLNDSVVPDGYHEYIRPLLKQQLRSARL

SEQ ID NO: 23509 - protein, 664 aa, Prunus mume
MEGVDHLAHERSKAQFDVDQMKVVWVGSRHALQVSDRIARLVASDPVLRKDNRTMMTRKELFKNTLRKAAHGWKRINELRLSEEEASWFRHYVDQPAYTDLHWGMFVPFIKGSGTEEQQKKWLPLAYKMQIIGCYAQTELGHGSNVQGLETTATFDPKTDEFVLNSPTLTSSKWWPGGLGKAATHAVAFARLITDGKDHGVNGFIVQLRSLDDHLPLPGITVGDIGMKFGNGAYNSMDNGVLRFDNVRIPRDQMLMRVAQVTREGKYVQSNVPRQLLYGTMVYVRQTIVSDASTALSRAVCIATRYSAVRRQFGSENGGVETQVIDYKTQQSRLFPLLASAYAFRFVGEWLKWLYTDVTQKLQANDFATLPEAHACTAGLKSLTTSATADAIEECRKLCGGHGYLTNSGLPELFAVYVPACTYEGDNVVLLLQVARFLMKTVSQLPSGKKPVGTTSYMGRAERLIQCRCNVQKVEDWLKPSVILEAFEARAIRMSIACAQDLSKFSNQEEGFAELSSNLAEAAVAHCQLIVVSKFIEKLQQDIPGKGVKEQLQNLCNIYALYIIHKHLGDFLSTGSITAEQASLANEQLRSLYSKLRPNAIALVDAFNYTDHYLGSVLGRYDGDVYPNLYAEAWKDPLNESVVPDGYWEYIQPLLKNQLRNARL

SEQ ID NO: 23510 - protein, 664 aa, Daucus carota
MKGVDYLAHERNKAGFDVDSMKIVWYGSQRDFDINDRMAKLVASDPVFSKENRTMLPRKDLFKNTLKKAAYGWKRIRELNLTFEEATKFRTYIDQPAFTDLHWGMFIPAIRGQGTDEQHKKWLPLAQKMQIIGCYAQTELGHGSNVQGLETTATFDPKTDEFVIHSPTLTSSKWWPGGLGKVSTHGVVYARLLTDGQDHGVHGFIVQLRSLEDHTPLPGVTIGDIGMKFGNGAYNSMDNGVLSFDHVRIPRDQMLMRVLQVSREGKCTQSDVPRQLIYGTMVYVRQTIVSDASVALSRAVTIATRYSCVRRQFGSQNGGPETQVIDYKTQQNRLFPLLASAYAFRFAGQWLSWLYKDVTDKLQANDFSTLPEAHACTAGLKSLTTSATADAIEECRKLCGGHGYLCTSGLPELFAVYVPACTYEGDNVVLLLQVARFLVKTVSQLSSGNKPAGTVAYMGRAEHLMKCRSSVERAEDWLKPSSILEAFETRAFRMAVACSQSLSQFANSEEGFAELSADLAEAAIAHCQLIVISKFIDKLKEPIPGKGIKQILEVLCQVYALSTLHKHQGDFLTTASITPKQAALAFTQLRHLYSQVRPNAVALVDSFNHTDHYLGSILGRYDGNVYPKLYDAAWKEPLNDTVVPDGYKEYIRPLLKNQLHLAKL

SEQ ID NO: 23511 - protein, 664 aa, Petroselinum crispum
MEGVDYLAEERNKAGFDVNCMKIVWYGSQRDFDISDRMAKLVASDPVFSKENRTMLPRKELFKNTLKKAAYGWKRIRELNLTFEESTKFRTYIDQPAFTDLHWGMFIPAIRGQGTDEQHKKWLPLAQKMQIIGCYAQTELGHGSNVQGLETTATFDPKTDEFVIHSPTLTSSKWWPGGLGKVSTHGIVYARLLTDGQDHGVHGFIVQLRSLEDHSPLPGVTIADIGMKFGNGAYNSMDNGLLRFDHVRIPRDQMLMRVLQVSREGKCTQSDVPRQLIYGTMVYVRQTIVSDASVALSRAVTIATRYSCVRRQFGSQNGGPETQVIDYKTQQHRLFPLLASAYAFRFAGQWLSWLYKDVTDKLQASDFSTLPEAHACTAGLKSLTTSATADAIEECRKLCGGHGYLCSSGLPELFAVYVPACTYEGDNVVLLLQVARFLVKTVSQLKSGNKPAGTVAYMGRAEHLMKCRSSVEKAEDWLKPSSILEAFETRAFRMAVACSQSLSQFANHEEGFAELSADLAEAAVAHCQLIVVSKFIDKLKEPIPGKGIKQILEVLCQVYALSTLHKHQGEFLATASITPKQGALAFTQLRHLYSQVRPNAVALVDSFNHTDHYLGSILGRYDGNVYPKLYDAAWQEPLNDKDVPDGYKEYIRPLLKNQLHLAKL

SEQ ID NO: 23512 - protein, 664 aa, Arabidopsis thaliana
MEGIDHLADERNKAEFDVEDMKIVWAGSRHAFEVSDRIARLVASDPVFEKSNRARLSRKELFKSTLRKCAHAFKRIIELRLNEEEAGRLRHFIDQPAYVDLHWGMFVPAIKGQGTEEQQKKWLSLANKMQIIGCYAQTELGHGSNVQGLETTATFDPKTDEFVIHTPTQTASKWWPGGLGKVSTHAVVYARLITNGKDYGIHGFIVQLRSLEDHSPLPNITVGDIGTKMGNGAYNSMDNGFLMFDHVRIPRDQMLMRLSKVTREGEYVPSDVPKQLVYGTMVYVRQTIVADASNALSRAVCIATRYSAVRRQFGAHNGGIETQVIDYKTQQNRLFPLLASAYAFRFVGEWLKWLYTDVTERLAASDFATLPEAHACTAGLKSLTTTATADGIEECRKLCGGHGYLWCSGLPELFAVYVPACTYEGDNVVLQLQVARFLMKTVAQLGSGKVPVGTTAYMGRAAHLLQCRSGVQKAEDWLNPDVVLEAFEARALRMAVTCAKNLSKFENQEQGFQELLADLVEAAIAHCQLIVVSKFIAKLEQDIGGKGVKKQLNNLCYIYALYLLHKHLGDFLSTNCITPKQASLANDQLRSLYTQVRPNAVALVDAFNYTDHYLNSVLGRYDGNVYPKLFEEALKDPLNDSVVPDGYQEYLRPVLQQQLRTARL

SEQ ID NO: 23513 - protein, 664 aa, Cocos nucifera
MEEVDHLAHERSKAQFDVDAMKVVWAGSKHALDVSDRMARLVASDPIFRKDNRTMLGRKELFKNTLRKAAHAWKRVHELRLTEEEASMLRLFLDEPSYVDLHWGMFVPAIKGQGTDEQQKKWLPLAYKMQIIGCYAQTELGHGSNVQGLETTATFDPKTDEFIIHSPTLTSSKWWPGGLGKVSTHAVVYAHLITEGKDHGVHGFIVQLRSLDNHSPLPGITIGDIGTKFGNGAYNTMDNGVLRFDHVRIPRSQMLMRVSQVTREGKFIVSDVPRQLVYGTMVYVRQTIVSDASRALSRAVCIAVRYSAVRRQFGSQDGGPETQVIDYKTQQSRLFPLLASAYAFRFVGEWLKWLYADVTQRLQANDFSTLPEAHACTAGLKSLTTSATADGIEECRKLCGGHGYLCSSGLPELFAVYVPTCTYEGDNVVLLLQVARFLMKTVSQLGSGKQPVGTTAYMGRAHHLMQYKCDVRGAEDWLKPSVILQAFEARAVRLAVNCAQNISKAPSPEEGFSELSADLVEAAVAHCQLIVVSKFIKKVQQDIPGLGVKEQLQILCNIYALSVLHKHLGEFLATGCITTRQGSLANDQLRYLYSQIRPNAVALVDAFNYTDHYLGSVLGRYDGNVYPKLEEEAWKDPLNDSVVPDGYHEYIQPVLKQKFRLSRL

SEQ ID NO: 23514 - protein, 497 aa, Zea mays
MAAAVLAPKPPPPLPTRAFPSSSPSRFAPAFISPRHPLRRLLLRPIPCASSPSSVLMPNPDLETEPAHDGDGDGDEAPPESRPRRIALFVEPSPFAYVSGYKNRFQNFIKYLREMGDEVIVVTTHEGVPQEFHGAKLIGSWSFPCPWYQKVPLSLALSPRIIAEVARFKPDIIHASSPGIMVFGALIIAKLLCVPLVMSYHTHVPIYIPRYTFSWLVKPMWLIIKFLHRAADLTLVPSVAIGRDLQAARVTAANKIRLWNKGVDSESFHPRFRNMEMRSRLTNGEPEKPLVFYVGRLGVEKSLDFLKRVMDRLPGARIAFIGDGPFRAELEQMFSGMPVVFTGTLQGEELSQAYASGDVFVMPSESETLGFVVLEAMSSGVPVVGARAGGIPDIIPEDQEGRTSFLYTPGDVDDCVGKIKRLLSSEELREAMGRAARKEMEKFDWRAATRKIRNEQYSAAIWFWRKKRAQVLRPLQWVLRLLRRTMPGAADAAAKQS

SEQ ID NO: 23515 - protein, 486 aa, Setaria italica
MAAAGAVVPRPPPPLPITAFPSSSWPRLSPRYPLRLRSMLRRPLPCAAASSSSVLMPDPDLEPEPAHEDESRPRRIALFVEPSPFAYVSGYKNRFQNFIKYLREMGDEVIVVTTHEGVPQEFHGAKLIGSWSFPCPWYQKVPLSLALSPRIIGEVARFKPDIIHASSPGIMVFGALIIAKLLCVPLVMSYHTHVPIYIPRYTFSWLVKPMWLIIKFLHRAADLTLVPSVAIGRDLQAARVTAANKIRLWNKGVDSESFHPRFRNKEMRSRLTNGEPEKPLILYVGRLGVEKSLDFLKRVMDRLPGSRIAFIGDGPFRAELEQMFSGMPAVFTGTLQGEELSQAYASGDVFVMPSESETLGFVVLEAMSSGVPVVGARAGGIPDIIPEDQEGKTSFLYTPGDVDDCVSKIERLLSCEELRETMGRAARKEMEKFDWRAATRKIRNEQYSAAIWFWRKKRAQLLRPVQWVVRKLVRPTTPGAAVAKQS

SEQ ID NO: 23516 - protein, 491 aa, Panicum virgatum
MAAAAVVPRPPPSLPTRAFPSSSSTSCSSRRYPLRLRRSMPRPLVCAAASSSVWMPDPDLEPEPARDDQPAPESRPRRIALFVEPSPFAYVSGYKNRFQNFIKYLREMGDEVIVVTTHEGVPQEFHGAKLIGSWSFPCPWYQKVPLSLALSPRIIGEVARFKPDIIHASSPGIMVFGALIIAKLLCVPLVMSYHTHVPIYIPRYTFSWLVKPMWLIIKFLHRAADLTLVPSVAIGRDLQAARVTAANKIRLWNKGVDSESFHPRFRNKEMRSRLTNGEPEKPLILYVGRLGVEKSLDFLKRVMDRLPGSRIAFIGDGPFRAELEQMFSGMPAVFTGTLQGEELSQAYASGDVFVMPSESETLGFVVLEAMSSGVPVVGARAGGIPDIIPEDQEGKTSFLYTPGDVDDCVSKIERLLSCEELREMMGRAARKEMEKFDWRAATRKIRNEQYSAAIWFWRKKRAQLLRPVQWVVRRLLRPTMPGAGNTVAKQS

SEQ ID NO: 23517 - protein, 484 aa, Echinochloa colona
MAAAAAVVPRPPPSLPTRAFFPSPAWPLLSRRHPTITRLTTTAAAASSSSVVMPEPDPDLDLEPADQSRPRRIALFVEPSPFAYVSGYKNRFQNFIKYLREMGDEVIVVTTHEGVPQEFHGAKLIGSWSFPCPWYQKVPLSLALSPRIIGEVARFKPDIIHASSPGIMVFGALIIAKLLCVPLVMSYHTHVPIYIPRYTFSWLVKPMWLIIRFLHRAADLTLVPSVAIGRDLQAARVTAANKIRLWNKGVDSESFHPRFRNKEMRSRLTNGEPEKPLIFYVGRLGVEKSLDFLKRVMDRLPGSRIAFIGDGPFRAELEQMFSGMPAVFTGTLQGEELSQAYASGDVFVMPSESETLGFVVLEAMSSGVPVVGARAGGIPDIIPEDQEGKTSFLYTPGDVDDCVSKIERLLSCEELRETMGRAARKEMEKFDWRAATRKIRNEQYSAAIWFWRKKRAQLLRPVQWVVRRLRPTTPGAGNTIAKQS

SEQ ID NO: 23518 - protein, 480 aa, Pennisetum glaucum
RPPPPLPITASPSSSTSWPRLSPRYPLRLRSKLRRPLPCSAASSSVLMPDPDLEPEPAHEGESRPRRIALFVEPSPFAYVSGYKNRFQNFIKYLREMGDEVIVITTHEGVPQEFHGAKLIGSWSFPCPWYQKVPLSLALSPRIIGEVARFKPDIIHASSPGIMVFGALIIAKLLCVPLVMSYHTHVPIYIPRYTFSWLVKPMWLIIKFLHRAADLTLVPSVAIGRDLQAAHVTAANKIRLWNKGVDSESFHPRFRNKEMRSRLTNGEPEKPLILYVGRLGVEKSLDFLKRVMDRLPGSRIAFIGDGPFRPELEQMFSGMPAVFTGTLQGEELSQAYASGDVFVMPSESETLGFVVLEAMSSGVPVVGARAGGIPDIIPEDQEGKTSFLYTPGDVDDCVSKIERLLSCEELRETMGRAARKEMEKFDWRAATRKIRNEQYSAAIWFWRKKRAQLLRPVQWVVRKLVRPRTPVAGNAIAKQS

SEQ ID NO: 23519 - protein, 497 aa, Triticum aestivum
MARAAPILAVSKPSPLPLIAPSSRPRAGSLHLHRRRLLPLSPSSSCSTSTSASSSSSSPVLLRDDELDHQEEPPPASEADSRPRRIALFVEPSPFAYVSGYKNRFQNFIKYLREMGDEVIVITTHEGVPDEFHGAKLIGSWSFPCPWYQKVPLSLALSPRIIGEVARFKPDIIHASSPGIMVFGALIIAKLLCVPLVMSYHTHVPIYIPRYTFSWLVKPMWLVIKFLHRAADLTLVPSVAIGRDLQAARVTAANKIRLWNKGVDSESFHPRFRNQEMRSRLTNGEPDKPLIIYVGRLGVEKSLDFHKRVMDRLPGSRIAFIGDGPFRPELEEMFSGMPAVFTGTLQGEELSQAYASGDVFVMPSESETLGFVVLEAMSSGVPVVAARAGGIPDIIPEDQEGKTSFLYTPGDVDDCVGKVELLLSCEELRETMGKAARKEMEKFGWKAATRKIRNEQYSAAIWFWRKKRSQLLRPLQWVFRRLFRPAPAPAPAITNQS

SEQ ID NO: 23520 - protein, 499 aa, Hordeum vulgare
MARAAPILAVSKPSPLPLIAPSSRQRAGSLRLHRRHLLLPFSPSSSCSTSTSASSSSSSSPVLLRDDELDHQEEPPPASEADSRPRRIALFVEPSPFAYVSGYKNRFQNFIKYLREMGDEVIVITTHEGVPDEFHGAKLIGSWSFPCPWYQKVPLSLALSPRIIGEVARFKPDIIHASSPGIMVFGALIIAKLLCVPLVMSYHTHVPIYIPRYTFSWLVKPMWLVIKFLHRAADLTLVPSAAIGRDLKAARVTAANKIRLWNKGVDSESFHPRFRNQEMRSMLTNGEPEKPLIIYVGRLGVEKSLDFHKRVMDRLPGARIAFIGDGPFRPELEEMFSGMPAVFTGTLQGEELSQAYASGDVFVMPSESETLGFVVLEAMSSGVPVVAARAGGIPDIIPEDQEGKTSFLYTPGDVDDCVGKVERLLSCEELRETMGKAARKEMEKFGWKAATRKIRNEQYSAAIWFWRKKRSQLLRPLQWVFRRLFRSAPAPAAAITNQS

SEQ ID NO: 23521 - protein, 499 aa, Secale cereale
MARAPPILAVSKPSPLPLIAPSSRPRAGSLRLHRRRLLPFSPSSSCSTSTSTSASSSSSSPVLLRDDELDHQEEPPPASEADSRPRRIALFVEPSPFAYVSGYKNRFQNFIKYLREMGDEVIVITTHEGVPDEFHGAKLIGSWSFPCPWYQKVPLSLALSPRIIGEVARFKPDIIHASSPGIMVFGALIIAKLLCVPLVMSYHTHVPIYIPRYTFSWLVKPMWLVIKFLHRAADLTLVPSVAIGRDLQAARVTAANKIRLWNKGVDSESFHPRFRNQEMRSRLTNGEPDKPLIIYVGRLGVEKSLDFHKRVMDRLPGSRIAFIGDGPFRPELEEMFSGMPAVFTGTLQGEELSQAYASGDVFVMPSESETLGFVVLEAMSSGVPVVAARAGGIPDIIPEDQEGKTSFLYTPGDVDDCVGKVELLLSCEELRETMGKAARKEMEKFGWKAATRKIRNEQYSAAIWFWRKKRSQLLRPLQWVFRRLFRPAPAPAPAITNQS

SEQ ID NO: 23522 - protein, 499 aa, Hordeum vulgare
MARAAPILAVSKPSPLPLIAPSSRQRAGSLRLHRRHLLLPFSPSSSCSTSTSASSSSSSSPVLLRDDELDHQEEPPPASEADSRPRRIALFVEPSPFAYVSGYKNRFQNFIKYLREMGDEVIVITTHEGVPDEFHGAKLIGSWSFPCPWYQKVPLSLALSPRIIGEVARFKPDIIHASSPGIMVFGALIIAKLLCVPLVMSYHTHVPIYIPRYTFSWLVKPMWLVIKFLHRAADLTLVPSAAIGRDLKAARVTAANKIRLWNKGVDSESFHPRFRNQEMRSMLTNGEPEKPLIIYVGRLGVEKSLDFHKRVMDRLPGARIAFIGDGPFRPELEEMFSGMPAVFTGTLQGEELSQAYASGDVFVMPSESETLGFVVLEAMSSGVPVVAARAGGIPDIIPEDQEGKTSFLYTPGDVDDCVGKVERLLSCEELRETMGKAARKEMEKFGWKAATRKIRNEQYSAAIWFWRKKRSQLLRPLQWVFRRLFRSAPVPAAAITNQS

SEQ ID NO: 23523 - protein, 482 aa, Brachypodium distachyon
MAAASILVVPKPHLPPISPRESPKAATTLIPLRRRLPFPSCRCTSASSASSAPVLLRDDGDEPPPPTSEADSRPRRIALFVEPSPFAYVSGYKNRFQNFIKYLREMGDEVIVVTTHEGVPAEFHGAKLVGSWSFPCPWYNKVPLSLALSPRIIGEVARFKPDIIHASSPGIMVFGALIIAKLLCVPLVMSYHTHVPIYIPRYTFSWLVKPMWLVIKFLHRAADLTLVPSVAIGRDLQAARVTAANKIRLWNKGVDSESFHPRFRNQEMRSRLTNGEPDKPLIIYVGRLGVEKSLDFHKRVMDRLPGSRIAFIGDGPFRPVLEEMFSGMPAVFTGTLQGEELSQAYASGDVFVMPSESETLGFVVLEAMSSGVPVVAARAGGIPDIIPEDQEGKTSFLYTPGDVDDCVGKVERLLSSEELRQTMGKAARKEMEKFDWKAATRKIRNEQYSAAIWFWRKKRSQLLRPVQWLFRGLFRPAPANQS

SEQ ID NO: 23524 - protein, 479 aa, Oryza sativa
MAAWNTSILLPPPPPLLSRAAVATPALNPYPLRLHRRHPQKPLCLPSESYPADTDADASSASLDSRPRRIALFVEPSPFAYVSGYKNRFLNFIKYLREMGDEVIVITTHEGVPQEFYGAKLIGSWSFPCPWYQKVPLSLALSPRIIGEVARFKPDIIHASSPGIMVFGALIIAKLLCVPLVMSYHTHVPIYIPRYTFSWLVKPMWLIIKFLHRAADLTLVPSVAIGKDLQAARVTAANKIRLWNKGVDSESFHPRFRNDEMRARLTNGEPEKPLILYVGRLGVEKSLDFLKRVMDRLPGSRIAFVGDGPFRAELQLMFTGMPAVFTGTLQGEELSQAYASGDVFVMPSESETLGFVVLEAMSSGVPVVAARAGGIPDIIPEDQEGKTSFLYTPGDVDDCVSKIERLLTCEELRETMRKAARKEMEKFDWRAATRKIRNEQYSAAIWFWRKKRAQLLRPIQWVSRRLFRPTPAPSTMNQS

SEQ ID NO: 23525 - protein, 479 aa, Oryza sativa
MAAWNTSILLSPPPPLLSRAAVATPALNPYPLRLHRRHPQKPLCLPSESYPADTDADASSASLDSRPRRIALFVEPSPFAYVSGYKNRFQNFIKYLREMGDEVIVITTHEGVPQEFYGAKLIGSWSFPCPWYQKVPLSLALSPRIIGEVARFKPDIIHASSPGIMVFGALIIAKLLCVPLVMSYHTHVPIYIPRYTFSWLVKPMWLIIKFLHRAADLTLVPSVAIGKDLQAARVTAANKIRLWNKGVDSESFHPRFRNDEMRARLTNGEPEKPLILYVGRLGVEKSLDFLKRVMDRLPGSRIAFVGDGPFRAELQLMFTGMPAVFTGTLQGEELSQAYASGDVFVMPSESETLGFVVLEAMSSGVPVVAARAGGIPDIIPEDQEGKTSFLYTPGDVDDCVSKIERLLTCEELRETMRKAARKEMEKFDWRAATRKIRNEQYSAAIWFWRKKRAQLLRPIQWVSRRLFRPTPAPSTMNQS

SEQ ID NO: 23526 - protein, 927 aa, Echinacea purpurea
MVSSHLTPILYFTLLLVTCSCVCSKPSPKPPTKIGDGYRLVSLEESPDGGLVGHLQVNKKNKIYGPDIPHLQLYIKHETDDRLRVHITDAQNQRWEVPYNLLPRAQPPKPSQQPTLGSTKNPITVSEFSGGELIFSYISNPFSFAVRRKSNGETIFNSSTDSSTPYNSLVFKDQYLEISTTLPKTASLYGLGENTQPHGIKLYPNDPYTLWTTDQSAINLNMDLYGSHPVYMDLRNTNGDPYAHGVLLLNSNGMDVFYTGSSLTYKVIGGVLDFYFFAGPTPLAVVDQYTQLIGRPAPMPYWSLGFHQCRWGYHNLSVVEDVVENYKKANIPLDVIWNDDDHMDGHKDFTLNPNAYPRPKLLNFLERIHARGMKYIVIIDPGIGVNTSYGTYQRGLAKDVFIKYEGKPYLAQVWPGAVNFPDFLNPATVAWWGDEVRRFHELVPVDGLWIDMNEASNFCSGLCTIPEGRICPNGTGPGWICCLDCKNITKTKWDDPPYKINASGTHVPIGYKTIATSAVHYNGVREYDAHSLYGFSHAIATHKALQGLQGKRPFILSRSTFVGSGHYTAHWTGDNQGTWNDIKYSIYTMLNFGLFGVPMVGSDICGFYPQPTEELCNRWIELGAFYPFSRDHANYYSPRQELYQWETVATSARNALGMRYKLLPYLYTLTYEAHTTGAPIARPLFFSFPNIQELYGLSTQFLLGESLMVSPVLDQGRTNVSAVFPPGTWYSLFDPSQAIVSKGTQTFTLDAPLHVINVHLYQNTILPMQRGGMISKDARMTPFTLLVTFPAGATDAKAKGKLFLDNDELPEMQLGNGQSTYVEFSASASKDMVKVWSDVQESKFALDKGWVIEKISVMGLSGVGGAFSVEVEGNMDILDASNVELAQTEHKFIYGVEDMKSVMVEVGGLNIPIGKKFTMSWKMGVSS

SEQ ID NO: 23527 - protein, 926 aa, Arnica chamissonis
FSSDTLFFYLTLLLCHIFMATVQTPRPAPLPPTKIGNGYRLVSLQESSDGGLVGHLQVNRKNNIYGPDIPHLQLYIKHETDDRLRVHISDAQKQRWEVPYNLLPRDQPPTASQQTLRRSTKNPITVSEFSGGELIFSYISNPFSFAVRRKSNGQTIFNSSSDESTPYNSLVFKDQYLEISTTLPKDASLYGLGENSQPHGIKLYPNDPYTLWTTDQSAINLNMDLYGSHPVYMDLRNVGGQAYAHGVLLLNSNGMDVFYRGNSLTYKVIGGVLDLYFFAGPSPLAVVDQYTQLIGRPAPMPYWSLGFHQCRWGYHNLSVVEDVVENYQKANIPLDVIWNDDDHMDGHKDFTLNPNAYPRPKLLDFLQRIHARGMKYIVIIDPGIGVNASYGTYQRGIAKDVFIKYEGKPYLAQVWPGAVNFPDFLNPATVSWWGDEVRRFHELVPVDGLWIDMNEVSNFCSGLCTIPQGKQCPTGTGPGWICCLDCKNITNTKWDDPPYKINASGTHVPIGYKTIATSAVHYNGVLEYDAHSIYGFSHAIATHKALQALEGKRPFILSRSTFVGSGHYTAHWTGDNQGTWNDIKYSIYTMLNFGLFGVPMVGSDICGFYPQPTEELCNRWIELGAFYPFSRDHANYYSPRQELYQWETVAISARNALGMRYKLLPYLYTLTYEAHTTGAPIARPLFFSFPNIPELYGLSTQFLLGESLMVSPVLDQGRTNVSAVFPPGTWYSLFDPSQAIISKETQTFTLDAPLHVINVHLYQNTILPMQRGGLISKDARMTPFTLLVTFPAEDTDAKAKGKLFLDDDELPEMQLGNGQSTYVEFSATKSKQMVKVWSDVEESKFALEKGWVIEKISVLGLSGVGGEFAVEVEGSLDILDASKVELVETEHKFINGGETKSVMVEVGGLNIPVGKVFTMSWKMGIS

SEQ ID NO: 23528 - protein, 938 aa, Lactuca sativa
MVSSSPAQAIFHLTLLLIISSCIPPSFSQSTPATTSPPTKIGNGYTLVSLQESPDGGLVGRLQVNRRNYIYGADIPFLQLYIKHETDDRLRVHISDAQQQRWEVPYDILPRDRPPTPSTQTIGRSRKNPITVSEFSGGELIFSCISNPFSFAVRRKSNGETLFNSTSDQSSPYNSLVFKDQYLEISTSLPKDASLYGLGENTQPHGIKLNPNEPYTLWTTDQSAINLNMDLYGSHPMYMDLRNVGGEAYAHGVLLLNSNGMDVLYRGNSLTYKVIGGIFDFYFFSGPSPLAVVDQYTQLVGRPAPMPYWSLGFHQCRWGYHNLSVVEDVVENYNKANIPLDVIWNDDDHMDGHKDFTLNPTAYPQPKLQDFLQRIHARGMKYIVIIDPGIGVNSSYGTYQRGLAKDVFIKYDGKPYLAQVWPGAVNFPDFLNPATVSWWGDEVRRFHEIVPVDGLWIDMNEASNFCSGLCTLPQGKQCPTGTGPGWICCLDCKNITKTKWDDPPYKINASGTHVPIGYKTIATSAVHYNGVREYDAHSMYGFTHAIATHKALQALQGKRPFILSRSTFVGSGHYTAHWTGDNQGTWNDLKYSIHTMLNFGIFGIPMVGSDICGFYPQPTEELCNRWIELGAFYPFSRDHANYYSPRQELYQWETVAESARNALGMRYKLLPYLYTLTYEAHTTGAPIARPVFFSFPNIQELYGLSTQFLLGESLMISPVLDQGQTNVSAVFPPGTWYNLFDLSQAIISKETQTVTLDAPLHVINVHLYQNTILPMQRGGLISKEAKMTPFTLIVTFPAGATEARAKGKLYLDDDELPDMSLGNGQSTYVEFYASASKENVKVWSDVTDSNYALDKGWVIEKVTVVGLAGIGGQFAIDVEGNAGILDVSKFKMVETEHKFLNEMKKVGEEENKSVMVEIGGLALPVGKQFTMSWTLGIS

SEQ ID NO: 23529 - protein, 924 aa, Chrysanthemum coronarium
MVSFKMTHIFYLATVLLISCSFVNVFGSKQSLVAPTKIGDGYRLVSLQESSDGGLVGLLKVNQKNNIYGPDIPHLQLYIKHETDDRLRIHITDAQQQRWEVPYDLLPRDKPPQQRPSKQTTIPINAAAFSSGELIFSYITDPFSFAVKRTSTGQTLFNSSTPYNSLVFKDQYIEISTSLPHDASLYGLGENSQPHGIKLYPNDPYTLWTTDQSAINLNMDLYGSHPVYMDLRSNGHAHGVLLLNSNGMDIIYRGDSLTYKVIGGVLDFYVFAGPTPLGVVDQYTQLIGRPAPMPYWSLGFHQCRWGYHNLSVVEDVVENYNKAQIPLDVIWNDDDHMDGHKDFTLNPVAYPRPKLLDFLQRIHDRGMKYIVIIDPGIGVNSSYGTYQRGIAKDVFIKYNGKPYLAQVWPGAVNFPDFMNPATVSWWVDEVRRFHELVPVDGLWIDMNEASNFCSGLCTLPEGRKCPNGTGPGWVCCLDCKNITNTKWDDPPYKINASGTHVPIGYKTIATSAVHYNGVREYDAHSMYGFSHAIATHKALEGLNGKRPFILSRSTFVGSGKYTAHWTGDNQGTWNDIKYSIYTMLNFGLFGVPMVGSDICGFYPQPTEELCNRWIELGAFYPFSRDHANYYSPRQELYQWETVAISARNALGMRYKLLPYLYTLTYEAHTTGAPIARPLFFSFPNIPQLYGLSTQFLLGESLMVSPVLDQGRTNVSAVFPPGTWYSLFDQSQVINSKDLKPITLDAPLHVINVHLYQNTILPMQRGGMISKDARMTPFTLIVTFPVGSTDSNAKGKLYLDNDELPEMRLGNGQSTYIDFSASASRKTVKVWSDVQESKFALDKGWYIEKITVLGSSGIGGSFAVEVEGESDILDVSKVEVVQTEHKFFDEIMKDSDVKKSMMVEVGGLNIPIGKKFTMSWKMGIS

SEQ ID NO: 23530 - protein, 926 aa, Conyza canadensis
MVSFKMTPIFHLMIILVFLCVTNVSCAKSSTTPVAPPTKIGNGYRLVSLQESSDGGLVGHLEVNQKNNVYGPDIPLLQLYIKHETDERLRVHISDAQQQRWEVPYNLLPRDQPPPLSQPIHGSPQNPITVSEYSAGELTFSYISNPFSFAIKRKSNGDTLFNSNYNALVFKDQYLEISTHLPKNASLYGLGENSQPHGIKLYPNDPYTLWTTDQSAINLNMDLYGSHPVYMDLRNDGEKANAHGVLLLNSNGMDVFYTGHSLTYKVIGGIFDFYFFSGPTPLAVVDQYTQLIGRPAPMPYWSLGFHQCRWGYHNLSVVKDVVENYNKANIPLDVIWNDDDHMDGHKDFTLNPTAYPQPKLFDFLKRIHARGMKYIVLIDPGIGVNSTYGVYQRAIAKDVFIKYEGKPYLAQVWPGAVNFPDFLNPATVDWWGDEIRRFHEMVPVDGLWIDMNEASNFCSGLCTLPKGQCPTGTGPGWICCLDCKNITSTKWDDPPYKINASGTQVPIGYKTIATSAVHYNGVKEYDAHSMYGFSHAIATHKALEALEGKRPFILSRSTFVGSGHYTAHWTGDNQGTWNDIKYSIYTMLNFGIFGIPMVGSDICGFYPQPTEELCNRWIELGAFYPFSRDHANYYSPRQELYQWETVATSARNALGMRYKLLPYLYTLMYEAHTTGAPIARPLFFSFSNIPELYGLSTQFLLGDSLMVSPVLNQGQTNVSAVFPPGTWYSLFDPSHAIISKGTQTFILDAPLHVINVHLYQNTILPMQRGGMISKEARMTPFTLIVTFPVGATDAQATGKLYLDNDELPEMKLGNGQSTYVDFTATTSKQMVKVWSNVQESKFALQQGLFIEKITVLGSDGVGGQFSVEVEGESDVLDASKVELVETEHKFDVLQAGDSKKSVMVEVGGLSIPIGKRFTMSWRMGVS

SEQ ID NO: 23531 - protein, 924 aa, Chrysanthemum coronarium
MVSFKMTHIFYLATVLLISCSFVNVFGSKQSLVAPTKIGDGYRLVSLQESSDGGLVGLLKVNQKNNIYGPDIPHLQLYIKHETDDRLRIHITDAQQQRWEVPYDLLPRDKPPQQRPSKQTTIPINAAAFSSGELIFSYITDPFSFAVKRTSTGQTLFNSSTPYNSLVFKDQYIEISTSLPHDASLYGLGENSQPHGIKLYPNDPYTLWTTDQSAINLNMDLYGSHPVYMDLRSNGHAHGVLLLNSNGMDIIYRGDSLTYKVIGGVLDFYVFAGPTPLGVVDQYTQLIGRPAPMPYWSLGFHQCRWGYHNLSVVEDVVENYNKAQIPLDVIWNDDDHMDGHKDFTLNPVAYPRPKLLDFLQRIHDRGMKYIVIIDPGIGVNSSYGTYQRGIAKDVFIKYNGKPYLAQVWPGAVNFPDFMNPATVSWWADEVRRFHELVPVDGLWIDMNEASNFCSGLCTLPEGRKCPNGTGPGWVCCLDCKNITNTKWDDPPYKINASGTHVPIGYKTIATSAVHYNGVREYDAHSMYGFSHAIATHKALEGLNGKRPFILSRSTFVGSGKYTAHWTGDNQGTWNDIKYSIYTMLNFGLFGVPMVGSDICGFYPQPTEELCNRWIELGAFYPFSRDHANYYSPRQELYQWETVAISARNALGMRYKLLPYLYTLTYEAHTTGAPIARPLFFSFPNIPQLYGLSTQFLLGESLMVSPVLDQGRTNVSAVFPPGTWYSLFDQSQVINSKDLKPITLDAPLHVINVHLYQNTILPMQRGGMISKDARMTPFTLIVTFPVGSTDSNAKGKLYLDNDELPEMKLGNGQSTYIDFSGSVSRKTVKVWSDVQESKFALDKGWYIEKITVLGSSGVGGSFAVEVEGESDILDVSKVEVVQTEHKFFDEIMKDSELKKSMMVEVGGLNIPIGKKFTMSWKMGIS

SEQ ID NO: 23532 - protein, 926 aa, Chrysanthemum coronarium
MVSFKMTHIFYLATVLLISCSFVNVFGSKQSLVAPTKIGDGYRLVSLQESSDGGLVGLLKVNQKNNIYGPDIPHLQLYIKHETDDRLRIHITDAQQQRWEVPYDLLPRDKPPQQRPSKQTTIPINAAAFSSGELIFSYITDPFSFAVKRTSTGQTLFNSSTPYNSLVFKDQYIEISTSLPHDASLYGLGENSQPHGIKLYPNDPYTLWTTDQSAINLNMDLYGSHPVYMDLRSNGHAHGVLLLNSNGMDIIYRGDSLTYKVIGGVLDFYVFAGPTPLGVVDQYTQLIGRPAPMPYWSLGFHQCRWGYHNLSVVEDVVENYNKAQIPLDVIWNDDDHMDGHKDFTLNPVAYPRPKLLDFLQRIHDRGMKYIVIIDPGIGVNSSYGTYQRGIAKDVFIKYNGKPYLAQVWPGAVNFPDFMNPATVSWWVDEVRRFHELVPVDGLWIDMNEASNFCSGLCTLPEGRKCPNGTGPGWVCCLDCKNITNTKWDNPPYKINASGTHVPIGYKTIATSAVHYNGVREYDAHSMYGFSHAIATHKALEGLNGKRPFILSRSTFVGSGKYTAHWTGDNQGTWNDIKYSIYTMLNFGLFGVPMVGSDICGFYPQPTEELCNRWIELGAFYPFSRDHANYYSPRQELYQWETVAISARNALGMRYKLLPYLYTLTYEAHTTGAPIARPLFFSFPNIPQLYGLSTQFLLGESLMVSPVLDQGRTNVSAVFPPGTWYSLFDQSQVINSKDLKPMTLDAPLHVINVHLYQNTILPMQRGGMISKDARMTPFTLIVTFPVGSTDSNAKGKLYLDNDELPEMRLGNGQSTYIDFSASASRKTVKVWSDVQESKFALDKGWYIEKITVLGSSGIGGSFAVEVEGESDILDVSKVEVVQTEHKFFDEIMKDSDVKKSMMVEVGGLNIPIGKKFTMSWKMGISFS

SEQ ID NO: 23533 - protein, 921 aa, Chrysanthemum coronarium
FKMTHIFYLVTVLLISCSFVNVFGSKQSLVAPTKIGDGYRLVSLQESSDGGLVGLLKVNQKNNIYGPDIPHLQLYIKHETNDRLRIHITDAQQQRWEVPYDLLPRDKPPQQRPSKQTTIPINAAAFSSGELIFSYITDPFSFAVKRTSTGQTLFNSSTPYNSLVFKDQYIEISTSLPHDASLYGLGENSQPHGIKLYPNDPYTLWTTDQSAINLNMDLYGSHPVYMDLRSNGHAHGVLLLNSNGMDIIYRGDSLTYKVIGGVLDFYVFAGPTPLGVVDQYTQLIGRPAPMPYWSLGFHQCRWGYHNLSVVEDVVENYNKAQIPLDVIWNDDDHMDGHKDFTLNPVAYPRPKLLDFLQRIHDRGMKYIVIIDPGIGVNSSYGTYQRGIAKDVFIKYNGKPYLAQVWPGAVNFPDFMNPATVSWWADEVRRFHELVPVDGLWIDMNEASNFCSGLCTLPEGRKCPNGTGPGWVCCLDCKNITNTKWDDPPYKINASGTHVPIGYKTIATSAVHYNGVREYDAHSMYGFSHAIATHKALEGLNGKRPFILSRSTFVGSGKYTAHWTGDNQGTWNDIKYSIYTMLNFGLFGVPMVGSDICGFYPQPTEELCNRWIELGAFYPFSRDHANYYSPRQELYQWETVAISARNALGMRYKLLPYLYTLTYEAHTTGAPIARPLFFSFPNIPQLYGLSTQFLLGESLMVSPVLDQGRTNVSAVFPPGTWYSLFDQSQVINSKDLKPITLDAPLHVINVHLYQNTILPMQRGGMISKDARMTPFTLIVTFPVGSTDSNAKGKLYLDNDELPEMRLGNGQSTYIDFSASASRKTVKVWSDVQESKFALDKGWYIEKITVLGSSGVGGSFAVEVEGESDILDVSKVEVVQTEHKFFDEIMKDSDVKKSMMVEVGGLNIPIGKKFTMSWKMGIS

SEQ ID NO: 23534 - protein, 924 aa, Chrysanthemum coronarium
MVSFKMTRIFHLAIVLLISCSFVNVFGSKQSLVAPTKIGDGYRVVSLQETSDGGLVGLLKVNQKNNIYGPDIPHLQLYIKHETDDRLRIHITDAQQQRWEVPYDLLPRDKPPQQQPSKQTTIPLNAAAFSSGTLMFSYITNPFSFAVKRTSTGQTLFNSSTPYNSLVFKDQYIEISTSLPHDASLYGLGENSQPHGIKLYPNDPYTLWTTDQSAINLNMDLYGSHPVYMDLRNNGHAHGVLLLNSNGMDIVYRGDSLTYKVIGGVLDFYVFAGPTPLGVVDQYTQLIGRPAPMPYWSLGFHQCRWGYHNLSVVEDVVENYNKAQIPLDVIWNDDDHMDNHKDFTLNPVAYPRPKLLDFLQRIHDRGMKYIVIIDPGIGVNSSYGTYQRAIAKDVFIKYNGKPYLAQVWPGAVNFPDFMNPATVSWWADEVRRFHELVPVDGLWIDMNEASNFCSGLCTLPEGRTCPNGTGPGWVCCLDCKNITNTKWDDPPYKINASGTHVPIGYKTIATSAVHYNGVREYDAHSMYGFSHAIATHKALEGLQGKRPFILSRSTFVGSGKYTAHWTGDNQGTWNDIKYSIYTMLNFGLFGVPMVGSDICGFYPQPTEELCNRWIELGAFYPFSRDHANYYSPRQELYQWQTVAISARNALGMRYKLLPYLYTLTYEAHTTGAPIARPLFFSFPNIPQLYGLSTQFLLGESLMVSPVLDQGRTNVSAVFPPGTWYSLFDHTQVINSKDLKPITLDAPLHVINVHLYQNTILPMQRGGMISKDARMTPFTLIVTFPVGSTESSAKGKLYLDNDELPEMRLGNGQSTYIDFSASASRKTVKVWSDVQESKYALDKGWYIERITVLGSSGIGGSFAVEVEGESDILDVSKVEVVQTEHTFFDEIMKDSDVKKSMMVEVGGLNIPIGKKFTMSWRMGIS

SEQ ID NO: 23535 - protein, 903 aa, Chrysanthemum coronarium
MVSFKMTHIFHLAIVLLVSCSFVNVFGSKQSLVAPTKIGDGYRVVSLQETSDGGLVGLLKVNQKNNIYGPDIPHLQLYIKHETDDRLRIHITDAQQQRWEVPYDLLPRDKPPQQQPSKQTTIPLNAAAFSSGTLMFSYITNPFSFAVKRTSTGQTLFNSSTPYNSLVFKDQYIEISTSLPHDASLYGLGENSQPHGIKLYPNDPYTLWTTDQSAINLNMDLYGSHPVYMDLRSNGHAHGVLLLNSNGMDIVYRGDSLTYKVIGGVLDFYVFAGPTPLGVVDQYTQLIGRPAPMPYWSLGFHQCRWGYHNLSVVEDVVENYNKAQIPLDVIWNDDDHMDNHKDFTLNPVAYPRPKLLDFLQRIHDRGMKYIVIIDPGIGVNSSYGTYQRAIAKDVFIKYNGKPYLAQVWPGAVNFPDFMNPATVSWWADEVRRFHELVPVDGLWIDMNEASNFCSGLCTLPEGRTCPNGTGPGWVCCLDCKNITNTKWDDPPYKINASGTHVPIGYKTIATSAVHYNGVREYDAHSMYGFSHAIATHKALEGLQGKRPFILSRSTFVGSGKYTAHWTGDNQGTWNDIKYSIYTMLNFGLFGVPMVGSDICGFYPQPTEELCNRWIELGACYPFSRDHATYYSPRQELYQWQTVAISARNALGMRYKLLPYLYTLTYEAHTTGAPIARPLFFSFPNIPQLYGLSTQFLLGESLMVSPVLDQGRTNVSAVFPPGTWYSLFDHTQVINSKDLKPITLDAPLHVINVHLYQNTILPMQRGGMISKDARMTPFTLIVTFPVGSTESSAKGKLYLDNDELPEMRLGNGQSTYIDFSASASRKTVKVWSDVQESKYALDKGWYIERITVLGSSGIGGSFAVEVEGESDILDVSKVEVVQTEHTFFDEIMKDSDVKKSMMVE

SEQ ID NO: 23536 - protein, 456 aa, Zea mays
MGVAAGGGVRLRASSAKKQRQRTLNNIKITLLCGFITVLVLRGTAGFNLLVSSGDLDGAAADAKVVEDVERILAEIRSDSEADDVVVVVEGGSSSSSSPRNATAASFGNFSASATLVKVREYSLGPPVRGWDAQRRDWMAQHPEFPRLHPRGRPRVLLVTGSPPGPCDNPAGDHYLLKATKNKIDYCRLHGIDVVHNMAHLDPELTGYWSKLPLVRRLMLAHPEVEWIWWVDSDAIFTDMAFELPLSRYDGSNLVIHGYPDLLFEKRSWISLNAGIFLLRNCQWSLDLLDAWVPMGPRGPSRVEAGKLLTASLTGRPPFDADDQSALIHLLLVQKERWMDKVHVETEFYLHGFWTGLVDRYEQMMEDNHPGLGDDRWPFITHFVGCKTCGRYEDYPLDRCIRGMERAFNFADNQVLRLYGFRHRSLTTAKVRRVTDPATNPLEAKEAALNMDAKFT

SEQ ID NO: 23537 - protein, 456 aa, Zea mays
MGVAAGGGARLRASSAKKQRQRTLNNIKITLLCGFITVLVLRGTAGFNLLVSSGDLDGAAADAKVVEDVERILAEIRSDSEADDVVVVVEGGSSSSSSPRNATAASFGNFSASATLVKVREYSLGPPVRGWDAQRREWMAQHPEFPRLHPRGRPRVLLVTGSPPGPCDNPAGDHYLLKATKNKIDYCRLHGIDVVHNMAHLDPELTGYWSKLPLVRRLMLAHPEVEWIWWVDSDAIFTDMAFELPLSRYDGRNLVIHGYPDLLFEKRSWISLNAGIFLLRNCQWSLDLLDAWVPMGPRGPSRVEAGKLLTASLTGRPPFDADDQSALIHLLLVQKERWMDKVHVETEFYLHGFWTGLVDRYEQMMEDNHPGLGDDRWPFITHFVGCKTCGRYEDYPLDRCIRGMERAFNFADNQVLRLYGFRHRSLTTAKVRRVTDPTTNPLEAKEAALNMDAKFT

SEQ ID NO: 23538 - protein, 453 aa, Setaria italica
MGVAGGGRLRASSIKKQRQRTMNNIKITLLCGFITVLVLRGTAGFNLLVNSGDPDGAAADAKVVEDIERILAEIRSDSEPDDVVVLVGDGSSSSPNNATAGLGNFSSSATLIRVKEYILGPKVSDWDSQRQEWLSRHPEFPSRDARGSPRVLLVTGSPPGPCDNPAGDHYLLKATKNKIDYCRLHGMDIVHNMAHLDPELTGYWSKIPLVRRLMLAHPEVEWIWWVDSDAIFTDMAFELPLSRYEGRNLVVHGYTDLLFEKRSWISLNAGIFLLRNCQWSLDLLDAWVPMGPRGPSRVEAGKLLTASLSGRPPFEADDQSALIHLLLIQKDKWMEKVQIETEFYLHGFWTGLVDRYEQMMEEHHPGLGDDRWPFITHFVGCKTCGRYEDYPLERCLRGMERAFNFADNQVLRLYGFQHRSLVSAKVRRVTDPRANPLEAKEAALKMDAKFQRV

SEQ ID NO: 23539 - protein, 460 aa, Setaria italica
MGVAGGGGRMRASSIKKQRQRTMNNIKITLLCGFITVLVLRGTAGFNLLVNSGDPDGAAADAKVVEDIERILAEIRSDSEPDEVVVFVGDGGSSSSSSPSNVTAGGFGNFSFSPSATLIKVKEYSLGPKVSDWDSQRQEWLSRHPEFPSRDARGNPKVLLVTGSPPGPCDNPAGDHYLLKAIKNKIDYCRLHGMDIVHNMAHLDPELTGYWSKIPLVRRLMLAHPEVEWIWWMDSDAIFTDMAFELPFSRYEGRNLVVHGYPDLLFEKRSWISLNAGIFLLRNCQWSLDLLDAWVPMGPRGPSRIEAGKLLTASLSGRPPFEADDQSVLIHLLLIQKDKWMEKVQIETEFYLHGFWTGLVDRYEQMMEEHHPGLGDDRWPFITHFVGCKTCGRYEDYPLERCLRGMERAFNFADNQVLRLYGFQHRSLVSAKVRRVTDPRANPLEAKEAALKMDAKFQRV

SEQ ID NO: 23540 - protein, 280 aa, Cajanus cajan
MEKASLSHMNTRLPLPNRTCAFLQFKHPTSFPTFPNPRPLRLRRPNCSISDGAVPSWVGASDSSLAVKKKAAEVSPELKGTSIFLVGLKSSLKTSLGKLLADVLRYYYFDSDSLVEEAVGGAHAAKSFRESDGKGFYESETEVLKQLSSMGRLVVCVGNGAVTSSTNLALLRYGISLWIDVPLDFVARDVIEDQSQFAPSEISISGSYPEVKDELGALYDKYRDGYATADATISVQKVASWLDCDNLDEITREDLALEALKEIEKLTRVKKMMEEAARPF

SEQ ID NO: 23541 - protein, 487 aa, Manihot esculenta
MGLGSEDGKVETACNTCQSKGRRKKKDSGSGGDEVVERSETGCWVKFRFIGSCISSRSKVDSSVSGTSTHCESKSTIDTSRDQPVAPAISSTTTSNTESNSSTSKLEEELKIASRLRKFTFNDLKLATRNFRPESLLGEGGFGCVFKGWIEENGTAPVKPGTGLTVAVKTLNHDGLQGHKEWLAEVNFLGDLVHSNLVKLIGYCIEDDQRLLVYEFMPRGSLENHLFRRSLPLPWSMRMKIALGAAKGLSFLHEEAERPVIYRDFKTSNILLDADYNAKLSDFGLAKDGPEGDKTHVSTRVMGTYGYAAPEYVMTGHLTSKSDVYSFGVVLLEMITGRRSMDKNRPIGEHNLVEWARPHLGERRRFYRLIDPRLEGHFSIKGAQKAAQLAAHCLSRDPKARPLMSEVVEALKPLPNLKDMASSSYYFQTMQAERAASSPNSKNSSRTPGGLLRNGQQQRSLSIPNGSNASPYHQQYPHQSPKPNRKP

SEQ ID NO: 23542 - protein, 492 aa, Medicago truncatula
MGLLGSDNVKMVESWDMSKSKGSKKMKKDKENEDVIDAGKTKTGCWVGLRFIGSCISSRSKVDSSVSGSGTSTHYAESKSTNDTSRGQRTAPVISSTTTSNAESNSSTTKLEEELKIASRLRKFSFNELKLATRNFRPESFLGEGGFGCVFKGWIEENGTAPVKPGTGLTVAVKTLNHDGLQGHKEWLAEVNFLGDLVHQNLVKLIGYCIEDDQRLLVYEFMPRGSLENHLFRRSMPLPWSIRMKIALGAAKGLAFLHEEAERPVIYRDFKTSNILLDADYNAKLSDFGLAKDGPEGDKTHVSTRVMGTYGYAAPEYVMTGHLTSKSDVYSFGVVLLEMISGRRSMDKHRPNGEHNLVEWARPHLGERRRFYRLIDPRLEGHFSVKGAQKAAQLAHHCLSRDPKARPLMSEVVEALMPLPNLKDMASSSYYFQSMQAERFGASPNSRSVHAQGASLARNGQQRRSLSIPNGAHVSPYHHKYPQQSPKPNVKA

SEQ ID NO: 23543 - protein, 488 aa, Trifolium pratense
MGLLGAEKGKVVESWDVCKSKGRKKKKKSQENEGVVEEKKPGCWVGLGLFGSCISSRSKVDSSISGASTHYAESKSTNDTSRGQPTAPVISSTTTSIAESNSSTSKLEEELKIASRLRKFTFNELKLATRNFRPESFLGEGGFGCVFKGWIEENGTAAVKPGTGLTVAVKTLNHDGLQGHKEWLAEVNFLGDLVHQNLVKLVGYCIEDDQRLLVYEFMARGSLENHLFRRPLPLPWSIRMKIALGAAKGLAFLHEEAERPVIYRDFKTSNILLDADYNAKLSDFGLAKDGPEGDKTHVSTRVMGTYGYAAPEYVMTGHLTSKSDVYSFGVVLLEMLSGRRSMDKHRPNGEHNLVEWARPHLGERRRFYRLLDPRLEGHFSVKGAQKAVQLAAHCLSRDPKVRPLMSEVVEALKPLPNLKDMASSSYYFQSMQAERFSASPNTRSAHAQGALLARNGQQRRTLSIPNGTHVSPYHHKYPQQSPKPNGKA

SEQ ID NO: 23544 - protein, 488 aa, Trifolium pratense
MGLLGAENGKVVESWDVCKSKGRKKKKKSQENEGVVEEKKPGCWVGLGLFGSCISSRSKVDSSISGASTHYAESKSTNDTSRGQPTAPVISSTTTSIAESNSSTSKLEDEIKIASRLRKFTFNELKLATRNFRPESFLGEGGFGCVFKGWIEENGTAAVKPGTGLTVAVKTLNHDGLQGHKEWLAEVNFLGDLVHQNLVKLVGYCIEDDQRLLVYEFMARGSLENHLFRRPLPLPWSIRMKIALGAAKGLAFLHEEAERPVIYRDFKTSNILLDADYNAKLSDFGLAKDGPEGDKTHVSTRVMGTYGYAAPEYVMTGHLTSKSDVYSFGVVLLEMLSGRRSMDKHRPNGEHNLVEWARPHLGERRRFYRLLDPRLEGHFSVKGAQKAVQLAAHCLSRDPKARPLMSEVVEALKPLPNLKDMASSSYYFQSMQAERFSASPNTRSAHAQGASLARNGQQRRTLSIPNGSHVSPYHHKFPQQSPNPNGKA

SEQ ID NO: 23545 - protein, 475 aa, Vitis vinifera
MGLGPDAIQVGNWEVGNSKGRKKKDDEEEATGCWIKFRFMGSCMSARSKVESSVSSSSTQYAESKSTNDTSRDQPVAPVVSSSTTSNGESTPSTPNTGEELKVASQLRKFTFNELKSATRNFRPESLLGEGGFGCVFKGWINGTGTTPVKPGTGLTVAVKTLNHDGLQGHKEWLAEVNFLGDLLHPNLVKLIGYCIEDDQRLLVYEFMPRGSLENHLFRRALPLPWSIRMKIALGAAKGLAFLHEEAERPVIYRDFKTSNILLDVDYNAKLSDFGLAKDGPEGDKTHVSTRVMGTYGYAAPEYVMTGHLTSKSDVYSFGVVLLEMLTGRRSMDKNRPNGEHNLVEWARPHLGERRRFYRLLDPRLEGRFSIKGAQKAAQLAAHCLSRDPKARPLMSEVVEALKPLPNLKDMASSSSFFQTMQAERTGSTPNSRSGIRAQAGFLSRNGQPNRSLSMPNGPHASPYNHNNPHRSPKP

SEQ ID NO: 23546 - protein, 495 aa, Arachis hypogaea
MGLGAENGKVVDSWDVCKSKGKKKSKKLKQKEGEVVVDEEDEEFEGETGCWVRLRFMGSCISSRPKVDNSVSGTTTHDAESKSTSDTSRDQRSEPTAPVVSSTTTSNASSSSTSKLEEELKVASRLRKFSFNDLKLATRNFRPESLLGEGGFGCVFKGWVEENGTAPVKPGTGLTVAVKTLNHDGLQGHKEWLAEVNFLGDLVHPHLVKLIGYCIEDDQRLLVYEFMPRGSLENHLFRRSMPLPWSVRLKIALGAAKGLAFLHEEAERPVIYRDFKTSNILLDAEYNAKLSDFGLAKDGPEGDKTHVSTRVMGTYGYAAPEYVMTGHLTSRSDVYSFGVVLLEMLTGRRSMDKHRPNGEHNLVEWARPHLGEKRRFYRLLDPRLEGHFSIKGAQKAAQIAARCLSRDPKARPLMSEVVEDLKPLLSLRDMASSSYYFQSMQADRFSPSPNTRNGRTQGVFLARNAQRSLSIPHGIHASPYHHQFLQQSPKPNGKT

SEQ ID NO: 23547 - protein, 473 aa, Amborella trichopoda
MGLGPGATQVEAWEQVKRSRGRKKGEDGEDTGCWFKFRLMGSCISSRSKVDNSISSASTHYAESKSTNDVSRDQPVVPVVSSTTTSNAESNPSTPKVGEELKVASQLRKFTFNDLKSATRNFRPESLLGEGGFGCVFKGWIEENGTAPVKPGTGLTVAVKTLNHDGLQGHKEWLAEVNFLGDLLHPNLVKLIGYCIEDDQRLLVYEFMPRGSLENHLFRRALPLPWSIRMKIALGAAKGLAFLHEEAERPVIYRDFKTSNILLDAEYNAKLSDFGLAKDGPEGDKTHVSTRVMGTYGYAAPEYVMTGHLTSRSDVYSFGVVLLEMLTGRRSMDKNRPNGEHNLVEWARPHLGERRRFYRLIDPRLEGHFSIKGAQKAAQLAYHCLSRDPKARPLMSEVVEALQPLLNLKDMASSSFNYQAIQAERAGANNGRTQHAAHYALKNGQQPARSLSNGSHYHPSPYRQSPKPNGKHP

SEQ ID NO: 23548 - protein, 477 aa, Ananas comosus
MGLGPDEVQLEAWDSVGKSKEKGRRKKKKDEAREETGCWIKFRLMGSCISSRSKVDSSISSASTHCGSKSTNDGSRDQPVAPVLSGSTTTSNAESISSASKAGEEFKVASQLRKFTFNELKAATRNFRPESLLGEGGFGCVFKGWIEENGTAPVKPGTGLTVAVKTLNHDGLQGHKEWVAEVNFLGNLLHPNLVKLIGYCIEDDQRLLVYEFMPRGSLENHLFRRSLPLPWSIRMKIALGAAKGLAFLHEEAERPVIYRDFKTSNILLDAEYNAKLSDFGLAKDGPEGDKTHVSTRVMGTYGYAAPEYVMTGHLTSKSDVYSFGVVLLEMMTGRRSMDKNRPNGEHNLVEWARPHLGERRRFYRLIDPRLEGNFSIKGAQKAAQLAHACLSRDPKARPLMSQVVEVLKPLLNLKDMASSSYFFQTMQAERAAHTGSTNGLKSQSSFTRNGPQPMRSLSNGPHASPYRHSPKPGGRQS

SEQ ID NO: 23549 - protein, 483 aa, Elaeis guineensis
MGLGLEEVKLEGWGSVGKGKDKGSKKKKKKSEAREEETGCWIKFRLIVSCISSRSKVDTSISSASTHCESKSTNDGSRDQPAAPVVSGSTTTSNAESNSSTSKVGEELKVASQLRKFTFYELKSATRNFRPESLLGEGGFGCVFKGWIEENGTAPVKPGTGLTVAVKTLNHDGLQGHKEWLAEVNYLGELQHPNLVKLIGYCIEDDQRLLVYEFMPRGSLENHLFRRSLPLPWPIRMKIALGAARGLAFLHEEAEKPVIYRDFKTSNILLDADYNAKLSDFGLAKDGPEGDKTHVSTRVMGTYGYAAPEYVMTGHLTSKSDVYSFGVVLLEMMTGRRSMDKNRPNGEHNLVEWARPHLGERRRFFRLIDPRLDGNFSIKGALKAAQLAHACLSRDPKSRPLMSEVVEVLKPLINLKDMASSSYFFQSMQAERAAANSNNQTGRNGLKSQASFPRNGHQPVRSLSNGSHPSPYRQSPKPNDKQP

SEQ ID NO: 23550 - protein, 485 aa, Aquilegia formosa
MGLVPEDIQLEGWDVAKSKSKSKGKKNSIKDGEEEENDIGCWFKFRFMRSCISSRSKVNSSISGASTNYAESKSTNDASRDQTVAPIVSSTTTSNAESVPCTPREGEELKIASQLRKFTNSELKSATRNFRPDTMLGEGGFGCVFKGWIEENGTAAAKPGTGLTVAVKTLNHDGLQGHKEWLAEVNFLGDLLHPNLVKLIGYCIEGDQRMLVYEFMPRGSLENHLFRRSLPLPWSIRMKIALGAAKGLAFLHEEAERPVIYRDFKSSNILLDAEYNAKLSDFGLAKDGPEGDKTHVSTRVMGTYGYAAPEYVMTGHLTSRSDVYSFGVVLLEMLTGRRSMDKNRPNGEHNLVEWARPHLGERRRFYKLIDPRLEGHFSIKGAQKAAQLAHHCLSRDPKARPLMSEVVEILKPLPNLKDMANSSPYFQTMQMERAGANNTNARNGLRSPALSLSRNGQSMRSPSISKGSHASPYHNYHRSPMPTGK

SEQ ID NO: 23551 - protein, 482 aa, Cocos nucifera
MGLGPEEVKLEGWGSVGKGKHKGSKKKKKSEAREEQTGCWIKFRLMVSCISSRSKVDTSISSASTHCESKSTNDGSRDQPAAPVVSGSTTTSNAESNSSTSKVGEELKVSSQLRKFTFCELKSATRNFRPESLLGEGGFGCVFKGWIEENGTAPVKPGTGLTVAVKTLNHDGLQGHKEWLAEVNYLGELQHPNLVKLIGYCIEDDQRLLVYEFMPRGSLENHLFRRSLPLPWPIRMKIALGAARGLAFLHEEAERPVIYRDFKTSNILLDADYNAKLSDFGLAKDGPEGDKTHVSTRVMGTYGYAAPEYVMTGHLTSKSDVYSFGVVLLEMMTGRRSMDKNRPNGEHNLVEWARPHLGERRRFFRLIDPRLDGNFSIKGALKAAQLAHACLSRDPKSRPLMSEVVEVLKPLINLKDMASSSYFFQSMQAERAAANSNNQTGRNGLKSQASFPRNGHQPVRSLSNGSHPSPYRQSPKPNDKQA

SEQ ID NO: 23552 - protein, 488 aa, Citrullus lanatus
MEVIAEDGKVESREVRESKGKKKQKNNKEQVETVEEETGCWIALRIFGSCISSRSKVDSSISGTSINYAESKSTADSSRDQPTPRDISSTNTSMSNAESNSSTSKLEEELKISPHLRKFSFNDLKLATRNFRPESLLGEGGFGCVFKGWVEENGTAPVKPGTGLTVAVKTLNHDGLQGHKEWMAEVNFLSDLKHPNLVRLIGYCNEDDQRLLVYEFMPRGSLENHLFRRSLPLPWSIRMKIALGAAKGLAFLHEEAKRPVIYRDFKTSNILLDAEYNAKLSDFGLAKDGPDGDKTHVSTRVMGTYGYAAPEYVMTGHLTSRSDVYSFGVVLLEMLTGRRSMDKNRPNGEHNLVEWARPYLGEKKRFYRLIDPRLEGHFSIKGAQKAVQLAAQCLSRDQKVRPLMSEVVEALKPLPNLKDMASSSYYFQTMQADRIRSSPMARNGYHTAAGPVPKNGQQLRSYSVANGSHASPYHHQQPHPSPKPNVKA

SEQ ID NO: 23553 - protein, 459 aa, Silene vulgaris
VDNVDVDDEELGVNTGCWVKLRLSSCISSRSKVDSSVSGSSTNYAESQSTNDASRDQPATAVVSSTTTSNAESSTSTSKLEEELKISCRLRKFQFNDLKLATRNFRPESLLGEGGFGCVFKGWIEENGTAPVKPGTGLTVAVKTLNHDGLQGHKEWLAEVNYLGELIHANLVKLIGYCIEDDQRLLVYEFMPRGSLENHLFRRSLPLPWSLRMKVALGAAKGLAFLHEEAEKPVIYRDFKTSNILLDAEYNAKLSDFGLAKDGPEEGKTHVSTRVMGTYGYAAPEYVMTGHLTSRSDVYSFGVVLLEMITGRRSMDKNRPNGEHNLVEWARPHLGDRRRFYRLIDPRLEGHFSIKGAQKAVQLAAHCLSRDPKARPVMSEVVDSLKPLPNLKDMASSSYYFQTMQADRVRANQIARNGQAQAAHHRNGQQPGLRSLSIPNGSHASPYNHHQSPKPTGKS

SEQ ID NO: 23554 - protein, 506 aa, Zea mays
MIAVRWAALLVALVVACGSAAAGAAAGEGPNWLGGLSRAAFPKDFVFGTATSAYQVEGAASTNGRGPSTWDAFVHTPGNIVYNQTADVAVDQYHRYREDVDLMKSLNFDAYRFSISWSRIFPDGEGRVNPEGVAYYNNLINYLLRKGITPYANLYHSDLPLALQNKYGGWLNAKMAKLFTDYADFCFKTFGDRVKHWFTFNEPRIVALLGYDAGSIPPQRCTKCSAGGNSATEPYIVAHNFLLSHAAAVSRYRNKYQAAQKGKVGIVLDFNWYEALTNSTEDQAAAQRARDFHVGWFADPLINGHYPQIMQDIVKERLPKFTPEQAKLVKGSADYIGINQYTASYVKGQKLLQQKPTSYSADWQVQYVLERNGKPIGPQANSKWLYIVPEGMYGCVNYLKHKYGNPTVFITENGMDQPGNLTRGQYLHDTTRVQFYKGYLAELRKAIDDGADVAGYFAWSLLDNFEWQSGYTSKFGIVYVDFSTPKLERHPKASAYWFRDMLQKHL

SEQ ID NO: 23555 - protein, 386 aa, Zea mays
MDVVGGAAAGGGDSKQLLVEADGNTRTLILNRPNQLNVLSPAMIKGLLSCFTAYVKDDGVKLLIMKGSGRAFCAGGDVVAGVQSINNEGWKWGADFFRDQYFLNYIIARCIKPQVSLLTGIVMGGGAGVSLHGKFRVATNNTVFAMPETSLGLFPDVGASYFLARLPGFYGEYVALVGARLDGAEMLACGLATHFVPSNRMLLLEESLKKVDTSNSFVVCSTIDQFCQQPSLKQKSSLNRLEIINKCFSKRTVEEIISSLEEVASNSASKWVAQTIQYLKKASPTSLKITLRSIREGRTQTVGECLQREYRMVCHVVRGDFSRDFFEGCRAILVDKDKNPKWMPPRLEQVHDDAVEEYFSRVDDPEWEDLDLPVMYSNGRIMESKL

SEQ ID NO: 23556 - protein, 393 aa, Ipomoea nil
MALQSASFLPSALSIHKEGKSLKETTFYGVALPCNPKAQFSHSSCTKEWGRKLVVGPVRAQTAVTTPVQSIPEEKKTLRKGCVIITGASSGLGLATAKALAETGKWHVIMACRNFLKAETAAKKAGMPKENYTVMHLDLASLDSVRQFVDTFRRSERPLDVLVCNAAVYFPTAKEPTFTAEGFELSVGTNHLGHFLLSRLLLDDLKQSDYPQKRLIIVGSITGNTNTLAGNVPPKANLGDLRGLKGGLNGTQSSPMIDGGEFDGAKAYKDSKVCNMLTMQEFHRRYHEETGVAFASLYPGCIAETGLFREHIPLFRLLFPPFQKYITKGYVSEDEAGKRLAQVVSDPSLSKSGVYWSWNSNSSSFENRLSKEASDAEKARKLWEVSEKLVGLA

SEQ ID NO: 23557 - protein, 385 aa, Flaveria ramosissima
MALQATSSFTIHKEVSLKDCSLFGAPLSTNLKVDFTSRREFNQRGALKTKAVATSSPAATRASTDGKKTLRKGTVIITGASSGLGLATAKSLAETGKWHVIMACRDFLKAERAAKSSGMSKENYTVMHLDLSSLDSVRQFVGNFRQSGRPVDVLVCNAAVYLPTAKEPTYTADGFELSVGTNHLGHFLLARLLLDDMKQSDYPSKRLIIVGSITGNTNTLAGNVPPKANLGDMRGLAGGLNGLNSSAMIDGGDFDGAKAYKDSKVCNMLMMQEFHRRFHEETGITFASLYPGCIATTGLFREHIPLFRLLFPPFQKYITKGYVSEDESGKRLAQVVSDPSLTKSGVYWSWNNNSASFENQLSEEASDVSKARKVWEISEKLVGLA

SEQ ID NO: 23558 - protein, 385 aa, Flaveria ramosissima
MALQATSSFTIHKEVSLKDCSLFGAPLSTNLKVDFTSRREFNQRGALKTKAVATTSPGATRASTDGKKTLRKGTVIITGASSGLGLATAKSLAETGKWHVIMACRDFLKAERAAKSSGMSKENYSVMHLDLSSLDSVRQFVGNFRQSGRPVDVLVCNAAVYLPTAKEPTYTADGFELSVGTNHLGHFLLARLLLDDMKQSDYPSKRLIIVGSITGNTNTLAGNVPPKANLGDMRGLAGGLNGLNSSAMIDGGDFDGAKAYKDSKVCNMLMMQEFHRRFHEETGITFASLYPGCIATTGLFREHIPLFRLLFPPFQKYITKGYVSEDESGKRLAQVVSDPSLTKSGVYWSWNNNSASFENQLSEEASDVSKARKVWEISEKLVGLA

SEQ ID NO: 23559 - protein, 385 aa, Flaveria ramosissima
MALQATSSFTIHKEVSLKDCSLFGAPLSTNLKVDFTSRREFNQRGALKTKAVATTSPAATHASTDGKKTLRKGTVIITGASSGLGLATAKSLAETGKWHVIMACRDFLKAERAAKSSGMSKENYTVMHLDLSSLDSVRQFVGNFRQSGRPVDVLVCNAAVYLPTAKEPTYTADGFELSVGTNHLGHFLLARLLLDDMKQSDYPSKRLIIVGSITGNTNTLAGNVPPKANLGDMRGLAGGLNGLNSSAMIDGGDFDGAKAYKDSKVCNMLMMQEFHRRFHEETGITFASLYPGCIATTGLFREHIPLFRLLFPPFQKYITKGYVSEDESGKRLAQVVSDPSLTKSGVYWSWNNNSASFENQLSEEASDVSKARKVWEISEKLVGLA

SEQ ID NO: 23560 - protein, 398 aa, Arnica chamissonis
MALQASLLPSAISVHKDGKLNSSLKESSFNGAFVSNNFKSDFSPLLIGTKELKRKSLWGPVRAQTVTAAPSVNEAAPDGKKTLRKGNVIITGASSGLGLATAKALADTGKWHIIMACRNFLKAEKAAKSVGITKENYTVMHLDLSSLESVRQFVDTFRLSGRPLDALVCNAAIYLPTAKEPTYTAEGFELSVGTNHLGHFLLSRLLLDDLKKTDYPQKRLVIVGSITGNTNTLAGNVPPKANLGDLRGLAGGLNGLNSSAMIDGGEFDGAKAYKDSKVCNMLTMQEFHRRYHEESGISFSSLYPGCIATTGLFREHIPLFRLLFPPFQKYITKGYVSEEEAGKRLAQVVSDSSLTKSGVYWSWNKNSASFENQLSQEASDAEKARKLWEVSEKLVGLA

SEQ ID NO: 23561 - protein, 389 aa, Artemisia annua
MALQATSSFSIHKEACLKESSIFGAPLSTHVKVDFTSSSKSKKEFSQRGALRTQAVATPTPTANRASTDAKKTLRKGTVIITGASSGLGLATAKSLAESGKWHVIMACRDFLKAERAAKSSGMTKENYSVMHLDLSSLDSVRQFVANFKQSGQSLDVLVCNAAVYLPTAKEPTYTADGFELSVGTNHLGHFLLARLLLDDLKQSDYPSKRLIIVGSITGNTNTLAGNVPPKANLGDMRGLAGGLNGLNSSTMIDGGDFDGAKAYKDSKVCNMLMMQEFHRRYHEETGITFASLYPGCIATTGLFREHIPLFRLLFPPFQKYITKGYVSEEESGKRLAQVVSDPSLTKSGVYWSWNNKSASFENELSEEASDVSKARKVWEISEKLVGLA

SEQ ID NO: 23562 - protein, 397 aa, Phaseolus vulgaris
MALQAASLVSASFSVAKEGTATSLRNTTMFGLSMADALKADFSSPSFSCKREFQQKNCPLRVQSVATTPGVTKASPEGKKTLRKGSVIITGASSGLGLATAKALAETGKWHVIMACRDFLKAERAAKAAGMAKENYTVIHLDLASLDSVRQFVYNFRQSGRPLDVLVCNAAVYLPTASEPTYTADGFELSVGTNHLGHFLLSRLLLEDLNKSDYPSKRLIIVGSITGNTNTLAGNVPPKANLGDMRGLAGGLNGLNTSAMIDGGSFDGAKAYKDSKVCNMLTMQEFHRRFHEETGITFASLYPGCIATTGLFREHIPLFRLLFPPFQKYITKGFVSEDESGKRLAQVVSDPSLTKSGVYWSWNKASASFENQLSQEASDADKARKVWEISEKLVGLA

SEQ ID NO: 23563 - protein, 398 aa, Flaveria ramosissima
MALQASLLSSAISVHKEGKLNSSFKESSISGAFVSKSVKSDFSPLLIGTKELKRKSLLGPIRAQTATVAPSVNEAAPDGKKTLRKGNVIITGASSGLGLATAKALADTGKWHIIMACRNFLKAEKAAKSVGITKENYTVMHLDLSSLESVRQFVDTFRRSGRPLDALVCNAAVYLPTAKEPTYTAEGFELSVGTNHLGHFLLSRLLLDDLKKSDYPQKRLIIVGSITGNTNTLAGNVPPKANLGDLRGLAGGLNGLNSSAMIDGGDFDGAKAYKDSKVCNMLTMQEFHRRYHEESGITFSSLYPGCIATTGLFREHIPLFRLLFPPFQKYITKGYVSEEEAGKRLAQVVSDSSLAKSGVYWSWNNKSASFENQLSQEASDAEKARKLWEVSEKLVGLA

SEQ ID NO: 23564 - protein, 394 aa, Centaurea maculosa
MALRAASLLPSAISVHKEGKLNSSQNGAFLSKNVKSDFSPLLIGTKELRRKSSLAPIRAQTATVAPSINEATQDGKKTLRKGNVIITGASSGLGLATAKALADTNEWHVIMACRNFLKAEKAAKSVGIAKENYTVMHLDLSSLESVRQFVDTFKRSGRPLDALVCNAAIYLPTAKEPTYTAEGFELSVGTNHLGHFLLSRLLLDDLKKSDYPQKRLIIVGSITGNTNTLAGNVPPKANLGDLRGLAGGLNGLNSSAMIDGGEFDGAKAYKDSKVCNMLTMQEFHRRYHEETGVTFSSLYPGCIATTGLFREHIPLFRLLFPPFQKYITKGYVSEEEAGKRLAQVVSDSSLTKSGVYWSWNKNSASFENQLSQEASDAEKARKLWEVSEKLVGLA

SEQ ID NO: 23565 - protein, 387 aa, Echinacea purpurea
MALQASLLPSAISVHKEGNGALVSTKVKSDFSPLLIGTKELKRKPLMGPIRAQTATVSPSVKDAASDGKKTLRKGNVIITGASSGLGLATAKALADTGKWHIVMACRNFLKAEKAAKSVGISKENYTVMHLDLSSLESVRQFVDTFRRSGRPLDALVNNAAVYLPTAKEPTYTAEGFELSVGTNHLGHFLLSRLLIEDLKKSDYPQKRLIIVGSITGNTNTLAGNVPPKANLGDLRGLAGGLNGLNSSAMIDGGEFDGAKAYKDSKVCNMLTMQEFHRRYHDETGITFSSLYPGCIATTGLFREHIPLFRLLFPPFQKYITKGYVSEEEAGKRLAQVVSDSSLTKSGVYWSWNKNSASFENQLSQEASDAEKARKLWEVSEKLVGLA

SEQ ID NO: 23566 - protein, 396 aa, Chrysanthemum coronarium
MALQATCFSVVHNVAGKANASLKDSTLFGVPLLDNRSNDITSLVSKNKMEFTRTKVFKAQAVATTSTPAVTRAAPKGKETLRKGCVVITGASSGLGLATAKALAETGKWHVIMACRDFLKAERAAKSSGISKENYTVMHLDLASLDSVRQFVANFKQSGRPLDVLVCNAAVYQPTAKEPTFTADGIELSVGTNHLGHFLLSRLLLDNMKQSDYPSKRLIIVGSITGNTNTLAGNVPPKANLGDMRGLAGGLNGLNSSTMIDGGDFDGAKAYKDSKICNMLTMQEFHRRYHEETGITFASLYPGCIATTGLFREHIPLFRMLFPPFQKFITKGYVSEEESGKRLAQVVSDPSLTKSGVYWSWNKDSASFENQLSEEASDVSKARKVWEISEKLVGLA

SEQ ID NO: 23567 - protein, 391 aa, Chrysanthemum coronarium
MALQATPFSVQNLATNLKDSTLFGVPLLDNRKLDITSSVLKSKMEFTRTKVFKAQAVATTSAPAVTSAAPESKKTLRKGSVIITGASSGLGLATAKALAETGKWHVIMACRDFLKAERAAKSAGISKENYTVMHLDLASLDSVRQFVANFKQSGRPLDVLVCNAAVYQPTAKEPTFTADGIELSVGTNHLGHFLLSRLLLDDMKQSDYPSKRLIIVGSITGNTNTLAGNVPPKANLGDMRGLAGGLNGLNSSTMIDGGDFDGAKAYKDSKICNMLTMQEFHRRYHEETGITFASLYPGCIATTGLFREHIPLFRMLFPPFQKFITKGFVSEDESGKRLAQVVSDPSLTKSGVYWSWNKDSASFENQLSEEASDLSKARKVWEISEKLVGLA

SEQ ID NO: 23568 - protein, 391 aa, Chrysanthemum coronarium
MALQATPFSVQNLATNLKDSTLFGVPLLDNRKLDITSSVLKSKMEFTRTKVFKAQAVATTSAPAVTSAAPESKKTLRKGSVIITGASSGLGLATAKALAETGKWHVIMACRDFLKAERAAKSAGISKENYTVMHLDLASLDSVRQFVANFKQSGRPLDVLVCNAAVYQPTAKEPTFTADGIELSVGTNHLGHFLLSRLLLDDMKQSDYPSKRLIIVGSITGNTNTLAGNVPPKANLGDMRGLAGGLNGLNSSTMIDGGAFDGAKAYKDSKICNMLTMQEFHRRYHEETGITFASLYPGCIATTGLFREHIPLFRMLFPPFQKFITKGFVSEDESGKRLAQVVSDPSLTKSGVYWSWNKDSASFENQLSEEASDLSKARKVWEISEKLVGLA

SEQ ID NO: 23569 - protein, 398 aa, Flaveria ramosissima
MALQASLLPSAISVHKEGKLNSSFKESSISGAFVSKSVKSDFSPLLIGTKELKRKSLLGPIRAQTATVAPSVNEAAPDGKKTLRKGNVIITGASSGLGLATAKALADTGKWHIIMACRNFLKAEKAAKSVGITKENYTVMHLDLSSLESVRQFVDTFRRSGRPLDALVCNAAVYLPTAKEPTYTAEGFELSVGTNHLGHFLLSRLLLDDLKKSDYPQKRLIIVGSITGNTNTLAGNVPPKANLGDLRGLAGGLNGLNSSAMIDGGDFDGAKAYKDSKVCNMLTMQEFHRRYHEESGITFSSLYPGCIATTGLFREHVPLFRILFPPFQKYITKGYVSEEEAGKRLAQVVSDSSLAKSGVYWSWNNKSASFENQLSQEASDAEKARKLWEVSEKLVGLA

SEQ ID NO: 23570 - protein, 398 aa, Flaveria ramosissima
MALQASLLPSAISVHKEGKLNSSFKESSISGAYVSKSVKSDFSPLLIGTKELKRKSLLGPIRAQTATVAPSVNEAAPDGKKTLRKGNVIITGASSGLGLATAKALADTGKWHIIMACRNFLKAEKAAKSVGITKENYTVMHLDLSSLESVRQFVDTFRRSGRPLDALVCNAAVYLPTAKEPTYTAEGFELSVGTNHLGHFLLSRLLLDDLKKSDYPQKRLIIVGSITGNTNTLAGNVPPKANLGDLRGLAGGLNGLNSSAMIDGGDFDGAKAYKDSKVCNMLTMQEFHRRYHEESGITFSSLYPGCIATTGLFREHVPLFRILFPPFQKYITKGYVSEEEAGKRLAQVVSDSSLAKSGVYWSWNNKSASFENQLSQEASDAEKARKLWEVSEKLVGLA

SEQ ID NO: 23571 - protein, 385 aa, Flaveria ramosissima
MALQATSSFTIHKEVSLKDCSLFGAPLATNLKVDFTSRREFNQRGALKTKAVATSSPAATRASTDGKKTLRKGTVIITGASSGLGLATAKSLAETGKWHVIMACRDFLKAERAAKSSGMSKENYTVMHLDLSSLDSVRQFVGNFRQSGRPVDVLVCNAAVYLPTANEPTYTADGFELSVGTNHLGHFLLARLLLDDMKQSDYPSKRLIIVGSITGNTNTLAGNVPPKANLGDMRGLAGGLNGLNSSAMIDGGDFDGAKAYKDSKVCNMLMMQEFHRRFHEETGITFASLYPGCIATTGLFREHIPLFRLLFPPFQKYITKGYVSEDESGKRLAQVVSDPSLTKSGVYWSWNNNSASFENQLSEEASDVSKARKVWDISEKLVGLA

SEQ ID NO: 23572 - protein, 385 aa, Flaveria ramosissima
MALQATSSFSIHKEVSLKDCSLFGAPLSTHLKVDFTSRKEFNQRGALKTKAVATTSPAATRASTDGKKTLRKGTVIITGASSGLGLATAKSLAETGKWHVIMACRDFLKAERAAKSSGISKENYTVMHLDLSSLDSVRQFVGNFRQSGRPLDVLVCNAAVYLPTAKEPTYTADGFELSVGTNHLGHFLLARLLLDDMKQSDYPSKRLIIVGSITGNTNTLAGNVPPKANLGDMRGLAGGLNGLNSSAMIDGGDFDGAKAYKDSKVCNMLMMQEFHRRFHEETGIAFASLYPGCIATTGLFREHIPLFRLLFPPFQKYITKGYVSEDESGKRLAQVVSDPSLTKSGVYWSWNNNSASFENQLSEEASDVSKAQKIWEISEKLVGLA

SEQ ID NO: 23573 - protein, 394 aa, Centaurea maculosa
MALRAASLLPSAISVHKEGKLNSSQNGAFLSKNVKSDFSPLLIGTKELRRKSSLAPIRAQTATVAPSINEATQDGKKTLRKGNVIITGASSGLGLATAKALADTSEWHVIMACRNFLKAEKAAKSVGIAKENYTVMHLDLSSLESVRQFVDTFKRSGRPLDALVCNAAIYLPTAKEPTYTAEGFELSVGTNHLGHFLLSRLLLDDLKKSDYPQKRLIIVGSITGNTNTLAGNVPPKANLGDLRGLAGGLNGLNSSAMIDGGEFDGAKAYKDSKVCNMLTMQEFHRRYHEESGVTFSSLYPGCIATTGLFREHIPLFRLLFPPFQKYITKGYVSEEEAGKRLAQVVSDSSLTKSGVYWSWNKNSASFENQLSQEASDAEKARKLWEVSEKLVGLA

SEQ ID NO: 23574 - protein, 675 aa, Triticum aestivum
MATYEPKNILITGAAGFIASHVANRLVRNYPRYNIVILDRVDYCSSLRNLDPSRGSPNFKFVRGDIASADLVNHLLVTESIDTVMHFAAQTHVDNSFGNSFEFTKNNIYGTHVLLEACKVTGQIRRFIHVSTDEVYGETDEDAVVGNHEASQLLPTNPYSATKAGAEMLVMAYGRSYGLPVITTRGNNVYGPNQFPEKLIPKFILLAMKGLPLPIHGDGSNVRSYLYCEDVAEAFEVVLHKGEVGHVYNIGTVKERRVIDVASDICKLFGLDTEKVIRFVENRPFNDQRYFLDDQKLKKLGWAERTTWEEGLKKTIEWYTSNPDYWGDVAGALLPHPRMLMTPGVERHNWTEEIKSLASSPAEAKECSTVPAAATSKSTSSVPQKATYKFLIYGKTGWIGGLLGKICEKQGIPYEYGKGRLQERSQLLQDIRNVKPTHVFNAAGVTGRPNVDWCETHKQDTIRTNVVGTLNLADVCREQGLLMINYATGCIFEYNAEHPEGSGIGFKEEDTPNFVGSFYSKTKAMVEELLKDYDNVCTLRVRMPISSDLSNPRNFITKIARYDKVVNIPNSMTILDELLPISVEMAKRDCRGIWNFTNPGVVSHNEILEMYKEYINPDFKWTNFTLEEQAKVIVAPRSNNEMDASKLKSEFPELLSIKESLIRNVFEPNRKVSTN

SEQ ID NO: 23575 - protein, 385 aa, Hordeum vulgare
MALLKAARVADVPTLDVVVPDHLAAAARVRLDAESAATTKRQQRGAGRRFAVIGHRGKGMNALASPDRRLQEVKENSVRSFNEAARFAVDYVEFDVQVTKDGCPVIFHDDIILTEEHGKISDKRVTDLQLEDFLQYGPQNKQGKNGKPLLRKMKDGRVLNWNVQSDDPLCTLQEAFEKVTPRLGFNVELKFDDHLAYEEEELTHILQAILKVVFECAKDRPIIFSSFQPDAAQLMRKLQSTYPVYFLTNGGTEIYADVRRNSLEEAVKLCLSTGMQGIVSEARAVFRFPTAIPMIKEADLSLLTYGTLNNVPEAVYMQHLMGVNGVIVDLVPEITGAVSDLIASPETDTEINDLSSQVVKDAASTPNFTQREISFLLRLMPELVQ

SEQ ID NO: 23576 - protein, 503 aa, Setaria italica
MDARWAVLLALLVASAGAGGARAAGVKGANWLGGLSRASFPKGFVFGTATSAYQVEGAASTNGRGPSIWDAFAHIPGKVAGNQNGDVAVDQYHRYKEDVDLMKSLNFDAYRFSISWSRIFPDGEGRVNPEGVAYYNNLINYLLQKGMTPYINLYHYDLPLALEQKYGGWLSSKMADLFTEYVDFCFKTYGDRVKHWFTFNEPRIVALLGYDAGSNPPQRCTKCAAGGNSATEPYIVAHNFLLAHAAAAARYRTKYQAAQKGKIGIVLDFNWYEPLTNSTDDQAAAQRARDFHIGWFVDPLINGHYPQIMQDLVKERLPRFTPEQAKLVKGSADYIGINQYTASYMKGQKLLQQTPTSYSADWQVQYVLARNGKPIGPQANSNWLYIVPWGMYGCVNYLKEKYGNPTVYITENGMDQPGNLTRDQYLRDVTRVRFYKSYLAQLKKAIDQGANVAGYFAWSLLDNFEWLSGYSSKFGIVYVDFNNKLERHPKASAYWFRDMLKKN

SEQ ID NO: 23577 - protein, 558 aa, Setaria italica
MRAGAAARRQPHAEAPRGVSPRAMSGAGAASSCRRRQLGVAVLLLLVALAAGLGGAEGKAHNYEDALQKSLLYFEAQRSGRLPHSQRVAWRHHSGLTDGLEQGVDLVGGYYDAGDHVKFGLPMAFTVTMLSWSLIEYGGDVAAAGELGHALEAVKWGTDYFIKAHTKPDELWAEVGDGDTDHYCWQRPEDMTTSRQAYKVDRDHPGSDVAGETAAAMAAASIVFRDSNPHYAHLLLHHAQQLFEFADKYRGKYDSSIAEVKSYYASVSGYKDELLWAALWLHRATGRADYLDYVVDNAHSFGGTGWAINEFSWDVKYAGVQILATRLLLRGEHAARHRSTLEQYRAKAEHYVCACLGRNADGGADANVERSPGGMLYIRQWNNMQYVTSAAFLLSAYSDYMAEAGVVTVQCGGGEAVAAEEVFALARAQVDYVLGTNPRGVSYLVGYGPKYPNRVHHRAASIVPYKHSKEFIGCTQGFDHWFGRRSSNPNVLVGAIVGGPDRRDRFRDNRENYMQTEACTYNTAPMVGMFAKLHRMARQEPERGPTPAAPVTSAASEV

SEQ ID NO: 23578 - protein, 181 aa, Zea mays
MGLAFGKLFSRLFAKKGMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATTGEGLYEGLDWLSSNIASKA

SEQ ID NO: 23579 - protein, 551 aa, Oryza sativa
MAAAAAAATATASSGLIRCATGGAPAHGHHQVFRCSAAKPSPLALRHRAGRPAPLQAFPEYDRVTPFDYDGEVDGGDGDDHPREECGVFGVVGDPDATSLCYLGLQKLQHRGEEGAGIAAAGDDGTIKLERGLGLVGDVFGDPARLGKLPGQAAIGHVRYSTAGAAASLRNVQPFLAGYRFGQLAVAHNGNLVNYQALRNKLEAQGSIFSTSSDTEVILHLIATSLSRPLLARICDACERLAGAYSLLFLTADKLLAVRDPFGFRPLVMGRRANGAIVFASETCALDLIDATYECEVEPGEVVVVDRRDMSVSSACLVPHRPRKSCVFEHIYFALPNSVVFGHAVHERRNAYGRALAEESPAPTADVVIPVPDSGFYAALGFSQTSGLEFQQGLIRWHYSGRSFIQPSQAIRDLAVKLKLAPVHGVIRGKSVVVVDDSLVRGTTSSKIVRLLRDAGAREVHMRIASPPVIGSCLYGIDTPSEGELISNRMDLEGVRRAIGCDSLAFLSLDKLHTIYGDEAHELCDACFSRNYPVLPTVPEPVPELVSAFED

SEQ ID NO: 23580 - protein, 388 aa, Sorghum bicolor
MASLPAAGGAAGGDSSDQLLVEADGSTRTLILNRPKKLNVLSSAMIKGLLRCFTVYEKDDRIKLLIMKGKGRAFCAGGDITGCVRSIHNESWIGGADFFRHLYLLNYRIATYIKPQVSLLTGIVMGGGAGVSLHGRFRVVTDNTIFAMPETALGLFPDVGASYFLSRLPGFYGEYLGLSGARLDGAEMLACGLATHFVPSNRLLLLEESLKKVNTSNPFVVGSTIDQFAQQPSLKENSSLNRMEIINKCFSKRTVEEIISSLEEVASDLADEWVAATIQYLKKASPTSLKISLRSIREGRTQTVGECLHREYRMVCHVMRGDFSPDFFEGCRAVLVDKDKNPMWMPPRLEQVHDKAVEEYFSRIDDPEWEDLNLPARRSNGRIVESML

SEQ ID NO: 23581 - protein, 336 aa, Gossypium hirsutum
MAPPELVRPSDKSNVFAKQVTLRNRAYVTFLAGNGDYVKGVVGLAKGLRKVKSAYPLVVAVLPDVPEEHRRILENQGCIVREIEPVYPPENQTQFAMAYYVINYSKLRIWEFVEYSKMIYLDGDIQVYDNIDHLFDLPDGHFYAVMDCFCEKTWSHSPQYKIGYCQQRPDKVKWPTEMGNPPALYFNAGMFVFEPSLVTYESLLKTLKITQPTPFAEQDFLNMFFKDIYKPIPLIYNLVLAMLWRHPENVELEKVKVVHYCAAGSKPWRYTGKEDNMQREDIKMLVQKWWDVYNDESLDYGTSAAEGGTETVNLQPFLAALSEAGAVHFVAAPSAA

SEQ ID NO: 23582 - protein, 297 aa, Sorghum bicolor
MAPPVALLLLAAIVLARVVTHAHGGGGGFYDPARVTQLSWRPRAFLYSGFLSDTECDHLINLAKGSMEKSMVADNDSGKSLMSQVRTSSGAFLAKHEDEIVSAIEKRVAAWTFLPEENAESMQVLRYEIGQKYDAHFDYFHDKNNVKHGGQRFATVLMYLTDVKKGGETVFPNAEGSHLQYKDETWSECSRSGLAVKPKKGDALLFFGLHLNATTDTSSLHGSCPVIEGEKWSATKWIHVRSFDNPPNVRMDAPCSDDNELCPKWAAIGECYKNPTYMVGTKDTNGFCRKSCGLCDA

SEQ ID NO: 23583 - protein, 387 aa, Sorghum bicolor
MASLPVAGCAAGGYSEQLLEEADGSTRTLILNRPKQLNVLSSAVIKGLLRCFIVYEKDDRVKLLIMKGNGRAFCAGGDITECVRYIHNESWKWGADFFRDLYLLNYISATYIKPQVSLLTGIVMGGGAGVSLHGRFRVATDNTVFAMPETALGFLPGVGATYFLSRLPGFYGEYVALTGARLDGAEMLACGLATHFVMSNILLLLEESLKNVDTSNTFAVRSTIDQFAQQPSLKENSSLNRMEIINNCFSKRTVEEIISALEQVDSNLSDEWVARTIQCLKKASPISLKVTLRSIREGRTQTVGECLHREYRVICHLIRGDFSRDFFEGCRAILVDKDRNPMWMPPSLEQVHEEVVEEYFSRIDDPKWEDLNLPYRRSHGRIMESKI

SEQ ID NO: 23584 - protein, 220 aa, Zea mays
MAANGGGYRAEDDYDYLFKVVLIGDSGVGKSNLLSRFTKNEFSLESKSTIGVEFATRSLQVDGKVIKAQIWDTAGQERYRAITSAYYRGAVGALLVYDVTRRATFDNVGRWLRELRDHTDQSIVVMLVGNKSDLRHLVAVSTDDAKEFAEAESMYFMETSALDATNVDSSFSEVLTQIYQIVSKKTVEASEEGAAAPGKGEKINVKDDVSAMKRVGCCSN

SEQ ID NO: 23585 - protein, 128 aa, Ambrosia trifida
  Sequence also found in Organisms: Arnica chamissonis, Artemisia annua, Centaurea maculosa, Cicer arietinum, Chrysanthemum coronarium, Cichorium intybus, Cirsium arvense and additional organisms as disclosed in Tables xx and yy
MQIFVKTLTGKTITLEVESSDTIDNVKAKIQDKEGIPPDQQRLIFAGKQLEDGRTLADYNIQKESTLHLVLRLRGGIIEPSLMALARKYNQDKTICRKCYARLHPRAVNCRKKKCGHSNQLRPKKKIK

SEQ ID NO: 23586 - protein, 395 aa, Solanum lycopersicum
MALQASSLLPSTFSKGKASATLKNSSIFGASLSDYTKSDFGSSSFRVKNQRRSSNGGVVRATMVASPGVTTNSPSGKKTLRKGCVIVTGASSGLGLATAKALSETGKWHVIMACRDFLKAEKAAKSVGMPKENYTIMHLDLASLDSVRQFVDNFRRSGRPLDVLVANAAVYQPTAKEPSFTAEGFELSVGTNHLGHFLLSRLLLDDLKQSDYPSKRLIIVGSITGNTNTLAGNVPPKANLGDLRGMAGGLNGINSSAMIDGGEFDGAKAYKDSKVCNMLTMQEFHRRYHEETGITFASLYPGCIATTGLFREHIPLFRLLFPPFQKYITKGYVSETESGKRLAQVVSDPSLTKSGVYWSWNKDSASFENQLSEEASDAEKARKVWEVSEKLVGLA

SEQ ID NO: 23587 - protein, 1564 aa, Oryza sativa
MGTPVNIIVGSHVWAEDPDDAWIDGEVVEIRGGDATIVSTDGKTIVASLASIYPKDTEAPPAGVDDMTKLAYLHEPGVLHNLACRYGINEIYTYTGNILIAVNPFRRLPHLYDVHMMEQYKGAAFGELSPHLFAIADACYRAMINEQGSQSILVSGESGAGKTETTKMLMRYLAFMGGRSGTEGRTVEQQVLESNPVLEAFGNAKTVKNNNSSRFGKFVEIQFDKYGKISGAAVRTYLLERSRVCQVSDPERNYHCFYMLCSAPPEDVKKFKVGDPRSFHYLNQTNCYEVANVDDAREYLETRNAMDVVGIGQEEQDAIFRVVAAILHLGNINFSKGQEIDSSKLRDEKSVYHLKIVAELLMCDEKALQDSLCERVIVTPDGNITKPLDPDSAALSRDALAKTVYSRLFDWIVDKINNSIGQDPDATNIIGVLDIYGFESFKINSFEQLCINLTNEKLQQHFNQHVFKMEQEDYTREEIDWSYVEFVDNQDVLDLIEKKPGGIIALLDEACMFPKSTHETFAQKMYQTYKAHKRFSKPKLARTAFTINHYAGDVTYQADQFLDKNKDYVVAEHQALLNSSRCPFVANLFPPLPEETSKQSKFSSIGTRFKQQLQALMETLSTTEPHYIRCVKPNAVLKPGIFENFNVLNQLRCGGVLEAIRISCAGYPTKRTFDEFIDRFGMLAAELVDSSDEKAACAAICDKMGLKGYQIGKTKVFLRAGQMAELDARRAEVLANAARLIQRRIKTHLTRKEFINLRKASIQSQKFWRARLARIFFEHMRRNAASIRIQKHARTHSARKSYLQMYESAIVIQTGLRAMAACNEHRFRRETKASIIIQTRWRQHKAYVDYKKQKRATLILQCLWRARIARKELRKLKMEARETGALKEAKDKLEKRVEELTWRLDVEKHLRIDLEEAKGQEISNLKSVLQEMQEKLSEAHAAIEKEKEDAKLAIEQAPPKIVEVPVVDNAKVELLTRQNKELEDELVTFRTKAEDLEKRLLEVQKESDELSREILEKDSKLNQLQEMIERLETNLSSLESENQVLRQQSLLASADDDKSKQIESLESKIAILESENQLLRSKSSVAVQAVITPEVIQPSAMEGLVNRYQLEEHKILIEEVVVPPIKNLSKQKSLTDRQQENHDVLIKSLAEDRRFDNGRPAAACIVYKSLLHWHSFEAEKTNIFDRIIHTIRSSIEHAESSTELAYWLSTTSTLLYLLQNTLKSSSSAGKGSNRSRTTTGNLFSRMVQNARSSSLGSGISSGYSGMVGRPDTASKVEAKYSALRFKQQLTAYVEKIYGMIRDNLKKEINPFLIMCIQAPRAVRVRSSRGSLKSVHSNSLSRQTSSVHWQSIIKCLNHTLETMNNNHVPPMIIRKTFNQAFAFMNVQLFNSLLLRRECCSFSNGEFLKAGLQELEQWCSVTTEEYAGTSWDEFQHIRQAVGFLVLHQKTHKTLEEITDELCPVLSITQIYRIGTMFWDDKYGAQGLSQEVIGKMRTMATDDSITTPNSSFLLDDDSSIPISLDDIARLMLDIDLSDVEPTPLLRQNSQFHFLLQHHATQTDGIVC

SEQ ID NO: 23588 - protein, 675 aa, Triticum aestivum
MATYEPKNILITGAAGFIASHVANRLIRSYPHYKIVVLDKIDYCSNLKNLNPSRPSPNFKFVKGDIASADLVNYLLITESIDTIMHFAAQTHVDNSFGNSFEFTKNNIYGTHVLLEACKVTGQIRRFIHVSTDEVYGETDEDAVVGNHEASQLLPTNPYSATKAGAEMLVMAYGRSYGLPVITTRGNNVYGPNQFPEKLIPKFILLAMKGLPLPIHGDGSNVRSYLYCEDVAEAFEVVLHKGEVGHVYNIGTVKERRVIDVASDICKLFGLDTEKVIRFVENRPFNDQRYFLDDQKLKKLGWAERTTWEEGLKKTIEWYTSNPDYWGDVAGALLPHPRMLMTPGVERHNWTEEIKSLASSPAEAKECSTVPAAATSKSTSSVPQKATYKFLIYGKTGWIGGLLGKICEKQGIPYEYGKGRLQERSQLLQDIRNVKPTHVFNAAGVTGRPNVDWCETHKQDTIRTNVVGTLNLADVCREQGLLMINYATGCIFEYNAEHPEGSGIGFKEEDTPNFVGSFYSKTKAMVEELLKDYDNVCTLRVRMPISSDLSNPRNFITKIARYDKVVNIPNSMTILDELLPISVEMAKRDCRGIWNFTNPGVVSHNEILEMYKEYINPDFKWTNFTLEEQAKVIVAPRSNNEMDASKLKSEFPELLSIKESLIRNVFEPNRKVSTN

SEQ ID NO: 23589 - protein, 388 aa, Hordeum vulgare
MALLKAARVADVPTLDVVVPDHLAAAARVRLDAESAAAAATTKRQQRGAGRRFAVIGHRGKGMNALASPDRRLQEVKENSVRSFNEAARFAVDYVEFDVQVTKDGCPVIFHDDIILTEEHGKISDKRVTDLQLEDFLQYGPQNKQGKNGKPLLRKMKDGRVLNWNVQSDDPLCTLQEAFEKVTPRLGFNVELKFDDHLAYEEEELTHILQAILKVVFECAKDRPIIFSSFQPDAAQLMRKLQSIYPVYFLTNGGTEIYADVRRNSLEEAVKLCLSTGMQGIVSEARAVFRFPTAIPMIKEADLSLLTYGTLNNVPEAVYMQHLMGVNGVIVDLVPEITGAVSNLIASPETDTEINDLSSQVVKDAASTPNFTQREISFLLRLMPELVQ

SEQ ID NO: 23590 - protein, 558 aa, Setaria italica
MRAGAAARRQPHAEAPRGVSPRAMSGAGAASSCRRRQLGVAVLLLLVALAAVLGGAEGKAHNYEDALQKSLLYFEAQRSGRLPHSQRVAWRHHSGLTDGLEQGVDLVGGYYDAGDHVKFGLPMAFTVTMLSWSLIEYGGDVAAAGELGHALEAVKWGTDYFIKAHTKPDELWAEVGDGDTDHYCWQRPEDMTTSRQAYKVDRDHPGSDVAGETAAAMAAASIVFRDSNPHYAHLLLHHAQQLFEFADKYRGKYDSSIAEVKSYYASVSGYKDELLWAALWLHRATGRADYLDYVVDNAHSFGGTGWAINEFSWDVKYAGVQILATRLLLRGEHAARHRSTLEQYRAKAEHYVCACLGRNADGGADANVERSPGGMLYIRQWNNMQYVTSAAFLLSAYSDYMAEAGVVTVQCGGGEAVAAEEVFALARAQVDYVLGTNPRGVSYLVGYGPKYPNRVHHRAASIVPYKHSKEFIGCTQGFDHWFGRRSSNPNVLVGAIVGGPDRRDRFRDNRENYMQTEACTYNTAPMVGMFAKLHRMARQEPERGPTPAAPVTSAASEV

SEQ ID NO: 23591 - protein, 181 aa, Gossypium hirsutum
  Sequence also found in Organisms: Zea mays, Pennisetum glaucum, Oryza sativa, Sorghum bicolor, Cynodon dactylon, Echinochloa colona, Setaria italica, Saccharum officinarum, Panicum virgatum
MGLAFGKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATTGEGLYEGLDWLSSNIASKA

SEQ ID NO: 23592 - protein, 550 aa, Oryza sativa
MAAAAAATATASSGLIRCATGGAPAHGHHQVFRCSAAKPSPLALRHRAGRPAPLQAFPEYDRVTPFDYDGEVDGGDGDDHPREECGVFGVVGDPDATSLCYLGLQKLQHRGEEGAGIAAAGDDGTIKLERGLGLVGDVFGDPARLGKLPGQAAIGHVRYSTAGAAASLRNVQPFLAGYRFGQLAVAHNGNLVNYQALRNKLEAQGSIFSTSSDTEVILHLIATSLSRPLLARICDACERLAGAYSLLFLTADKLLAVRDPFGFRPLVMGRRANGAIVFASETCALDLIDATYECEVEPGEVVVVDRRDMSVSSACLVPHRPRKSCVFEHIYFALPNSVVFGHAVHERRNAYGRALAEESPAPTADVVIPVPDSGFYAALGFSQTSGLEFQQGLIRWHYSGRSFIQPSQAIRDLAVKLKLAPVHGVIRGKSVVVVDDSLVRGTTSSKIVRLLRDAGAREVHMRIASPPVIGSCLYGIDTPSEGELISNRMDLEGVRRAIGCDSLAFLSLDKLHTIYGDEAHELCDACFSRNYPVLPTVPEPVPELVSAFED

SEQ ID NO: 23593 - protein, 336 aa, Gossypium hirsutum
MAPPELVQPSDKTNVFAKQVSLRNRAYVTFLAGNGDYVKGVVGLAKGLRKVKSAYPLVVAVLPDVPEEHRRILENQGCIVREIEPVYPPENQTQFAMAYYVINYSKLRIWEFVEYSKMIYLDGDIQVYDNIDHLFDLPDGHFYAVMDCFCEKTWSHTPQYRIGYCQQCPDKVKWPAEMGNPPSLYFNAGMFVFEPSLVTYESLLKTLKITQPTPFAEQDFLKMFFKDIYKPIPLIYNLVLAMLWRHPENVELEKVKVVHYCAAGSKPWRYTGKEANMQREDIKMLVQKWWDIYNDESLDYRTSAAEGGTETVNLQPFLVALSEVGAVHFVAAPSAA

SEQ ID NO: 23594 - protein, 220 aa, Zea mays
MAANGGGYRAEDDYDYLFKVVLIGDSGVGKSNLLSRFTKNEFSLESKSTIGVEFATRSLQVDGKVIKAQIWDTAGQERYRAITSAYYRGAVGALLVYDVTRRATFDNVGRWLRELRDHTDQSIVVMLVGNKSDLRHLVAVSTDDAKEFAEAESMYFMETSALDATNVDSSFSEVLTQIYQIVSKKTVEASEEGAVAPGKGEKINVKDDVSAMKRVGCCSN

SEQ ID NO: 23595 - protein, 395 aa, Solanum lycopersicum
MALQASSLLPSTFSKGKASATLKNSSIFGASLSDYTKSDFGSSSFRVKNQRRSSNGGVVRATMVASPGVTTNSPSGKKTLRKGCVIVTGASSGLGLATAKALSETGKWHVIMACRDFLKAEKAAKSVGMSKENYTIMHLDLASLDSVRQFVDNFRRSGRPLDVLVANAAVYQPTAKEPSFTAEGFELSVGTNHLGHFLLSRLLLDDLKQSDYPSKRLIIVGSITGNTNTLAGNVPPKANLGDLRGMAGGLNGINSSAMIDGGEFDGAKAYKDSKVCNMLTMQEFHRRYHEETGITFASLYPGCIATTGLFREHIPLFRLLFPPFQKYITKGYVSETESGKRLAQVVSDPSLTKSGVYWSWNKDSASFENQLSEEASDAEKARKVWEVSEKLVGLA

SEQ ID NO: 23596 - protein, 1549 aa, Oryza sativa
MGTPVNIIVGSHVWAEDPDDAWIDGEVVEIRGGDATIVSTDGKTIVASLASIYPKDTEAPPAGVDDMTKLAYLHEPGVLHNLACRYGINEIYTYTGNILIAVNPFRRLPHLYDVHMMEQYKGAAFGELSPHLFAIADACYRAMINEQGSQSILVSGESGAGKTETTKMLMRYLAFMGGRSGTEGRTVEQQVLESNPVLEAFGNAKTVKNNNSSRFGKFVEIQFDKYGKISGAAVRTYLLERSRVCQVSDPERNYHCFYMLCSAPPEDVKKFKVGDPRSFHYLNQTNCYEVANVDDAREYLETRNAMDVVGIGQEEQDAIFRVVAAILHLGNINFSKGQEIDSSKLRDEKSVYHLKIVAELLMCDEKALQDSLCERVIVTPDGNITKPLDPDSAALSRDALAKTVYSRLFDWIVDKINNSIGQDPDATNIIGVLDIYGFESFKINSFEQLCINLTNEKLQQHFNQHVFKMEQEDYTREEIDWSYVEFVDNQDVLDLIEKKPGGIIALLDEACMFPKSTHETFAQKMYQTYKAHKRFSKPKLARTAFTINHYAGDVTYQADQFLDKNKDYVVAEHQALLNSSRCPFVANLFPPLPEETSKQSKFSSIGTRFKQQLQALMETLSTTEPHYIRCVKPNAVLKPGIFENFNVLNQLRCGGVLEAIRISCAGYPTKRTFDEFIDRFGMLAAELVDSSDEKAACAAICDKMGLKGYQIGKTKVFLRAGQMAELDARRAEVLANAARLIQRRIKTHLTRKEFINLRKASIQSQKFWRARLARIFFEHMRRNAASIRIQKHARTHSARKSYLQMYESAIVIQTGLRAMAACNEHRFRRETKASIIIQTRWRQHKAYVDYKKQKRATLILQCLWRARIARKELRKLKMEARETGALKEAKDKLEKRVEELTWRLDVEKHLRIDLEEAKGQEISNLKSVLQEMQEKLSEAHAAIEKEKEDAKLAIEQAPPKIVEVPVVDNAKVELLTRQNKELEDELVTFRTKAEDLEKRLLEVQKESDELSREILEKDSKLNQLQEMIERLETNLSSLESENQVLRQQSLLASADDDKSKQIESLESKIAILESENQLLRSKSSVAVQAVITPEVIQPSAMEEEVVVPPIKNLSKQKSLTDRQQENHDVLIKSLAEDRRFDNGRPAAACIVYKSLLHWHSFEAEKTNIFDRIIHTIRSSIEHAESSTELAYWLSTTSTLLYLLQNTLKSSSSAGKGSNRSRTTTGNLFSRMVQNARSSSLGSGISSGYSGMVGRPDTASKVEAKYSALRFKQQLTAYVEKIYGMIRDNLKKEINPFLIMCIQAPRAVRVRSSRGSLKSVHSNSLSRQTSSVHWQSIIKCLNHTLETMNNNHVPPMIIRKTFNQAFAFMNVQLFNSLLLRRECCSFSNGEFLKAGLQELEQWCSVTTEEYAGTSWDEFQHIRQAVGFLVLHQKTHKTLEEITDELCPVLSITQIYRIGTMFWDDKYGAQGLSQEVIGKMRTMATDDSITTPNSSFLLDDDSSIPISLDDIARLMLDIDLSDVEPTPLLRQNSQFHFLLQHHATQTDGIVC

SEQ ID NO: 23597 - protein, 214 aa, Echinochloa colona
QHPKENGRAAAGDAVAVAVAVVEAAAAAPVAAAAADPRLQGISDAIRVVPHFPKEGIMFNDITTLLLRPGVFKDAVDLFVERYRGMGIHAVAGIEARGFIFGPAIALAIGAKFIPLRKPRKLPGEVISEKYVLEYGTDCLEMHVGAIEPAERVIIVDDLVATGGTLCAAIRLLERAGADVVECACLIGLPKFKNFYKLNGKPVYVLVESRESDK

SEQ ID NO: 23598 - protein, 716 aa, Setaria italica
MATADRNRSFMKDVKRVIIKVGTAVVTRHDGRLALGRLGALCEQVKELNTLGYEVIMVTSGAVGVGRQRLKYRKLVNSSFADLQKPQMELDGKACAAVGQSGLMALYDMLFTQLDVSSSQLLVTDNDFENPNFRERLRETVESLLDLKVVPVFNENDAISTRKAPYEDSSGIFWDNDSLAGLLAIELKADLLVLLSDVDGLYSGPPSEPQSKLIHTYIKEKHHNEITFGDKSRVGRGGMTAKVKAAFVASNSGTPVVITSGFASQSIVRVLQGEKIGTLFHKDANLWAPSKDVSAREMAVAARECSRRLQNLSSDERKKILLDVADALEANEDLIRAENEADVVAAQDAGYEKSLVARLTLKPGKIASLAKSIRTLANMEDPINQILKRTEVAEDLVLEKTSCPLGVLLIVFESRPDALVQIASLAIRSGNGLLLKGGKEAMRSNTILHKVITDALPDTVGKGLIGLVTSRDEIADLLKLDDVIDLVIPRGSNKLVSQIKASTKIPVLGHADGVCHVYIDKSANMDIAKRIVIDAKIDYPAACNAMETLLVHKDLIKSPGLDDILLSLKTEGVAIYGGPVAHEVLSIPKADSFHHEYSSMACTVEFVDDVQSAIDHIHRYGSAHTDCIVTTDSKVAETFLRQVDSAAVFHNASTRFSDGARFGLGAEVGISTGRIHARGPVGVEGLLTTRWIMRGSGQVVNGDKDVAYTHKNLPLQ

SEQ ID NO: 23599 - protein, 716 aa, Panicum virgatum
MATADRTRSFMKDVKRVIIKVGTAVVTRHDGRLALGRLGALCEQVKELNTLEYEVIIVTSGAVGVGRQRLKYRKLVNSSFADLQKPQMELDGKACAAVGQTGLMALYDMLFNQLDVSSSQLLVTDSDFENPNFRERLRETVESLLDLKVVPVFNENDAISTRKAPYEDSSGIFWDNDSLAGLLAIELKADLLVLLSDVDGLYSGPPSEPQSKIIHTYIKEKHHNEITFGDKSRVGRGGMTAKVKAAFVASNSGTPVVITSGFASQSILRVLQGEKIGTLFHKDASLWEPSKDVSAREMAVAARECSRRLQNLSSDERKKILLDVADALEANEDLIRAENEADVLAAQDAGYEKSLVARLTLKPGKIASLAKSIRTLANMEDPINQILKRTEIAENLVLEKTSCPLGVLLIVFESRPDALVQIASLAIRSGNGLLLKGGKEAMRSNTILHKVITDALPDSVGKRLIGLVTSRDEIADLLKLDDVIDLVIPRGSNKLVSQIKASTKIPVLGHADGVCHVYIDKSADMDIAKRIVMDAKIDYPAACNAMETLLVHKDLIKSPGLDDILISLKTEGVSIYGGPVAHEVLSIPKADSFHHEYSSMACTVEFVDDVQSAIDHIHRYGSAHTDCIVTTDSKVAETFLRQVDSAAVFHNASTRFSDGARFGLGAEVGISTGRIHARGPVGVEGLLTTRWIMRGSGQVVNGDKDVAYTHQNLPLQ

SEQ ID NO: 23600 - protein, 716 aa, Oryza sativa
MASVDPSRSFVRDVKRVIIKVGTAVVSRQDGRLALGRVGALCEQVKELNSLGYEVILVTSGAVGVGRQRLRYRKLVNSSFADLQKPQMELDGKACAAVGQSGLMALYDMLFNQLDVSSSQLLVTDSDFENPKFREQLTETVESLLDLKVIPIFNENDAISTRKAPYEDSSGIFWDNDSLAGLLALELKADLLILLSDVDGLYSGPPSEPSSKIIHTYIKEKHQQEITFGDKSRVGRGGMTAKVKAAVLASNSGTPVVITSGFENRSILKVLHGEKIGTLFHKNANLWESSKDVSAREMAVAARDCSRRLQNLSSEERKKILLDVADALEANEDLIRSENEADVAAAQVAGYEKPLVARLTIKPGKIASLAKSIRTLANMEDPINQILKKTEVADDLVLEKTSCPLGVLLIVFESRPDALVQIASLAIRSGNGLLLKGGKEAIRSNTILHKVITDAIPRNVGEKLIGLVTTRDEIADLLKLDDVIDLVIPRGSNKLVSQIKASTKIPVLGHADGICHVYIDKSADMDMAKHIVMDAKIDYPAACNAMETLLVHKDLMKSPGLDDILVALKTEGVNIYGGPIAHKALGFPKAVSFHHEYSSMACTVEFVDDVQSAIDHIHRYGSAHTDCIVTTDDKVAETFLRRVDSAAVFHNASTRFSDGARFGLGAEVGISTGRIHARGPVGVEGLLTTRWILRGRGQVVNGDKDVVYTHKSLPLQ

SEQ ID NO: 23601 - protein, 716 aa, Oryza sativa
MASVDPSRSFVRDVKRVIIKVGTAVVSRQDGRLALGRVGALCEQVKELNSLGYEVILVTSGAVGVGRQRLRYRKLVNSSFADLQKPQMELDGKACAAVGQSGLMALYDMLFNQLDVSSSQLLVTDSDFENPKFREQLTETVESLLDLKVIPIFNENDAISTRKAPYEDSSGIFWDNDSLAGLLALELKADLLILLSDVDGLYSGPPSEPSSKIIHTYIKEKHQQEITFGDKSRVGRGGMTAKVKAAVLASNSGTPVVITSGFENRSILKVLHGEKIGTLFHKNANLWESSKDVSTREMAVAARDCSRHLQNLSSEERKKILLDVADALEANEDLIRSENEADVAAAQVAGYEKPLVARLTIKPGKIASLAKSIRTLANMEDPINQILKKTEVADDLVLEKTSCPLGVLLIVFESRPDALVQIASLAIRSGNGLLLKGGKEAIRSNTILHKVITDAIPRNVGEKLIGLVTTRDEIADLLKLDDVIDLVIPRGSNKLVSQIKASTKIPVLGHADGICHVYIDKSADMDMAKHIVMDAKIDYPAACNAMETLLVHKDLMKSPGLDDILVALKTEGVNIYGGPIAHKALGFPKAVSFHHEYSSMACTVEFVDDVQSAIDHIHRYGSAHTDCIVTTDDKVAETFLRRVDSAAVFHNASTRFSDGARFGLGAEVGISTGRIHARGPVGVEGLLTTRWILRGRGQVVNGDKDVVYTHKSLPLQ

SEQ ID NO: 23602 - protein, 122 aa, Lippia dulcis
KSVSRSSKAGLQFPVGRIARFLKAGKYAERVGAGAPVYLSAVLEYLAAEVLELAGNAARDNKKNRIVPRHIQLAVRNDEELSKLLGHVTIANGGVLPNIHQTLLPKKAGGRDKEIGSASQEF

SEQ ID NO: 23603 - protein, 124 aa, Brassica napus
ATKSVSRSSKAGLQFPVGRIARFLKAGKYAERVGAGAPVYLSAVLEYLAAEVLELAGNAARDNKKTRIVPRHIQLAVRNDEELSKLLGAVTIANGGVLPNIHSNLLPSKVGKNKGDIGSASQEF

SEQ ID NO: 23604 - protein, 126 aa, Tripterygium wilfordii
GSTKGGRGKPKATKSVSRSSKAGLQFPVGRIARFLKAGKYAERVGAGAPVYLSAVLEYLAAEVLELAGNAARDNKKNRIVPRHIQLAVRNDEELSKLLGSVTIANGGVLPNIHQTLLPKKMGKGKG

SEQ ID NO: 23605 - protein, 137 aa, Selaginella moellendorffii
MAAGGGGRGKSAGKKATSRSSKAGLQFPVGRIARFLKAGKYAERVGAGAPVYLAAVLEYLAAEVLELAGNAARDNKKNRIVPRHIQLAVRNDEELSKLLGSVTIAAGGVLPNIHNVLLPKKTGTGSSKKDAAGDESP

SEQ ID NO: 23606 - protein, 150 aa, Oryza sativa
MGSNTEVEKKKAPTALAPIAKPLAGKKLCKRTLKLVRRASEAKCLKRGVKEVVKSIRRGNKGLCVIAGNISPIDVITHVPILCEEANIPYIYVPSKEDLATAGTTKRPTCCVLVMTKPAKGEINEEVKEKLKSDYDHVVAEVAEVTSSMF

SEQ ID NO: 23607 - protein, 150 aa, Oryza sativa
MGSDTEVEKKKAPTALAPIAKPLAGKKLCKRTLKLVRRASEAKCLKRGVKEVVKSIRRGNKGLCVIAGNISPIDVITHVPILCEEANIPYIYVPSKEDLATAGTTKRPTCCVLVMTKPAKGEINEEVKEKLKSDYDHIVAEVAEVTSSMF

SEQ ID NO: 23608 - protein, 485 aa, Cajanus cajan
MGLGAQNGKVVESWDVCKSKGRKKKKQGDEEVEGAEAGCWVRLRFIGSCISSRSKVDSSVSGSGTSTHYAESKSTNDTSRDQPTVPAVSSTTTSNTESNSSTSKLEEELKIASRLRKFSFNDLKLATRNFRPESFLGEGGFGCVFKGWIEENGTAPVKPGTGLTVAVKTLNHDGLQGHKEWLAEVNFLGDLVHQNLVKLVGYCIEDDQRLLVYEFMPRGSLENHLFRRSLPLPWSIRMKIALGAAKGLAFLHEEAERPVIYRDFKTSNILLDADYNAKLSDFGLAKDGPEGDKTHVSTRVMGTYGYAAPEYVMTGHLTSKSDVYSFGVVLLEMLTGRRSMDKHRPNGEHNLVEWARPHLGERRRFYRLIDPRLEGHFSIKGAQKAAQLAAHCLSRDPKARPLMSEVVEALKPLPNLKDMASSSYYFQAMQADRFGASPNTRNGRTQGALLTRNGQQQRSLSIPNGTYASPYHQFPQPSPKPNGKA

SEQ ID NO: 23609 - protein, 485 aa, Glycine max
MGLGAENGKVVESWDVCKSKGRKKKKGDEGGEAEAGCWVRLRFIGSCISSRSKVDTSVSGSGTSTHYAESKSTNDTSRDQPTAPAVSSTTTSNAESNSSSTSKLEEELKIASRLRKFSFNELKLATRNFRPESFLGEGGFGCVFKGWIEENGTAPVKPGTGLTVAVKTLNHDGLQGHKEWLAEVNFLGDLVHPNLVKLVGYCIEEDQRLLVYEFMPRGSLENHLFRRSIPLPWSIRMKIALGAAKGLAFLHEEAERPVIYRDFKTSNILLDAEYNAKLSDFGLAKDGPEGDKTHVSTRVMGTYGYAAPEYVMTGHLTSKSDVYSFGVVLLEMLTGRRSMDKHRPNGEHNLVEWARPHLGERRRFYRLIDPRLEGHFSVKGAQKAALLAAHCLSRDPKARPLMSEVVEALKPLPNLKDMASSSYYFQAMQADRIGASPNTRNGRMQGALLTRNGQQQRSLSIPNGTYASPYHHQFPQPSPKPNGKA

SEQ ID NO: 23610 - protein, 484 aa, Phaseolus vulgaris
MGLGAENGKVVEPWDVCKSKGRKKKKGDEEVEGAGSGCWLRLRFIGSCISSRSKVDTSVSGSGTSTHYAESKSTNDTSRDQPTAPAVSSTTTSNAESNSSTSKLEEELKIASRLRKFSFNDLKLATRNFRPESFLGEGGFGCVFKGWIEENGTAPVKPGTGLTVAVKTLNHDGLQGHKEWLAEVNFLGDLVHPNLVKLVGYCIEDDQRLLVYEFMPRGSLENHLFRRSLPLPWSIRMKIALGAAKGLAFLHEEADRPVIYRDFKTSNILLDAEYNAKLSDFGLAKDGPEGDKTHVSTRVMGTYGYAAPEYVMTGHLTSKSDVYSFGVVLLEMLSGRRSMDKHRPNGEHNLVEWARPHLGERRRFYKLIDPRLEGHFSVKGAQKAAQLAAHCLCRDPKARPLMSEVVEALKPLPNLKDMASSSYYYQTMQADRIGASPNTRNGRTQGALLTRNGHQQRSLSIPNGTYASPYHQFPQPSPKPNGKA

SEQ ID NO: 23611 - protein, 432 aa, Tabernaemontana elegans
TKVDSSISGISTHCESKSANDTSRDQPVAAIISSTATSNGESNSSTTKLEEELKVASRLRKFTFNDLKLATRNFRPESLLGEGGFGCVFKGWIEENGTAPVKPGTGLTVAVKTLNHDGLQGHKEWLAEVSFLGDLIHPNLVKLIGYCIEDDQRLLVYEFMPRGSLENHLFRRSLPLPWSIRMKIALGAAKGLAFLHEEAERPVIYRDFKTSNILLDADYNAKLSDFGLAKDGPEGDKTHVSTRVMGTYGYAAPEYVMTGHLTSKSDVYSFGVVLLEMLTGRRSMDKNRPNGEHNLVEWARPHLGERRRFYRLIDPRLEGHFSIKGAQKAAQLAARCLSRDPKARPLMSEVVEALKPLPALKDMASSSYYFQTMQADRVGSSPNTRNGIRSQAATFSRNGQPHPRSLSIPNGSHASPYHHQFPHNSPKPNGKQ

SEQ ID NO: 23612 - protein, 417 aa, Malus domestica
IKSINDTSRDQPTATVVSSSTTSNTESNASTSKLEEELKVASRLRKFTFIDLKLATRNFRPESLLGEGGFGCVFKGWIEENGTAPVKPGTGLTVAVKTLNHDGLQGHKEWLAEVNYLGDLVHPNLVKLIGYCIEDDQRLLVYEFMPRGSLENHLFRRSLPLPWSIRMKIALGAAKGLAFLHEEAERPVIYRDFKTSNILLDADYNAKLSDFGLAKDGPEGDKTHVSTRVMGTYGYAAPEYVMTGHLTSKSDVYSFGVVLLEMLTGRRSMDKNRPNGEHNLVEWARPHLGERRRFYRLIDPRLEGHFSIKGVQKAAQLAAHCLSRDPKARPLMSEVVEALKPLPALKDMASSSYYFQTMQGDRVGSSPNTRNGVRPQGGLLTRNGHNQQRSLSIPNGTHASPYHLQHPQPSPKPNGKS

SEQ ID NO: 23613 - protein, 384 aa, Triticum aestivum
MALLKAARVADVPTLDVVVPDHLTAAARVLDAESVATMKRQQRGAGRRFAVIGHRGKGMNALASPDRRLQEVKENSVRSFNEAARFAVDYVEFDVQVTKDVCPIIFHDNFIITEEHGKISEKRVTDLQLEDFLQYGPQNKQGKNGKPLLRKMKDGRVLNWSVQSDDPLCTLQEAFEKVNPRLGFNVELKFDDNLVYQDEELTHILQAILKVVFECAKDRPIIFSSFQPDAAQLMRKLQSTYPVYFLTNGGTEVYADVRRNSLEEAVKLCLATGMQGIVSEARAVFRFPTAIPKIKEADLSLLTYGTLNNVPEAVYMQHLMGVNGVIVDLVPEITGAVSDLIAVPEIDTEINDLSSQAVKDAASTPNFTQREISFLLRLMPELVQ

SEQ ID NO: 23614 - protein, 384 aa, Triticum aestivum
MALLKAARVADVPSLDVVVPDHLAAAARVLDAESAAAMKRQQRGAGRRFAVIGHRGKGMNALASPDRRLQEVKENSIRSFNEAARFAVDYVEFDVQVTKDVCPVIFHDNFIVTEEHGKISEKRVTDLQLEDFLQYGPQNKQGKNGKPLLRKMKDGRVLNWNVQSDDPLCTLQEAFEKVNPRLGFNVELKFDDNLVYQDEELTHILQAILKVVFECAKDRPIIFSSFQPDAAQLMRKLQSTYPVYFLTNGGTEVYADVRRNSLEEAVKLCLASGMQGIVSEARAVFRFPTAIPKIKEADLSLLTYGTLNNVPEAVYMQHLMGVNGVIVDLVPEITGAVSDLIAVPETDVEINDLSGQVAKDAASTPNFTQREISFLLRLMPELVQ

SEQ ID NO: 23615 - protein, 382 aa, Secale cereale
MALLKAARVADVPTLDVVVPDHLAAAAARALDAEAAATMKRHQRRQFAVIGHRGKGMNALASPDRRLQEVKENSVRSFNEAARFAVDYVEFDVQVTKDGCPVIFHDNFIITEEHGKISDKRVTDLQLEDFLQYGPQNKQGKNGKPLLRKMKDGRVLNWNVQSDDPLCTLQEAFEKVNPRLGFNVELKFDDNLVYQDEELTHILQAILKVVFECAKDRPIIFSSFQPDAAQLMRKLQSTYPVYFLTNGGTEIYADVRRNSLEEAVKLCLATGMQGIVSEARAIFRFPTAIPKIKEADLSLLTYGTLNNVPEAVYMQHLMGVNGVIVDLVPEITGAVSDLIAIPETDTEINDLSSQVVKDAALTPNFTPREISFLLRLMPELVQ

SEQ ID NO: 23616 - protein, 384 aa, Triticum aestivum
MALLKAARVADVPTLDVVVPDHLTAAARVLDAESVAMMKKQQRGAGRRFAVIGHRGKGMNALASPDRRLQEVKENSVRSFNEAARFAVDYVEFDVQVTKDVCPVIFHDNFIITEEHGKISEKRVTDLQLEDFLQYGPQNKQGKNGKPLLRKMKDGRLLNWNVQSDDPLCTLQEAFEKVNPRLGFNVELKFDDNLVYQDEELTHILQAILKVVFECAKDRPIIFSSFQPDAAQLMRKLQSTYPVYFLTNGGTEVYADVRRNSLEEAVKLCLASGMQGIVSEARAVFRFPTAIPKIKEADLSLLTYGTLNNVPEAVYMQHLMGVNGVIVDLVPEITGAVSDLITVPETDTEVNDLGSQAVKDAASTPNFTQREISFLLRLMPELVQ

SEQ ID NO: 23617 - protein, 383 aa, Triticum aestivum
MALLKAARVADVPSLDVVVPDHLAAAARVLDAEAASMVKKQRGAGRRFAVIGHRGKGMNALASPDRRMQEVKENSVRSFNEAARFAVDYVEFDVQVTKDVCPVIFHDNFIITEEHGKISEKRVTDLQLEDFLQYGPQNKQGKNGKPLLRKMKDGRVLNWNVQSDDPLCTLQEAFEKVNPRLGFNVELKFDDNLVYQDEELTHILQAILKVVFECAKDRPIIFSSFQPDAAQLMRKLQSTYPVYFLTNGGTEVYADVRRNSLEEAVKLCLASGMQGIVSEARAVFRFPTAIPKIKEADLSLLTYGTLNNVPEAVYMQHLMGVNGVIVDLVPEITGAVSDLIAVPETDVEINDLSGQVAKDAASTPNFTQREISFLLRLMPELVQ

SEQ ID NO: 23618 - protein, 376 aa, Lolium multiflorum
MALLKAARVSDVPTLDVLVPDLAAAARIGPGAKQQRAAGRLALIGHRGKGMNALSSPDRRLQEVKENSVRSFNEAARFAIDYVEFDVQVTKDACPIIFHDNFIFTEEQGKVSDRRVTDLRLEEFLQYGPQNKEGKNGKPLLRKMKDGRVLNWNVQSDDPLCTLQEAFEKVNPRLGFNVELKFDDNLVYQEEELSHILEAILKVVFEYAKDRHIIFSSFQPDAAQLMRKMQSTYPVYFLTNGGTEIYTDVRRNSLEEAVKLCLASGMQGIVSEARAIFRFPAAIPKIKEADLSLLTYGTLNNVPEAVYMQHLMGVNGVIVDLVPEITKAISDLIATPQTDIEIEDLSSKVMKDATSTPNFTHREISFLLRLMPELVQ

SEQ ID NO: 23619 - protein, 503 aa, Cenchrus ciliaris
MDARWAVLLLALLVASAGAGGAGAAGVKGASWVGGLSRASFPKGFVFGTATSAYQVEGAASTNGRGPSIWDAFAHIPGKVAGNQNGDVAVDQYHRYKEDVDLMKSLNFDAYRFSISWSRIFPDGEGRVNPEGVAYYNNLINYLLQKGMTPYINLYHYDLPLALEQKYGGWLSSKMADLFTEYADFCFKTYGDRVKHWFTFNEPRIVAMLGYDAGSNPPQRCTKCAAGGNSATEPYIVAHNFLLAHAAAAARYRTKYQAAQKGKIGIVLDFNWYEALTNSPDDQAAAQRARDFHIGWFVDPLINGHYPQIMQDLVKERLPRFTPEQAKLVKGSADYIGINQYTASYMQGQKLLQQTPTSYSADWQVQYVFARNGKPIGPQANSNWLYIVPWGMYGCVNYLKQKYGNPTVYITENGMDQPGNLTRDQYLRDVTRVRFYKSYLGQLKKAIDQGANVAGYFAWSLLDNFEWLSGYSSKFGIVYVDFNKNLERHPKASAYWFRDMLKH

SEQ ID NO: 23620 - protein, 497 aa, Pennisetum glaucum
MDARWAVLLALLVASAGAAGAKGANGVGGLSRASFPKGFVFGTATSAYQVEGAASTNGRGPSIWDAFAHIPGKIAGNQNGDVAVDQYHRYKEDVDLMKSLNFDAYRFSISWSRIFPDGEGRVNPEGVAYYNNLINYLLQKGMTPYINLYHYDLPLALEQKYGGWLSSKMVDLFTEYADFCFKTYGDRVKHWFTFNEPRIVALLGYDAGSNPPQRCTKCAAGGNSATEPYIVAHNFLLAHAAAAARYRTKYQAAQKGKIGIVLDFNWYEALTNSPDDQAAAQRARDFHIGWFVDPLINGHYPQIMQDLVKERLPKFTPEQAKLVKGSADYIGINQYTASYMQGQKLLQQTPTSYSADWQVQYVFARNGKPIGPQANSNWLYIVPWGMYGCVNYLKQKYGNPTVYITENGMDQPGNLTRDQYLRDVTRVRFYKSYLGQLKKAIDQGANVAGYFAWSLLDNFEWLSGYSSKFGIVYVDFNKNLERHPKASAYWFRDMLKH

SEQ ID NO: 23621 - protein, 500 aa, Echinochloa colona
MDARWAAVLLALLVASGGGVRAAGVKGANWLGGLSRASFPKGFVFGTATSAYQVEGAASTNGRGPSIWDAFAHTPGKIAGNQNGDVAVDQYHRYKQDVDLMKSLNFDAYRFSISWSRIFPDGEGKVNPEGVAYYNNLINYLLQKGMTPYINLYHYDLPLALEKKYGGWLSAKMADLFTEYADFCFKTYGDRVKHWFTFNEPRIVALLGYDSGSNPPQRCTQCAAGGNSATEPYIVAHNFLLAHAAAVARYRAKYQAAQKGKVGIVLDFNWYEPLTNSPDDQAAAQRARDFHIGWFVDPLINGHYPQIMQDLVKERLPRFTPEQARLVKGSADYIGINQYTASYMKGQKLLQQTPTSYSADWQVQYVYARNGKPIGPQANSNWLYIVPWGMYGCVNYLKEKYGNPVVYITENGMDQPGNLTRDEYLRDVTRVRFYRSYIGQLKKAIDQGANVAGYFAWSLLDNFEWLSGYTSKFGIVYVDFNTLERHPKASAYWFRDMLKH

SEQ ID NO: 23622 - protein, 504 aa, Sorghum bicolor
MDARWAVLLALLVASGGGGGVRVCAAGAKGANWLAGLSRASFPKGFVFGTATSAYQVEGAASTNGRGPSIWDSFAHVPGNIAGNQNGDVAVDQYHRYKEDVDLMKSLNFDAYRFSISWSRIFPDGEGKVNPEGVAYYNNLINYLLQKGMTPYINLYHYDLPLALEKKYGGWLSAKMADLFTDYADFCFKTYGDRVKHWFTFNEPRIAALLGYDVGSNPPQRCTKCAAGGNSATEPYIVAHNFLLAHAAAVARYRTKYQAAQKGKVGIVLDFNWYEALTNSPDDQAAAQRARDFHIGWFVDPLINGHYPQIMQDLVKERLPRFTPEQAKLVKGSADYIGINEYTSSYMKGQKLLQQTPSSYSADWQVQYVFARNGKPIGPKANSNWLYIVPTGMYGCVNYLKEKYGNPTVYITENGMDQPGNLTRDQYLRDATRVRFYRSYIGQLKKAIDQGANVAGYFAWSLLDNFEWLSGYSSKFGIVYVDFNTLERHPKASAYWFRDMLQKH

SEQ ID NO: 23623 - protein, 501 aa, Saccharum officinarum
MDARWAVLLALLVASGGVRVYAAGAKGANWLGGLSRASFPKGFVFGTATSAYQVEGAASTNGRGPSIWDSFAHVPGNIAGNQNGDIAVDQYHRYKEDVDLMKSLNFDAYRFSISWSRIFPDGEGRVNPEGVAYYNNLINYLLQKGMTPYINLYHYDLPLALEKKYGGWLSAKMADLFTDYADFCFKTYGDRVKHWFTFNEPRIVALLGYDVGSNPPQRCTKCAAGGNSATEPYIVAHNFLLAHAAAVARYRTKYQAAQKGKVGIVLDFNWYEALTNSPDDQAAAQRARDFHIGWFVDPLINGHYPQIMQDLVKERLPRFTPEQAKLVKGSADYIGINEYTASYIKGGKLVQQTPSSYSADWQVQYVFARNGKPIGPQANSNWLYIVPTGMYGCVNYLKEKYGNPTVYITENGMDQPGNLTRDQYLRDTTRVRFYRSYIGQLKKAIDQGANVAGYFAWSLLDNFEWLSGYSSKFGIVYVDFNTLERHPKASAYWFRDMLQKH

SEQ ID NO: 23624 - protein, 502 aa, Zea mays
MDARWAVLLALLVASGGVRVCAAAGAKGANWLGGLSRASFPKGFVFGTATSAYQVEGAASTNGRGPSIWDSFAHVPGNIAGNQNGDVAVDQYHRYKEDVDLMKSLNFDAYRFSISWSRIFPDGEGKVNPEGVAYYNNLINYLLQQGMTPYINLYHYDLPLALEKKYGGWLSAKMADLFTDYADFCFKTYGDRVKHWFTFNEPRIVALLGYDTGSNPPQRCTRCAAGGNSATEPYIVAHNFLLAHATAVARYRTKYQAAQKGKVGIVLDFNWYEALTNSPDDQAAAQRARDFHIGWFVDPLINGHYPQIMQDLVKERLPRFTPEQAKLVKGSADYIGINEYTSSYMKGQKLVQLAPSSYSADWQVQYVFARNGKPIGPQANSKWLYIAPTGMYGCVNYLKEKYGNPTIYITENGMDQPGNLTRDQYLRDATRVRFYRSYIGQLKKAIDQGANVAGYFAWSLLDNFEWLAGYSSKFGIVYVDFNTLERHPKASAYWFRDMLQKH

SEQ ID NO: 23625 - protein, 504 aa, Oryza sativa
MAARRANCALVLVLALALLAARDAGAAAVPKPNWLGGLSRAAFPKRFVFGTATSAYQVEGMAASGGRGPSIWDAFAHTPGNVAGNQNGDVATDQYHRYKEDVNLMKSLNFDAYRFSISWSRIFPDGEGRVNQEGVAYYNNLINYLLQKGITPYVNLYHYDLPLALEKKYGGWLNAKMADLFTEYADFCFKTFGNRVKHWFTFNEPRIVALLGYDQGTNPPKRCTKCAAGGNSATEPYIVAHNFLLSHAAAVARYRTKYQAAQQGKVGIVLDFNWYEALSNSTEDQAAAQRARDFHIGWYLDPLINGHYPQIMQDLVKDRLPKFTPEQARLVKGSADYIGINQYTASYMKGQQLMQQTPTSYSADWQVTYVFAKNGKPIGPQANSNWLYIVPWGMYGCVNYIKQKYGNPTVVITENGMDQPANLSRDQYLRDTTRVHFYRSYLTQLKKAIDEGANVAGYFAWSLLDNFEWLSGYTSKFGIVYVDFNTLERHPKASAYWFRDMLKH

SEQ ID NO: 23626 - protein, 504 aa, Oryza sativa
MAARRANCALVLVLALALLAARDAGAAAVPKPNWLGGLSRAAFPNRFVFGTATSAYQVEGMAASGGRGPSIWDAFAHTPGNVAGNQNGDVATDQYHRYKEDVNLMKSLNFDAYRFSISWSRIFPDGEGRVNQEGVAYYNNLINYLLQKGITPYVNLYHYDLPLALEKKYGGWLNAKMADLFTEYADFCFKTFGNRVKHWFTFNEPRIVALLGYDQGTNPPKRCTKCAAGGNSATEPYIVAHNFLLSHAAAVARYRTKYQAAQQGKVGIVLDFNWYEALSNSTEDQAAAQRARDFHIGWYLDPLINGHYPQIMQDLVKDRLPKFTPEQARLVKGSADYIGINQYTASYMKGQQLMQQTPTSYSADWQVTYVFAKNGKPIGPQANSNWLYIVPWGMYGCVNYIKQKYGNPTVVITENGMDQPANLSRDQYLRDTTRVHFYRSYLTQLKKAIDEGANVAGYFAWSLLDNFEWLSGYTSKFGIVYVDFNTLERHPKASAYWFRDMLKH

SEQ ID NO: 23627 - protein, 507 aa, Triticum aestivum
MAARSAVLLLLALVAAACHGVGAAGAGASPRRPNWLGGLSRASFPKGFVFGTATSAYQVEGMAAGGGRGPSIWDAFAHVPGNIAGNQNADVTTDQYHRYKEDVNLMKGLNFDAYRFSISWSRIFPDGDGKVNKEGVAYYNNLINYLLQKGITPYINLYHYDLPLALEKKYGGWLNAKTVGLFADYADFCFKTFGDRVKHWFTFNEPRIVALLGYDVGSNPPQRCSKCAAGGNSATEPYIVAHNFLLAHGYAVARYRTKYQAAQKGKVGIVLDFNWYEALTNSTEDQAAAQRARDFHVGWFVDPLINGHYPQIMQDLVKERLPRFTPDEAKLVKGSADYIGINQYTASLMKGQKLTQQTPTSYSADWQVTYAFERNGKPIGPKANSNWLYIVPSGMYGCVHYLSQKYGNPAIVITENGMDQPGGLTRDQYLRDATRVRFYRSYLSELKKAIDGGANVLGYFAWSLLDNFEWISGYSSKFGIVYVDFNSPTLDRHPKASAYWFRDLLQH

SEQ ID NO: 23628 - protein, 508 aa, Secale cereale
MAARSALLLLLLALVVAACHGVSAAGAGASPRRANWLGGLSRASFPKGFVFGTATSAYQVEGMANAGGRGPSIWDAFAHVPGNIAGNQNADVTTDQYHRYKEDVNLMKGLNFDAYRFSISWSRIFPDGDGKVNQEGVAYYNNLINYLLQKGITPYINLYHYDLPLALEKKYGGWLNAKTVGLFADYADFCFKTFGDRVKHWFTFNEPRIVALLGYDVGSNPPQRCSKCAAGGNSATEPYIVAHNFLLAHGYAVARYRTKYQAAQKGKVGIVLDFNWYEALTNSTDDQAAAQRARDFHVGWFVDPLINGHYPQIMQDLVKERLPRFTPSEAKLVKGSADYIGINQYTASLMKGQKLLQQTPTSYSADWQVTYAFERNGKPIGPKANSNWLYIVPSGMYGCVHYLSQKYGNPPIVITENGMDQPGGLTRDQYLRDATRVRFYRSYLGELKKAIDGGANVLGYFAWSLLDNFEWISGYSSKFGIVYVDFNSPTLDRHPKASAYWFRDLLQH

SEQ ID NO: 23629 - protein, 501 aa, Hordeum vulgare
MAARSALLLALVAAAAAACHGVGAAGANWLGGLSRASFPKGFVFGTATSAYQVEGMATGGGRGPSIWDAFAHVPGNIAGNQNADVTTDQYHRYKEDVNLMKGLNFDAYRFSISWSRIFPDGDGKVNQEGVAYYNNLINYLLQKGITPYINLYHYDLPLALEKKYGGWLNAKTVGLFADYADFCFKTFGDRVKHWFTFNEPRIVALLGYDVGSNPPQRCSKCTAGGNSATEPYIVAHNFLLAHGYAVARYRTKYQAAQKGKVGIVLDFNWYEALTNSTEDQAAAQRARDFHVGWFVDPLINGHYPQIMQDLVKERLPKFTPAEAKMVMGSADYIGINQYTASLMKGQKLLQQTPTSYSADWQVTYAFERNGKPIGPKANSNWLYIVPSGMYGCVHYLSQKYGNPPIVITENGMDQPGGLTRDQYLRDTTRVRFYRSYLSELKKAIDGGANVLGYFAWSLLDNFEWMSGYSSKFGIVYVDFNSPNLDRHPKASAYWFRDLLRH

SEQ ID NO: 23630 - protein, 508 aa, Secale cereale
MATRSALLLLLLSLVVAACHGVSAAGAGATPRRANWLGGLSRASFPKGFVFGTATSAYQVEGMAAGGGRGPSIWDAFAHVPGNIAGNQNADVTTDQYHRYKEDVNLMKGLNFDAYRFSISWSRIFPDGDGKVNHEGVAYYNNLINYLLQKGITPYINLYHYDLPLALEKKYGGWLNAKTVGLFADYADFCFKTFGDRVKHWFTFNEPRIVALLGYDVGSNPPQRCSKCAAGGNSATEPYIVAHNFLLAHGYAVARYRTKYQAAQKGKVGIVLDFNWYEALTNSTEDQAAAQRARDFHVGWFVDPLINGHYPQIMQDLVKERLPRFTPSEAKLVKGSADYIGINQYTASLMKGQKLLQQTPTSYSADWQVTYAFERNGKPIGPKANSNWLYIVPSGMYGCVHYLSQKYGNPPIVITENGMDQPGGLTRDQYLRDATRVRFYRSYLGELKKAIDGGANVLGYFAWSLLDNFEWISGYSSKFGIVYVDFNSPTLDRHPKASAYWFRDLLQH

SEQ ID NO: 23631 - protein, 507 aa, Triticum aestivum
MAARLVVVLLLLALVAACHGVSAAAAGASPRRPNWLGGLSRASFPKGFVFGTATSAYQVEGMANAGGRGPSIWDAFAHVPGNIAGNQNADVTTDQYHRYKEDVNLMKGLNFDAYRFSISWSRIFPDGDGKVNQEGVAYYNNLINYLLQKGITPYINLYHYDLPLALEKKYGGWLNAKTVGLFADYADFCFKTFGDRVKHWFTFNEPRIVALLGYDVGSNPPQRCSKCAAGGNSATEPYIVAHNFLLAHGYAVARYRTKYQAAQKGKVGIVLDFNWYEALTNSTEDQAAAQRARDFHVGWFVDPLINGHYPQIMQDLVKERLPRFTPSEAKLLKGSADYIGINQYTASLMKGQKLLQQTPTSYSADWQVTYAFERNGKPIGPKANSNWLYIVPSGMYGCVHYLSQKYGNPPIVITENGMDEPGGLTREQYLRDATRVRFYRSYLGELKKAIDGGANVLGYFAWSLLDNFEWSSGYSSKFGIVYVDFSSPTLDRHPKASAYWFRDLLQH

SEQ ID NO: 23632 - protein, 475 aa, Avena sativa
WLGGLSRASFPKGFVFGTATSAFQVEGMANGGGRGPSIWDEFAHTPGKIAGNGNADVTTDQYHHYKEDVNLMKGLNFDAYRFSISWSRIFPDGEGKVNEEGVAYYNNLINYLLQKGITPYINLYHYDLPLALEKKYGGWLNAKTVELFTNYADFCFKTFGNRVKHWFTFNEPRIVSLLGYDAGSNPPQRCTKCAAGGNSATEPYIVGHNFLLAHGYAVARYRSKYQAAQQGKVGIVLDFNWYEALTNSIEDQAAAQRARDFHIGWFVDPLINGHYPQIMQDLVKERLPKFTPDQAKMIKGSADYIGINQYTASYMKGQKLLQQTPTSYSADWQVTYAYARNGKPIGPKANSDWLYMAPFGMYGCVNYIKQKYGNPAVFITENGMDQPGNLTRDQYLRDTTRVRFYRSYLNELKKGIDNGANVVGYFAWSLLDNFEWSSGYTSKFGIVYVDFNSPSLERHPKASAYWFRDLLQVKH

SEQ ID NO: 23633 - protein, 163 aa, Cenchrus ciliaris
RILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATTGEGLYEGLDWLSSNIASKA

SEQ ID NO: 23634 - protein, 164 aa, Heritiera littoralis
MRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATSGEGLYEGLDWLSNNIASKA

SEQ ID NO: 23635 - protein, 164 aa, Bupleurum chinense
  Sequence also found in Organisms: Trifolium pratense, Conyza canadensis, Gerbera hybrid cultivar, Primula obconica, Vinca minor
MRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATSGEGLYEGLDWLSNNIANKA

SEQ ID NO: 23636 - protein, 164 aa, Amaranthus tuberculatus
MRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELREAVLLVFANKQDLPNAMNAAEITDKLGLHSLRQRHWYIQSTCATSGEGLYEGLDWLSNNIASKA

SEQ ID NO: 23637 - protein, 164 aa, Cynara scolymus
MRILMVGLDAAGKTTILYKLKLGDIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATSGEGLYEGLDWLSNNIANKA

SEQ ID NO: 23638 - protein, 164 aa, Panax ginseng
MRILMVGLDAAGKTTILYKLKLGEIVTTIPTIGFNVETVEYKNISFTVWDVGGQDKIRPLWRHYFQNTQGLIFVVDSNDRDRVVEAKDELHRMLNEDELRDAVLLVFANKQDLPNAMNAAEITDKLGLHSLRQRHWYIQSTCATSGEGLYEGLDWLSNNIANKA

SEQ ID NO: 23639 - protein, 164 aa, Panax ginseng
MRILMVGLDAAGKTTILYKLKLGEIVTTIPTIGFNVETVEYKNISFTVWDVGGQDKIRPLWRHYFQNTQGLIFVVDSNDRERVVEARDELHRMLNEDELRDAVLLVFANKQDLPNAMNAAEITDKLGLHSLRQRHWYIQSTCATSGEGLYEGLDWLSNNIANKA

SEQ ID NO: 23640 - protein, 164 aa, Lippia dulcis
MRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATSGEGLYEGLDWLSNNIANKS

SEQ ID NO: 23641 - protein, 164 aa, Orobanche aegyptiaca
MRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLQSLRQRHWYIQSTCATSGEGLYEGLDWLSNNIANKA

SEQ ID NO: 23642 - protein, 164 aa, Rosmarinus officinalis
MRILMVGLDAAGKTTILYKLKLGEIVTTIPTIGFNVETVEYKNISFTVWDVGGQDKIRPLWRHYFQTTQGLIFVVDSNDRDRVVEARDELHRMLNEDELKDAVLLVFANKQDLPNAMNAAEITDKLGLHSLRQRHWYIQSTCATSGEGLYEGLDWLSNNIANKA

SEQ ID NO: 23643 - protein, 160 aa, Brachypodium distachyon
MVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATSGEGLYEGLDWLSSNIASKS

SEQ ID NO: 23644 - protein, 161 aa, Flaveria ramosissima
LMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATSGEGLYEGLDWLSNNIANKA

SEQ ID NO: 23645 - protein, 174 aa, Fraxinus spp
AFQPSVRKERDADTYVGLDAAGKTTILCKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATSGEGLYEGLDWLSNNIANKA

SEQ ID NO: 23646 - protein, 163 aa, Heritiera littoralis
RILMVGLDAAGKTTILYKLKLGEIVTTIPTIGFNVETVEYKNISFTVWDVGGQDKIRPLWRHYFQNTQGLIFVIDSNDRDRVVEARDELHRMLNEDELRDAVLLVFANKQDLPNAMNAAEITDKLGLHTLRQRQWYIQSTCATSGEGLYEGLDWLSNNIANKA

SEQ ID NO: 23647 - protein, 164 aa, Utricularia gibba
MRILMVGLDAAGKTTILYKLKLGEIVTTIPTIGFNVETVEYKNISFTVWDVGGQDKIRPLWRHYFQNTQGLIFVVDSNDRDRIVEARDELHRMLGEDELRDAVLLVFANKQDLPNAMNAAEITDKLGLHSLRQRLWYIQSTCATSGEGLYEGLDWLSSNIGPKG

SEQ ID NO: 23648 - protein, 160 aa, Allium cepa
MVGLDAAGKTTILYKLKLGEIVTTIPTIGFNVETVEYKNISFTVWDVGGQDKIRPLWRHYFQNTQGLIFVVDSNDRDRAVEARDELHRMLNEDELRDAVLLVFANKQDLPNAMNAAEITDKLGLHSLRQRHWYIQSTCATSGEGLYEGLDWLSSNIASKS

SEQ ID NO: 23649 - protein, 182 aa, Trifolium pratense
MGLTVSRLMRLFYAKKDMRILMVGLDAAGKTTILYKLKLGEIVTTIPTIGFNVETVEYKNISFTVWDVGGQDKIRPLWRHYFQNTQGLIFVVDSNDRERILEARDELHRMLSEDELRDATLLVFANKQDLPNALTVSEITDKLGLHSLRQRRWYIQSTCATSGQGLYEGLDWLSSNISNKIR

SEQ ID NO: 23650 - protein, 158 aa, Centaurea maculosa
GLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATSGEGLYEGLDWLSNNIANKA

SEQ ID NO: 23651 - protein, 181 aa, Capsicum annuum
MGMSISKFVKMLFAKKDMRILMVGLDAAGKTTILYKLKLGEIVNTIPTIGFNVETVEYKNSSFTVWDVGGQDKIRPLWRHYFQNTQGLIFVVDSNDRDRISEARDELHRMINEEELRGATILVFANKQDLPNAMNVAEITDKLGLHSLRQRRWYIQSACATSGQGLYEGLDWLSHNITGKA

SEQ ID NO: 23652 - protein, 160 aa, Rosmarinus officinalis
MVGLDAAGKTTILYKLKLGEIVTTIPTIGFNVETVEYKNISFTVWDVGGQDKIRPLWRHYFQNTQGLIFVVDSNDRDRIVEARDELHRMLNEDELRDAVLLVFANKQDLPNTMNAAEITDKLGLHSLRQRHWYIQSTCATSGEGLYEGLDWLSNNIANKA

SEQ ID NO: 23653 - protein, 160 aa, Picea glauca
MVGLDAAGKTTILYKLKLGEIVTTIPTIGFNVETVEYKNISFTVWDVGGQDKIRPLWRHYFQNTQGLIFVVDSNDRDRVAEARDELHRMLNEDELRDAVLLVFANKQDLPNAMTAAEITDKLGLHSLRQRHWYIQSTCATSGEGLYEGLDWLSNNIANKA

SEQ ID NO: 23654 - protein, 182 aa, Triticum aestivum
MGLSFGKLFSRLFSSTKDVRILMVGLDAAGKTTILYKLKLGEIVTTIPTIGFNVETVEYKNISFTVWDVGGQDKIRPLWRHYFQNTQGLIFVVDSADRERVTEAAEELQKMLNEDELRDAVLLVFANKQDLPNAMTVAEVTDKLGLHSLHRRKWFIQSTCATNGEGLYEGLDWLSNVLSGKS

SEQ ID NO: 23655 - protein, 181 aa, Papaver somniferum
MGVTFTKLFSQLFAKKSMRILMVGLDAAGKTTILYKLRLGEIVSTIPTIGFNVENVEYKNISFTVWDVGGQDKIRPLWKYYYQNTQGLIFVVDSNDRERIVEARDELHKLMNEDELRNAVLLIFANKQDLPNAMSAAEITDKLGLHSVRKRRWYIQSTCATSGEGLYEGLEWLSSNAANVA

SEQ ID NO: 23656 - protein, 156 aa, Ambrosia trifida
DAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATSGEGLYEGLDWLSNNIANKA

SEQ ID NO: 23657 - protein, 180 aa, Amborella trichopoda
MGLTISSLLTRLFGKKQMRILMVGLDAAGKTTILYKLKLGEIVTTIPTIGFNVETVEYRNICFTVWDVGGQDKIRPLWRHYFQNTQGLIYVVDSNDRERIGEAERELANMLKEDELRDAVLLVFANKQDLPNAMTAAELTDKLGLNSLRGRHWYIQSTCATQGHGLYEGLDWLSNELAKK

SEQ ID NO: 23658 - protein, 205 aa, Gerbera hybrid cultivar
SNARLLFDRPLSKSFISGILTSNKRGLTFTKLFSRLFAKKKMQILMGGLDAAGKTTILYKLKLGEIGTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATSGEGLYEGLDWLSNNIANKA

SEQ ID NO: 23659 - protein, 156 aa, Bupleurum chinense
MQLGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATSGEGLYEGLDWLSNNIANKA

SEQ ID NO: 23660 - protein, 166 aa, Panax ginseng
ERMRILMVGLDAAGKTTILYKLKLGEIVTTIPTIGFNVETVEYKNIQFTVWDVGGQDKIRPLWRHYFQNTQGIIFVVDSNDRDRVVEAREELQRMLNEDELRDALLLVFANKQDLPNAMNAAEITDKLGLHSLRQRAWYIQSTCATSGDGLYEGLEWLSNSLRKAG

SEQ ID NO: 23661 - protein, 152 aa, Pteridium aquilinum
KTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATSGEGLYEGLDWLSNNIANKA

SEQ ID NO: 23662 - protein, 187 aa, Castanea mollissima
SLLLHNNGFIFWKLFARLFGKKDMRILMVGLDAAGKTTILYKLKLGEIVTTIPTIGFNVETVEYKNINFTVWDVGGQDKIRPLWRHYFQNTQGLIFVVDSNDRERINEANEELQKMLNEDELRDAVLLVFCNKQDLPNAMSVAEVTDKLGLHSLRNRKWYIQSTCATSGDGLYEGLDWLSNTLSSSK

SEQ ID NO: 23663 - protein, 157 aa, Picea glauca
RILMVGLDAAGKTTILYKLKLGEIVTTIPTIGFNVETVEYKNIQFTVWDVGGQDKIRPLWRHYFQNTQGIIFVVDSNDRDRIVEAREELQRMLNEDELRDALLLVFANKQDLPNAMNAAEITDKLGLHSLRQRAWYIQSTCATSGDGLYEGLDWLSN

SEQ ID NO: 23664 - protein, 161 aa, Taxus baccata
ILMVGLDAAGKTTILYKLKLGEIVTTIPTIGFNVETVEYKNIQFTVWDVGGQDKIRPLWRHYFQNTQGIIFVVDSNDRDRIVEAREELQRMLNEDELRDALLLVFANKQDLPNAMNAAEITDKLGLHSLRQRAWYIQSTCATSGDGLYEGLEWLSNSLRKA

SEQ ID NO: 23665 - protein, 160 aa, Taxus baccata
RILMVGLDAAGKTTILYKLKLGEIVTTIPTIGFNVETVEYKNIQFTVWDVGGQDKIRPLWRHYFQNTQGIIFVVDSNDRDRVVEAREELQRMLNEDELRDALLLVFANKQDLPNAMNAAEITDKLGLHSLRQRAWYIQSTCATSGDGLYEGLEWLSNSLR

SEQ ID NO: 23666 - protein, 149 aa, Allium cepa
ILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATSGEGLYEGLDWLSSNIASKG

SEQ ID NO: 23667 - protein, 148 aa, Cenchrus ciliaris
LYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATSGEGLYEGLDWLSSNIASKS

SEQ ID NO: 23668 - protein, 147 aa, Avena sativa
GKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAARITDKLGLHSLRQRHWYIQSTCATSGEGLYEGLDWLSS

SEQ ID NO: 23669 - protein, 152 aa, Triticum aestivum
PTPILYKLKLGEIVTTIPTIGFNVETVEYKNISFTVWDVGGQDKIRPLWRHYFQNTQGLIFVVDSNDRERVVEARDELHRMLNEDELCDAVLLVFANKQDLPNAMNAAEITDKLGLHSLRQRHWYIQSTCATSGEGLYEGLDWLSNNIANKA

SEQ ID NO: 23670 - protein, 541 aa, Oryza sativa
MAAAAAAASTSRLLLLRHHHHAAADGSKQQQQLRYSSKPSSLALPRLRLLPAAGALLPDRVTPFSYEEDDESDDHPREECGLVGVVGDPDASSLCYLGLQKLQHRGEEGAGIVAVGGDGKLKSVTGLGLVADVFGDPARLASLPGPAAIGHVRYSTAGAAASLRNVQPFLAGYRFGQVAVAHNGNLVNYQALRNKLEARGSIFNTSSDTEVILHLIATSLSRPLLSRICDACERLAGAYSLLFLTADKMFAVRDPHGFRPLVLGRRRNGTVAFASETCALDLIEATYEREVEPGEVVVVDRRDMSVSSACLVPHRPRRSCVFEHIYFALPNSVVFSHAVHERRTAFGRALAEESPAAGADVVIPVPDSGFYAALGFARASGLEFQQGLIRWHYSGRSFIQPTQAIRDLAVKLKLAPVHGVIRGKSVVVVDDSLVRGTTSSKIVRLLRDAGAREVHMRIASPPVVGSCLYGIDTPSEGELISNRMDLEGVRREIGSDSLAFLSLGKLHSIYGAEAEGYCDACFSRNYPVLPTLPEPVVELEE

SEQ ID NO: 23671 - protein, 545 aa, Triticum aestivum
MAAAAAAPPATPSSRPLRAPPAPSTVHRQLRCHAGPSPSLLALRHRAARAAPARALLDKVTPFNFGEEEDDGGDDHPREECGVFGVVGDPEASSLCYLGLQKLQHRGEEGAGICAAGDDGKLKSVTGLGLVSDVFRDPAHLGSLPGQAAIGHVRYSTSGGDAQLCNVQPFLAGYRFGQLAVAHNGNLVNYLPLRHKLEAQGSIFNNSSDTEVILHLIATSLSRPLLARICDACERLQGAYSLLFLTADKLFAVRDPFGFRPLVMGRRPNGAVVFASETCALDLIDAVYEREVEPGEVIVVDRRDMSVSSACLVPHRPRKSCVFEHIYFALPNSIVFGHAVHERRTAYGRALAEESPAPTADVVIPVPDSGFYAALGFAQASGLEFQQGLIRSHYTGRSFIQPTQAIRDLAVKLKLAPVRGVITGKSVVVVDDSIVRGTTSSKIVRLLRDAGAREVHMRISSPPVVGRCHYGIDTPDEKELISNRLDVEGVREMIGCDSLGFLTLDKLHSIYGDEADELCDACFSRNYPVPMPEKVPAMASADDED

SEQ ID NO: 23672 - protein, 386 aa, Saccharum officinarum
MASLPASGAAGGDSDQLLVEADGSTRTLILNRPKKLNALSSTMIKGLLRCFAAYEKDDGVKLLIMKGKGRAFCAGGDVTACLQSVQNESWKWGADFFHDEYFLNYIIATYIKPQVSLLNGIVMGGGAGISLHGRFRVVTDNTVFAMPETALGHFPDVGASYFLSRLPGFYGEYVALAGARLDGEEMLACGLATHFVQSNRLLLLEESLKKLDTSNTSDVCGTIDQFAQQPSLKENSSLYRMEIINKCFAKRTVEEIISTLEQVASNLADEWVATTIQCLKQASPTSLKITLRSIREGRTQTVGECLHREYRMACHVLRGDFSRDCYEGYRSILVDKDRKPMWMPPRLEQVHDEAVEEYFSRIDDPQWEDLNLPARHSNGIIIESKL

SEQ ID NO: 23673 - protein, 386 aa, Setaria italica
MASLPPAGAAGADSDQLLVEANDSTRTLILNRPKQLNALSSAMIMGLLRCFTAYEKDDGVKLLIMKGKGRAFCAGGDVAAVVRAINNGSWKYGADFFRNEFLLNYIIATYSKPQVSLLAGIVMGGGAGVSLHGRFRVVTENTVFAMPETALGLFPDIGASYFLSRLPGFYGEYVALAGARLDGAEMHACGLATHFVQINRLPSLEESLKKVDTSNPFVVCGIIDQFAQQPSLKENSSLNRLEIINKCFSKRTVEEIISALEQETSNSADEWIASTIQSLKKASPTSLKISLRSIREGRIQTVGECLRREYRMVCHVMRGDFSRDFFEGCRAILVDKDRNPKWMPPRLEQVHDEAVEQYFSRIDDPQWEDLDLPARRSYGRIIESKL

SEQ ID NO: 23674 - protein, 383 aa, Pennisetum glaucum
MASLPPAGADSDQLLVEANGSTRTLILNRPKQLNALSSAMIMGLLRCFTAYEKDDGVKLLIMKGKGRAFCAGGDVAAVVRAINNGSWKYGADFFRNEFLLNYIIAMYSKPQVSLLAGIVMGGGAGVSLHGRFRVATENTVFAMPETALGLFPDIGASYFLSRLPGFYGEYVALAGARLDGAEMHACGLATHFVQINRLPSLEESLKKVDTSNPFVVCGIIDQFAQQPSLKENSSLNRLEIINKCFSKRTVEEIISALEQETSNLADEWIASTIQSLKKASPTSLKISLRSIREGRTQTVGECLRREYRMVCHVMRGDFSRDFFEGCRAILVDKDRNPKWMPPRLEQVHDEAVDQYFSRIDDPQWEDLDLPARPSYGRIIESKL

SEQ ID NO: 23675 - protein, 382 aa, Panicum virgatum
MASLPPGADSDQLLIEANGSTRTLILNRPKQLNALSSSMIMGLLRCFTAYEKDDGVKVLIMKGKGRAFCAGGDVAAVVRDINNDTWKYGADFFRNEFLLNYIIATYSKPQVSLLAGIVMGGGAGVSLHGRFRVATENTVFAMPETALGLFPDIGASYFLSRLPGFYGEYVALAGARLDGAEMHACGLATHFVQLNRLPLLEESLKKVDTSNPFALCGIIDQFSHQPSLKENSSLNRLEMINKCFSKRTVEEIIYALEQETSNSADEWVAATIQSLKKASPTSLKISLRSIREGRTQTIGECLRREYRMVCHVMRGDFSRDFFEGCRAILLDKDRNPKWMPPRLEQVHDAAVEQYFSRINDPQWEDLNLPARRSHGRNVESKL

SEQ ID NO: 23676 - protein, 336 aa, Ricinus communis
MAPELVHAALKPASFTKPPTLPSRAYVTFLAGNGDYIKGVVGLAKGLRKVKTAYPLVVAVLPDVPEEHRKILESQGCIVREIEPVYPPENQTQFAMAYYVINYSKLRIWEFVEYSKMIYLDGDIQVFDNIDHLFDLPDGHFYAVMDCFCEKTWSHTPQYKIGYCQQCPDRVKWPAKLGQPPSLYFNAGMFVFEPSISTYHDLLKTVQITPPTPFAEQDFLNMYFRDIYKPIPVVYNLVLAMLWRHPENVELDKVKVVHYCAAGSKPWRYTGKEENMEREDIKMVVKKWWDVYNDESLDYKKQPAADGDAEPMNLQPFIAALYEAGAVQYVTAPSAA

SEQ ID NO: 23677 - protein, 336 aa, Castanea mollissima
MAPELVPAAVKPASFSKPVQTMSNRAYVTFLAGNGDYVKGVVGLAKGLRKVKTAYPLVVAVLPDVPQEHRRILESQGCIVREIEPVYPPENQTQFAMAYYVINYSKLRIWEFVEYSKMIYLDGDIQVFDNIDHLFDLPDGHFYAVMDCFCEKTWGHTPQYKIGYCQQCPDRVRWPAEMGQPPSLYFNAGMFVFEPSLYTYHDLLKTVKITTPTTFAEQDFLNMYFRDIYKPLPLIYNLVLAMLWRHPENVELDKVKVAHYCATGSKPWRYTGKEENMQREDIKMLVKKWWDIYNDESLEYKRPVGVADGEEVKMQPFLAALSEAGAVQYVTAPSAA

SEQ ID NO: 23678 - protein, 336 aa, Quercus alba
MAPELVPAAVKPASFSKPVQTMLNRAYVTFLAGNGDYVKGVVGLAKGLRKVKTAYPLVVAVLPDVPQEHRRILESQGCIVREIEPVYPPENQTQFAMAYYVINYSKLRIWEFVEYSKMIYLDGDIQVFDNIDHLFDLPDGHFYAVMDCFCEKTWSHTPQYKVGYCQQCPDRVKWPAEMGQPPSLYFNAGMFVFEPSFYTYNDLLKTVKITTPTTFAEQDFLNMYFRNIYKPLPLIYNLVLAMLWRHPENVEFDKIKVVHYCAAGSKPWRYTGKEENMQREDIKMLVKKWWDIYNDESLDYKKPVEVADGEEVKMQPFLAALSEAGAVQYVTAPSAA

SEQ ID NO: 23679 - protein, 331 aa, Cajanus cajan
MAPELVPTLAKSGAAFTKPATLARRAYVTFLAGNGDYVKGVVGLAKGLRKVKTAYPLVVAVLPDVPQEHRNILESQGCIVREIEPVYPPENQTQFAMAYYVINYSKLRIWEFVEYSKMIYLDGDIQVYENIDHLFDLPDGNFYAVMDCFCEKTWSHTPQYKVGYCQQCPEKVQWPTKLGPPPSLYFNAGMFVFEPSLDTYHDLLKTVQVTTPTSFAEQDFLNMYFKDIYKPIPLAYNLVLAMLWRHPENVKLDQVKVVHYCAAGSKPWRYTGKEENMQREDIKMLVKKWWDIYNDSSLDYKGLSGSEDMEPFVQALSEVGHVQYVTAPSAA

SEQ ID NO: 23680 - protein, 345 aa, Prunus mume
MAPVLVPTSVAKSGFTIPATLPSRAYVTFLAGNGDYVKGVVGLAKGLRKVKTAYPLVVAVLPDVPQEHRRILESQGCIVGEIEPVCPPENQTRFAMAYYVINYSKLRIWEFVEYSKMIYLDGDIQVYDNIDHLFDLPDGHFYAVMDCFCEKTWSHTPQYKIGYCQQCPEKVQWPTSELGPPPSLYFNAGMFVFEPDLETYHDLLNTLKVTPPTPFAEQDYLNMFFRKIYKPIPLAYNLVLAMLWRHPENVELDKVKVVHYCAAGSKPWRYTGKEENMEREDIKMLVKKWWDIYNDTSLDYKKPSAPGARAAVVGGAEGEGVNMQPFIEALSEAGVVQYVTAPSAA

SEQ ID NO: 23681 - protein, 334 aa, Arachis hypogaea
MAPPELVPTAAAASAFTAKTATTLPRRAYVTFLAGNGDYVKGVVGLAKGLRKVKSAYPLVVAILPDVPEEHRQILESQGCIVREIEPVYPPENQTQFAMAYYVINYSKLRIWEFVEYSKMIYLDGDIEVYENIDHLFDLPDGKFYAVMDCFCEKTWSHSPQYKIGYCQQCPDKVQWPEELGQPPSLYFNAGMFVFEPSMETYHDLLRKLQITPPTPFAEQDFLNMYFKDIYQPIPLVYNLVLAMLWRHPENVDLDKVKVVHYCAAGSKPWRYTGKEENMQREDIKMLVKKWWDVYYDASLDYKKPPLSSDEADPFVHVLSEAAEVHYVASASAA

SEQ ID NO: 23682 - protein, 343 aa, Eutrema halophilum
MAPELTQTNTAKSAVTITKPPPQIYGGDRAYVTFLAGNGDYVKGVVGLAKGLRKVKSAHPLVVAVLPDVPEEHRRLLVEQGCIVREIEPVYPPENQTQFAMAYYVINYSKLRIWKFVEYSKLIYLDGDIQVYDNIDHLFDLDDGYFYAVMDCFCEKTWSHTPQYKIGYCQQCPEKVQWPKAELGEPPALYFNAGMFVFEPDLNTYEDLLRTLKITPPTPFAEQDFLNMYFKKIYKPIPLVYNLVLAMLWRHPENVELDKVKVVHYCAAGSKPWRYTGKETNMEREDIKMLVNKWWDIYNDDSLDYTKSVADLERDSDMVNLKPFITALTEAGRVKYVTAPSAA

SEQ ID NO: 23683 - protein, 339 aa, Cicer arietinum
MAPELVPTAAKSVTGFTKPATIPKRAFVTFLAGNGDYVKGVIGLAKGLRKVKTAYPLVVAVLPDVPEEHREMLESQGCIVREIEPVYPPENQTQFAMAYYVINYSKLRIWEFVEYSKMIYLDGDIQVYENIDHLFDLQDGYLYGVMDCFCEKTWSHTPQYKIGYCQQCPNKVQWPKEMGQPPSLYFNAGMFVFEPSIETYHDLLNTLQVTPPTPFAEQDFLNMYFKDIYKPIPLDYNLVLAMLWRHPQNVELRKVKVVHYCAAGSKPWRYTGKEENMQREDIKMLVQKWWDVYNDSSLDYSKSLNGSSETQRNDVENEPFVHALSEVGHVQYVTAPSAA

SEQ ID NO: 23684 - protein, 343 aa, Nicotiana benthamiana
MAPEIVKVSEKMVKPRIITSGDRAYVTFLAGNGDYVKGVVGLAKGLRKVKSAYPLVVAVLPDVPAEHRRILEEQGCIVREIEPVYPPENQTQFAMAYYVINYSKLRIWEFVEYKKMIYLDGDIQVYDNIDHLFDLPDGYVYAVMDCFCEKTWSHTPQYRIGYCQQCPDKVKWPTEELGQPPSLYFNAGMFVFEPSLHIYDDLLKTLQITPSTPFAEQDFLNMYFNDIYRPIPLVYNLVLAMLWRHPENVELDKVKVVHYCAAGSKPWRYTGKEENMQREDIKLLVKKWWDIYKDESLDYKNAVAVNNQVIAGAAEAVNQLQPLIAAAIAQAGAVKYVTAPSAA

SEQ ID NO: 23685 - protein, 338 aa, Ricinus communis
MAPHLASANLAANTNSLVKQASISSCAYVTFLAGDGDYVKGVVGLAKGLRKVKSKYPLVVAILPDVPEDHRKILVSQGCIVKEIEPVYPPENQTQFAMAYYVINYSKLRIWEFVEYSKMIYLDGDIQVFENIDHLFDLQNGYFYAVMDCFCEKTWSHSPQYKIGYCQQCPDRVKWPAEMGPKPPLYFNAGMFVFEPSLSTYDDLLNTVKLTPPTPFAEQDFLNMFFKDIYRPIPPIYNLVLALLWRHPENIEFEKVKVVHYCAAGSKPWRYTGKEDNMDREDIKMLVKKWWDIYEDESLDYKNTVAATGGATEGELQPFLAALSEAGVVHYVTAPSAA

SEQ ID NO: 23686 - protein, 326 aa, Thalictrum flavum
KTVGFTKQTSIPSKAFVTFLAGNGDYVKGVVGLAKGLRKVKSAYPLVVAILPDVPQEHRRILESQGCIVREIEPVYPPENQTQFAMAYYVINYSKLRIWEFVEYSKMIYLDGDIQVFENIDHLFDLPDGYFYAVMDCFCEKTWSHTPQYKLGYCQQCPNKVQWPAEMGQPPALYFNAGMFVYEPNLSTYDDLLKQVKITPPTPFAEQDFLNSFFKDIYKPIPLVYNLVLAMLWRHPENVELEKVKVVHYCAAGSKPWRYTGKEDNMDREDIKLLVKKWWDIYDDASLDYKRSVVPSSQESGEKLQQILAALSEAGVVHFVTAPSAA

SEQ ID NO: 23687 - protein, 347 aa, Malus domestica
MAPELVPTSVPKSGFTTPATMPSRAYVTFLAGNGDYVKGVVGLAKGLRKVKTAYPLVVAVLPDVPEDHRRILESQGCIVREIEPVYPPENQTQFAMAYYVINYSKLRIWEFVEYEKMIYLDGDIEVYDNIDHLFDLPDGHFYAVMDCFCEKTWSHTPQYQIGYCQQCPEKVQWPTSELGPPPSLYFNAGMFVFEPGLETYHDLLRTLRVTPPTPFAEQDFLNMYFRKIYKPIPLVYNLVLAMLWRHPENVELDKVKVVHYCAAGSKPWRYTGKEENMQREDIKMLVKKWWDIYNDESLDYKKAAGGAWAGGVVGPEAASGGEGVNMQPFIDALSEAAVQYVTAPSAA

SEQ ID NO: 23688 - protein, 349 aa, Prunus persica
MAPELVPTGVAKSGFTIPATVPSRAYVTFLAGNGDYVKGVVGLAKGLRKVKTAYPLVVAVLPDVPQEHRRILESQGCIVREIEPVCPPENQTQFAMAYYVINYSKLRIWEFVEYSKMIYLDGDIQVYDNIDHLFDLPDGHFYAVMDCFCEKTWSHTPQYKIGYCQQCPEKVQWPASELGPPPSLYFNAGMFVFEPDLETYHDLLNTLKVTPPTPFAEQDYLNMFFRKIYKPIPLAYNLVLAMLWRHPENVELDKVKVVHYCAAGSKPWRYTGKEENMEREDIKMLVKKWWDIYNDKSLDYKKPSAPGARAGTRAAVVGGAEGEGVNMQPFIEALSEAGVVQYVTAPSAA

SEQ ID NO: 23689 - protein, 297 aa, Zea mays
MAPPLALFLLAAIVLSRAVSHAHGGGGGFYDPASVTQLSSRPRAFLYSGFLSDTECDHLVSLAKGSMEKSMVADNDSGKSVASQARTSSGTFLAKREDEIVSAIEKRVAAWTFLPEENAESLQVLRYETGQKYDAHFDYFHDRNNLKLGGQRVATVLMYLTDVKKGGETVFPNAEGSHLQYKDETWSECSRSGLAVKPKKGDALLFFNLHVNATADTGSLHGSCPVIEGEKWSATKWIHVRSFDNPPDVRTDAPCSDDKELCPRWAAIGECHRNPTYMVGTKDTLGFCRKSCGICDA

SEQ ID NO: 23690 - protein, 301 aa, Panicum virgatum
MAPPPALLLLLVALALCPSPALSDAHGIGGGGFYDPARVTQLSWRPRAFLYSGFLSDGECDHLVNLAKGNMEKSMVADNDSGKSVMSQVRTSSGTFLVKHEDEIVSAIEKRVAAWTFLPEENAESIQVLRYEIGQKYDAHFDYFHDKNNLKRGGHRIATVLMYLTDVKKGGETVFPNAEGGHLQYKDETWSDCARSGLAVKPKKGDALLFFSLHVNATTDTSSLHGSCPVIEGEKWSATKWIHVRSFDNPPDVRTDVPCSDDNELCRKWAAIGECYKNPTYMVGTKDTLGFCRKSCGLCDA

SEQ ID NO: 23691 - protein, 297 aa, Pennisetum glaucum
MAPPPLAMLLLLALCLATALSRANGGGGFYDPARVTQLSWRPRAFLYSGFLSDSECDHLVNLAKGSMEKSMVADSDSGKSVMSQVRTSSGTFLDKHQDEIVSGIEKRVAAWTFLPEENAESMQVLHYEIGEKYDAHFDYFHDKNNLKLGGHRIATVLMYLSDVKKGGETVFPIAEGGHLQYKDDTWSDCARSGLAVKPKKGDALLFFSLHVNATTDTSSLHGSCPVIEGEKWSATKWIHVRSFDNPPNVRTDAPCSDDNELCAKWAAIGECYKNPTYMVGTKDTLGFCRKSCGLCDA

SEQ ID NO: 23692 - protein, 296 aa, Secale cereale
MPPLLLAALALALAPALSHAAAGGGAGFYDPARVTQISWRPRAFLYSGFLSHAECDHLIKLAKGRLEKSMVADTDSGKSVMSQVRTSSGTFLSKREDEIISGIEKRVAAWTFLPEENAESMQVLHYEVGQKYDAHFDYFSDKKNVKRGGHRVATVLMYLTDVKKGGETVFPIAEGGDLQHKDETWSECARHGLAVKPRKGDALLFFSLHVNATTDPSSLHASCPVVEGEKWSATKWIHVRSFDNPPAVMTDAPCSDDNEQCPRWAALGECYKNVKYMVGTKDTLGSCRKSCGVCDA

SEQ ID NO: 23693 - protein, 220 aa, Sorghum bicolor
MAANGGGYRAEDDYDYLFKVVLIGDSGVGKSNLLSRFTKNEFSLESKSTIGVEFATRSLQVDGKVIKAQIWDTAGQERYRAITSAYYRGAVGALLVYDVTRRATFDNVGRWLRELRDHTDQSIVVMLIGNKSDLRHLVAVSTDDAKEYAEAESMYFMETSALDATNVDNAFSEVLTQIYQIVSKKTVEAPEEGAAGPGKGEKINVKDDVSAMKRVGCCSN

SEQ ID NO: 23694 - protein, 220 aa, Saccharum officinarum
MAANGGGYRAEDDYDYLFKVVLIGDSGVGKSNLLSRFTKNEFSLESKSTIGVEFATRSLQVDGKVIKAQIWDTAGQERYRAITSAYYRGAVGALLVYDVTRRATFDNVGRWLRELRDHTDQSIVVMLIGNKSDLRHLVAVSTEDAKEFAEAESMYFMETSALDATNVDNAFSEVLTQIYQIVSKKTVEAPEEGAAGPGKGEKINVKDDVSAMKRGGCCSN

SEQ ID NO: 23695 - protein, 221 aa, Setaria italica
MAANGGGYRAEDDYDYLFKVVLIGDSGVGKSNLLSRFTKNEFSLESKSTIGVEFATRSLQVDGKVIKAQIWDTAGQERYRAITSAYYRGAVGALLVYDVTRRATFDNVGRWLRELRDHTDQSIVVMLIGNKSDLRHLVTISTEDAKEFAEAESMYFMETSALDATNVDNAFSEVLTQIYQIVSKKTVEAPEEGAAAPGKGEKINVKDDVSAMKRVGCCSSN

SEQ ID NO: 23696 - protein, 220 aa, Cynodon dactylon
MAGAGGGYRAEDDYDYLFKVVLIGDSGVGKSNLLSRFTKNEFSLESKSTIGVEFATRSLQVDGKVIKAQIWDTAGQERYRAITSAYYRGAVGALLVYDVTRRATFDNVGRWLRELRDHTDQSIVVMLIGNKSDLRHLVTVSTEDGKEFAEAESMYFMETSALDATNVDNAFSEVLTQIYQIVSKKTVEAPEEGSALPGKGEKINVKDDVSALKRAGCCSS

SEQ ID NO: 23697 - protein, 220 aa, Oryza sativa
MAAAAGGYRAEDDYDYLFKVVLIGDSGVGKSNLLSRFTKNEFSLESKSTIGVEFATRSLQVDGKVIKAQIWDTAGQERYRAITSAYYRGAVGALLVYDVTRRATFDNVGRWLRELRDHTDPSIVCMLIGNKSDLRHLVAVSTEDGKEFAEAESMYFMETSALDATNVDNAFAEVLTQIYQIVNKKPVEAPEDGSAGPGKGEKINVKDDVSAMKRVGCCSN

SEQ ID NO: 23698 - protein, 220 aa, Oryza sativa
MSAAAGGYRAEDDYDYLFKVVLIGDSGVGKSNLLSRFTKNEFSLESKSTIGVEFATRSLQVDGKVIKAQIWDTAGQERYRAITSAYYRGAVGALLVYDVTRRATFDNVGRWLRELRDHTDPSIVCMLIGNKSDLRHLVAVSTEDGKEFAEAESMYFMETSALDATNVDNAFAEVLTQIYQIVNKKPVEAPEDGSAGPGKGEKINVKDDVSAMKRVGCCSN

SEQ ID NO: 23699 - protein, 208 aa, Pennisetum glaucum
DYDYLFKVVLIGDSGVGKSNLLSRFTKNEFSLESKSTIGVEFATRSLQVDGKVIKAQIWDTAGQERYRAITSAYYRGAVGALLVYDVTRRATFDNVGRWLRELKDHTDQSIVVMLIGNKSDLRHLVTVSTEDAKEFAEAESMYFMETSALDATNVDNAFSEVLTQIYQIVSKKTVEAPEQGAAAPGKGEKINVKDDVSAMKRAGCCSN

SEQ ID NO: 23700 - protein, 222 aa, Brachypodium distachyon
MAGGGGSGAYRAEDDYDYLFKAVIIGDSGVGKSNLLSRFTKNEFCLESKSTIGVEFATRSLQVDGKVVKAQIWDTAGQERYRAITSAYYRGAVGALLVYDVTRRSTFDNVARWLKELRDHTDPSIVVMLVGNKSDLRHLVAVSTEDGQEYAEAESLYFMETSALDATNVDNAFAEVLTQIYQIASRKTVDAGEDGSAAPSKGEKINVKDDVSALKRVGCCSN

SEQ ID NO: 23701 - protein, 194 aa, Cenchrus ciliaris
GVGKSNLLSRFTKNEFSLESKSTIGVEFATRSLQVDGKVIKAQIWDTAGQERYRAITSAYYRGAVGALLVYDVTRRATFDNVGRWLRELRDHTDQSIVVMLIGNKSDLRHLVTVSTEDAKEFAEAESMYFMETSALDATNVDNAFSEVLTQIYQIVSKKTVEAPEEGAAAPGKGEKINVKDDVSAMKRAGCCSN

SEQ ID NO: 23702 - protein, 217 aa, Persea americana
MAAYKAEDDYDYLFKVVLIGDSGVGKSNLLSRFTKNEFSLESKSTIGVEFATRSLNVEGKVIKAQIWDTAGQERYRAITSAYYRGAIGALLVYDVTRHTTFENVERWLKELRDHTDPNIVVMLIGNKSDLRHLVAVSTEDGKSFAQRENLYFMETSALEATNVENAFAEVLTHIYHIVSKKAVEAGDGAAATVPSKGEKINVKDDVSAMKRVGCCSN

SEQ ID NO: 23703 - protein, 217 aa, Platanus occidentalis
MAGYRAEDDYDYLFKVVLIGDSGVGKSNLLSRFTKNEFSLESKSTIGVEFATRSLNVDGKVIKAQIWDTAGQERYRAITSAYYRGAVGALLVYDVTRHSTFENVERWLKELRDHTDPNIVVMLIGNKSDLRHLVAVSTEDGKSFAERESLYFMETSALEATNVDNAFAEVLTQIYRIVSKKAVETGDDGAASGVPSKGEKINVDDVSTLKRVGCCSN

SEQ ID NO: 23704 - protein, 217 aa, Secale cereale
  Sequence also found in Organisms: Triticum aestivum
MAAGYRAEDDYDYLFKVVLIGDSGVGKSNLLSRFTRNEFSLESKSTIGVEFATRSLQVDGKVVKAQIWDTAGQERYRAITSAYYRGAVGALLVYDVTRHATFENAERWLKELRDHTDPNIVVMLVGNKSDLRHLVAVPTDEGKAFAERESLYFMETSALESTNVEDAFAEVLKQIYRIVSKRAVEAGEDSAAGPGKGEKINMKDDVSAVKKGGCCSS

SEQ ID NO: 23705 - protein, 218 aa, Chelidonium majus
MAAYRAEDDYDYLFKVVLIGDSGVGKSNLLSRFTRNEFSLESKSTIGVEFATRSLNVDGKVIKAQIWDTAGQERYRAITSAYYRGAVGALLVYDVTRHATFENVERWLKELREHTDPNIVVMLIGNKADLRHLVAVSTEDGKSFAERESLYFMETSALEATNVENAFAEVLAQIYHIVSKKSVETGDEGATSAVPVKGERINVKDDVSALKRVGCCSS

SEQ ID NO: 23706 - protein, 218 aa, Manihot esculenta
MAGYRAEDDYDYLFKVVLIGDSGVGKSNLLSRFTRNEFSLESKSTIGVEFATRSLNVDGKVIKAQIWDTAGQERYRAITSAYYRGAVGALLVYDVTRHSTFENVERWLRELRDHTDPNIVVMLIGNKSDLRHLVAVSTEDGKSFAERESLYFMETSALEATNVENAFAEVLTQIYRIVSKKAMETGDEGAASAVPSQGEKIDVSKDVSAMKRVGCCSS

SEQ ID NO: 23707 - protein, 218 aa, Euonymus alatus
MAGYRAEDDYDYLFKVVLIGDSGVGKSNLLSRFTRNEFSLESKSTIGVEFATRSLNVDGKVIKAQIWDTAGQERYRAITSAYYRGAVGALLVYDVTRHSTFENIERWLRELRDHTDPNIVVMLIGNKSDLRHLVAVSTEDGKSFAERESLYFMETSALEATNVDSAFAEVLTQIYRIVSKKAMESGEDGAAAAVPSKGEKIDVSKDVSAVKKGGCCSS

SEQ ID NO: 23708 - protein, 218 aa, Olea europaea
MSGYRAEDDYDYLFKVVLIGDSGVGKSNLLSRFTRDEFSLESKSTIGVEFATRSLNVDGKVIKAQIWDTAGQERYRAITSAYYRGAVGALLVYDVTRNPTFENVGRWLRELRDHTDPNIVVMLVGNKSDLRHLVAVSTEDGKSFAEKESLYFMETSALEATNVENAFAEVLTQIYRIVSKKTMETGENGAASNIPSKGEKIDVSKDLSAMKSGGCCST

SEQ ID NO: 23709 - protein, 218 aa, Sesamum indicum
MAGYRAEDDYDYLFKVVLIGDSGVGKSNLLSRFTRNEFSLESKSTIGVEFATRSLTVDGKVIKAQIWDTAGQERYRAITSAYYRGAVGALLVYDVTRHSTFENVERWLRELRDHTDPNIVVMLIGNKSDLRHLVAVSTEDGTSFAERESLYFMETSALDATNVDNAFTEVLTQIYRIVSKKTMETGDDGAAANVPSKGEKIDVSKDVSAVKKAGCCSS

SEQ ID NO: 23710 - protein, 218 aa, Tripterygium wilfordii
MAGYRADDDYDYLFKVVLIGDSGVGKSNLLSRFTRNEFSLESKSTIGVEFATRSLNVDGKVIKAQIWDTAGQERYRAITSAYYRGAVGALLVYDVTRHSTFENVERWLRELRDHTDPNIVVMLIGNKSDLRHLVAVSTEDGKSFAERESLYFMETSALEATNVDSAFAELLTQIYRIVSKKAMESGEDGAAAAVPSKGEKIDVSKDVSAMKKGGCCSS

SEQ ID NO: 23711 - protein, 218 aa, Valeriana officinalis
MAGYRAEDDYDYLFKVVLIGDSGVGKSNLLSRFTRNEFSLESKSTIGVEFATRSLTVDTKVIKAQIWDTAGQERYRAITSAYYRGAVGALLVYDVTRHSTFENVERWLRELRDHTDPNIVVMLIGNKSDLRHLVAVPTDDAKSFAERESLYFMETSALEATNVENAFSEVLTQIYRIVSKKAMDTANDADGSAVPSKGEKIDVGKDVSAMKRVGCCSN

SEQ ID NO: 23712 - protein, 220 aa, Nuphar advena
MAIYRAEDDYDYLFKVVLIGDSGVGKSNLLSRFTKNEFSLESKSTIGVEFATRSLNVDGKVIKAQIWDTAGQERYRAITSAYYRGAVGALLVYDVTRHATFENVERWLKELRDHTDPNIVVMLIGNKSDLRHLVTVSTQDGKSFAERESLYFMETSALEATNVENAFAEVLTQIYHIVSKKAVGAGEDGAATTLPSKGERINIANKDDVSALKKIGCCSS

SEQ ID NO: 23713 - protein, 218 aa, Vaccinium corymbosum
MAGYRAEDDYDYLFKVVLIGDSGVGKSNLLSRFTRNEFSLESKSTIGVEFATRSLNVDGKVIKAQIWDTAGQERYRAITSAYYRGAVGALLVYDVTRHSTFENVERWLRELRDHTDPNIVVMLIGNKSDLRHLVAVSTEDGKSFAERESLFFMETSALEATNVENAFSEVLTQIYRIVSKKAMESADDGAASAVPSKGERIDVGKDVSAMKRVGCCSS

SEQ ID NO: 23714 - protein, 218 aa, Chelidonium majus
MGAYKAEDDYDYLFKVVLIGDSGVGKSNLLSRFTRNEFSLESKSTIGVEFATRSLNVDGKVIKAQIWDTAGQERYRAITSAYYRGAVGALLVYDVTRHATFESVERWLKELRNHTDPNIVVMLIGNKSDLRHLVAVSTEDGKSFAEQESLYFMETSALEATNVENAFAEVLTQIYRIVSKKAVEAGDDGSASAVPAKGEKINIKDDVSAMKKVGCCSS

SEQ ID NO: 23715 - protein, 218 aa, Euphorbia peplus
MAGYKAEDDYDYLFKVVLIGDSGVGKSNLLSRFTRNEFSLESKSTIGVEFATRSLTVDGKVIKAQIWDTAGQERYRAITSAYYRGAVGALLVYDVTRHSTFENVERWLRELRDHTDPNIVVMLIGNKSDLRHLVAVQTEDGKSFAERESLYFMETSALESTNVDNAFAEVLTQIYRIVSKKAMEAGDESATSAVPSKGEKINVNKDVSAMKRVPCCSS

SEQ ID NO: 23716 - protein, 218 aa, Euphorbia esula
MAGYKAEDDYDYLFKVVLIGDSGVGKSNLLSRFTRNEFSLESKSTIGVEFATRSLTVDGKVIKAQIWDTAGQERYRAITSAYYRGAVGALLVYDVTRHSTFENVERWLRELRDHTDPNIVVMLIGNKSDLRHLVAVQTEDGKSFAERESLYFMETSALESTNVDNAFAEVLTQIYRIVSKKAMEAGDESATSAVPSKGEKIHVNKDVSAMKRVGCCSS

SEQ ID NO: 23717 - protein, 216 aa, Rosa hybrid cultivar
MAGYRAEDDYDYLFKVVLIGDSGVGKSNLLSRFTRNEFSLESKSTIGVEFATRSLDVDGKVIKAQIWDTAGQERYRAITSAYYRGAVGALLVYDVTRNSTFESVERWLRELRDHTDPNIVVMLVGNKSDLRHLVAVSTEDGKSFAERESLYFMETSALEATNVDNAFAEVLTQIFHIVSKKTMEANNDAAAVPSQGEKIDVSKDVSAVKKGGCCSS

SEQ ID NO: 23718 - protein, 217 aa, Arachis hypogaea
MAGYRADDDYDYLFKVVLIGDSGVGKSNLLSRFTKNEFNLESKSTIGVEFATRTLNVDSKVIKAQIWDTAGQERYRAITSAYYRGAVGALLVYDVTRHATFENVDRWLKELRNHTDANIVVMLVGNKSDLRHLVAVSTEDGKSYAEKESLYFMETSALEATNVENAFAEVLTQIYRIVSKKAVEAAENGTAAVPAKGEKIDLKNDVSALKRVGCCSS

SEQ ID NO: 23719 - protein, 218 aa, Gossypium hirsutum
MSGYRAEDDYDYLFKVVLIGDSGVGKSNLLSRFTRNEFSLESKSTIGVEFATRSLNVDGKVIKAQIWDTAGQERYRAITSAYYRGAVGALLVYDVTRHSTFENVERWLRELRDHTDPNIVVMLIGNKSDLRHLVAVSTEDGKSFAEKEFLYFMETSALEATNVENAFAEVLTQIYHIMSKKAMETSEEGNASAVPSKGEKIDVSKDVSAMKKGGCCSS

SEQ ID NO: 23720 - protein, 218 aa, Gossypium raimondii
MAGYRAEDDYDYLFKVVLIGDSGVGKSNLLSRFTRNEFSLESKSTIGVEFATRSLNVDGKVIKAQIWDTAGQERYRAITSAYYRGAVGALLVYDVTRHSTFENVERWLRELRDHTDPNIVVMLIGNKSDLRHLVAVSTEDGKSFAEKEFLYFMETSALEATNVENAFAEVLTQIYHIMSKKAMETSEEGNASAVPSKGEKIDVSKDVSAMKKGGCCSS

SEQ ID NO: 23721 - protein, 218 aa, Papaver somniferum
MGAYKAEDDYDYLFKVVLIGDSGVGKSNLLSRFTRNEFSLESKSTIGVEFATRSLNVDGKVIKAQIWDTAGQERYRAITSAYYRGAVGALLVYDVTRHATFESVERWLKELRNHTDPNIVVMLIGNKSDLRHLVAVSTEDGTSFAERESLYFMETSALEATNVENAFAEVLTQIYRIVSKKAVEAGDDGSASAVPAKGEKINIKDDVSALKRVGCCST

SEQ ID NO: 23722 - protein, 218 aa, Scabiosa columbaria
MAGYRAEDDYDYLFKVVLIGDSGVGKSNLLSRFTRNEFSLESKSTIGVEFATRSLTVDTKVIKAQIWDTAGQERYRAITSAYYRGAVGALLVYDVTRHSTFESVERWLRELRDHTDPNIVVMLIGNKSDLRHLVAVSTEDGKSFAEKESLYFMETSALESTNVENAFSEVLTQIYRIVSKKAMETTNEGPGSAVPSKGEKIDVSKDVSAMKRVGCCST

SEQ ID NO: 23723 - protein, 218 aa, Fragaria vesca
MAGYRADDDYDYLFKVVLIGDSGVGKSNLLSRFTKNEFNLESKSTIGVEFATRTLNVDSKVIKAQIWDTAGQERYRAITSAYYRGAVGALLVYDVTRHATFENVDRWLKELRNHTDSNIVVMLVGNKSDLRHLVAVSTEDGKSYAEKESLYFMETSALEAVNVENAFAEVLTQIYHIVSKKAVEAGENGTASSVPAKGEKINIKDDVSALKRVGCCSS

SEQ ID NO: 23724 - protein, 218 aa, Fagus grandifolia
MAGYRAEDDYDYLFKVVLIGDSGVGKSNLLSRFTRNEFSLESKSTIGVEFATRSLNVDSKVIKAQIWDTAGQERYRAITSAYYRGAVGALLVYDVTRHSTFENVERWLRELRDHTDPNIVVMLIGNKSDLRHLVAVSTEDGKSFAERESLFFMETSALEATNVDNAFAEVLTQIYRIVSKKAMEAGDDAAASAVPSKGEKIDVGKEVSAVKRVGCCSS

SEQ ID NO: 23725 - protein, 218 aa, Plantago ovata
MAGYRAEDDYDYLFKLVLIGDSGVGKSNLLSRFTRNEFSLESKSTIGVEFATRSLTVDGKVIKAQIWDTAGQERYRAITSAYYRGAVGALLVYDVTRHSTFESVERWLKELRDHTDPNIVVMLIGNKSDLRHLVAVSTEDGTSFAERESLYFMETSALESTNVENAFTEVLTQIYHIVSKKTMEASENGAAANLPSKGEKIDVSKDVSAMKKPSCCSS

SEQ ID NO: 23726 - protein, 218 aa, Papaver somniferum
MGAYKAEDDYDYLFKVVLIGDSGVGKSNLLSRFTRNEFSLESKSTIGVEFATRSLNVDGKVIKAQIWDTAGQERYRAITSAYYRGAVGALLVYDVTRHATFESVERWLKELRNHTDPNIVVMLIGNKSDLRHLVAVSTEDGTSFAERESLYFMETSALEATNVENAFAEVLTQIYRIVSKKAVETGDDGSASAVPAKGEKINIKDDVSALKRVGCCST

SEQ ID NO: 23727 - protein, 218 aa, Gossypium hirsutum
MAGYRAEDDYDYLFKVVLIGDSGVGKSNLLSRFTRNEFSLESKSTIGVEFATRSLNVDGKVIKAQIWDTAGQERYRAITSAYYRGAVGALLVYDVTRHSTFENVERWLRELRDHTDPNIVVMLIGNKSDLRHLVAVPTEDGKSFAEKESLYFMETSALEATNVENAFAEVLTQIYHIVSKKAMETADEGTASTVPSKGEKIDVGKDISAMKKGGCCSS

SEQ ID NO: 23728 - protein, 216 aa, Castanea mollissima
GYRAEDDYDYLFKVVLIGDSGVGKSNLLSRFTRNEFSLESKSTIGVEFATRSLNVDSKVIKAQIWDTAGQERYRAITSAYYRGAVGALLVYDVTRHSTFENVERWLRELRDHTDPNIVVMLIGNKSDLRHLVAVSTEDGKSFAERESLFFMETSALEATNVDNAFAEVLTQIYHIVSKKAMETGDDAAASAVPSKGEKIDVSKDVSAVKRAGCCST

SEQ ID NO: 23729 - protein, 218 aa, Citrus clementina
MAGYRAEDDYDYLFKVVLIGDSGVGKSNLLSRFTRNEFSLESKSTIGVEFATRSLNVDGKVIKAQIWDTAGQERYRAITSAYYRGAVGALLVYDVTRHSTFENVERWLRELRDHTDPNIVVMLIGNKSDLRHLVAVSTEDGKSFAEKESLFFMETSALEATNVDNAFAEVLTQIYRIVSKKAMETGEDVGNSAVPSKGEKIDVSKDVSAVKKGGCCST

SEQ ID NO: 23730 - protein, 218 aa, Eschscholzia californica
MGAYKAEDDYDYLFKLVLIGDSGVGKSNLLSRFTRNEFSLESKSTIGVEFATRSLNVDGKVIKAQIWDTAGQERYRAITSAYYRGAVGALLVYDVTRHATFESVERWLKELRNHTDPNIVVMLIGNKSDLRHLVAVSTEDGKSFAETESLYFMETSALEASNVENAFAEVLTQIYRIVSKKAVETGDDGSASAVPAKGEKINIKDDVSALKRVGCCST

SEQ ID NO: 23731 - protein, 218 aa, Quercus alba
MAGYRAEDDYDYLFKVVLIGDSGVGKSNLLSRFTRNEFSLESKSTIGVEFATRSLNVDSKVIKAQIWDTAGQERYRAITSAYYRGAVGALLVYDVTRHSTFENVERWLRELRDHTDPNIVVMLIGNKSDLRHLVAVSTEDGKSFAERESLFFMETSALEATNVDNAFAEVLTQIYHIVSKKAMETGDDAAASAVPSKGEKIDVSKDVSAVKRAGCCST

SEQ ID NO: 23732 - protein, 218 aa, Lippia dulcis
MAGYRAEDDYDYLFKVVLIGDSGVGKSNLLSRFTRNEFSLESKSTIGVEFATRSLTVDGKVIKAQIWDTAGQERYRAITSAYYRGAVGALLVFDVTRHSTFESVERWLRELRDHTDPNIVVMLIGNKSDLRHLVAVSKEDGTSFAERESLYFMETSALDSTNVDNAFTEVLTQIYRIVSKKAMEAGDDSAAANVPSKGEKIDVSKDVSAMKKGGCCSS

SEQ ID NO: 23733 - protein, 215 aa, Fragaria vesca
MAGYRAEDDYDYLFKVVLIGDSGVGKSNLLSRFTRNEFSLESKSTIGVEFATRSLNVDSKVIKAQIWDTAGQERYRAITSAYYRGAVGALLVYDVTRNSTFQSVERWLKELRDHTDPNIVVMLVGNKSDLRHLVAVSTEDGKSFAERESLYFMETSALEATNVDNAFAEVLTQIFHIVSKKSMEANNDAAAVPSQGEKIDVSDVSAVKKGGCCSS

SEQ ID NO: 23734 - protein, 127 aa, Artemisia annua
MQIFVKTLTGKTITLEVESSDTIDNVKAKIQDKEGIPPDQQRLIFAGKQLEDGRTLADYNIQKESTLHLVLRLRGGIIEPSLMALARKYNQDKTICRKCYARLHPRAVNCRKKKCGHSNQLRPKKKI

SEQ ID NO: 23735 - protein, 127 aa, Trifolium pratense
  Sequence also found in Organisms: Gerbera hybrid cultivar
QIFVKTLTGKTITLEVESSDTIDNVKAKIQDKEGIPPDQQRLIFAGKQLEDGRTLADYNIQKESTLHLVLRLRGGIIEPSLMALARKYNQDKTICRKCYARLHPRAVNCRKKKCGHSNQLRPKKKIK

SEQ ID NO: 23736 - protein, 128 aa, Cyamopsis tetragonoloba
MQIFVKTLTGKTITLEVESSDTIDNVKTKIQDKEGIPPDQQRLIFAGKQLEDGRTLADYNIQKESTLHLVLRLRGGIIEPSLMALARKYNQDKTICRKCYARLHPRAVNCRKKKCGHSNQLRPKKKIK

SEQ ID NO: 23737 - protein, 128 aa, Fagopyrum esculentum
MQIFVKTLTGKTITLEVESSDTIDNVKAKIQDKEGIPPDQQRLIFAGKQLEDGRTLADYNIQKESTLHLVLRLRGGIIEPSLMALARKYNQEKTICRKCYARLHPRAVNCRKKKCGHSNQLRPKKKIK

SEQ ID NO: 23738 - protein, 128 aa, Flaveria ramosissima
MQIFVKTLTGKTITLEVESSDAIDNVKAKIQDKEGIPPDQQRLIFAGKQLEDGRTLADYNIQKESTLHLVLRLRGGIIEPSLMALARKYNQDKTICRKCYARLHPRAVNCRKKKCGHSNQLRPKKKIK

SEQ ID NO: 23739 - protein, 128 aa, Lupinus angustifolius
MQIFVKTLTGKTITLEVESSDTIDNVKAKIQDKEGVPPDQQRLIFAGKQLEDGRTLADYNIQKESTLHLVLRLRGGIIEPSLMALARKYNQDKTICRKCYARLHPRAVNCRKKKCGHSNQLRPKKKIK

SEQ ID NO: 23740 - protein, 128 aa, Allium cepa
MQIFVKTLTGKTITLEVESSDTIANVKAKIQDKEGIPPDQQRLIFAGKQLEDGRTLADYNIQKESTLHLVLRLRGGIIEPSLMALARKYNQDKTICRKCYARLHPRAVNCRKKKCGHSNQLRPKKKIK

SEQ ID NO: 23741 - protein, 128 aa, Allium cepa
MQIFVKTLTGKTITLEVESSDTIDNVKAKIQDKEGIPPDQQRLIFAGKQLEDGRTLADYNIQKESTLHLVLRLRGGLIEPSLMALARKYNQDKTICRKCYARLHPRAVNCRKKKCGHSNQLRPKKKIK

SEQ ID NO: 23742 - protein, 128 aa, Helianthus annuus
MQIFVKTLTGKTITLEVESSDTIDNVKAKIQDKEGIPPDQQRLIFAGKQLEDGRTLADYNIQKESTLHLVLRLRGEIIEPSLMALARKYNQDKTICRKCYARLHPRAVNCRKKKCGHSNQLRPKKKIK

SEQ ID NO: 23743 - protein, 128 aa, Abies balsamea
  Sequence also found in Organisms: Amsonia hubrichtii
MQIFVKTLTGKTITLEVESSDTIDNVKAKIQDKEGIPPDQQRLIFAGKQLEDGRTLADYNIQKESTLHLVLRLRGGIIEPSLMALARKYNQDKMICRKCYARLHSRAVNCRKKKCGHSNQLRPKKKIK

SEQ ID NO: 23744 - protein, 128 aa, Acacia harpophylla
MQIFVKTLTGKTITLEVESSDTIDNVKAKIQDKEGIPPDQQRLIFAGKQLEDGRTLADYNIQKESTLHLVLRLRGGIIEPSLMALARKYNQDKMICRKCHARLHPRAVNCRKKKCGHSNQLRPKKKIK

SEQ ID NO: 23745 - protein, 128 aa, Solanum lycopersicum
  Sequence also found in Organisms: Antirrhinum majus, Malus domestica, Brassica juncea, Musa acuminata, Bruguiera gymnorhiza, Cannabis sativa, Daucus carota, Curcuma longa, Solanum melongena and additional organisms as disclosed in Tables xx and yy
MQIFVKTLTGKTITLEVESSDTIDNVKAKIQDKEGIPPDQQRLIFAGKQLEDGRTLADYNIQKESTLHLVLRLRGGIIEPSLMALARKYNQEKMICRKCYARLHPRAVNCRKKKCGHSNQLRPKKKIK

SEQ ID NO: 23746 - protein, 128 aa, Arabidopsis thaliana
  Sequence also found in Organisms: Arabidopsis lyrata
MQIFVKTLTGKTITLEVESSDTIDNVKAKIQDKEGIPPDQQRLIFAGKQLEDGRTLADYNIQKESTLHLVLRLRGGIIEPSLMMLARKYNQDKMICRKCYARLHPRAVNCRKKKCGHSNQLRPKKKIK

SEQ ID NO: 23747 - protein, 128 aa, Brassica juncea
  Sequence also found in Organisms: Nicotiana benthamiana
MQIFVKTLTGKTITLEVESSDTIDNVKAKIQDKEGIPPDQQRLIFAGKQLEDGRTLADYSIQKESTLHLVLRLRGGIIEPSLMALARKYNQDKMICRKCYARLHPRAVNCRKKKCGHSNQLRPKKKIK

SEQ ID NO: 23748 - protein, 128 aa, Brassica juncea
MQIFVKTLTGKTITLEVESSDTIDNVKAKIQDKEGIPPDQQRLIFAGKQLEDGRTLADYNIQKDSTLHLVLRLRGGIIEPSLMALARKYNQDKMICRKCYARLHPRAVNCRKKKCGHSNQLRPKKKIK

SEQ ID NO: 23749 - protein, 128 aa, Phaseolus vulgaris
  Sequence also found in Organisms: Vigna unguiculata, Marchantia polymorpha, Arachis hypogaea, Phalaenopsis aphrodite, Lippia dulcis, Cajanus cajan
MQIFVKTLTGKTITLEVESSDTIDNVKTKIQDKEGIPPDQQRLIFAGKQLEDGRTLADYNIQKESTLHLVLRLRGGIIEPSLMALARKYNQDKMICRKCYARLHPRAVNCRKKKCGHSNQLRPKKKIK

SEQ ID NO: 23750 - protein, 128 aa, Castanea mollissima
  Sequence also found in Organisms: Vitis vinifera
MQIFVKTLTGKTITLEVESSDTIDNVKAKIQDKEGIPPDQQRLIFAGKQLEDGRTLADYNIQKESTLHLVLRLRGGIIEPSLMQLARKYNQDKMICRKCYARLHPRAVNCRKKKCGHSNQLRPKKKIK

SEQ ID NO: 23751 - protein, 128 aa, Gossypium hirsutum
MQIFVKTLTGKTITLEVESSDTIDNVKAKIQDREGIPPDQQRLIFAGKQLEDGRTLADYNIQKESTLHLVLRLRGGIIEPSLMALARKYNQDKMICRKCYARLHPRAVNCRKKKCGHSNQLRPKKKIK

SEQ ID NO: 23752 - protein, 128 aa, Cryptomeria japonica
MQIFVKTLTGKTITLEVESSDTIDNVKAKIQDKEGIPPDQQRFIFAGKQLEDGRTLADYNIQKESTLHLVLRLRGGIIEPSLMALARKYNQDKMICRKCYARLHPRAVNCRKKKCGHSNQLRPKKKIK

SEQ ID NO: 23753 - protein, 128 aa, Gnetum gnemon
MQIFVKTLTGKTITLEVESSDTIDNVKAKIQDKEGIPPDQQRLIFAGKQLEDGRTLADYNIQKESTLHLVLRLRGGLIEPSLMALARKYNQDKMICRKCYARLHPRAVNCRKKKCGHSNQLRPKKKIK

SEQ ID NO: 23754 - protein, 128 aa, Mesembryanthemum crystallinum
  Sequence also found in Organisms: Chenopodium quinoa
MQIFVKTLTGKTITLEVESSDTIDNVKAKIQDKEGIPPDQQRLIFAGKQLEDGRTLADYNIQKESTLHLVLRLRGGIIEPSLMALARKFNQDKMICRKCYARLHPRAVNCRKKKCGHSNQLRPKKKIK

SEQ ID NO: 23755 - protein, 128 aa, Ipomoea batatas
MQIFVKTLTGKTITLEVESSDTNDNVKAKIQDKEGIPPDQQRLIFAGKQLEDGRTLADYNIQKESTLHLVLRLRGGIIEPSLMALARKYNQDKMICRKCYARLHPRAVNCRKKKCGHSNQLRPKKKIK

SEQ ID NO: 23756 - protein, 128 aa, Ipomoea batatas
MQTFVKTLTGKTITLEVESSDTIDNVKAKIQDKEGIPPDQQRLIFAGKQLEDGRTLADYNIQKESTLHLVLRLRGGIIEPSLMALARKYNQDKMICRKCYARLHPRAVNCRKKKCGHSNQLRPKKKIK

SEQ ID NO: 23757 - protein, 127 aa, Allium cepa
QIFVKTLTGKTITLEVESSDTIDNVKAKIQDKEGIPPDQQRLIFAGKQLEDGRTLADYNIQKESTLHLVLRLRGGLIEPSLMALARKYNQDKTICRKCYARLHPRAVNCRKKKCGHSNQLRPKKKIK

SEQ ID NO: 23758 - protein, 128 aa, Prunus persica
  Sequence also found in Organisms: Prunus mume
MQIFVKTLTGKTITLEVESSDTIDNVKAKIQDKEGIPPDQQRLIFAGKQLEDGRTLADYNIQKESTLHLVLRLRGGIIEPSLMALARKYNQDKMICRKCYARLHPRAVNCRKKKCGHSNQLRPKKKVK

SEQ ID NO: 23759 - protein, 128 aa, Raphanus sativus
MQIFVKTLTGKTITLEVESSDTIDNVKAKIQDKEGIPPDQQSLIFAGKQLEDGRTLADYNIQKESTLHLVLRLRGGIIEPSLMALARKYNQDKMICRKCYARLHPRAVNCRKKKCGHSNQLRPKKKIK

SEQ ID NO: 23760 - protein, 128 aa, Raphanus sativus
MQIFVKTLTGKTITLEVESSDTIDNVKAKIHDKEGIPPDQQRLIFAGKQLEDGRTLADYNIQKESTLHLVLRLRGGIIEPSLMALARKYNQDKMICRKCYARLHPRAVNCRKKKCGHSNQLRPKKKIK

SEQ ID NO: 23761 - protein, 128 aa, Rhizophora mangle
MQIFVKTLTGKTITLEVESSDTIDNVKAKIQDKEGIPPDQQRLIFAGKQLEDGRTLADYNIQKESTLHLVLRLRGGIIEPSLMALARKYNQDKMICRKCYARLHPRAVNCRKKKCGHGNQLRPKKKIK

SEQ ID NO: 23762 - protein, 128 aa, Rhizophora mangle
MQIFVKTLTGKTITLEVESSDTIDNVKAKIQDKEGIPPDQQRLIFAGKQLEDGRTLADYNIQKESTLHLVLRLRGGIIEPSLMALARKHNQDKMICRKCYARLHPRAVNCRKKKCGHSNQLRPKKKIK

SEQ ID NO: 23763 - protein, 128 aa, Senecio madagascariensis
MQIFVKTLTGKTITLEVESSDTIDNVKSKIQDKEGIPPDQQRLIFAGKQLEDGRTLADYNIQKESTLHLVLRLRGGIIEPSLMALARKYNQDKTICRKCYARLHPRAVNCRKKKCGHTNQLRPKKKIK

SEQ ID NO: 23764 - protein, 126 aa, Helianthus annuus
IFVKTLTGKTITLEVESSDTIDNVKAKIQDKEGIPPDQQRLIFAGKQLEDGRTLADYNIQKESTLHLVLRLRGGIIEPSLMALARKYNQDKTICRKCYARLHPRAVNCRKKKCGHSNQLRPKKKIK

SEQ ID NO: 23765 - protein, 128 aa, Tabernaemontana elegans
MQIFVKTLTGKTITLEVESSDTIDNVKAKIQDKEGIPPDQQRLIFAGKQLEDGRTLADYNIQKESTLHLVLRLRGGIIEPSLMALARKYNQDKMICRKCYARLHPRAVNCRKKKCGHSNQLRAKKKIK

SEQ ID NO: 23766 - protein, 128 aa, Camellia sinensis
MQIFVKTLTGKTITLEVESSDTIDNVKAKIQDKEGIPPDQQRLIFAGKQLEDGRTLADYNIQKESTLHLVLRLRGGMIEPSLMALARKYNQDKMICRKCYARLHPRAVNCRKKKCGHSNQLRPKKKIK

SEQ ID NO: 23767 - protein, 128 aa, Utricularia gibba
MQIFVKTLTGKTITLEVESSDTIDNVKAKIQDKEGIPPDQQRLIFAGKQLEDGRTLADYNIQKESTLHLVLRLRGGIIEPSLMALARKYNQDKMICRKCYARLHPRAVNCRKKKCGHSNQLRVKKKIK

SEQ ID NO: 23768 - protein, 128 aa, Vinca minor
MQIFVKTLTGKTITLEVESSDTIDNVKAKIQDKEGIPPDQQRLIFAGKQLEDGRTLADYNIQKESTLHLVLRLRGGIIEPSLMALARKYNQDKMICRKCYARLHPRAVNCRKKKCGHTNQLRPKKKIK

SEQ ID NO: 23769 - protein, 128 aa, Juglans hindsii x Juglans regia
MPIFVKTLTGKTITLEVESSDTIDNVKAKIQDKEGIPPDQQRLIFAGKQLEDGRTLADYNIQKESTLHLVLRLRGGIIEPSLMALARKYNQDKMICRKCYARLHPRAVNCRKKKCGHSNQLRPKKKIK

SEQ ID NO: 23770 - protein, 129 aa, Pennisetum glaucum
  Sequence also found in Organisms: Oryza sativa, Cynodon dactylon, Echinochloa colona, Eragrostis curvula, Panicum virgatum
MQIFVKTLTGKTITLEVESSDTIDNVKAKIQDKEGIPPDQQRLIFAGKQLEDGRTLADYNIQKESTLHLVLRLRGGIIEPSLQALARKYNQDKMICRKCYARLHPRAVNCRKKKCGHSNQLRPKKKIKN

SEQ ID NO: 23771 - protein, 128 aa, Beta vulgaris
  Sequence also found in Organisms: Spinacia oleracea
MQIFVKTLTGKTITLEVESSDTIDNVKAKIQDKEGIPPDQQRLIFAGKQLEDGRTLADYNIQKESTLHLVLRLRGGIIEPSLMALARKFNQEKMICRKCYARLHPRAVNCRKKKCGHSNQLRPKKKIK

SEQ ID NO: 23772 - protein, 128 aa, Amaranthus tuberculatus
  Sequence also found in Organisms: Beta vulgaris
MQIFVKTLTGKTITLEVESSDTIDNVKTKIQDKEGIPPDQQRLIFAGKQLEDGRTLADYNIQKESTLHLVLRLRGGIIEPSLMALARKFNQDKMICRKCYARLHPRAVNCRKKKCGHSNQLRPKKKIK

SEQ ID NO: 23773 - protein, 125 aa, Ambrosia trifida
MQIFVKTLTGKTITLEVESSDTIDNVKAKIQDKEGIPPDQQRLIFAGKQLEDGRTLADYNIQKESTLHLVLRLRGGIIEPSLMALARKYNQDKTICRKCYARLHPRAVNCRKKKCGHSNQLRPKK

SEQ ID NO: 23774 - protein, 128 aa, Arabidopsis lyrata
MQIFVKTLTGKTITLEVESSDTIDNVKAKIQDKEGIPPDQQRLIFAGKQLEDGRTLAEYNIQKESTLHLVLRLRGGIIEPSLMMLARKYNQDKMICRKCYARLHPRAVNCRKKKCGHSNQLRPKKKIK

SEQ ID NO: 23775 - protein, 128 aa, Musa acuminata
  Sequence also found in Organisms: Ceratodon purpureus, Adiantum capillus-veneris, Physcomitrella patens, Pteridium aquilinum, Selaginella moellendorffii
MQIFVKTLTGKTITLEVESSDTIDNVKTKIQDKEGIPPDQQRLIFAGKQLEDGRTLADYNIQKESTLHLVLRLRGGIIEPSLMALARKYNQEKMICRKCYARLHPRAVNCRKKKCGHSNQLRPKKKIK

SEQ ID NO: 23776 - protein, 128 aa, Bupleurum chinense
MQIFVKTLTGKTITLEVESSDTIDNVKAKIQDKEGIPPDQQRLIFAGKQLEDGRTLADYNIQKESTLHLVLRLRGGIIEPSLMALARKYNQEKMICRKCYARLHPRAVNCRKKKCGHTNQLRPKKKIK

SEQ ID NO: 23777 - protein, 128 aa, Euonymus alatus
  Sequence also found in Organisms: Tripterygium wilfordii
MQIFVKTLTGKTITLEVESSDTIDNVKAKIQDKEGIPPDQQRLIFAGKQLEDGRTLADYNIQKESTLHLVLRLRGGIIEPSLMALARKYNQEKMICRKCYARLHPRAVNCRKKKCGHSNQLRPKKKSK

SEQ ID NO: 23778 - protein, 125 aa, Fagopyrum esculentum
FVKTLTGKTITLEVESSDTIDNVKAKIQDKEGIPPDQQRLIFAGKQLEDGRTLADYNIQKESTLHLVLRLRGGIIEPSLMALARKYNQDKTICRKCYARLHPRAVNCRKKKCGHSNQLRPKKKIK

SEQ ID NO: 23779 - protein, 128 aa, Zingiber officinale
MQIFVKTLTGKTITLEVESSDTIDNVKAKIQDKEGIPPDQQRLISAGKQLEDGRTLADYNIQKESTLHLVLRLRGGIIEPSLMALARKYNQEKMICRKCYARLHPRAVNCRKKKCGHSNQLRPKKKIK

SEQ ID NO: 23780 - protein, 128 aa, Panax ginseng
MQIFVKTLTGKTITLEIESSDTIDNVKAKIQDKEGIPPDQQRLIFAGKQLEDGRTLADYNIQKESTLHLVLRLRGGIIEPSLMALARKYNQEKMICRKCYARLHPRAVNCRKKKCGHSNQLRPKKKIK

SEQ ID NO: 23781 - protein, 128 aa, Ipomoea nil
MQIFVKTLPGKTITLEVESSDTIDNVKAKIQDKEGIPPDQQRLIFAGKQLEDGRTLADYNIQKESPLHLVLRLRGGIIEPSLMALARKYNQDKMICRKCYARLHPRAVNCRKKKCGHSNQLRPKKKIK

SEQ ID NO: 23782 - protein, 128 aa, Orobanche aegyptiaca
MQIFVKTLTGKTITLEVESSDTIDNVKVKIQDKEGIPPDQQRLIFAGKQLEDGRTLADYNIQKESTLHLVLRLRGGIIEPSLMALARKYNQEKMICRKCYARLHPRAVNCRKKKCGHSNQLRPKKKIK

SEQ ID NO: 23783 - protein, 128 aa, Capsicum annuum
MQIFVKTLTGKTITIEVESSDAIDNVKAKIQDKEGIPPDQQRLIFAGKQLEDGRTLADYNIQKESTLHLVLRLRGGIIEPSLMALARKYNQDKMICRKCYARLHPRAVNCRKKKCGHSNQLRPKKKIK

SEQ ID NO: 23784 - protein, 128 aa, Tabernaemontana elegans
MQIFVKTLTGKTITLEVESSDTIDNVKTKIQDKEGIPPDQQRLIFAGKQLEDGRTLADYNIQKESTLHLVLRLRGGIIEPSLMALARKYNQDKMICRKCYARLHPRAVNCRKKKCGHSNQLRAKKKIK

SEQ ID NO: 23785 - protein, 127 aa, Triphysaria pusilla
QIFVKTLTGKTITLEVESSDTIDNVKAKIQDKEGIPPDQQRLIFAGKQLEDGRTLADYNIQKESTLHLVLRLRGGIIEPSLMALARKYNQEKMICRKCYARLHPRAVNCRKKKCGHSNQLRPKKKIK

SEQ ID NO: 23786 - protein, 127 aa, Vinca minor
QIFVKTLTGKTITLEVESSDTIDNVKAKIQDKEGIPPDQQRLIFAGKQLEDGRTLADYNIQKESTLHLVLRLRGGIIEPSLMALARKYNQDKMICRKCYARLHPRAVNCRKKKCGHTNQLRPKKKIK

SEQ ID NO: 23787 - protein, 129 aa, Hordeum vulgare
  Sequence also found in Organisms: Brachypodium distachyon, Festuca arundinacea, Lolium multiflorum, Avena sativa, Secale cereale, Triticum aestivum
MQIFVKTLTGKTITLEVESSDTIDNVKAKIQDKEGIPPDQQRLIFAGKQLEDGRTLADYNIQKESTLHLVLRLRGGIIEPSLQALARKYNQEKMICRKCYARLHPRAVNCRKKKCGHSNQLRPKKKIKN

SEQ ID NO: 23788 - protein, 124 aa, Artemisia annua
  Sequence also found in Organisms: Flaveria ramosissima
VKTLTGKTITLEVESSDTIDNVKAKIQDKEGIPPDQQRLIFAGKQLEDGRTLADYNIQKESTLHLVLRLRGGIIEPSLMALARKYNQDKTICRKCYARLHPRAVNCRKKKCGHSNQLRPKKKIK

SEQ ID NO: 23789 - protein, 129 aa, Zea mays
  Sequence also found in Organisms: Pennisetum glaucum, Sorghum bicolor, Cenchrus ciliaris, Setaria italica, Saccharum officinarum
MQIFVKTLTGKTITLEVESSDTIDNVKAKIQDKEGIPPDQQRLIFAGKQLEDGRTLADYNIQKESTLHLVLRLRGGIIEPSLQALARKYNQDKMICRKCYARLHPRAVNCRKKKCGHSNQLRAKKKIKN

SEQ ID NO: 23790 - protein, 128 aa, Cynara scolymus
MQIFLKTLTGTTITLEVESSDTIDNVKAKIHDKEGIPPDQQRLIFAGKQLEDGRTLADYNIQKESTLHLVLRLRGGIIEPSLMALARKYNQDKTICRKCYARLHPRAVNCRKKKCGHSNQLRPKKKTK

SEQ ID NO: 23791 - protein, 126 aa, Actinidia deliciosa
IFVKTLTGKTITLEVESSDTIDNVKAKIQDKEGIPPDQQRLIFAGKQLEDGRILADYNIQKESTLHLVLRLRGGIIEPSLMALARKYNQDKMICRKCYARLHPRAVNCRKKKCGHSNQLRPKKKIK

SEQ ID NO: 23792 - protein, 125 aa, Abies balsamea
FVKTLTGKTITLEVESSDTIDNVKAKIQDKEGIPPDQQRLIFAGKQLEDGRTLADYNIQKESTLHLVLRLRGGIIEPSLMALARKYNQDKMICRKCYARLHSRAVNCRKKKCGHSNQLRPKKKIK

SEQ ID NO: 23793 - protein, 123 aa, Flaveria ramosissima
KTLTGKTITLEVESSDTIDNVKAKIQDKEGIPPDQQRLIFAGKQLEDGRTLADYNIQKESTLHLVLRLRGGIIEPSLMALARKYNQDKTICRKCYARLHPRAVNCRKKKCGHSNQLRPKKKIK

SEQ ID NO: 23794 - protein, 125 aa, Quercus alba
FVKTLTGKTITLEVESSDTIDNVKAKIQDKEGIPPDQQRLIFAGKQLEDGRTLADYNIQKESTLHLVLRLRGGIIEPSLMQLARKYNQDKMICRKCYARLHPRAVNCRKKKCGHSNQLRPKKKIK

SEQ ID NO: 23795 - protein, 128 aa, Quercus alba
MQIFVKTLTGKTITLEVESSDTIDNVKAKIQDKEGIPPDQQRLIFAGKQLEDGRTLADYNIQKESTLHLVLRLRGGIIEPSLMQLAGKFNQDKMFCRKCYARLHPRAVNCRKKKCGHSNQLRPKKKIK

SEQ ID NO: 23796 - protein, 125 aa, Ananas comosus
MQIFVKTLTGKTITLEVESSDTIDNVKAKIQDKEGIPPDQQRLIFAGKQLEDGRTLADYNIQKESTLHLVLRLRGGIIEPSLMALARKYNQDKMICRKCYARLHPRAVNCRKKKCGHSNQLRPRK

SEQ ID NO: 23797 - protein, 128 aa, Secale cereale
QIFVKTLTGKTITLEVESSDTIDNVKAKIQDKEGIPPDQQRLIFAGKQLEDGRTLADYNIQKESTLHLVLRLRGGIIEPSLQALARKYNQEKMICRKCYARLHPRAVNCRKKKCGHSNQLRPKKKIKN

SEQ ID NO: 23798 - protein, 129 aa, Secale cereale
LQIFVKTLTGKTITLEVESSDTIDNVKAKIQDKEGIPPDQQRLIFAGKQLEDGRTLADYNIQKESTLHLVLRLRGGIIEPSLQALARKYNQEKMICRKCYARLHPRAVNCRKKKCGHSNQLRPKKKIKN

SEQ ID NO: 23799 - protein, 128 aa, Silene vulgaris
MQIFVKTLTGKTITLEVESSDTIDNVKTKIQDKEGIPPDQQRLIFAGKQLEDGRTLADYNIQKESTLHLVLRLRGGIIEPSLMALARKFNQEKMICRKCYARLHPRAVNCRKKKCGHTNQLRPKKKIK

SEQ ID NO: 23800 - protein, 131 aa, Antirrhinum majus
GKKKQIFVKTLTGKTITLEVESSDTIDNVKAKIQDKEGIPPDQQRLIFAGKQLEDGRTLADYNIQKESTLHLVLRLRGGIIEPSLMALARKYNQEKMICRKCYARLHPRAVNCRKKKCGHSNQLRPKKKIK

SEQ ID NO: 23801 - protein, 126 aa, Cenchrus ciliaris
FVKTLTGKTITLEVESSDTIDNVKAKIQDKEGIPPDQQRLIFAGKQLEDGRTLADYNIQKESTLHLVLRLRGGIIEPSLQALARKYNQDKMICRKCYARLHPRAVNCRKKKCGHSNQLRPKKKIKN

SEQ ID NO: 23802 - protein, 124 aa, Zingiber officinale
VKTLTGKTITLEVESSDTIDNVKAKIQDKEGIPPDQQRLIFAGKQLEDGRTLADYNIQKESTLHLVLRLRGGIIEPSLMALARKYNQEKMICRKCYARLHPRAVNCRKKKCGHSNQLRPKKKIK

SEQ ID NO: 23803 - protein, 126 aa, Sarracenia psittacina
MQIFVKPTETITLEVESSDTIDNVKAKIQDKEGIPPDQQRLIFAGKQLEDGRTLADYNIQKESTLHLVLRLRGGIIEPSLMALARKYNQDKMICRKCYARLHPRAVNCRKKKCGHSNQLRPKKKIK

SEQ ID NO: 23804 - protein, 131 aa, Papaver somniferum
QIFVKTLTGKTITLEVESSDTIDNVKAKIQDKEGIPPDQQRLIFAGKQLEDGRTLADYNIQKESTLHLVLRLRGGIIEPSLMALARKYNQDKMICRKCYARLHPRAVNCRKKKCGHSNQLRPKKKIQIDLL

SEQ ID NO: 23805 - protein, 126 aa, Secale cereale
FVKTLTGKTITLEVESSDTIDNVKAKIQDKEGIPPDQQRLIFAGKQLEDGRTLADYNIQKESTLHLVLRLRGGIIEPSLQALARKYNQEKMICRKCYARLHPRAVNCRKKKCGHSNQLRPKKKIKN

SEQ ID NO: 23806 - protein, 124 aa, Hevea brasiliensis
CETLTGKTITLEVESSDTIDNVKAKIQDKEGIPPDQQRLIFAGKQLEDGRTLADYNIQKESTLHLVLRLRGGIIEPSLMALARKYNQDKMICRKCYARLHPRAVNCRKKKCGHSNQLRPKKKIK

SEQ ID NO: 23807 - protein, 131 aa, Flaveria ramosissima
MQIFVKTLTGKTITLEVESSDTIDNVKAKIQDKEGIPPDQQRLIFAGKQLEDGRTLADYNIQKESTLHLVLRLRGGIIEPSLMALARKYNQDKTICRKCYARLHPRAVNCRKKKCGHSNQLRTKEEDQVKT

SEQ ID NO: 23808 - protein, 128 aa, Chlamydomonas reinhardtii
  Sequence also found in Organisms: Volvox carteri
MQIFVKTLTGKTITLEVESSDTIENVKAKIQDKEGIPPDQQRLIFAGKQLEDGRTLADYNIQKESTLHLVLRLRGGIIEPSLQALARKYNQEKMICRKCYARLHPRAKNCRKKSCGHTNQLRPKKKLK

SEQ ID NO: 23809 - protein, 123 aa, Zingiber officinale
KTLPGKTITLEVESSDTIDNVKAKIQDKEGIPPDQQRLIFAGKQLEDGRTLADYNIQKESTLHLVLRLRGGIIEPSLMALARKYNQEKMICRKCYARLHPRAVNCRKKKCGHSNQLRPKKKIK

SEQ ID NO: 23810 - protein, 123 aa, Pennisetum glaucum
MQIFVKTLTGKTITLEVESSDTIDNVKAKIQDKEGIPPDQQRLIFAGKQLEDGRTLADYNIQKESTLHLVLRLRGGIIEPSLQALARKYNQDKMICRKCYARLHPRAVNCRKKKCGHSNQLRA

SEQ ID NO: 23811 - protein, 125 aa, Secale cereale
  Sequence also found in Organisms: Triticum aestivum
VKTLTGKTITLEVESSDTIDNVKAKIQDKEGIPPDQQRLIFAGKQLEDGRTLADYNIQKESTLHLVLRLRGGIIEPSLQALARKYNQEKMICRKCYARLHPRAVNCRKKKCGHSNQLRPKKKIKN

SEQ ID NO: 23812 - protein, 128 aa, Gossypium hirsutum
  Sequence also found in Organisms: Abies balsamea
MQIFVKTLTGKTITLEVESSDTIDNVKSKIQDKEGIPPDQQRLIFAGKQLEDGRTLSDYNIQKESTLHLVLRLRGGIIEPSLKALASKYNCDKMICRKCYARLPPRAVNCRKKKCGHTNQLRPKKKLK

SEQ ID NO: 23813 - protein, 119 aa, Ambrosia trifida
  Sequence also found in Organisms: Arnica chamissonis, Cirsium arvense
GKTITLEVESSDTIDNVKAKIQDKEGIPPDQQRLIFAGKQLEDGRTLADYNIQKESTLHLVLRLRGGIIEPSLMALARKYNQDKTICRKCYARLHPRAVNCRKKKCGHSNQLRPKKKIK

SEQ ID NO: 23814 - protein, 126 aa, Phalaenopsis aphrodite
MQVFVKTGKTITLEVESSEAIHNVKWKIQDKEGIPPDQQRLIFAGKQLEDGRTLADYNIQKESTLHLVLRLRGGIIEPSLMALARKYNQDKMICRKCYARLHPRAINCRKKKCGHSNQLRPKKKIK

SEQ ID NO: 23815 - protein, 124 aa, Secale cereale
KTLTGKTITLEVESSDTIDNVKAKIQDKEGIPPDQQRLIFAGKQLEDGRTLADYNIQKESTLHLVLRLRGGIIEPSLQALARKYNQEKMICRKCYARLHPRAVNCRKKKCGHSNQLRPKKKIKN

SEQ ID NO: 23816 - protein, 126 aa, Secale cereale
SVKTLTGKTITLEVECSDTIDNVKAKIQDKEGIPPDQQRLIFAGKQLEDGRTLADYNIQKESTLHLVLRLRGGIIEPSLQALARKYNQEKMICRKCYARLHPRAVNCRKKKCGHSNQLRPKKKIKN

SEQ ID NO: 23817 - protein, 128 aa, Triticum aestivum
MQIFVKTLTGKTITLEVESSDTIENVKAKIQDKEGIPPDQQRLIFAGKQLEDGRTLADYNIQKESTLHLVLRLRGGIIEPSLLILARKYRQDKMICRKCYARLHPRATNCRKKKCGRTNQLRMKKKIK

SEQ ID NO: 23818 - protein, 128 aa, Humulus lupulus
MQIFVKTLTGKTITLEVESSDTIDNVKSKIQDKEGIPPDQQRLIFAGKQLEDGRTLSDYNIQKESTLHLVLRLRGGIIEPSLKALASKYNCDKAICRKCYARLPPRATNCRKKKCGHTNQLRPKKKLK

SEQ ID NO: 23819 - protein, 125 aa, Elaeis guineensis
MQIFVKTLTGKTITLEVESSDTIDNVKAKLGVERVAQQRLIFAGKQLEDGRTLADYNIQKESTLHLVLRLRGGIIEPSLMALARKYNQDKMICRKCYARLHPRAVNCRKKKCGHSNQLRPKKKIK

SEQ ID NO: 23820 - protein, 124 aa, Ananas comosus
MQIFVKTLTGKTITLEVESSDTIDNVKAKIQDKEGIPPDQQRLIFAGKQLEDGRTLADYNIQKESTLHLVLRLRGGIIEPSLMALARKYNQDKMICRKCYARLHPRAVNCRKKKCGHSNPAAEA

SEQ ID NO: 23821 - protein, 128 aa, Pinus taeda
MQIFVKTLTGKTITLEVESSDTIDNVKSKIQDKEGIPPDQQRLIFAGKQLEDGRTLSDYNIQKESTLHLVLRLRGGIIEPSLKALASKYNCDKMICRKCYARLPPRATNCRKKKCGHTNQLRPKKKLK

SEQ ID NO: 23822 - protein, 123 aa, Secale cereale
TLTGKTITLEVESSDTIDNVKAKIQDKEGIPPDQQRLIFAGKQLEDGRTLADYNIQKESTLHLVLRLRGGIIEPSLQALARKYNQEKMICRKCYARLHPRAVNCRKKKCGHSNQLRPKKKIKN

SEQ ID NO: 23823 - protein, 124 aa, Secale cereale
PTLTGKTITLEVESSDTIDNVKAKIQDKEGIPPDQQRLIFAGKQLEDGRTLADYNIQKESTLHLVLRLRGGIIEPSLQALARKYNQEKMICRKCYARLHPRAVNCRKKKCGHSNQLRPKKKIKN

SEQ ID NO: 23824 - protein, 128 aa, Picea glauca
  Sequence also found in Organisms: Taxus baccata
MQIFVKTLTGKTITLEVESSDTIDNVKSKIQDKEGIPPDQQRLIFAGKQLEDGRTLSDYNIQKESTLHLVLRLRGGIIEPSLKALASKYNCEKMICRKCYARLPPRATNCRKKKCGHTNQLRPKKKIK

SEQ ID NO: 23825 - protein, 119 aa, Jatropha curcas
WKTITLEVESSDTIDNVKAKIQDKEGIPPDQQRLIFAGKQLEDGRTLADYNIQKESTLHLVLRLRGGIIEPSLMALARKYNQDKMICRKCYARLHPRAVNCRKKKCGHSNQLRPKKKIK

SEQ ID NO: 23826 - protein, 128 aa, Mesostigma viride
MQIFVKTLTGKTFTLEVESSDTIDNVKANIQDKEGIPPDQQRLIFAGKQLEDGRTLADYNIQKESTLHLVLRLRGGIIEPSLIALAKKTNCEKKICRKCYARLHPRAVNCRKKKCGHTSQLRLKKKIK

SEQ ID NO: 23827 - protein, 126 aa, Mesostigma viride
IFVKTLTGKTITLEVESSDTIDNVKAKIQDKEGIPPDQQRLIFAGKQLEDGRTLADYNIQKESTLHLVLRLRGGIIEPSLIALAKKTNCEKKICRKCYARLHPRAVNCRKKKCGHTSQLRLKKKIK

SEQ ID NO: 23828 - protein, 128 aa, Pinus taeda
MQIFVKTLTGKTITLEVESSDTIDNVKSKIQDKEGIPPDQQRLIFAGKQLEDGRTLSDYNIQKESTLHLVLRLRGGIIEPSLKALASKYNCEKMICRKCYARLPPRATNCRKKKCGHTNQLRPKKKLK

SEQ ID NO: 23829 - protein, 128 aa, Silene vulgaris
MQIFVKTLTGKTITLEVESSDTIENVKQKIQDKEGIPPDQQRLIFAGKQLEDGRTLSDYNIQKESTLHLVLRLRGGVIEPSLQVLARSYNVDKMICRKCYARLPPRAVNCRKKKCGHSNQLRPKKKLK

SEQ ID NO: 23830 - protein, 128 aa, Picea glauca
MQIFVKTLTGKTITLEVESSDTIDNVKSKIQDKEGIPPDQQRLIFAGKQLEDGRTLSDYNIQKESTLHLVLRLRGGIIEPSLKALASKYNCEKSICRKCYARLPPRATNCRKRKCGHSNQLRPKKKLK

SEQ ID NO: 23831 - protein, 128 aa, Picea glauca
MQIFVKTLTGKTITLEVEPSDTIENVKAKIQDKEGIPPDQQRLIFAGKQLEDGRTLSDYNIQKESTLHLVLRLRGGIIEPSLRQLAQKYNCDKMICRKCYARLHPRAVNCRKKKCGHTNNLRPKKKLK

SEQ ID NO: 23832 - protein, 128 aa, Triticum aestivum
MQIFVKTLTGKTITLEVESSDTIDNVKSKIQDKEGIPPDQQRLIFAGKQLEDGRTLSDYNIQKESTLHLVLRLRGGIIEPSLKALASKYNCEKSICRKCYARLPPRATNCRKKKCGHTNQLRPKKKLK

SEQ ID NO: 23833 - protein, 120 aa, Echinochloa colona
GKTITLEVESSDTIDNVKAKIQDKEGIPPDQQRLIFAGKQLEDGRTLADYNIQKESTLHLVLRLRGGIIEPSLQALARKYNQDKMICRKCYARLHPRAVNCRKKKCGHSNQLRPKKKIKN

SEQ ID NO: 23834 - protein, 128 aa, Conyza canadensis
MQIFVKTLTGKTITLEVEPSDTIENVKAKIQDKEGIPPDQQRLIFAGKQLEDGRTLSDYNIQKESTLHLVLRLRGGIIEPSLRILAQKYNCDKMICRKCYARLHPRATNCRKKKCGHTNNLRPKKKLK

SEQ ID NO: 23835 - protein, 116 aa, Taraxacum officinale
ITLEVESSDTIDNVKAKIQDKEGIPPDQQRLIFAGKQLEDGRTLADYNIQKESTLHLVLRLRGGIIEPSLMALARKYNQDKTICRKCYARLHPRAVNCRKKKCGHSNQLRPKKKIK

SEQ ID NO: 23836 - protein, 128 aa, Festuca arundinacea
  Sequence also found in Organisms: Ananas comosus, Secale cereale, Tamarix hispida
MQIFVKTLTGKTITLEVESSDTIDNVKSKIQDKEGIPPDQQRLIFAGKQLEDGRTLSDYNIQKESTLHLVLRLRGGIIEPSLKALASKFNCDKMICRKCYARLPPRATNCRKRKCGHTNQLRPKKKLK

SEQ ID NO: 23837 - protein, 119 aa, Pteridium aquilinum
GKTITLEVESSDTIDNVKTKIQDKEGIPPDQQRLIFAGKQLEDGRTLADYNIQKESTLHLVLRLRGGIIEPSLMALARKYNQEKMICRKCYARLHPRAVNCRKKKCGHSNQLRPKKKIK

SEQ ID NO: 23838 - protein, 128 aa, Triticum aestivum
MQIFVKTLTGKTITLDVESSDTIDNVKTKIQDKEGIPPDQQRLIFAGKQLEDGRTLSDYNIQKESTLHLVLRLRGGIIEPSLKALASKYNCEKAICRKCYARLPPRATNCRKKKCGHTNQLRPKKKLK

SEQ ID NO: 23839 - protein, 132 aa, Triphysaria pusilla
MQIFVKTLTGKTITLEVESSDTIDNVKVKIQDKEGIPPDQQRLIFAGKQLEDGRTLADYNIQKESTLHLVLRLRGGVNMIEPSLKLLAQKYNQQKMICRVCYARLHPRAVNCRKKKCGHSNQLRPKKKSKYA

SEQ ID NO: 23840 - protein, 129 aa, Lolium multiflorum
MQIFVKTLTGKTITLEVESSDTIDNVKSKIQDKEGIPPDQQRLIFAGKQLEDGRTLLDYNIQKESTLHLVLRLRGGMIEPSLRALASKFNCEKMICRKCYARLPPRATNCRKKKCGHTNQLRPKKKIKS

SEQ ID NO: 23841 - protein, 129 aa, Triticum aestivum
PGQIFVKTLTGKTITLEVESSDTIDNVKSKIQDKEGIPPDQQRLIFAGKQLEDGRTLSDYNIQKESTLHLVLRLRGGIIEPSLKALASKFNCDKQICRKCYARLPPRATNCRKRKCGHSNQLRPKKKLK

SEQ ID NO: 23842 - protein, 128 aa, Cicer arietinum
  Sequence also found in Organisms: Chrysanthemum coronarium, Rosmarinus officinalis, Triticum aestivum
MQIFVKTLTGKTITLEVESSDTIENVKAKIQDKEGIPPDQQRLIFAGKQLEDGRTLSDYNIQKESTLHLVLRLRGGVIEPTLRLLAQKYNCDKMICRKCYARLHPRATNCRKKKCGHTNNLRPKKKLK

SEQ ID NO: 23843 - protein, 127 aa, Arachis hypogaea
QIFVKTLTGKTITLEVESSDTIDNVKAKIQDKEGIPPDQQRLIFAGKQLEDGRTLSDYNIQKESTLHLVLRLRGGIIEPSLKVLASKYNCDKQICRKCYARLPPRATNCRKRSCGHSSQLRPKKKLK

SEQ ID NO: 23844 - protein, 128 aa, Triticum aestivum
MQIFVKTLTGKTITLEVESSDTIDNVKAKIQDKEGIPPDQQRLIFAGKQLEDGRTLADYNIQKESTLHLVLRLRGGLIEPSLKALASTYNCEKMICRKCYARLPPRATNCRKRSCGHSSQLRPKKKLK

SEQ ID NO: 23845 - protein, 139 aa, Antirrhinum majus
ELREDPEIKIKNAIFVKTLTGKTITLEVESSDTIDNVKAKIQDKEGIPPDQQRLIFAGKQLEDGRTLADYNIQKESTLHLVLRLRGGIIEPSLMALARKYNQEKMICRKCYARLHPRAVNCRKKKCGHSNQLRPKKKIK

SEQ ID NO: 23846 - protein, 127 aa, Conyza canadensis
QIFVKTLTGKTITLEVEASDTIENVKAKIQDKEGIPPDQQRLIFAGKQLEDGRTLSDYNIQKESTLHLVLRLRGGIIEPSLRQLAQKYNCDKQICRKCYARLPPRATNCRKKKCGHSNDLRIKKKLK

SEQ ID NO: 23847 - protein, 137 aa, Flaveria ramosissima
MQIFVKTLTGKTITLEVESSDTIDNVKAKIQDKEGIPPDQQRLIFAGKQLDDGRTLADYNIQKESTLHLVLRLRGGIIEPSLMALARKYNQDKTICRKCYARLHPRAVNCRKKKCGHSNQLRTEKEDSSEEMCMSLL

SEQ ID NO: 23848 - protein, 123 aa, Secale cereale
KTLTGKTITLEVESSDTIENVKTKIQDKEGIPPDQQRLIFAGKQLEDGRTLADYNIQKESTLHLVLRLRGGVIEPSLQVLARKYNCDKMICRKCYARLPPRAVNCRKKKCGHSNQLRPKKKLK

SEQ ID NO: 23849 - protein, 129 aa, Saccharum officinarum
MQIFVKTLTGKTITLEVESSDTIDNVKSKIQDKEGIPPDQQRLIFAGKQLEDGRTLSDYNIQKESTLHLVLRLRGGIIEPSLKVLASKFNCDKMICRKCYARLPPRATNCRKRKCGHSSQLRPKKKLKN

SEQ ID NO: 23850 - protein, 135 aa, Artemisia annua
MQIFVKTLTGKTITLEVESSDTIDNVKAKIQDKEGIPPDQQRLIFAGKQLEDGRTLADYNIQKESTLHLVLRLRGGMGKTIKIEPYLMALARKTNQNKAVCRKCYARLPPRAVNCRKKKCGHSNQLRPKKMIKMD

SEQ ID NO: 23851 - protein, 130 aa, Aquilegia formosa
MQIFVKNLKGKTITLEVESSDTIDNVNAKIQDKEEIPPDQQRLIFAGKQLEDGRTLGDYNIQKESTLHLVLRLRGGLIEPSLKALALKYREKKMICRKCYARLHPRAVNCRKKKCGHSNQLRPKKKGKYN

SEQ ID NO: 23852 - protein, 135 aa, Cynara scolymus
RGGDQTEDADLRETLTGKTITLEVESSDTIDNVKAKIQDKEGIPPDQQRLIFAGKQLEDGRTLADYNIQKESTLHLVLRLRGGIIEPSLMALARKYNQDKTICRKCYARLHPRAVNCRKKKCGHSNQLRPKKKIK

SEQ ID NO: 23853 - protein, 128 aa, Amborella trichopoda
MQIFVKTLTGKTITLEVEASDTIENVKAKIQDKEGIPPDQQRLIFAGKQLEDGRTLSDYNIQKESTLHLVLRLRGGVIEPTLRILAQKYNCDKMICRKCYARLHPRATNCRKKKCGHTNNIRPKKKLK

SEQ ID NO: 23854 - protein, 128 aa, Chrysanthemum coronarium
MQIFVKTLTGKTITLEVEPSDSIENVKAKIQDKEGIPPDQQRLIFAGKQLEDGRTLSDYNIQKESTLHLVLRLRGGVIEPTLRILAMKYNCDKMICRKCYARLHPRATNCRKKKCGHTNNLRPKKKLK

SEQ ID NO: 23855 - protein, 113 aa, Glycyrrhiza uralensis
MQIFVKTLTGKTITLEVESSDTIDNVKAKIQDKEGIPPDQQRLIFAGKQLEDGRTLADYNIQKESTLHLVLRLRGGIIEPSLMALARKYNQDKTICRKCYARLHPRAVNCRKK

SEQ ID NO: 23856 - protein, 120 aa, Arachis hypogaea
MQIFVKTLTGKTITLEVESSDTIDNVKAKIQDKEGIPPDQQRLIFAGKQLEDGRTLADYNIQKESTLHLVLRLRGGIIEPSLMALARKYNQDKMICRKCYARLHPRAVNCRKKSAGTATS

SEQ ID NO: 23857 - protein, 124 aa, Pinus taeda
MQIFVKTLTGKTITLEVESSDTIDNVKSKIQDKEGIPPDQQRLIFAGKQLEDGRTLSDYNIQKESTLHLVLRLRGGIIEPSLKALASKYNCDKMICRKCYARLPPRATNCRKKKCGHTNQLRSE

SEQ ID NO: 23858 - protein, 128 aa, Nicotiana tabacum
MQIFVKTLAGKTITLDVDSSDTIEAVKQKIQDKEGIPPDQQRLIFAGKQLEDGRTLADYNIQKESTLHLVLRLRGGVIEASLQVLARKYNTDKVICRKCYARLYPRAKNCRKKKCGHSNQLRPKKKLK

SEQ ID NO: 23859 - protein, 145 aa, Flaveria ramosissima
MQIFVKTLTGKTITLEVESSDTIDNVKAKIQDKEGIPPDQQRLIFAGKQLEDGRTLADYNIQKESTLHLVLRLRGGIIEPSLMALARKYNQDKTICRKCYARLHPRAVNCRKKKCGHSNQLRPKKKIQVDDDVTMRVLERKIFYM

SEQ ID NO: 23860 - protein, 120 aa, Cucurbita pepo
MQIFVKTLTGKTITLEVESSDTIDNVKAKIQDKEGIPPDQQRLIFAGKQLEDGRTLADYNIQKESTLHLVLRLRGGIIEPSLMALARKYNQDKMICRKCYARLHPRAVNCRKKNADTAIS

SEQ ID NO: 23861 - protein, 135 aa, Chrysanthemum coronarium
MQIFVKTLTGKTITLEVESSDTIDNVKAKIQDKEGIPPDQQRLIFAGKQLEDGRTLADYNIQKESTLHLVLRLRGGMGKTIKIEPYLMGLARKSNQFKAVCRKCYARLPPRAVNCRKKKCGHSNQLRPKKMIRME

SEQ ID NO: 23862 - protein, 136 aa, Chrysanthemum coronarium
MQIFVKTLTGKTITLEVESSDTIDNVKAKIQDKEGIPPDQQRLIFAGKQLEDGRTLADYNIQKESTLHLVLRLRGGGKKGKVNIEPSLIVLAKKYTQDKKICRKCYARLHPRAVNCRKKKCGHSNQLRTKKPSEWI

SEQ ID NO: 23863 - protein, 120 aa, Zostera marina
MQIFVKTLTGKTITLEVESSDTIDNVKAKIQDKEGIPPDQQRLIFAGKQLEDGRTLADYNIQKESTLHLVLRLRGGIIEPSLMALARKYNQEKMICRKCYARLHPRAVNCRKKNAVTAIN

SEQ ID NO: 23864 - protein, 121 aa, Conyza canadensis
LTGKTITLEVEASDTIENVKAKIQDKEGIPPDQQRLIFAGKQLEDGRTLSDYNIQKESTLHLVLRLRGGIIEPSLKALASKYNCDKMICRKCYARLPPRAVNCRKKKCGHTNQLRPKKKLK

SEQ ID NO: 23865 - protein, 135 aa, Chrysanthemum coronarium
MQIFVKTLTGKTITLEVESSDTIDNVKAKIQDKEGIPPDQQRLIFAGKQLEDGRTLADYNIQKESTLHLVLRLRGGMGKTIKIEPYLMGLARKSNQFKAVCRKCYARLPPRAVNCRKRKCGHSNQLRPKKMIRME

SEQ ID NO: 23866 - protein, 120 aa, Pinus pinaster
  Sequence also found in Organisms: Picea glauca
MQIFVKTLTGKTITLEVESSDTIDNVKAKIQDKEGIPPDQQRLIFAGKQLEDGRTLADYNIQKESTLHLVLRLRGGIIEPSLMALARKYNQDKMICRKCYARLHPRAVNCRKRSADIVIS

SEQ ID NO: 23867 - protein, 128 aa, Pinus pinaster
MQIFVKTLTGKTITLDVEASDSIENVKAKIQDKEGIPPDQQRLIFAGKQLEDGRTLSDYNIQKESTLHLVLRLRGGAIEPTVAALARKYNADKMICRKCYARLPLKAHNCRKRKCGHSNQLRPKKKLK

SEQ ID NO: 23868 - protein, 126 aa, Silene vulgaris
IFVKTLTGKTITLEVEPSDTIENVKAKIQDKEGIPPDQQRLIFAGKQLEDGRTLSDYNIQKESTLHLVLRLRGGTIEPTLRMLAQKYNCDKVICRKCYARLHPRAVNCRKRKCGHTSNLRPKKKLK

SEQ ID NO: 23869 - protein, 139 aa, Eutrema parvulum
MQIFVKTLTGKTITLEVESSDTIDNVKAKIQDKEGIPPDQQRLIFAGKQLEDGRTLADYNIQKESTLHLVLRLRGGIIEPSLMALARKYNQDKMICRKCYARLHPRAVNCRKKKCGHSNQVKSLPPINLNMFGSIPVDR

SEQ ID NO: 23870 - protein, 122 aa, Orobanche aegyptiaca
TGKTITLEVESSDTIDNVKTKIQDKEGIPPDQQRLIFAGKQLEDGRTLADYNIQKESTLHLVLRLRGGILEPSLKVLAQEYNQHKTICRKCYARLHPRAVNCRKKKCGHSNQLRPKKKSKYV

SEQ ID NO: 23871 - protein, 129 aa, Centaurea maculosa
MQIFVKTLTGKTITLDVEPSDSIDNVKQKIQDKEGIPPDQQRLIFAGKQLEDGRTLSDYNIQKESTLHLVLRLRGGIIEPTLMALAKKHNVEKKICRVCYARLPPRATNCRKKKCGHSNQLRIKKKLAK

SEQ ID NO: 23872 - protein, 129 aa, Sarracenia psittacina
MQIFVKTLTGKTITLEVEPSDSIENVKQKIQDKEGIPPDQQRLIFAGKQLEDGRTLSDYNIQKESTLHLVLRLRGGVIEPTLRQLAEKYNCEKMICRKCYARLHPRATNCRKKKCGHTNNLRPKKKLKK

SEQ ID NO: 23873 - protein, 124 aa, Flaveria ramosissima
MQIFVKTLTGKIITLEVESSDTIDNVKSKIQDKEGIPPDQQRLIFAGKQLEDGRTLSDYNIQKESTLHLVLRLRGGVIEPSLKVLASKFNCEKMICRKCYARLPPRATNCRKKKCGHTNQLRPK

SEQ ID NO: 23874 - protein, 117 aa, Arachis hypogaea
MQIFVKTLTGKTITLEVESSDTIDNVKTKIQDKEGIPPDQQRLIFAGKQLEDGRTLADYNIQKESTLHLVLRLRGGIIEPSLMALARKYNQDKMICRKCYARLHPRAVNCRQKEVWP

SEQ ID NO: 23875 - protein, 124 aa, Primula obconica
MQIFVKTLTGKTITLEVEPSDSIENVKAKIQDKEGIPPDQQRLIFAGKQLEDGRTLSDYNIQKESTLHLVLRLRGGVIEPTLRILAMKYNCDKMICRKCYARLHPRATNCRKKKCGHTNNLRPK

SEQ ID NO: 23876 - protein, 112 aa, Utricularia gibba
VESSDTIDNVKAKIQDKEGIPPDQQRLIFAGKQLEDGRTLADYNIQKESTLHLVLRLRGGIIEPSLMALARKYNQDKMICRKCYARLHPRAVNCRKKKCGHSNQLRVKKKIK

SEQ ID NO: 23877 - protein, 132 aa, Brachypodium distachyon
MQIFVKTLTGKTITLEVESSDTIDNVKAKIQDKEGIPPDQQRLIFAGKQLDDGRTLADYNIQKESTLHLVLRLRGGSSIIEPNLRALAQKHNQRKQICRKCYSRLPLKAQNCRKKKCGHSNQLRAKKKCRYC

SEQ ID NO: 23878 - protein, 130 aa, Cucurbita pepo
MQIFVKTLTGKTITLEVESSDTIDNVKAKIQDKEGIPPDQQRLIFAGKQLEDGRTLADYNIQKESTLHLVLRLRGGIIEPSLMALARKYNQDKMICRKCYARLHPRAVNCRKRVRTQQPVEAKEEDQVDH

SEQ ID NO: 23879 - protein, 149 aa, Brassica oleracea
MKGIRIPSCMVTRPEHKKPTKMQIFVKTLTGKTITLEVESSDTIDNVKAKIQDKEGIPPDQQRLIFAGKQLEDGRTLADYNIQKESTLHLVLRLRGGIIEPSLMALARKYNQDKMICRKCYARLHPRAVNCRKKKCGHSNQLRPKKKIK

SEQ ID NO: 23880 - protein, 113 aa, Bupleurum chinense
EVESSDTIDNVKAKIQDKEGIPPDQQRLIFAGKQLEDGRTLADYNVQKESTLHLVLRLRGGIIEPSLMALARKYNQEKMICRKCYARLHPRAVNCRKKKCGHTNQLRPKKKIK

SEQ ID NO: 23881 - protein, 128 aa, Festuca arundinacea
MQIFVKTLTGKTITLDVEPSDSIENVKAKIQDKEGIPPDQQRLIFAGKQLEDGRTLSDYNIQKESTLHLVLRLRGGAIEPTVAALARKYNADKMICRVCYARLPLKAHNCRKRKCGHSNRLRPKKKLK

SEQ ID NO: 23882 - protein, 124 aa, Solanum tuberosum
VKTLTGKTITLEVEGSDSIQQVKQKIQDKEGIPPDQQRLIFAGKQLEDGRTLADYNIQKESTLHLVLRLRGGVIEPSLAVLARKYNCEKKICRKCYARLHPRATNCRKRKCGHSNQLRLKKKLK

SEQ ID NO: 23883 - protein, 126 aa, Sarracenia psittacina
MQIFVKTLTGKTITLEVEPSDTIENVKAKIQDKEGIPPDQQRLIFAGKQLEDGRTLSDYNIQKESTLHLALRLRGGIIEPSLRILAQKYNCDKMICRKCYARLHPRATNCRKKKCGHTNNLAQRRS

SEQ ID NO: 23884 - protein, 128 aa, Triticum aestivum
MQIFVKTLTGKTITLDVDGADTIEAVKTKIQDKEGIPPDQQRLIFAGKQLEDGRTLADYNIQKESTLHLVLRLRGGVMEPSLKALAMKYNCEKKICRKCYARLPPRAHNCRKRKCGHSNQLRDKKKPK

SEQ ID NO: 23885 - protein, 123 aa, Triticum aestivum
MQIFVKTLTGKTITLEVEPSDSIENVKAKIQDKEGIPPDQQRLIFAGKQLEDGRTLSDYNIQKESTLHLVLRLRGGVIEPTLRILAMKYNCDKMICRKCYARLHPRATNCRKKKCGHTNNLRP

SEQ ID NO: 23886 - protein, 132 aa, Triticum aestivum
MQIFVKTLTGKTITLEVESSDTVDNVKAKIQDKEGIPPDQQRLIFAGKQLDDGRTLADYNIQKESTLHLVLRLRGGTRIEPSLKELAQKYNQKKLICRKCYSRLPLRATNCRKKKCGHSNQLRLKSKRRWFC

SEQ ID NO: 23887 - protein, 128 aa, Marchantia polymorpha
MQIFVKTLTGKTITLEVEGGDTIENVKQKIQDKEGIPPDQQRLIFAGKQLEDGRTLQDYNIQKEATLHLVLRLRGGVIEPTLQVLARKYNCEKMICRKCYARLPARATSCRKKKCGHSTSLRPKKKLK

SEQ ID NO: 23888 - protein, 122 aa, Picea glauca
MQIFVKTLTGKTITLEVESSDTIDNVKAKIQDKEGIPPDQQRLIFAGKQLEDGRTLADYNIQKESTLHLVLRLRGGIIEPSLMALARKYNQDKMICRKCYAGCIRGSELQEKKCGHSNLAEA

SEQ ID NO: 23889 - protein, 128 aa, Volvox carteri
MQIFVKTLTGKTITLDVEPSDTIDNVKTKIQDKEGIPPDQQRLIFAGKQLEDGRTLSDYNIQKESTLHLVLRLRGGVYDPTLALLAKKYNCEKSICRKCYARLPPKATNCRKRKCGHSSQLRPKKKLK

SEQ ID NO: 23890 - protein, 132 aa, Triticum aestivum
MQIFVKTLTGKTITLEVESSDTIDAVKAKIQDKEGIPPDQQRLIFAGKQLDDGRTLADYNIQKESTIHLVLRLRGGGCMIEPNLKALAQKYNQGKLICRKCYSRLPPKAKSCRKKKCGHSNQLRSKKKCRYC

SEQ ID NO: 23891 - protein, 132 aa, Triticum aestivum
MQIFVKTLTGKTITLEVEPADSIDNVKQKIQDKEGIPPDQQRLIFAGKQLEDGRTLSDYNIQKESTLHLVLRLRGGVIEPSLVLLARKYNADKKICRDCYARLDPRATNCRKKKCGHSSDLRIKKKGKNALK

SEQ ID NO: 23892 - protein, 117 aa, Cephalotaxus harringtonia
TITLEVESSDTIDNVKSKIQDKEGIPPDQQRLIFAGKQLEDGRTLSDYNIQKESTLHLVLRLRGGIIEPSLKALASKYNCDKAICRKCYARLPPRATNCRKKKCGHTNQLRPKKKLK

SEQ ID NO: 23893 - protein, 107 aa, Chrysanthemum coronarium
TIDNVKAKIQDKEGIPPDQQRLIFAGKQLEDGRTLADYNIQKESTLHLVLRLRGGIIEPSLMALARKYNQDKTICRKCYARLHPRAVNCRKKKCGHSNQLRPKKKIK

SEQ ID NO: 23894 - protein, 146 aa, Picea glauca
CLVPQLSWGNWEIVGSEQDADLLKTLTGKTITLEVESSDTIDNVKAKIQDKEGIPPDQQRLIFAGKQLEDGRTLADYNIQKESTLHLVLRLRGGIIEPSLMALARKYNQDKMICRKCYARLHPRAVNCRKKKCGHSNQLRPKKKIK

SEQ ID NO: 23895 - protein, 130 aa, Arnica chamissonis
GKTITLEVESSDTIDNVKAKIQDKEGIPPDQQRLIFAGKQLEDGRTLADYNIQKESTLHLVLRLRGGIIEPSLMALARKYNQDKTICRKCYARLHPRAVNCRKKKCGHSNQLRPKKEELSEQICVGYLLE

SEQ ID NO: 23896 - protein, 131 aa, Hordeum vulgare
MQIFVKTLTGKTITLEVVSSDTIDNVKAKIQDKEGIHPDQQRLIFAGKQLDDDRTLADYNIQKESTIHLVLRLRGGACLIEPNLKALAQKYNQGKLICRKCYSRLPPKAKSCRKKKCGHSNQLRSKKKCRY

SEQ ID NO: 23897 - protein, 153 aa, Glycine max
MHWVAGLALVLWKRSEAAEGGAALKMQIFVKTLTGKTITLEVESSDTIDNVKAKIQDKEGIPPDQQRLIFAGKQLEDGRTLADYNIQKESTLHLVLRLRGGIIEPSLMALARKYNQDKMICRKCYARLHPRAVNCRKKKCGHSNQLRPKKKIK

SEQ ID NO: 23898 - protein, 122 aa, Jatropha curcas
FGNPNGKPNSEVESSDPLKCQSQIQDKEGIPPDQQRLIFAGKQLEDGRTLADYNIQKESTLHLVLRLRGGIIEPSLMALARKYNQDKMICRKCYARLHPRAVNCRKKKCGHSNQLRPKKKIK

SEQ ID NO: 23899 - protein, 124 aa, Ostreococcus lucimarinus
MMMFANAVTGKTITLEVESSDTIDNVKAKIQDKEGIPPDQQRLIFAGKQLEDGRTLADYNIQKESTLHLVLRLRGGIIEPSLVVLAKKTNADRAVCRKCYARLPPRATNCRKKKCGHTNQLRLK

SEQ ID NO: 23900 - protein, 106 aa, Pisum sativum
IDNVKAKIQDKEGIPPDQQRLIFAGKQLEDGRTLADYNIQKESTLHLVLRLRGGIIEPSLMALARKYNQDKTICRKCYARLHPRAVNCRKKKCGHSNQLRPKKKIK

SEQ ID NO: 23901 - protein, 123 aa, Secale cereale
KTLTGKTITLDVESSDSIEAVKQKIQDKEGIPPDQQRLIFAGKQLEDGRTLADYNIQKESTLHLVLRLRGGAIEPALVELARSYNVDKKVCRKCYARLHPRATNCRKKKCGHTNQLRMKKKLK

SEQ ID NO: 23902 - protein, 121 aa, Silene vulgaris
MQIFVKTLTGKTITLDVDSSDTIEAVKQKIQDKEGIPPDQQRLIFAGKQLEDGRTLADYNIQKESTLQLVLRLRGGVIEASLQVLAGKYNTDKVICRKCYARLYPRAKNCRKKKCGHSNQL

SEQ ID NO: 23903 - protein, 107 aa, Arachis hypogaea
MQIFVKTLTGKTITLEVESSDTIDNVKAKIQDKEGIPPDQQRLIFAGKQLEDGRTLADYNIQKESTLHLVLRLRGGIIEPSLMALARKYNQDKMICRKCYARLHPRR

SEQ ID NO: 23904 - protein, 128 aa, Picea glauca
MQIFVKTLTGKTITLEVESSDTIDNVKSKIQDKEGIPPDQQRLIFAGKQLEDGRTLSDYNIQKESTLHLVLRLRGGIIEPSLKALASKFNCDKMICRKCYARLPRRATNCRKKSAVTPTSFDPRRRLK

SEQ ID NO: 23905 - protein, 136 aa, Avena sativa
QIFVKTLTGKTITLEVESSDTIDNVKAKIQDKEGIPPDQQRLIFAGKQLEDGRTLADYNIQKESTLHLVLRLRGGIIEPSLQALARKYNQEKMICRKCYARLPPRGLSTAARRSVGHSNQLDGPKKKIQRTRVPLV

SEQ ID NO: 23906 - protein, 120 aa, Arachis hypogaea
MQIFVKTLTGKTITLEVESSDTIDNVKAKIQDKEGIPPDQQRLIFAGKQLEDGRTLADYNIQKESTLHLVLRLRGGIIEPSLMALARKYNQDKMICRKCYARLHQGRLIAARRSVVTVTS

SEQ ID NO: 23907 - protein, 138 aa, Conyza canadensis
MQIFVKTLTGKTITLEVESSDTIDNVKAKIQDKEGIPPDQQRLIFAGKQLEDGRTLADYNIQKESTLHLVLRLRGGKGGYPKIDPNLRELALKHTENKNICRKCYARLHPRAVNCRKKKCGHSNELRKKHKLDSHGSS

SEQ ID NO: 23908 - protein, 118 aa, Vaccinium corymbosum
MQIFVKTLTGKTITLEVESSDTIDNVKSKIQDKEGIPPDQQRLIFAGKQLEDGRTLSDYNIQKESTLHLVLRLRGGIIEPSLKALASKYNCEKMICRKCYARLPPRAVNCRKEQNKDK

SEQ ID NO: 23909 - protein, 119 aa, Cocos nucifera
GKTITLEVEPSDSIENVKAKIQDKEGIPPDQQRLIFAGKQLEDGRTLSDYNIQKESTLHLVLRLRGGIIEPSLRQLAQKYNCDKQICRKCYARLPPRASNCRKKKCGHSSELRIKKKLK

SEQ ID NO: 23910 - protein, 117 aa, Panax ginseng
TITLEVESSDTIENVKAKIQDKEGIPPDQQRLIFAGKQLEDGRTLSDYNIQKESTLHLVLRLRGGVIEPTLRLLAQKYNCDKMICRKCYARLHPRATNCRKKKCGHTNNLRPKKKLK

SEQ ID NO: 23911 - protein, 119 aa, Arachis hypogaea
MQIFVKTLTGKTITLEVESSDTIDNVKAKIQDKEGIPPDQQRLIFAGKQLEDGRTLADYNIQKESTLHLVLRLRGGIIEPSLMALARKYNQDKMICRKCYARLHQALIAARRSVVTVTS

SEQ ID NO: 23912 - protein, 107 aa, Arachis hypogaea
MQIFVKTLTGKTITLEVESSDTIDNVKTKIQDKEGIPPDQQRLIFAGKQLEDGRTLADYNIQKGSTLHLVLRLRGGIIEPSLMALARKYNQDKMICRKCYARLHPRA

SEQ ID NO: 23913 - protein, 107 aa, Arachis hypogaea
MQIFVKTLTGKTITLEVESSDTIDNVKAKIQDKEGIPPDQQRLIFAGKQLEDGRTLADYNIQKESTLHLVLRLRGGIIEPSLMALARKYNQDKMICRKCYARLHPGG

SEQ ID NO: 23914 - protein, 128 aa, Picea glauca
MQIFVKTLTGKTITLDVEPSDSIEQVKSKIQDKEGIPPDQQRLIFAGKQLEDGRSLSDYNIQKESTLHLVLRLRGGVIEPTLAALAKSYNCDTKVCRKCYARLPVRATNCRKKKCGRTNQLRLKKKLK

SEQ ID NO: 23915 - protein, 105 aa, Artemisia annua
MQIFVKTLTGKTITLEVESSDTIDNVKAKIQDKEGIPPDQQRLIFAGKQLEDGRTLADYNIQKESTLHLVLRLRGGIIEPSLMALARKYNQDKTICRKCYARLIL

SEQ ID NO: 23916 - protein, 127 aa, Secale cereale
ADLRQDPYGKTITLEVEPSDSIENVKAKIQDKEGIPPDQQRLIFAGKQLGDGRTLSDYNIQKESTLHLVLRLRGGVIEPTLRILAMKYNCDKMICRKCYARLHPRATNCRKKKCGHTNNLRPKKKLK

SEQ ID NO: 23917 - protein, 158 aa, Flaveria ramosissima
MQIFVKTLTGKTITLEVESSDTIDNVKAKIQDKEGIPPDQQRLIFAGKQLEDGRTLADYNIQKESTLHLVLRLRGGIIEPSLMALARKYNQDKTICRKCYARLHPRAVNCRKKKCGHSNQLRPKKKIQVDEDVTMCVFHSFECFWRIFRPSKFMFGDS

SEQ ID NO: 23918 - protein, 136 aa, Oryza sativa
MQIFVKTLTGKTITLEVENSDAVANVKAKIQDKEGIPPDQQRLIFAGKQLEDGRTLADYNIQKESTLHLVLRLRGGHIWIEPSLRVLAYKHNINKMVCRKCYATLPPRATNCRKKKCGHSNQLRPKKVRWCRYFNF

SEQ ID NO: 23919 - protein, 136 aa, Setaria italica
MQIFVKTLTGKTITLEVESSDTVENVKAKIQDKEGIPPDQQRLIFAGKQLDDGRTLADYNIQKESTLHLVLRLRGGGRGGYPTMRVPWDLINLARKHNEKKMICRKCYARLHPKATNCRKKKCGHSNALRVKKKLM

SEQ ID NO: 23920 - protein, 398 aa, Solanum tuberosum
MALQAASLLPSTFSISKEGKASATLKNSSIFGASLSDYTKSDFGSSSFKVKSQRRLSNGAVVRATMVASPGVTTNSPSGKKTLRKGCVIVTGASSGLGLATAKALSETGKWHVIMACRDFLKAEKAAKSVGMPKENYTIMHLDLASLDSVRQFVDNFRRSGRPLDVLVANAAVYQPTAKEPSFTAEGFELSVGTNHLGHFLLSRLLLDDLKQSDYPSKRLIIVGSITGNTNTLAGNVPPKANLGDLRGMAGGLNGINSSSMIDGGDFDGAKAYKDSKVCNMLTMQEFHRRYHEETGITFASLYPGCIATTGLFREHIPLFRLLFPPFQKYITKGYVSETESGKRLAQVVSDPSLTKSGVYWSWNKDSASFENQLSEEASDAEKARKVWEVSEKLVGLA

SEQ ID NO: 23921 - protein, 398 aa, Solanum phureja
MALQAASLLPSTFSISKEGKASATLKNSSTFGASLSDYTKSDFGSSSFKVKSQRRLSNGAVVRATMVASPGVTTNSPSGKKTLRKGCVIVTGASSGLGLATAKALSETGKWHVIMACRDFLKAEKAAKSVGMPKENYTIMHLDLASLDSVRQFVDNFRRSGRPLDVLVANAAVYQPTAKEPSFTAEGFELSVGTNHLGHFLLSRLLLDDLKQSDYPSKRLIIVGSITGNTNTLAGNVPPKANLGDLRGMAGGLNGINSSSMIDGGDFDGAKAYKDSKVCNMLTMQEFHRRYHEETGITFASLYPGCIATTGLFREHIPLFRLLFPPFQKYITKGYVSETESGKRLAQVVSDPSLTKSGVYWSWNKDSASFENQLSEEASDAEKARKVWEVSEKLVGLA

SEQ ID NO: 23922 - protein, 398 aa, Capsicum annuum
MALHTATLLPSTFSISKEGKASAALKNCSLFGASLSDYTKFDFGSSSFKVKNQRRLSNGAVVRATMVASPGVTTNSPAGKKTLRKGCVIVTGASSGLGLATAKALSETGKWHIIMACRDFLKAEKAAKSVGMPKENYTIMHLDLASLDSVRQFVDNFRRSGRPLDVLVANAAVYQPTAKEPSFTAEGFELSVGTNHLGHFLLSRLLLDDLKQSDYPSKRLIIVGSITGNTNTLAGNVPPKANLGDLRGMAGGLNGINSSAMIDGGEFDGAKAYKDSKVCNMLTMQEFHRRYHEETGITFASLYPGCIATTGLFREHIPLFRLLFPPFQKYITKGYVSETEAGKRLAQVVSDPSLTKSGVYWSWNKDSASFENQLSEEASDAEKARKVWEVSEKLVGLA

SEQ ID NO: 23923 - protein, 397 aa, Nicotiana tabacum
MALQAAALVPSAFSISKEGKASANLKNSSLFGVSLSDYSKSDFGSSSFKVKSQRRLSNGAVRATMVASPDVTTNSPAGKKTLRKGCVIVTGASSGLGLATAKALSETGKWHVIMACRDFLKAEKAAKSVGMPKENYTIMHLDLASLDSVRQFVDNFRRSGRPLDVLVANAAVYQPTAKEPSFTAEGFEISVGTNHLGHFLLSRLLLDDLKQSDYPSKRLIIVGSITGNTNTLAGNVPPKANLGDLRGMAGGLNGINSSAMIDGGEFDGAKAYKDSKVCNMLTMQEFHRRYHEETGITFASLYPGCIATTGLFREHIPLFRLLFPPFQKYITKGFVSETEAGKRLAQVVSDPSLTKSGVYWSWNKDSASFENQLSEEASDVEKARKVWEVSEKLVGLA

SEQ ID NO: 23924 - protein, 398 aa, Nicotiana benthamiana
MALQAAALLPSAFSIPKEGKAGAILKDSNLFGISLSDHIKSDFRSSSFKVKSQRRLSHGSIRAETMVATPGVTNATVSGKKTLRKGCVVVTGASSGLGLATAKALAETGKWHVIMACRDFLKTERAAKSAGMPKENYTIMHLDLASLDSVRQFVDNFRRSGRPLDVLVCNAAVYQPTAKEPSFTADGFELSVGTNHLGHFLLSRLLLDDLKQSDYPSKRLIIVGSITGNTNTLAGNVPPKANLGDLRGLARGLDGLNSSAMIDGGDFDGAKAYKDSKVCNMLTMQEFHRRYHEETGITFASLYPGCIATTGLFREHIPLFRLLFPPFQKYITKGFVSETESGKRLAQVVSDPSLTKSGVYWSWNKNSSSFENQLSQEASDAEKARKVWEVSEKLVGLA

SEQ ID NO: 23925 - protein, 397 aa, Solanum phureja
MALQAAALLPSTFSIPKEGKTSATLKDSSLFGISLSDHVKSDFGSSFKIKSGRKSSLGAIRAETMVASPGVTNTPVTGKKTLRKGCVVITGASSGLGLATAKALAETGKWHVIMACRDFLKAERAAKSAGMPKENYTIMHLDLASLDSVRQFVDNFRRSGNPLDVLVCNAAVYQPTAKEPSFTAEGFELSVGTNHLGHFLLSRLLLDDLKQSDYPSKRLIIVGSITGNTNTLAGNVPPKANLGDLRGLARGLDGLNSSAMIDGGDFDGAKAYKDSKVCNMLTMQEFHRRYHEETGITFASLYPGCIATTGLFREHIPLFRLLFPPFQKFITKGFVSEAESGKRLAQVVSDPSLTKSGVYWSWNKNSSSFENQLSEEASDVEKARKVWEVSEKLLGLA

SEQ ID NO: 23926 - protein, 397 aa, Solanum lycopersicum
MALQAAALLPSTFSIPKEGKTSASLKDSSLFGISLSDHVKSDFGSSFKIKSGRKSSLGAIRAETMVASPGVTSTPVTGKKTLRKGCVVITGASSGLGLATAKALAETGKWHVIMACRDFLKAERAAKSAGMPKENYTIMHLDLASLDSVRQFVDNFRRSGNPLDVLVCNAAVYQPTAKEPSFTAEGFELSVGTNHLGHFLLSRLLIDDLKQSDYPSKRLIIVGSITGNTNTLAGNVPPKANLGDLRGLARGLDGLNSSAMIDGGDFDGAKAYKDSKVCNMLTMQEFHRRYHEETGITFASLYPGCIATTGLFREHIPLFRLLFPPFQKFITKGFVSEAESGKRLAQVVSDPSLTKSGVYWSWNKNSSSFENQLSEEASDVEKARKVWEVSEKLVGLA

SEQ ID NO: 23927 - protein, 397 aa, Solanum melongena
MALQAAALLPSTFFIPKEGKTSATLKDSTLFGISLSDHVKFDFGSSFKIKSGRKSSLGAIRAETMVASPGVTDAPMTGKKTLRKGCVVITGASSGLGLATAKALAETGKWHVIMACRDFLKAERAAKSAGIPKDNYTIMHLDLASLESVRQFVDNFRRSGNPLDVLVCNAAVYQPTAKEPSFTAEGFELSVGTNHLGHFLLSRLLLDDLNKSNYPSKRLIIVGSITGNTNTLAGNVPPKANLGDLRGLARGLDGLNSSAMIDGGDFDGAKAYKDSKVCNMLTMQEFHRRYHEETGITFASLYPGCIATTGLFREHIPLFRLLFPPFQKFITKGFVSEAESGQRLAQVVSDPSLTKSGVYWSWNKNSSSFENQLSEEASDPEKARKVWEVSEKLVGLA

SEQ ID NO: 23928 - protein, 398 aa, Castanea mollissima
MALQATSLLPSAFSIPKEGKSGSSSKDSTLFGVSFSDHLKADFNSSGLRCKREFNQRVGAVRAQTVTATPSVTRSAPEGKKTLRKGSVVVTGASSGLGLATAKALAETGKWHVIMACRDFLKTERAAKSAGIPKENYTIMHLDLASLDSVRQFVDNFKQSGRPLDVLVCNAAVYLPTAKEPTFTAEGFELSVGTNHLGHFLLSRLLLEDLQKSDYPSRRLIIVGSITGNTNTLAGNVPPKANLGDLRGLAGGLNGLNSSAMIDGGGFDGAKAYKDSKVCNMLTMQEFHRRFHEDTGIVFASLYPGCIATTGLFREHIPLFRLLFPPFQKYITKGYVSEDEAGKRLAQVVSDPSLTKSGVYWSWNKDSASFENQLSQEASDAEKARKVWEVSEKLVGLA

SEQ ID NO: 23929 - protein, 398 aa, Daucus carota
MALQAASFLPSSFSINKEGKANVSLKDTSLFGVTFSDSLRTDFSSLRTRRGCRQISQTGAIRSQAVATTPSVNRATGEGKKTLRKGSVIITGASSGLGLATAKALAETGKWHVIMACRDFLKAERAAKSAGMPKENYTIMHLDLASLDSVRQFVETFRRSERPLDVLVCNAAVYFPTAKEPTYTADGFELSVGTNHLGHFLLSRLLLDDLNKSDYPSKRLIIVGSITGNTNTLAGNVPPKANLGDLRGLAGGLNGMNSSAMIDGAEFDGAKAYKDSKVCNMLTMQEFHRRYHEETGITFASLYPGCIATTGLFREHIPLFRTLFPPFQKYITKGYVSEAESGKRLAQVVSEPSLTKSGVYWSWNKDSASFENQLSEEASDVEKARKVWEVSEKLVCLA

SEQ ID NO: 23930 - protein, 398 aa, Daucus carota
MALQAASFLPSSFSINKEGKANVSLKDTSLFGVTFSDSLRTDFSSLRTRRGCRQISQAGAIRSQAVATTPSVNRATGEGKKTLRKGSVIITGASSGLGLATAKALAETGKWHVIMACRDFLKAERAAKSAGMPKENYTIMHLDLASLDSVRQFVETFRRSERPLDVLVCNAAVYFPTAKEPTYTADGFELSVGTNHLGHFLLSRLLLDDLNKSDYPSKRLIIVGSITGNTNTLAGNVPPKANLGDLRGLAGGLNGMNSSAMIDGAEFDGAKAYKDSKVCNMLTMQEFHRRYHEETGITFASLYPGCIATTGLFREHIPLFRTLFPPFQKYITKGYVSEAESGKRLAQVVSEPSLTKSGVYWSWNKDSASFENQLSEEASDVEKARKVWEVSEKLVCLA

SEQ ID NO: 23931 - protein, 395 aa, Prunus persica
MALQAASVVSSAFSVPKEGKSSASFKESSLFGVSFSDNLKAEFSSVALSCKREFKPVRAQTAATASPAITRGASEGKKTLRKGSVVVTGASSGLGLATAKALAESGKWHVIMACRDFLKAERAAKSAGMPKENYTIMHLDLASLDSVRQFVDNFRRSERPLDVLVCNAAVYQPTAKEPSFTAEGFELSVGTNHLGHFLLSRLLLEDLNKSDYPSRRLIIVGSITGNTNTLAGNVPPKANLGDLRGLAGGLNGLNSSSMIDGGDFDGAKAYKDSKVCNMLTMQEFHRRYHEDTGITFTSLYPGCIATTGLFREHIPLFRLLFPPFQKYITKGYVSEEEAGKRLAQVVSDPSLTKSGVYWSWNKDSASFENQLSQEASDAEKARKVWEVSEKLVGLV

SEQ ID NO: 23932 - protein, 398 aa, Quercus alba
MALQATSLLPSAFSIPKEGKSGSSSKDSTLFGVSFSDHLKADFNSSGLRCKREFNQRVGAVRAQTVTATPSVTRSAPEGKKTLRKGSVVITGASSGLGLATAKALAETGKWHVIMACRDFLKTERAAKSAGIPKENYTIMHLDLASLDSVRQFVDNFKRSGRPLDVLVCNAAVYLPTAKEPTFTAEGFELSVGTNHLGHFLLSRLLLEDLQKSDYPSRRLIIVGSITGNTNTLAGNVPPKANLGDLRGLAGGLNGLNSSAMIDGGDFDGAKAYKDSKVCNMLTMQEFHRRFHEDTGVVFASLYPGCIATTGLFREHIPLFRLLFPPFQKYITKGYVSEDEAGKRLAQVVDDPSLTKSGVYWSWNKDSASFENRLSQEASDAEKARKVWEVSEKLVGLA

SEQ ID NO: 23933 - protein, 395 aa, Prunus mume
MALQAASVVSSAFSVPKEGKSSASFKDSSLFGVSFSDNLKAEFSSVALSFKREFKPVRAQTAATASPAINKGASEGKKTLRKGSVVVTGASSGLGLATAKALAESGKWHVIMACRDFLKAERAAKSAGMPKENYTIMHLDLASLDSVRQFVDNFRRSERPLDVLVCNAAVYQPTAKEPSFTAEGFELSVGTNHLGHFLLSRLLLEDLNKSDYPSRRLIIVGSITGNTNTLAGNVPPKANLGDLRGLAGGLNGLNSSSMIDGGDFDGAKAYKDSKVCNMLTMQEFHRRYHEDTGITFNSLYPGCIATTGLFREHIPLFRLLFPPFQKYITKGYVSEEEAGNRLAQVVSDPSLTKSGVYWSWNKDSASFENQLSKEASDAEKARKVWEVSEKLVGLA

SEQ ID NO: 23934 - protein, 395 aa, Malus domestica
MALQAASVVSSAFSVPKEGKTSASFKDSSLFGVSFSDNLKAEFSSVALSCKREFKPVRAQTTATASPAINRGTSEGRKTLRKGSVIVTGASSGLGLATAKSLAESGKWHVIMACRDFLKTERAAKSAGMPKENYTIMHLDLASLDSVRQFVDNFRRSERPLDVLVCNAAVYQPTAKEPSFTAEGFELSVGTNHLGHFLLSRLLMEDLNKSDYPSRRLIIVGSITGNTNTLAGNVPPKANLGDLRGLAGGLNGLNSSAMIDGGDFDGAKAYKDSKVCNMLTMQEFHRRYHEETGITFTSLYPGCIATTGLFREHIPLFRLLFPPFQKYITKGYVSEEEAGKRLAQVVSDPSLTKSGVYWSWNKDSASFENQLSQEASDAEKARKVWEVSEKLVGLA

SEQ ID NO: 23935 - protein, 400 aa, Cleome spinosa
MALQAASLVSSAFSVRKEGKSNASSFKESSLFGVSLPDQIRADFGSSPLKCKREYNARNGAIRAQTAATSSPAISKPAVEGKKTLRKGNVIVTGASSGLGLATAKALAETGKWHVIMACRDFLKAERAAKSAGMPKGSYTVMHLDLASLDSVRQFVDNFRRKELPLDVLVCNAAVYLPTAKEPSFSAEGFELSVGTNHLGHFLLSRLLLDDLKNSDYPSKRLIIVGSITGNTNTLAGNVPPKANLGDLRGLAGGLNGLNSSAMIDGGDFDGAKAYKDSKVCNMLTMQEFHRRYHEETGITFASLYPGCIATTGLFREHIPLFRLLFPPFQKYITKGFVSEAESGKRLAQVVSDPSLTKSGVYWSWNKASASFENQLSQEASDVEKARKMWEISEKLVGLA

SEQ ID NO: 23936 - protein, 398 aa, Brassica oleracea
MALQAASLVSSAFSVRKDGKLNASSSSFKESSLFGASITEHGSFSFRFKREHSSRNVLAVRAQTAATSSPSVTKSSSGGKKTLRKGTVVVTGASSGLGLATAKALAETGKWHVIMACRDFLKAERAAKSAGMPKDSYTVMHLDLASLDSVRQFVDSFRRSEMPLDVLVCNAAVYFPTAKEPTYSAEGFELSVATNHLGHFLLSRLLLDDLKKSDYPSKRLIIVGSITGNTNTLAGNVPPKANLGDLRGLAGGLNGLNSSAMIDGGDFDGAKAYKDSKVCNMLTMQEFHRRYHEETGVTFASLYPGCIASTGLFREHIPLFRTLFPPFQKYITKGYVSETESGKRLAQVVSDPSLTKSGVYWSWNKASASFENELSEEASDVEKARKVWEISEKLVGLA

SEQ ID NO: 23937 - protein, 398 aa, Raphanus sativus
MALQAASLVSSAFSVRKDVKLNASSSSSFKDSSLFGASFADQIKSEHGSSSLRFKRNVAIRAQTAATSSPSITKSPVDGKKTLRKGNVVVTGASSGLGLATAKALAETGKWHVIMACRDFLKAERAAKSAGMPKDSYTVMHLDLASLDSVRQFVDSFRRSEMPLDVLVCNAAVYFPTAKEPTYSAEGFELSVATNHLGHFLLSRLLLDDLKKSDYPSKRLIIVGSITGNTNTLAGNVPPKANLGDLRGLAGGLNGLNSSAMIDGGDFDGAKAYKDSKVCNMLTMQEFHRRYHEETGITFASLYPGCIASTGLFREHIPLFRTLFPPFQKYITKGYVSETESGKRLAQVVSDPSLTKSGVYWSWNKASASFENQLSEEASDVEKARKVWEISEKLVGLA

SEQ ID NO: 23938 - protein, 402 aa, Eutrema parvulum
MALQAASLVSSAFSVRKDGKFNTSSSSFKDSSLFGASITDQIKSEHGSSSLRVKRDHSSRNVAIRAQTAATSSPSVTKSTTDGKKTLRKGNVVVTGASSGLGLATAKALAETGKWHVIMACRDFLKAERAAKSAGMPKGSYTVKHLDLASLDSVRQFVDNFRRSEMPLDVLVCNAAVYFPTAKEPTYSAEGFELSVATNHLGHFLLSRLLLDDLKKSDYPSKRLIIVGSITGNTNTLAGNVPPKANLGDLRGLAGGLNGLNSSAMIDGGDFDGAKAYKDSKVCNMLTMQEFHRRYHEDTGVTFASLYPGCIASTGLFREHIPLFRTLFPPFQKYITKGYVSETESGKRLAQVVSDPSLTKSGVYWSWNKSSASFENQLSEEASDVEKARKVWEISEKLVGLA

SEQ ID NO: 23939 - protein, 399 aa, Tripterygium wilfordii
MALQAASLVASSFSIPKEGKCGAAFKDSSLFGFSLSEHVKADFTSSALRCKGGFNRRNGAVRAQTMATTTPAVNMSAPERKKTLRKGSVVITGASSGLGLATAKALAESGKWDVIMACRDFLKAERAAKAAGMPKENYTIMHLDLASLDSVRQFVDSFRRSGRPLDALVCNAAVYQPTANEPAFTAEGFELSVGTNHLGHFLLSRLLLEDLNKSDYPSRRLIIVGSITGNTNTLAGNVPPKANLGDMRGLAGGLNGLNSSAMVDGGNFDGAKAYKDSKVCNMLTMQEFHRRFHEETGITFASLYPGCIATTGLFREHIPLFRILFPPFQKYITKGYVSEEESGKRLAQVVSDPSLTKSGVYWSWNKASASFENQLSQEASDPEKARKVWEISEKLVGLA

SEQ ID NO: 23940 - protein, 387 aa, Tripterygium wilfordii
FSIPKEGKSCASFKDSSLFGVSLSDHVKADFSSSALRCKREFSRRNGVVRSQTVATTTPAVNRSAPEGKKTLRKGSVVITGASSGLGLATAKALAETGKWHVIMACRDFLKAERAAKSVGMPKENYTIMHLDLASLDSVRQFVDSFRQSGRPLDALVCNAAVYQPTAKEPAFTAEGFELSVGTNHLGHFLLSRLLLEDLNKSDYPSRRLIIVGSITGNTNTLAGNVPPKANLGDMRGLAGGLTGLNSSAMIDGGNFDGAKAYKDSKVCNMLTMQEFHRRFHEETGITFASLYPGCIATTGLFREHIPLFRLLFPPFQKYITKGYVSEEESGKRLAQVVSDPSLTKSGVYWSWNKDSASFENQMSQEASDPEKARKVWEISEKLVGLA

SEQ ID NO: 23941 - protein, 395 aa, Malus domestica
MALQAASVVSSAFSVPKEGKSGASFKDSSLFGVTFSENLKAEFSSVALSCKREFKPVRAQTTATSSPAINKGTSEGKKTLRKGSVIVTGASSGLGLATAKSLAESGKWHVIMACRDFLKTERAAKAAGMPKENYTIMHLDLASLDSVRQFVDNFRRSERPLDVLVCNAAVYQPTAKEPSFTAEGFELSVGTNHLGHFLLSRLLLEDLNKSDYPSKRLIIVGSITGNTNTLAGNVPPKANLGDLRGLAGGLNGLNSSAMIDGGDFDGAKAYKDSKVCNMLTMQEFHRRYHEETGITFASLYPGCIATTGLFREHIPLFRLLFPPFQKYITKGYVSEDEAGKRLAQVVSDPSLTKSGVYWSWNKNSASFENQLSQEASDVEKARKVWEVSEKLVGLA

SEQ ID NO: 23942 - protein, 398 aa, Brassica napus
MALQAASLVSSAFSVRKDGKLNASSSSFKESSLFGASITEHGSFSFRFKREHSSRNVLAVRAQTAATSSPSVTKSSSGGKKTLRKGTVVVTGASSGLGLATAKALAETGKWHVIMACRDFLKAERAAKSAGMPKDSYTVMHLDLASLDSVRQFVDSFRRSEMPLDVLVCNAAVYFPTAKEPTYSAEGFELSVATNHLGHFLLSRLLLDDLKKSDYPSKRLIIVGSITGNTNTLAGNVPPKANLGDLRGLAGGLNGLNSSVMIDGGDFDGAKAYKDSKVCNMLTMQEFHRRYHEETGVTFASLYPGCIASTGLFREHIPLFRTLFPPFQKYITKGYVSETESGKRLAQVVSDPSLTKSGVYWSWNKASASFENELSEEASDVEKARKVWEISEKLVGLA

SEQ ID NO: 23943 - protein, 397 aa, Brassica napus
MALQAASLVSSAFSVRKDGKLNASSASFKDSSLFGASITEHGSSSLRFKRELSVRNVAIRAQTAATSSPSITKSSVDGKKTLRKGNVVVTGASSGLGLATAKALAETGKWHVIMACRDFLKAERAAKSAGMPKDSYTVMHLDLASLDSVRQFVDNFRRSEMPLDVLVCNAAVYFPTAKEPTYSAEGFELSVATNHLGHFLLSRLLLDDLKKSDYPSKRLIIVGSITGNTNTLAGNVPPKANLGDLRGLAGGLNGLNSSAMIDGGDFDGAKAYKDSKVCNMLTMQEFHRRYHEETGITFASLYPGCIASTGLFREHIPLFRTLFPPFQKYITKGYVSETESGKRLAQVVSDPSLTKSGVYWSWNKASASFENQLSEEASDVEKARKVWEISEKLVGLA

SEQ ID NO: 23944 - protein, 397 aa, Brassica napus
MALQAASLVSSAFSVRKDGKLSASSAYFKDSSLFGASITEHGSSSLRFKRELSVRNVAIRAQTAATSSPSITKSSVDGKKTLRKGNVVVTGASSGLGLATAKALAETGKWHVIMACRDFLKAERAAKSAGMPKDSYTVMHLDLASLDSVRQFVDNFRRSEMPLDVLVCNAAVYFPTAKEPTYSAEGFELSVATNHLGHFLLSRLLLDDLKKSDYPSKRLIIVGSITGNTNTLAGNVPPKANLGDLRGLAGGLNGLNSSAMIDGGDFDGAKAYKDSKVCNMLTMQEFHRRYHEETGITFASLYPGCIASTGLFREHIPLFRTLFPPFQKYITKGYVSETESGKRLAQVVSDPSLTKSGVYWSWNKASASFENQLSEEASDVEKARKVWEISEKLVGLA

SEQ ID NO: 23945 - protein, 398 aa, Vigna unguiculata
MALQAVSLVSASFSVAKEGKLGMSLRNTTIFGLSLADALKADFSSLSFSCKRELQQKFCPLRVQSVATTPGVTKASPEGKKTLRKGSVIITGASSGLGLATAKALAETGKWHVIMACRDFLKAERAAKAAGIPKENYTVMHLDLASLDSVRQFVDNFRQSGRPLDVLVCNAAVYLPTASEPTYTADGFELSVGTNHLGHFLLSRLLLEDLNISDYPSKRLIIVGSITGNTNTLAGNVPPKANLGDLRGLAGGLNGLNTSAMIDGGSFDGAKAYKDSKVCNMLTMQEFHRRYHEETGITFASLYPGCIATTGLFREHIPLFRLLFPPFQKFITKGFVSEDESGKRLAQVVSDPSLTKSGVYWSWNKASASFENQLSQEASDADKARKVWEISEKLVGLA

SEQ ID NO: 23946 - protein, 402 aa, Eutrema halophilum
MALQAASLVSSAFSVRKDAKLNASSSSFKDSSLFGVSITDQIKSEHGSSSLRFKREHSLRNVAIRAQTAATSSPSVTKSSADGKKTLRKGNVVVTGASSGLGLATAKALAETGKWHVIMACRDFLKAERAAKSAGMPKDSYTVMHLDLASLDSVRQFVDNFRRSEMPLDVLVCNAAVYFPTAKEPTYSAEGFELSVATNHLGHFLLSRLLLDDLKKSDYPSKRLIIVGSITGNTNTLAGNVPPKANLGDLRGLAGGLNGLNSSAMIDGGDFDGAKAYKDSKVCNMLTMQEFHRRYHEETGVTFASLYPGCIASTGLFREHIPLFRTLFPPFQKYITKGYVSETESGKRLAQVVSDPSLTKSGVYWSWNKASASFENQLSEEASDVAKARKVWEISEKLVGLA

SEQ ID NO: 23947 - protein, 403 aa, Brassica oleracea
MALQAASLVSSAFSVRKDGKSNASSSFKESSLFGASLSDQIKSDFVSFSLRCKREQSLRTTGARIRAQTIVTSTPSVTRSTFDRKKTLRKGNVVVTGASSGLGLATAKALAETGKWHVIMACRDFLKAERAAKSAGMPKDSYTVMHLDLASLDSVRQFVDNFRRAEMPLDVLVCNAAIYQPTANKPTFTAEGFELSVGTNHLGHFLLSRLLIDDLKNSDYPSKRLIIVGSITGNTNTLAGNVPPKANLGDLRGLASGLNGLNSSAMIDGGDFNGAKAYKDSKVCNMLTMQEFHRRFHEETGITFASLYPGCIATTGLFREHIPLFRSLFPLFQKYITKGYVSEAEAGKRLAQVVGDPNLTKSGVYWSWNKTSASFENQLSQEASDVEKARRVWEVSEKLVGLA

SEQ ID NO: 23948 - protein, 401 aa, Euonymus alatus
MALQAASIVAPSFSIPTESKSCASFKDSSLFGVSISVSDHVKADFSSSALRSKREFSRRNGVVRAQTVATTTPAVNRSAPEGKKTLRKGNVVITGASSGLGLATAKALAETGKLHVIMACRDFLKAERAAKAAGMPKENYTIMHLDLASLDSVRQFVESFRRSGRPLDALVCNAAVYQPTAKEPAFTAEGFELSVGTNHLGHFLLSRLLLEDLNKSDYPSRRLIIVGSITGNTNTLAGNVPPKANLGDMRGLAGGLNGLNSSAMVDGGNFDGAKAYKDSKVCNMLTMQEFHRRFHEETGITFASLYPGCIATTGLFREHIPLFRVLFPPFQKYITKGYVSEEEAGKRLAQVVSDPSLTKSGVYWSWNKDSASFENKMSQEASDPEKARKVWEISEKLVGLA

SEQ ID NO: 23949 - protein, 398 aa, Petroselinum crispum
MALQAASFLPSSFSINKEGKTNVSLKDTSLFGVSFNDSLKTDFSSLRTKRGCGQISQAGAIRSQAVVTTPSVNRGTGEGKKTSRKGSVIITGASSGLGLATAKALAETGKWHVIMACRDFLKAERAAKSAGIPKENYTIMHLDLASLDSVRQFVETFRRSERPLDVLVCNAAVYFPTAKEPTYTADGFELSVGTNHLGHFLLSRLLLDDLNKSDYPSRRLIIVGSITGNTNTLAGNVPPKANLGDLRGLSGGLNGMNSSAMIDGASFDGAKAYKDSKVCNMLTMQEFHRRYHEDTGITFASLYPGCIATTGLFREHIPLFRTLFPPFQKYVTKGYVSEAESGKRLAQVVSEPSLTKSGVYWSWNQDSASFENQLSEEASDVEKARKVWEVSEKLVGLA

SEQ ID NO: 23950 - protein, 395 aa, Fragaria vesca
MALRAASVVSSAFSAPKEGKPCASFKDSTLFGVSFSENLKADFSSVALSCKREFKPVRAQTAATASPAINKSTSDGKKTLRKGSVVITGASSGLGLATAKALAETGKWHVIMACRDFLKAERAAKAAGMPKENYTIMHLDLASLDSVRQFVDNFRRSERPLDVLVCNAAVYLPTAKEPTYTADGFELSVGTNHLGHFLLARLMLEDLNKSDYPSKRLIIVGSITGNTNTLAGNVPPKANLGDLRGLAGGVNGVNSSAMIDGGDFDGAKAYKDSKVCNMLTMQEFHRRYHEETGITFASLYPGCIATTGLFREHIPLFRLLFPPFQKYITKGYVSEEESGKRLAQVVSDPSLTKSGVYWSWNKTSASFENQLSEEASDADKARKLWEVSEKLVGLA

SEQ ID NO: 23951 - protein, 401 aa, Arabidopsis lyrata
MALQAASLVSSAFSVRKDAKLNASSSSFKDSSLFGASIAEQIKSEHGSSSLRFKREHSLRSLAIRAQTAATSSPTVTKSVDGKKTLRKGNVVVTGASSGLGLATAKALAETGKWHVIMACRDFLKAERAAKSAGMPKDSYTVMHLDLASLDSVRQFVDNFRRTEMPLDVLVCNAAVYFPTAKEPTYSAEGFELSVATNHLGHFLLARLLLDDLKKSDYPSKRLIIVGSITGNTNTLAGNVPPKANLGDLRGLAGGLNGLNSSAMIDGGDFDGAKAYKDSKVCNMLTMQEFHRRYHEETGVTFASLYPGCIASTGLFRDHIPLFRALFPPFQKYITKGYVSETESGKRLAQVVSDPSLTKSGVYWSWNNASASFENQLSEEASDVEKARKVWEISEKLVGLA

SEQ ID NO: 23952 - protein, 398 aa, Brassica rapa
MALQVALLVSSAFSVQKDGKVNASSSSFKDSSLFGASITEHGSSSLRFKREHSSRSVLAVRAQTAATSSPSVTKSSSGGKKTLRKGNVVVTGASSGLGLATAKALAETGKWHVIMACRDFLKAERAAKSAGMPKDSYTVMHLDLASLDSVRQFVDSFRRSEMPLDVLVCNAAVYFPTAKEPTYSAEGFELSVATNHLGHFLLSRLLLDDLKKSDYPSKRLIIVGSITGNTNTLAGNVPPKANLGDLRGLAGGLNGLNSSAMIDGGDFDGAKAYKDSKVCNMLTMQELHRRYHEETGVTFASLYPGCIASTGLFREHIPLFRTLFPPFQKYITKGYVSETESGKRLAQVVSDPSLTKSGVYWSWNKASASFENELSEEASDVEKARKVWEISEKLVGLA

SEQ ID NO: 23953 - protein, 403 aa, Brassica rapa
MALQAASLVSSAFSVRKDGKSNASSSFKESSLFGASLSDQIKSDFVSFSLRCKREQSLRTTGARIRAQTIVTSTPSVTRSTFDRKKTLRKGNVVVTGASSGLGLATAKALAETGKWHVIMACRDFLKAERAAKSAGMPKDSYTVMHLDLASLDSVRQFVDNFRRAEMPLDVLVCNAAIYQPTANKPTFTAEGFELSVGTNHLGHFLLSRLLIDDLKNSDYPSKRLIIVGSITGNTNTLAGNVPPKANLGDLRGLASGLNGLNSSAMIDGGDFNGAKAYKDSKVCNMLTMQEFHRRFHEETGITFASLYPGCIATTGLFREHIPLFRSLFPLFQKYITKGYVSEAEAGKRLAQVVGDPNLTKSGVYWSWNKTSASFENQLSQEASDVEKARRVWEVSEKLVGSA

SEQ ID NO: 23954 - protein, 395 aa, Centaurea maculosa
MALQATSSSFSIHKEGKTNASLKDSSLFGASLSSHLKVDLKSSLSRNMTEFSRRGALKIKAVATTTPSVNQASTDAKKTLRKGTVVITGASSGLGLATAKALAETGKWHVIMACRDFLKAERSAKSVGMPKENYTVMHLDLASFDSVRQFVANFKQSGQPLDVLVCNAAVYFPTAKEPTYTADGFELSVGTNHLGHFLLARLLLDDLKQSDYPSKRLIIVGSITGNTNTLAGNVPPKANLGDMRGLAGGLNGLNSSAMIDGGDFDGAKAYKDSKVCNMLMMQEFHRRYHEETGITFASLYPGCIATTGLFREHIPLFRLLFPPFQKFITKGYVSEEESGKRLAQVVSDPSLTKSGVYWSWNNNSASFENQLSEEASDVTKARKIWEISEKLVGLA

SEQ ID NO: 23955 - protein, 395 aa, Centaurea maculosa
MALQATSSCFSIHKEGKTNASLKDSSLFGASLSSHLKVDLKSSLSRNMTEFSGRGALKIKAVATTTPSVNQASTDAKKTLRKGTVVITGASSGLGLATAKALAETGKWHVIMACRDFLKAERSAKSVGMPKENYTVMHLDLASFDSVRQFVANFKQSGQPLDVLVCNAAVYFPTAKEPTYTADGFELSVGTNHLGHFLLARLLLDDLKQSDYPSKRLIIVGSITGNTNTLAGNVPPKANLGDMRGLAGGLNGLNSSAMIDGGDFDGAKAYKDSKVCNMLMMQEFHRRYHEETGITFASLYPGCIATTGLFREHIPLFRLLFPPFQKFITKGFVSEEESGKRLAQVVSDPSLTKSGVYWSWNNNSASFENQLSEEASDVVKARKVWEISEKLVGLA

SEQ ID NO: 23956 - protein, 401 aa, Arabidopsis thaliana
MALQAASLVSSAFSVRKDAKLNASSSSFKDSSLFGASITDQIKSEHGSSSLRFKREQSLRNLAIRAQTAATSSPTVTKSVDGKKTLRKGNVVVTGASSGLGLATAKALAETGKWNVIMACRDFLKAERAAKSVGMPKDSYTVMHLDLASLDSVRQFVDNFRRTETPLDVLVCNAAVYFPTAKEPTYSAEGFELSVATNHLGHFLLARLLLDDLKKSDYPSKRLIIVGSITGNTNTLAGNVPPKANLGDLRGLAGGLNGLNSSAMIDGGDFDGAKAYKDSKVCNMLTMQEFHRRFHEETGVTFASLYPGCIASTGLFREHIPLFRALFPPFQKYITKGYVSETESGKRLAQVVSDPSLTKSGVYWSWNNASASFENQLSEEASDVEKARKVWEISEKLVGLA

SEQ ID NO: 23957 - protein, 404 aa, Arabidopsis lyrata
MALQAASLVSSAFSVPKDGKLNASSSSFKESSLFGVSLSEHSKADFVSSSLRCKREQSLRNNKAIIRAQAIATSTPSVTKSSLDRKKTLRKGNVVVTGASSGLGLATAKALAETGKWHVIMACRDFLKAERAAQSAGMPKDSYTVMHLDLASLDSVRQFVDNFRRAEMPLDVLVCNAAVYQPTANQPTFTAEGFELSVGINHLGHFLLSRLLIDDLKNSDYPSKRLIIVGSITGNTNTLAGNVPPKANLGDLRGLAGGLNGLNSSAMIDGGDFVGAKAYKDSKVCNMLTMQEFHRRFHEDTGITFASLYPGCIATTGLFREHIPLFRTLFPPFQKYITKGYVSETEAGKRLAQVVGDPSLTKSGVYWSWNKTSASFENQLSQEASDVEKARRVWEVSEKLVGLA

SEQ ID NO: 23958 - protein, 405 aa, Arabidopsis thaliana
MALQAASLVSSAFSVRKDGKLNASASSSFKESSLFGVSLSEQSKADFVSSSLRCKREQSLRNNKAIIRAQAIATSTPSVTKSSLDRKKTLRKGNVVVTGASSGLGLATAKALAETGKWHVIMACRDFLKAERAAQSAGMPKDSYTVMHLDLASLDSVRQFVDNFRRAEMPLDVLVCNAAVYQPTANQPTFTAEGFELSVGINHLGHFLLSRLLIDDLKNSDYPSKRLIIVGSITGNTNTLAGNVPPKANLGDLRGLAGGLNGLNSSAMIDGGDFVGAKAYKDSKVCNMLTMQEFHRRFHEDTGITFASLYPGCIATTGLFREHIPLFRTLFPPFQKYITKGYVSESEAGKRLAQVVADPSLTKSGVYWSWNKTSASFENQLSQEASDVEKARRVWEVSEKLVGLA

SEQ ID NO: 23959 - protein, 400 aa, Cleome gynandra
MALQAASLVSSAFSVRKEAKSNASSFKDSTLFGVSLSDQIRADFGSCPLKCKREYNARNGAIRAQTAATSSPAIIKSAVDGKKTLRKGNVVVTGASSGLGLATAKALAESGKWHVIMACRDFLKAERAAKSAGMPKGSYTVMHLDLASLDSVRQFVDNFRRKEMPLDVLVCNAAVYLPTAKEPTFTAEGFELSVGTNHLGHFLLSRLLLDDLKNSDYPSKRLIIVGSITGNTNTLAGNVPPKANLGDLRGLAGGLNGLNSSAMIDGGDFDGAKAYKDSKVCNMLTMQEFHRRYHEETGVTFASLYPGCIATTGLFREHISLFRLLFPPFQKYITKGYVSEADAGKRLAQVVSDPSLTKSGVYWSWNKNSASFENQLSQEASDVEKARKVWEISEKLVGLA

SEQ ID NO: 23960 - protein, 1563 aa, Setaria italica
MGTPVNIIVGSHVWLEDPGEAWVDGVVTEIKGRDATIATTNGKTVVASLGSIYPKDTEAPPSGVDDMTKLAYLHEPGVLHNLSCRYGLNEIYTYTGNILIAVNPFQRLPHLYDVHMMEQYKGATFGELSPHLFAIADACYRALINDHGSQSILVSGESGAGKTETTKMLMRYLAFMGGRSGTEGRTVEQQVLESNPVLEAFGNAKTVKNNNSSRFGKFVEIQFDKYGKISGAAVRTYLLERSRVCQVSDPERNYHCFYMLCNAPPEDVKRFKVGDPRSFHYLNQTNCYEVANVDDAREYIETRNAMDIVGIDQEEQDAIFRVVAAILHLGNIEFSKGKEIDSSKLRDDKSVHHLKTVAELLMCNEKALEDSLCQRVIVTPDGNITKPLDPDSAALSRDALAKTVYSRLFDWIVDKINNSIGQDPDATDIIGVLDIYGFESFKINSFEQLCINLTNEKLQQHFNQHVFKMEQEEYTREEIDWSYVEFVDNQDVLDLLEKKPGGIIALLDEACMFPKSTHETFAQKMYQTYKAHKRFSKPKLARTAFTINHYAGDVTYQADQFLDKNKDYVVAEHQALLNSSRCHFVANLFPPLPEETSKQSKFSSIGTRFKQQLQSLMETLSTTEPHYIRCVKPNTVLKPGIFENFNVLNQLRCGGVLEAIRISCAGYPTKRTFDEFIDRFGMLAPELVDSSDEKAACAAICDRMGLKGYQIGKTKVFLRAGQMAELDARRAEVLANAARLIQRRIKTHLMRKEFVNLRKASIKSQKFWRARLARKLFEYMRRDAASIRIQKHARTHSARKAYLQVYESAIVIQTGLRAMAARNEHRFRRETKASIIIQTRWRQHKAYVAYKQQKRASLILQCLWRARIARKELRKLRMEARETGALKEAKDKLEKRVEELTWRLDVEKRLRTDLEEAKGQEIGKLQSALQEMQEKIEEAHAAILKEKEAAKLAIEQAPPKIVEVPVVDTAEVEQLTSKNKELEDEVSTFKQKAEDLEEKLLELQKRSDELSQETLERESKVNQLQEMIERLETSLSSMESENQVLRQQSLVVASADEDKSKQIERLESKIAILESEIQLLRSNSVLAVQAIVTPEMNQTSVMENLVHKEIDNRHQLEEVKIANEQVAVPPVKNLSKQKSLTDRQQENHDALIKSLVGDRRFDDKKPAAACIVYKSLLHWHSFEAEKTNIFDRIIQTIRSSVEGAESSGELAYWLSTTSTLLCLLQNTLKASSSLRKGSNHSRTATGSLFSRMVQSARISSSGLGVTSGYSGMVGRPDTASMVEAKYPAIRFKQQLTAYVEKIYGTIRDNLKKEISPFLTLCIQAPRANRMRPSRGSLKSIHSNALSRQASSVHWQSIVKCLDHTLEIMKNNHVPPMIIKKTFSQVYAYLNVQLFNSLLLRRECCSFSNGEFLKAGLQELEQWCSRTTEEYAGASWDELQHIRQAVGFLVLHQKSHKNLEEIMNELCPVLSITQIYRIATMFWDDKYGAQGLSQEVIGKMRTMTTDDSITTPNSSFLLDDDSSIPISLDDIARLMLDIDPSDVEPPPLLRQNSQFHFLLQQHTD

SEQ ID NO: 23961 - protein, 1563 aa, Panicum virgatum
MGTPVNIIVGSHVWLEDPGEAWVDGVVTEIKGRDATIATTNGKTVVASLGSIYPKDTEAPPSGVDDMTKLAYLHEPGVLHNLSCRYGLNEIYTYTGNILIAVNPFQRLPHLYDVHMMEQYKGATFGELSPHLFAIADACYRALINDHGSQSILVSGESGAGKTETTKMLMRYLAFMGGRSGTEGRTVEQQVLESNPVLEAFGNAKTVKNNNSSRFGKFVEIQFDKYGKISGAAVRTYLLERSRVCQVSDPERNYHCFYMLCNAPPEDVKRFKVGDPRSFHYLNQTNCYEVANVDDAREYIETRNAMDIVGIDQDEQDAIFRVVAAILHLGNIDFSKGKEIDSSKLRDDKSVHHLKTVAELLMCDEKALEDSLCQRVIVTPDGNITKPLDPDSAALSRDALAKTVYSRLFDWIVDKINNSIGQDPDATNIIGVLDIYGFESFKINSFEQLCINLTNEKLQQHFNQHVFKMEQEEYTREEIDWSYVEFVDNQDVLDLIEKKPGGIIALLDEACMFPKSTHETFAQKMYQTYKAHKRFSKPKLARTAFTINHYAGDVTYQADQFLDKNKDYVVAEHQALLNSSRCPFVANLFPPLPEETSKQSKFSSIGTRFKQQLQSLMETLSTTEPHYIRCVKPNTVLKPGIFENFNVLNQLRCGGVLEAIRISCAGYPTKRTFDEFIDRFGMLAPELVDSSDEKAACAAICDRMGLKGYQIGKTKVFLRAGQMAELDARRAEVLANAARLIQRRIKTYLMRKEFVNLRKASVQSQKFWRARLARKLFEYMRRDAASIRIQKHARGHSARKAYRQVYESAIVIQTGIRAMAARNEHRFRRETKASIIIQTRWRQHKAYVAYKQQKRASLILQCLWRARIARKELRKLRMEARETGALKEAKDKLEKRAEELTWRLDVEKRLRTDLEEAKGQEIGKLQSALQEMQEKIEEAHAAVLKEKEAAKLAIEQAPPKIVEVPVVDTEKVEQLTSKNKELEDELSTFRQKAEDLENKLLEMQKRSDELSQETQEQESKVNQLQEMIERLETSLSNMESENQVLRQQSLVVATADEDKSKQIERLESKIAILESEIQLLRSNSAPAVQAVVTPEMYQTSVMENLIHMEVDNGHQLEEAKIVNEQVVVPPVKNLSKQKSLTDRQQENHDVLIKSLVEDRRFDAKKSAAACIVYKSLLRWRSFEAEKTNIFDRIIQTIRSSVEGAESSGELAYWLSTTSTLLYLLQNTLKASSSSSKGSNRSRTATGSLFSRMVQSARTSSSGLGITSGYGGMVGRPDTASMVEAKYPALRFKQQLTAYVEKIYGIIRDNLKKEISPFLTLCIQAPRANRVRPSRGSLKSIHSNALSRQASSVHWQSIVKCLENTLETMKNNHVPPMIIKKTFSQVYAYLNVQLFNSLLLRRECCSFSNGEFLKAGLQELEQWYSRTTEEYAGASWDELQHIRQAVGFLVLHQKSHKTLEEITNELCPVLSITQIYRIATMFWDDKYGAQGLSQEVIGKMRMMTTDDSITTPNSSFLLDDDSSIPISLDDIAHLMLDIDPLDVEPPALLRQNSQFHFLLQQHTD

SEQ ID NO: 23962 - protein, 1556 aa, Brachypodium distachyon
MGTPVNIIVGSQVWLEDPDDAWVDGEVTGIKGGDVTVATTNGKTVVASLASIHPKDTEAPPAGVDDMTKLAYLHEPGVLHNLACRYGLNEIYTYTGNILIAVNPFQRLPHLYDVHMMEQYKGATFGELSPHLFAIADSCYRAMINEHGSQSILVSGESGAGKTETTKMLMRYLAFMGGRSGTEGRTVEQQVLESNPVLEAFGNAKTVKNNNSSRFGKFVEIQFDKYGKISGAAVRTYLLERSRVCQVSDPERNYHCFYMLCSAPPEDVKRFKVGDPRSFHYLNQTNCYEVANVDDAREYLETRNAMDIVGICEEEQDAIFRVVAAILHLGNINFSKGEEIDSSRLRDEKSVYHLKTVAELLMCDEKYLEDSLCKRVIVTPDGNITKPLDPDSALQSRDALAKTVYSRLFDWIVDKINNSIGQDPDAISIIGVLDIYGFESFKINSFEQLCINMTNEKLQQHFNQHVFKMEQEEYTRDEIDWSYVEFVDNQDVLDLIEKKPGGIIALLDEACMFPKSTHETFAQKMYQTYKAHKRFSKPKLARTAFTINHYAGDVTYQADQFLDKNKDYVVAEHQALLNYSRCPFVANLFPPLPEESSKQSKFSSIGTRFKQQLQALMETLSTTEPHYIRCVKPNTVLKPGIFENYNVLNQLRCGGVLEAIRISCAGYPTKRTFDEFIDRFGVLAPELVDSSDEKAACAAICDRMGLKGYQIGKTKVFLRAGQMAELDARRAEVLANAVRLIQRRIRTHLMRKEFTNLRKASIQTQKFWRARLARKLFEHMRRVAAAITIQKHTRTRSAWKAYLQIYRSSITIQTGLRAMAARNEHRFRRQTKAAIIIQTRWRQHKAYVAYKQQKKASLILQCSWRARVARKELRKLKMEARDNGALKEAKDKLEKRVEELTWRLDVEKHLRIDLEISKGQEIVKLQSALQEMREKLEEAHTAIIKEKEDAKLAIEQAPPKIVEVPVVDNEKVELLTSQNEELEGKFGMFKKKADDLENKLIEIQKQFDELSRETQERDSKINQLEEMISRLETNLSSMESENHVLRQQSLLASADDDKSRQIESLESKIANLESENQLLRNNSALAVQAAVTPEVIQPSVIEVLENGQQLGELKIFNEQVVVPPVKNLSKQKSLTDRQQENHDVLIKSLAEDRRYDNRRPAAACIVYKSLLHWHSFEAEKTNIFDRIIHTIRSSIESAEGSGELAYWLSTTSTLLYLLQNTLKTSSSSTKGSNRSRTSTGNLFNRMMQNARSSSSGLGISSGYSGMIGRTDIASMVEAKYPAVRFKQQLTAYVEKIYGMMRDSLKKEISTILIMCIQAPRAVRVRSSRGSLKSIHSSALSRQVSNVHWQNIVMCLNNTLETMNSNYVPPMIIRKTFSQVFAFMNVQLFNSLLLRRECCSFSNGEFLKAGLQELEQWCSRTTEEFAGTSWDEMKHIRQAVGFLVLHQKSHKTLDEITDELCPVLSITQICRIGTMFWDDKYGAQGLSQEVIGNMRTLTTDDSVATPNSSFLLDDDSSIPISLDDISRLMLDINPSDVEPPPLLRQNSQFHFLLQQCT

SEQ ID NO: 23963 - protein, 1556 aa, Sorghum bicolor
MGTPVNIIVGSHVWLEDPGEAWVDGVVTDIKGGNATIATTNGKTVVASLDSIYPKDTEAPPSGVDDMTKLAYLHEPGVLHNLSCRYGLNEIYTYTGNILIAVNPFQRLPHLYDVHMMEQYKGASFGELSPHLFAIADACYRALINDQGSQAILVSGESGAGKTETTKMLMRYLAFMGGRSGTEGRTVEQQVLESNPVLEAFGNAKTVKNNNSSRFGKFVEIQFDKYGKISGAAVRTYLLERSRVCQVSDPERNYHCFYMLCSAPPEDVKRFKVGDPRQFHYLNQTNCYEVANVDDAREYLETRNAMDIVGIDQEEQDAIFRVVAAILHLGNINFSKGQEIDSSKLRDDKSVYHLKTVAELLMCDEKALEDSLCQRVIVTPDGNITKPLDPDSAALSRDALAKTVYSRLFDWIVDKINNSIGQDPDATNIIGVLDIYGFESFKINSFEQLCINLTNEKLQQHFNQHVFKMEQEEYTREEIDWSYVEFVDNQDVLDLIEKKPGGIIALLDEACMFPKSTHETFAQKMYQTYKAHKRFSKPKLARTAFTINHYAGDVTYQADHFLDKNKDYVVAEHQALLNSSRCPFVANLFPPLPEETSKQSKFSSIGTRFKQQLQSLMETLNTTEPHYIRCVKPNAVLKPGIFENHNVLNQLRCGGVLEAIRISCAGYPTKRTFDEFIDRFGMLAPELVDSDEKAACAAICDRMGLKGYQIGKTKVFLRAGQMAELDARRAEILANAARLIQRHIKAHLMRKEFINLRKASVQSQKFWRARLARKLFEYMRRDAASIRIQKHVRTHSARKAYLQVYESAIVIQTGLRAMAARNEHRFRRETKASIIIQTRWRQHRAYVAYKQQKRAALILQCLWRARIARKELRKLKMEARETGALKEAKDKLEKRVEELTWRLDVEKRLRTDLEEAKGHEIEKLQSALQKLQENLEEAHAAIVKEKEAAKLAIEQAPPKIVEVPVVDNAKLEELTTQNKELEDELTTFKQKAEDLENKLLELQKQSDELSQETQEQASKVTQLQELIERLEASLSNMESENQVLRQQSLVVTSADEDKSKQIERLESKIATLESEIELLRCNSALAVQAVVTPEMNQTTVIEELDNGHQLEEVKTVNEQVVIPPVKNLSKQKSLTDRQQENHDALIKSLVEDRRFDDKKSAAACIVYKSLLHWHSFEAEKTNIFDRIIQTIRSSVEGAESSGELAYWLSTTSTLLYLLQNTLKASSSLSKGTNRSRTTTGSLFSRMVQSARASSGLGIPSGYSGMVRRPNTASMVEAQYPALRFKQQLTAYVEKIYGIIRDNLKKEISPFLTMCIQAPRANRVRPSRGSLKSIHSNGLARQASSLHWQNIVKCLDHTLETMKNNYVPPVIIRKTFSQVFAYLNVQLLNSLLLRRECCSFSNGEFLKAGLQDLEQWCSTITEEYVGTSWDELQHIRQAVGFLVLHQKSHKTLEEITNDLCPVLSITQIYRIATMFWDDKYGAQGLSQEVIGKMRTMTTDDSITTPNSSFLLDDDSSIPISLDDIARLMGDIDPSDVEPPPLLRQNSQFHFLLQQHTD

SEQ ID NO: 23964 - protein, 1564 aa, Echinochloa colona
MGTPVNIIVGSHVWLEDPGEAWVDGVVAEIKGGNATIATTNGKTVVASLGSIYPKDTEAPPSGVDDMTKLAYLHEPGVLYNLSCRYGLNEIYTYTGNILIAVNPFQRLPHLYDVHMMEQYKGATFGELSPHLFAIADACYRALINDHGSQSILVSGESGAGKTETTKMLMRYLAFMGGRSGTEGRTVEQQVLESNPVLEAFGNAKTVKNNNSSRFGKFVEIQFDKYGKISGAAVRTYLLERSRVCQVSDPERNYHCFYMLCNAPPEDVKRFKVGDPRSFHYLNQTNCYEVANVDDAREYIETRNAMDIVGIDQEEQDAIFRVVAAILHLGNIEFSKGKEIDSSKLRDEKSVYHLKTVAELLMCDEKALEDSLCQRVIVTPDGNITKPLDPDSAALSRDALAKTVYSRLFDWIVDKINNSIGQDPDATNIIGVLDIYGFESFKINSFEQLCINLTNEKLQQHFNQHVFKMEQEEYTREEIDWSYVEFVDNQDVLDLIEKKPGGIIALLDEACMFPKSTHETFAQKMYQTYKAHKRFSKPKLARTAFTINHYAGDVTYQADHFLDKNKDYVVAEHQALLNSSRCHFVANLFPPLPEETSKQSKFSSIGTRFKQQLQSLMETLSTTEPHYIRCVKPNAVLKPGIFENFNVLNQLRCGGVLEAIRISCAGYPTKRTFDEFVDRFGMLAPELVDSSDEKAACAAICDRMGLKGYQIGKTKVFLRAGQMAELDARRAEVLARAARLIQRRIKTHLMRKEFVNLRKASVHSQKFWRARLARKLFEYMRRDAASIRIQKHARTHSARKAYLQVYESAIVIQTGLRAMAARNEHRFLRETKASIIIQTQWRQNKAYVAYKQQKRASLILQCLWRARIARKELRKLRMEARETGALKEAKDKLEKRVEELTWRLDVEKRLRTDLEEAKGQEIEKLQSALQGMQEKIEAAHEAIEKEKEAAKLAIEQAPPKIVEVPVVDTAKVEQLTSKNKELEDELSAFKQKAEDLENKLLELQNKADELSQETQERESKTNQLQEMIERLETSLTSMESENQVLRQQSLVVASADEDKSKQIERLESKIATLESEIQLLRSNSVVAVQAIVTPEMNQTSVMENITHKEIDNGHQLEEVKVVNEQVVVPPVKNLSKQKSLTDRQQENHDALIKSLVEDRRFDDKKSAAACIVYKSLLHWHSFEAERTNIFDRIIQTIRSSVEGAESPGELAYWLSTTSTLLYLLQNTLKASSSSSKGSNHSRTTRGSLFSRMVQSARTSSSSGLGITSGYSGMVGRPDTASMVEAKYPALRFKQQLTAYVEKIYAIIRDNLKKEISPLLTMCIQAARANRVRPSRGSLKSIHSNALSRQASSVHWQSIVKCLDHTLETMKNNYVPPMIIRKAFSQVFAYLNVQLFNSLLLRRECCSFSNGEFLKAGLQELEQWCSKTTEEYAGASWDELQHIRQAAGFLVLHQKSHKNLEEIMNELCPVLSITQIYRIATMFWDDKYGAQGLSQEVIGKMRTMTTDGSITAPNSSFLLDDDSSIPISLDDIARLMLDIDPSEVEPPPLLRQNSQFHFLLQQHTD

SEQ ID NO: 23965 - protein, 1556 aa, Secale cereale
MGTPVNIIVGSQVWLEDPDEAWVDGEVTGIKGADVTVATTNGKTVVASLASIYPKDTEAPPAGVDDMTKLAYLHEPGVLHNLACRYGLNEIYTYTGNILIAVNPFQRLPHLYDVHMMEQYKGATFGELSPHLFAIADSCYRAMINEHGSQSILVSGESGAGKTETTKMLMRYLAFMGGRSGTEGRTVEQQVLESNPVLEAFGNAKTVKNNNSSRFGKFVEIQFDKYGKISGAAVRTYLLERSRVCQVSDPERNYHCFYMLCSAPPEDVKRFKVGDPRSFHYLNQTSCYEVANVDDAREYLETRNAMDIVGISQEEQDAIFRVVAAILHLGNINFSKGKEIDSSRLRDEKSINHLKIVAELLMCDEKLLEDSLCQRVIVTPDGNITKPLDPDSALQSRDALAKTVYSRLFDWIVDKINNSIGQDPDAISIIGVLDIYGFESFKVNSFEQLCINMTNEKLQQHFNQHVFKMEQEEYTRDEIDWSYVEFVDNQDVLDLIEKKPGGIIALLDEACMFPKSTHETFAQKMYQTYKSHKRFSKPKLARTAFTINHYAGDVTYQSDYFLDKNKDYVVAEHQALLNSSRCSFVANLFPPLPEESSKQSKFSSIGTRFKQQLQALMETLSTTEPHYIRCVKPNTVLKPGIFENDNVLNQLRCGGVLEAIRISCAGYPTKRTFDEFIDRFGVLAPELVDSSDEKTACAAICDKMGLKGYQIGKTKVFLRAGQMAELDARRAEVLANAVRLIQRRIRTHLMRKDFISLKKASIQTQKFWRARLARKLFEHMRRVAAAITIQKHTRTHSAWKAYLQIYRSSITIQTGLRAMAARKEHRFRRETKATIIIQTQWRRHKAYVAYKQQKRASLILQCSWRGRVARKELRKLKMEARDNGALKEAKDKLEKRVEELTWRLDVEKHLRVDLEVAKGQEITKLQSALQEMQEKLEEAHAAIINEKEAAKLAIEQAPPKIVEVPVVDNAKVELLTSQNEELETELGTFRTKAEDLEKKLFEIQKQSDELSLEAQERDSKINELQEMIARLETNLSNMESENHVLRQQSLLASADDDNKTKQIESLESKIAILESENQLLRSNPAPAVQAVVTPEVIEPAVVKVLENGHQHEEPKMEEVVVPPIKNLSKQQSLTDRQQENHDVLIKSLAEDRRYDNRRPAAACIVYKSLLHWHSFEAEKTNIFDRIIHTIRSSVENAESSGELAYWLSTTSTLLYLLQNTLKASSSSTKVPNRSRTATGNLFNRMVQNARSSSSGLGISNGYSGMVGRADTASRIEAKYPAVRFKQQLTAYVEKIYGMMRDSLKREISAILTLCIQAPRAGRVKASRGSLKSIHSSALSRQASSVHWQNIIKCLNHTLETMNSNYVPPMIIRKTFSQVFAFMNVQLFNSLLLRRECCSFSNGEFLKAGLQELEQWCSRTTEEYAGTSWDELQHIRQAVGFLVLHQKSHKTLDEITDELCPVLSISQIYRIGTMFWDDKYGAQGLSQEVTGNMRTMTTDDSITTPNSSFLLDDDSSIPISLDDIAQLMLDINPTDVEPPPLLRQNSQFHFLLQQHTD

SEQ ID NO: 23966 - protein, 1556 aa, Secale cereale
MGTPVNIIVGSQVWLEDPDEAWVDGEVTGIKGADVTVATTNGKTVVASLASIYPKDTEAPPAGVDDMTKLAYLHEPGVLHNLACRYGLNEIYTYTGNILIAVNPFQRLPHLYDVHMMEQYKGATFGELSPHLFAIADSCYRAMINEHGSQSILVSGESGAGKTETTKMLMRYLAFMGGRSGTEGRTVEQQVLESNPVLEAFGNAKTVKNNNSSRFGKFVEIQFDKYGKISGAAVRTYLLERSRVCQVSDPERNYHCFYMLCSAPPEDVKRFKVGDPRSFHYLNQTSCYEVANVDDAREYLETRNAMDIVGISQEEQDAIFRVVAAILHLGNINFSKGKEIDSSRLRDEKSINHLKIVAELLMCDEKLLEDSLCQRVIVTPDGNITKPLDPDSALQSRDALAKTVYSRLFDWIVDKINNSIGQDPDAISIIGVLDIYGFESFKVNSFEQLCINMTNEKLQQHFNQHVFKMEQEEYTRDEIDWSYVEFVDNQDVLDLIEKKPGGIIALLDEACMFPKSTHETFAQKMYQTYKSHKRFSKPKLARTAFTINHYAGDVTYQSDYFLDKNKDYVVAEHQALLNSSRCSFVANLFPPLPEESSKQSKFSSIGTRFKQQLQALMETLSTTEPHYIRCVKPNTVLKPGIFENDNVLNQLRCGGVLEAIRISCAGYPTKRTFDEFIDRFGVLAPELVDSSDEKTACAAICDKMGLKGYQIGKTKVFLRAGQMAELDARRAEVLANAVRLIQRRIRTHLMRKDFISLKKASIQTQKFWRARLARKLFEHMRRVAAAITIQKHTRTHSAWKAYLQIYRSSITIQTGLRAMAARKEHRFRRETKATIIIQTRWRQHKAYVAYKQQKRASLILQCSWRGRVARKELRKLKMEARDNGALKEAKDKLEKRVEELTWRLDVEKHLRVDLEVAKGQEITKLQSALQEMQEKLEEAHAAIINEKEAAKLAIEQAPPKIVEVPVVDNAKVELLTSQNEELETELGTFRAKAEDLEKKLFEIQKQSDELSIEAQERESKINELQEMIARLETNLSNMESENHVLRQQSLLASADDDNKTKQIESLESKIAILESENQLLRSNPAPAVQAVVIPEVIEPAVVKVLENGHQHGEPKMEEVVVPPIKNLSKQQSLTDRQQENHDVLIKSLAEDRRYDNRRPAAACIVYKSLLHWHSFEAEKTNIFDRIIHTIRSSVENAESSGELAYWLSTTSTLLYLLQNTLKASSSSTKVPNRSRNATGNLFNRMVQNARSSSSGLGISNGYSGMVGRADTASRIEAKYPAVRFKQQLTAYVEKIYGMMRDSLKREISAILTLCIQAPRAGRVKASRGSLKSIHSSALSRQASSVHWQNIIKCLNHTLETMNSNYVPPMIIRKTFSQVFAFMNVQLFNSLLLRRECCSFSNGEFLKAGLQELEQWCSRTTEEYAGTSWDELQHIRQAVGFLVLHQKSHKTLDEITDELCPVLSISQIYRIGTMFWDDKYGAQGLSQEVIGNMRTMTTDDSITTPNSSFLLDDDSSIPISLDDIAQLMLDINPTDVEPPPLLRQNSQFHFLLQQHTD

SEQ ID NO: 23967 - protein, 1492 aa, Panicum virgatum
MTKLAYLHEPGVLHNLSCRYGLNEIYTYTGNILIAVNPFQRLPHLYDVHMMEQYKGATFGELSPHLFAIADACYRALINDHGSQSILVSGESGAGKTETTKMLMRYLAFMGGRSGTEGRTVEQQVLESNPVLEAFGNAKTVKNNNSSRFGKFVEIQFDKYGKISGAAVRTYLLERSRVCQVSDPERNYHCFYMLCNAPPEDVKRFKVGDPRSFHYLNQTNCYEVANVDDAREYIETRNAMDIVGIDQDEQDAIFRVVAAILHLGNIDFSKGKEIDSSKLRDDKSVHHLKTVAELLMCDEKALEDSLCQRVIVTPDGNITKPLDPDSAALSRDALAKTVYSRLFDWIVDKINNSIGQDPDATNIIGVLDIYGFESFKINSFEQLCINLTNEKLQQHFNQHVFKMEQEEYTREEIDWSYVEFVDNQDVLDLIEKKPGGIIALLDEACMFPKSTHETFAQKMYQTYKAHKRFSKPKLARTAFTINHYAGDVTYQADQFLDKNKDYVVAEHQALLNSSRCPFVANLFPPLPEETSKQSKFSSIGARFKQQLQSLMETLSTTEPHYIRCVKPNTVLKPGIFENFNVLNQLRCGGVLEAIRISCAGYPTKRTFDEFIDRFGMLAPELVDSSDEKAACAAICDRMGLKGYQIGKTKVFLRAGQMAELDARRAEVLANAARLIQRRIKTHLMRKEFVNLRKASVQSQKFWRARLARKLFEYMRRDAASIRIQKHARSHSARKVYRQVYESAIVIQTGLRAMAARNEHRFRRETKASIIIQTRWRQHKAYVAYKQQKRASLILQCLWRARVARKELRKLRMEARETGALKEAKDKLEKRVEELTWRLDVEKRLRTDLEEAKGQEIGKLQSALQEMQEKIEEAHAAVVKEKEAAKLAIEQAPPKIVEVPVVDTEKVEQLTSKNKELEDELSTFRQKAEDLENKLLEMQKRSDELSQETQERESKVNQLQEMIERLETSLSNMESENQVLRQQSLVVATADEDKSKQIERLESKIAILESEIQLLHSNSALAVQAVVTPAMNQTSVMEEIDNGHQLEEAKIVNEHVVVPPVKNLSKQKSLTDRQQENHDALIKSLVEDRRFDDKKSAAACIVYKSLLHWRSFEAEKTNIFDRIIQTIRSSVEGAESSGELAYWLSTTSTLLYLLQNTLKASSSSSKGSNRSRTATGSLFSRMVLSARTSSSGLGITSGYGGMVGRPDTASMVEAKYPALRFKQQLTAYVEKIYGIIRDNLKKEISPFLTLCIQAPRANRVRPSRGSLKSIHSNALSRQASSVHWQSIVKCLDNTLETMKNNHVPPMIIKKTFSQVYAYLNVQLFNSLLLRRECCSFSNGEFLKAGLQELEQWCSRTTEEYAGASWDELQHIRQAVGSLVLHQKSHKTLEEITNELCPILSITQIYRIATMFWDDKYGAQGLSQEVIGKMRTMTTDDTITTPNSSFLLDDDSSIPISLDDIAHLMLDIDPIDVEPPPLLRQNSQFHFLLQQHTD

SEQ ID NO: 23968 - protein, 1494 aa, Triticum aestivum
MTKLAYLHEPGVLHNLACRYSLNEIYTYTGNILIAVNPFQRLPHLYDVHMMEQYKGATFGELSPHLFAIADSCYRAMINEHGSQSILVSGESGAGKTETTKMLMRYLAFMGGRSGTEGRTVEQQVLESNPVLEAFGNAKTVKNNNSSRFGKFVEIQFDKYGKISGAAVRTYLLERSRVCQVSDPERNYHCFYMLCSAPPEDVKRFKVGNPRSFHYLNQTSCYEVANVDDAREYLETRNAMDIVGISQEEQDAIFRVVAAILHLGNINFSKGKEIDSSRLRDEKSINHLKIVAELLMCDEKLLEDSLCQRVIVTPDGNITKPLDPDSALQSRDALAKTVYSRLFDWIVDKINNSIGQDPDAISIIGVLDIYGFESFKVNSFEQLCINMTNEKLQQHFNQHVFKMEQEEYTRDEIDWSYVEFVDNQDVLDLIEKKPGGIIALLDEACMFPKSTHETFAQKMYQTYKSHKRFSKPKLARTAFTINHYAGDVTYQADYFLDKNKDYVVAEHQALLNSSRCSFVANLFPPLPEESSKQSKFSSIGTRFKQQLQALMETLSTTEPHYIRCVKPNTVLKPGIFENDNVLNQLRCGGVLEAIRISCAGYPTKRTFDEFIDRFGVLAPELVDSSDEKTACAAICDKMGLKGYQIGKTKVFLRAGQMAELDARRAEVLANAVRLIQRRIRTHLMRKEFVSLKKASIQTQKFWRARLARKLFEHMRRVAAAITIQKHTRTHSAWKAYLQIYRSSITIQTGLRAMAARKEHRFRRETKATIIIQTRWRQHKAYVAYKLQKRASLILQCSWRGRVARKELRKLKMEARDNGALKEAKDKLEKRVEELTWRLDVEKHLRVDLEVAKGQEITKLQSALQEMQEKLEEAHAAIINEKEAAKLAIEQAPPKIVEVPVVDNAKVELLTSQNEELETELGTFRTKAEDLEKKLFEIQKQSDELSREAQERDSKINELQEMIARLETNLSNMESENHVLRQQSLLASADDDNKTKQIESLESKIAILESENQVLCSNPAPAVQAVVNPEVIQPSVMKNSHQVLENGHQLGEPKMEEVVVPPIKNLSKQQSLTDRQQENHDILIKSLAEDRRYDNRRPAAACIVYKSLLHWHSFEAEKTNIFDRIIHTIRSSVENAESSGELAYWLSTTSTLLYLLQNTLKASSSSTKVPNRSRTATGNLFNRMVQNARSSSSGLGISNGYSGMVGRADTTSMIEAKYPAVRFKQQLTAYVEKIYGTMRDSLKREISAILTLCIQAPRAGRVRASRGSLKSIHSSALSRQASSVHWQNIVKCLNHTLETMNNNYVPPMIIRKTFSQVFAFMNVQLFNSLLLRRECCSFSNGEFLKAGLQELEQWCSRTTEEYAGTSWDELQHIRQAVGFLVLHQKSHKTLEEITDELCPVLSISQIYRIGTMFWDDKYGAQGLSQEVIGNMRTMTTDDSITTPNSSFLLDDDSSIPISLDDIARLMLDINPTDVEPPPLLRQNSQFHFLLQQHTD

SEQ ID NO: 23969 - protein, 675 aa, Triticum aestivum
MATYEPKNILITGAAGFIASHVANRLIRSYPHYKIVVLDKIDYCSNLKNLNPSRPSPNFKFVKGDIASADLVNYLLITESIDTIMHFAAQTHVDNSFGNSFEFTKNNIYGTHVLLEACKVTGQIRRFIHVSTDEVYGETDEDAVVGNHEASQLLPTNPYSATKAGAEMLVMAYGRSYGLPVITTRGNNVYGPNQFPEKLIPKFILLAMKGLPLPIHGDGSNVRSYLYCEDVAEAFEVVLHKGEVGHVYNIGTVKERRVIDVASDICKLFGLDTEKVIRFVENRPFNDQRYFLDDQKLKKLGWAERTTWEEGLKKTIEWYTSNPDYWGDVAGALLPHPRMLMTPGVERHNWTEEIKSLASSPAEAKECSTVPAAATSKSTSSVPQKATYKFLIYGKTGWIGGLLGKICEKQGIPYEYGKGRLQERSQLLQDIRNVKPTHVFNAAGVTGRPNVDWCETHKQDTIRTNVVGTLNLADVCREQGLLMINYATGCIFEYNAEHPEGSGIGFKEEDTPNFVGSFYSKTKAMVEELLKDYDNVCTLRVRMPISSDLSNPRNFITKIARYDKVVNIPNSMTILDELLPISVEMAKRDCRGIWNFTNPGVVSHNEILEMYKEYINPDFKWTNFTLEEQAKVIVAPRSNNEMDASKLKSEFPELLSIKESLIKNVFEPNRKVSTN

SEQ ID NO: 23970 - protein, 675 aa, Secale cereale
MATYEPKNILITGAAGFIASHVANRLIRSYPHYKIVVLDKIDYCSNLKNLNPSRPSPNFKFVKGDIASADLVNYLLITESIDTIMHFAAQTHVDNSFGNSFEFTKNNIYGTHVLLEACKVTGQIRRFIHVSTDEVYGETDEDAVVGNHEASQLLPTNPYSATKAGAEMLVMAYGRSYGLPVITTRGNNVYGPNQFPEKLIPKFILLAMKGLPLPIHGDGSNVRSYLYCEDVAEAFEVVLHKGEVGHVYNIGTVKERRVIDVASDICKLFGLDTEKVIRFVENRPFNDQRYFLDDQKLKKLGWAERTTWEEGLKKTIEWYTSNPDYWGDVAGALLPHPRMLMTPGVERHNWTDEIKSLASSPAEAKECSTVPAAATSKSTSSAPQKATYKFLIYGKTGWIGGLLGKICEKQGIPYEYGKGRLQERSQLLQDIRNVKPTHVFNAAGVTGRPNVDWCETHKQDTIRTNVVGTLNLADVCREQGLLMINYATGCIFEYNAEHPEGSGIGFKEEDTPNFVGSFYSKTKAMVEELLKDYDNVCTLRVRMPISSDLSNPRNFITKIARYDKVVNIPNSMTILDELLPISVEMAKRDCRGIWNFTNPGVVSHNEILEMYKEYINPDFKWTNFTLEEQAKVIVAPRSNNEMDASKLKSEFPELLSIKESLIKNVFEPNRKVSTN

SEQ ID NO: 23971 - protein, 675 aa, Hordeum vulgare
MATYEPKNILITGAAGFIASHVANRLIRSYPHYKIVVLDKIDYCSNLKNLNPSRPSPNFKFVKGDIASADLVNYLLITESIDTIMHFAAQTHVDNSFGNSFEFTKNNIYGTHVLLEACKVTGQIRRFIHVSTDEVYGETDEDAVVGNHEASQLLPTNPYSATKAGAEMLVMAYGRSYGLPVITTRGNNVYGPNQFPEKLIPKFILLAMKGLPLPIHGDGSNVRSYLYCEDVAEAFEVVLHKGEVGHVYNIGTVKERRVIDVASDICKLFGLDTEKVIRFVENRPFNDQRYFLDDQKLKKLGWAERTTWEEGLKKTIEWYTSNPEYWGDVAGALLPHPRMLMTPGVERHNWTEEIKSLASSPAEAKECNTVAAAATSNSTSSAPQKATYKFLIYGKTGWIGGLLGKICEKQSIPYEYGKGRLQERSQLLQDIRNVKPTHVFNAAGVTGRPNVDWCETHKQDTIRTNVVGTLNLADVCREQGLLMINYATGCIFEYNAEHPEGSGIGFKEEDTPNFVGSFYSKTKAMVEELLKDYDNVCTLRVRMPISSDLSNPRNFITKIARYDKVVNIPNSMTILDELLPISVEMAKRDCRGIWNFTNPGVVSHNEILEMYKEYINPDFKWTNFTLEEQAKVIVAPRSNNEMDASKLKSEFPELLSIKESLIKNVFEPNRKVSTN

SEQ ID NO: 23972 - protein, 673 aa, Setaria italica
MATYEPKNILITGAAGFIASHVANRLVRNYPHYKIVVLDKLDYCSNLKNLNPSRPSPNFKFVKGDIASADLVNYLLITESIDTIMHFAAQTHVDNSFGNSFEFTKNNIYGTHVLLEACKVTGQIRRFIHVSTDEVYGETEEDAVVGNHEASQLLPTNPYSATKAGAEMLVMAYGRSYGLPVITTRGNNVYGPNQFPEKLIPKFILLAMRGLPLPIHGDGSNVRSYLYCEDVAEAFEVVLHKGEVGHVYNIGTVKERRVIDVAKDICKLFGLDTEKVIRFVENRPFNDQRYFLDDQKLKKLGWAERTPWEEGLKKTIEWYTTNPDYWGDVTGALLPHPRMLMTPGVDERHNWTEEIKSLASSPVEASTTAPAASTQSTTDAPQKPSYKFLIYGRTGWIGGLLGKICEKQGIPYEYGKGRLEERSQLLEDIRNVKPTHVFNAAGVTGRPNVDWCETHKQDTIRTNVVGTLNLADVCREQGLLMINYATGCIFEYDAKHPEGSGIGFKEEDTPNFTGSFYSKTKAMVEELLKDYDNVCTLRVRMPISSDLGNPRNFITKIARYDKVVNIPNSMTILDELLPISIEMAKRDCRGIWNFTNPGVVSHNEILEMYKKYINPDFKWTNFTLEEQAKVIVAPRSNNEMDASKLKAEFPELLSIKDSLIKYVFEPNRKVPTN

SEQ ID NO: 23973 - protein, 675 aa, Oryza sativa
MAAYEPKNILITGAAGFIASHVANRLVRNYPHYKIVVLDKLDYCSSLSNLNPSRPSPNFKFVKGDIASADLVNYLLTTESIDTIMHFAAQTHVDNSFGNSFEFTKNNIYGTHVLLEACKVTGQIRRFIHVSTDEVYGETDEDAVVGNHEASQLLPTNPYSATKAGAEMLVMAYGRSYGLPVITTRGNNVYGPNQFPEKLIPKFILLAMRGLPLPIHGDGSNVRSYLYCEDVAEAFEVVLHKGEVGHVYNIGTVKERRVIDVAKDICKLFGLDTEKVIRFVENRPFNDQRYFLDDQKLKKLGWAERTLWEEGLKKTIEWYTNNPDYWGDVAGALLPHPRMLMTPGVERHNWTDEIKSLSTSPDEAKESSTAVPAATAKSTSSAPQKASYKFLIYGRTGWIGGLLGKICEKQGIPYEYGKGRLEERSQLLQDIRNVKPTHVFNAAGVTGRPNVDWCETHKQDTIRTNVVGTLNLADVCREQGLLMINYATGCIFEYDAKHPEGSGIGFKEEDKPNFTGSYYSKTKAMVEELLQEYDNVCTLRVRMPISSDLSNPRNFITKIARYDKVVNIPNSMTILDELLPISIEMAKRDCRGIWNFTNPGVVSHNEILEMYKKYLNPDFKWTNFTLEEQAKVIVAPRSNNEMDASKLKSEFPELLSIKDSLVKYVFEPNRKVPAN

SEQ ID NO: 23974 - protein, 673 aa, Pennisetum glaucum
MATYEPKNILITGAAGFIASHVANRLVRNYPHYKIVVLDKLDYCSNLKNLNPSRPSPNFKFVKGDIASADLVNYLLITESIDTIMHFAAQTHVDNSFGNSFEFTKNNIYGTHVLLEACKVTGQIRRFIHVSTDEVYGETDEDAVVGNHEASQLLPTNPYSATKAGAEMLVMAYGRSYGLPVITTRGNNVYGPNQFPEKLIPKFILLAMRGLPLPIHGDGSNVRSYLYCEDVAEAFEVVLHKGEVGHVYNIGTVKERRVIDVAKDICKLFGLDTEKVIRFVENRPFNDQRYFLDDQKLKRLGWAERTPWEEGLKKTIEWYTTNPDYWGDVTGALLPHPRMLMTPGVDERHNWTEEIKSLASLPVEASTTAPATSTQNITGAPQKPSYKFLIYGRTGWIGGLLGKICEKQGIPYEYGKGRLEERSQLLDDVRNVKPTHVFNAAGVTGRPNVDWCETHKQDTIRTNVVGTLNLADVCREQGLLMINYATGCIFEYDAKHPEGSGIGFKEEDTPNFTGSFYSKTKAMVEELLKDYDNVCTLRVRMPISSDLSNPRNFITKIARYDKVVNIPNSMTILDELLPISIEMAKRDCRGIWNFTNPGVVSHNEILEMYKKYINPEFKWTNFTLEEQAKVIVAPRSNNEMDASKLKAEFPELLSIKDSLIKNVFEPNRKVPAN

SEQ ID NO: 23975 - protein, 673 aa, Panicum virgatum
MATYEPKNILITGAAGFIASHVANRLVRNYPHYKIVVLDKLDYCSSLKNLNPSRPSPNFKFVKGDIASADLVNYLLITESIDTIMHFAAQTHVDNSFGNSFEFTKNNIYGTHVLLEACKVTGQIRRFIHVSTDEVYGETDEDAVVGNHEASQLLPTNPYSATKAGAEMLVMAYGRSYGLPVITTRGNNVYGPNQFPEKLIPKFILLAMRGLPLPIHGDGSNVRSYLYCEDVAEAFEVVLHKGEVGHVYNIGTVKERRVIDVAKDICRLFGLDTEKVIRFVENRPFNDQRYFLDDQKLKRLGWAERTPWEEGLKKTIEWYTTNPDYWGDVSGALLPHPRMLMTPGVDERHNWTEEIKSISSSPVEASTTAPATNTQSTTDAPQKHPYKFLIYGRTGWIGGLLGKICEKQGIPYEYGKGRLEERSQLLEDIRNVKPTHVFNAAGVTGRPNVDWCETHKQDTIRTNVVGTLNLADVCREQGLLMINYATGCIFEYDAKHPEGSGIGFKEEDTPNFTGSFYSKTKAMVEELLKDYDNVCTLRVRMPISSDLSNPRNFITKIARYDKVVNIPNSMTILDELLPISIEMAKRDCRGIWNFTNPGVVSHNEILEMYKKYINPEFKWTNFTLEEQAKVIVAPRSNNEMDASKLKAEFPELLSIKDSLIKNVFEPNRKVPSS

SEQ ID NO: 23976 - protein, 673 aa, Panicum virgatum
MATYEPKNILITGAAGFIASHVANRLVRSYPHYKIVVLDKLDYCSNLKNLNPSRPSPNFKFVKGDIASADLVNYLLITESIDTIMHFAAQTHVDNSFGNSFEFTKNNIYGTHVLLEACKVTGQIRRFIHVSTDEVYGETDEDAVVGNHEASQLLPTNPYSATKAGAEMLVMAYGRSYGLPVITTRGNNVYGPNQFPEKLIPKFILLAMRGLPLPIHGDGSNVRSYLYCEDVAEAFEVVLHKGEVGHVYNIGTVKERRVIDVAKDICRLFGLDTEKVIRFVDNRPFNDQRYFLDDQKLKRLGWAERTPWEEGLKKTIEWYTTNPDYWGDVSGALLPHPRMLMTPGVDERHNWTEETKYLSSSPLEASTTAPATSTQSTTDAPQKHPYKFLIYGRTGWIGGLLGKICEKQGIPYEYGKGRLEERSQLLEDIRNVRPTHVFNAAGVTGRPNVDWCETHKQDTIRTNVVGTLNLADVCREQGLLMINYATGCIFEYDAKHPEGSGIGFKEEDTPNFAGSFYSKTKAMVEELLKDYDNVCTLRVRMPISSDLSNPRNFITKIARYDKVVNIPNSMTILDELLPISIEMAKRDCRGIWNFTNPGVVSHNEILEMYKKYINPDFKWTNFTLEEQAKVIVAPRSNNEMDASKLKAEFPELLSIKDSLIKYVFEPNRKVPSN

SEQ ID NO: 23977 - protein, 672 aa, Setaria italica
MATYEPKNILITGAAGFIASHVANRLIRNYPHYKIVVLDKLDYCSSLKNLNPSRSSPNLKFVKGDIASADLVNYLLITESIDTIMHFAAQTHVDNSFGNSFEFTKNNIYGTHVLLEACKVTGQIRRFIHVSTDEVYGETEEDAVVGNHEASQLLPTNPYSATKAGAEMLVMAYGRSYGLPVITTRGNNVYGPNQFPEKLIPKFILLAMRGLPLPIHGDGSNVRSYLYCEDVAEAFEVVLHKGEVGHVYNIGTVKERRVIDVAKDICKLFGLDTEKVIRFVENRPFNDQRYFLDDQKLKRLGWAERTPWEEGLKKTIEWYTTNPDYWGDVAGALLPHPRMLMTPGVERHNWTEEIKSLFSSPAEVSTTAPAASTKSTTNAPQSPSYKFLIYGRTGWIGGLLGKICEKQGIPYEYGKGRLEERSQLLEDIRNVKPTHVLNAAGVTGRPNVDWCETHKQDTIRTNVVGTLNLADVCCEQGLLMINYATGCIFEYDAKHPEGSGIGFKEEDTPNFRGSFYSKTKAMVEELLKEYDNVCTLRVRMPISSDLSNPRNFITKIARYDKVVNIPNSMTILDELLPFSIEMAKRDCRGIWNFTNPGVVSHNEILEMYRKYINPDFKWTNFTLEEQAKVIVAPRSNNEMDASKLKVEFPELLSIKDSLIKYVFEPNRKVPAN

SEQ ID NO: 23978 - protein, 672 aa, Saccharum officinarum
MATYEPKNILITGAAGFIASHVANRLVRNYPQYKIVVLDKIDYCSNLKNLNPSRSSPNFKFVKGDIASADLVNYLLITESIDTIMHFAAQTHVDNSFGNSFEFTKNNIYGTHVLLEACKVTGQIRRFIHVSTDEVYGETDEDAVVGNHEASQLLPTNPYSATKAGAEMLVMAYGRSYGLPVITTRGNNVYGPNQFPEKLIPKFILLAMRGLPLPIHGDGSNVRSYLYCEDVAEAFEVVLHKGEVGHVYNIGTVKERRVIDVAKDMCRLFGLDTEKVIRFVENRPFNDQRYFLDDQKLKRLGWAERTPWEEGLKKTIEWYTTNPDYWGDVTGALLPHPRMLMTPGVERHNWTEEIKSLTSSPAEASTTAPATSTKRTTDAPQKPLYKFLIYGRTGWIGGLLGKICDKQGIPYEYGKGRLEERSQLLEDIRNVKPTHVFNAAGVTGRPNVDWCETHKQDTIRTNVVGTLNLADVCREQGLLVINYATGCIFEYDAKHPEGSGIGFKEEDTPNFTGSFYSKTKAMVEELLKEYDNVCTLRVRMPISSDLSNPRNFITKIARYDKVVNIPNSMTILDELLPISIEMAKRDCRGIWNFTNPGVVSHNEILEMYKKYINPDFKWTNFTLEEQAKVIVAPRSNNEMDASKLKAEFPQLLSIKDSLIKYVFEPNRKVPVN

SEQ ID NO: 23979 - protein, 672 aa, Zea mays
MATYEPKNILITGAAGFIASHVANRLVRNYPQYKIVVLDKIDYCSNLKNLNPSRSSPNFKFVKGDIASADLVNYLLITESIDTIMHFAAQTHVDNSFGNSFEFTKNNIYGTHVLLEACKVTGQIRRFIHVSTDEVYGETDEDAVVGNHEASQLLPTNPYSATKAGAEMLVMAYGRSYGLPVITTRGNNVYGPNQFPEKLIPKFILLAMQGLPLPIHGDGSNVRSYLYCEDVAEAFEVVLHKGEVGHVYNIGTVKERRVIDVAKDICKLFGLDTEKVIRFVENRPFNDQRYFLDDQKLKRLGWAERTPWEEGLKKTMEWYTTNPDYWGDVTGALLPHPRMLMTPGVERHNWAEEIKSLASSPAEASTIAPATSTKSISDAPQKPSYRFLIYGRTGWIGGLLGKICEKQGIPYEYGKGRLEERSQLLEDIRNVKPTHVFNAAGVTGRPNVDWCETHKQDTIRTNVVGTLNLADVCRKQGLLMINYATGCIFEYDAKHPEGSGIGFKEEDTPNFIGSFYSKTKAMVEELLKEYDNVCTLRVRMPISSDLSNPRNFITKIARYDKVVNIPNSMTILDELLPISIEMAKRDCRGIWNFTNPGAVSHNEILEMYKKYINPDFKWTNFTLEEQAKVIVAPRSNNEMDTSKLKAEFPQLLSIKDSLIKYVFEPNRKVPVN

SEQ ID NO: 23980 - protein, 672 aa, Sorghum bicolor
MATYEPKNILITGAAGFIASHVANRLVRNYPHYKIVVLDKLDYCSSLKNLNPSRASPNLKFVKGDIASADLVNYLLVTESIDTIMHFAAQTHVDNSFGNSFEFTKNNIYGTHVLLEACKVTGQIRRFIHVSTDEVYGETDEDAVVGNHEASQLLPTNPYSATKAGAEMLVMAYGRSYGLPVITTRGNNVYGPNQFPEKLIPKFILLAMRGLPLPIHGDGSNVRSYLYCEDVAEAFEVVLHKGEVGHVYNIGTVKERRVIDVAKDICRLFGLDTEKVIRFVENRPFNDQRYFLDDQKLKRLGWAERTPWEEGLKKTIEWYTTNPDYWGDVTGALLPHPRMLMTPGVERHNWTEEIKSLTSSPAEASTTAPATSTKRTTDAPQKPLYKFLIYGRTGWIGGLLGKICEKQGILYEYGKGRLEERSQLLEDIRNVKPTHVFNAAGVTGRPNVDWCETHKQDTVRTNVVGTLNLADVCREQGLLMVNYATGCIFEYDAKHPEGSGIGFKEEDTPNFTGSFYSKTKAMVEELLKEYDNVCTLRVRMPISSDLSNPRNFITKIARYDKVVNIPNSMTILDELLPISIEMAKQDCRGIWNFTNPGVVSHNEILEMYKKYINPDFKWTNFTLEEQAKVIVAPRSNNEMDASKLKAEFPQLLSIKDSLIKYVFEPNRKVPSI

SEQ ID NO: 23981 - protein, 672 aa, Sorghum bicolor
MATYEPKNILITGAAGFIASHVANRLVRNYPHYKIVVLDKLDYCSSLKNLNPSRASQNLKFVKGDIASADLVNHLLVTESIDTIMHFAAQTHVDNSFGNSFEFTKNNIYGTHVLLEACKVTGQIRRFIHVSTDEVYGETDEDAVVGNHEASQLLPTNPYSATKAGAEMLVMAYGRSYGLPVITTRGNNVYGPNQFPEKLIPKFILLAMRGLPLPIHGDGSNVRSYLYCEDVAEAFEVVLHKGEVGHVYNIGTVKERRVIDVAKDICRLFDLDTEKVIRFVENRPFNDQRYFLDDQKLKRLGWAERTPWEEGLKKTIEWYTTNPDYWGDVTGALLPHPRMLMTPGVERHNWTEEIKSLTSSPAEASTTAPATSTKRATDAPQKPLFKFLIYGRTGWIGGLLGKICEKQGIPYEYGKGRLEERSQLLEDIRNVKPTHVFNAAGVTGRPNVDWCETHKQDTIRTNVVGTLNLADICREQGLLMVNYATGCIFEYDAKHPEGSGIGFKEEDTPNFTGSFYSKTKAMVEELLKEYDNVCTLRVRMPISSDLSNPRNFITKIARYDKVVNIPNSMTILDELLPISIEMAKRDCRGIWNFTNPGVVSHNEILEMYKKYINPDFKWTNFTLEEQAKVIVARRSNNEMDASKLKAEFPQLLSIKDSLIKYVFEPNRKVPAI

SEQ ID NO: 23982 - protein, 672 aa, Zea mays
MATYEPKNILITGAAGFIASHVTNCLVRNYPHYKIVVLDKLDYCSSLKNLNPSRASPNLKFVKGDIASADLVNHLLVTESIDTIMHFAAQTHVDNSFGNSFEFTKNNIYGTHVLLEACKVTGQIRRFIHVSTDEVYGETDEDAVVGNHEASQLLPTNPYSATKAGAEMLVMAYGRSYGLPVITTRGNNVYGPNQFPEKLIPKFILLAMRGLPLPIHGDGSNVRSYLYCEDVAEAFEVVLHKGEVGHVYNIGTVKERRVIDVAKDICRLFGLDTEKVIRFVENRPFNDQRYFLDDQKLKRLGWAERTPWEEGLKKTIEWYTTNPDYWGDVTGALLPHPRMLMIPGVERHNWTEDIKSLTSSPAEASTTAPATSAKRTTAAPQKPLYKFLIYGRTGWIGGLLGKICDKQGIPYEYGKGRLEERSQLLEDIRNVKPTQVFNAAGVTGRPNVDWCETHKQDTIRTNVVGILNLADVCREQGLLMINYATGCIFEYDAKHPEGSGIGFKEEDTPNFTGSFYSKTKAMVEELLKEYDNVCTLRVRMPISSDLNNPRNFITKIARYDKVVNIPNSMTILDELLPISIEMAKRDCRGIWNFTNPGVVSHNEILEMYKKYINPDFKWTNFTLEEQSKVIVAPRSNNEMDASKLKAEFSQLMSIKDSLIKYVFEPNRKVPAN

SEQ ID NO: 23983 - protein, 672 aa, Panax ginseng
MANYTPKNILITGAAGFIASHVANRLIRSYPDYKIVVLDKLDYCSNLKNLNPSRSSPNFKFVKGDIGSADLVNYLLITESIDTIMHFAAQTHVDNSFGNSFEFTKNNIYGTHVLLEACKVTGQIRRFIHVSTDEVYGETEEDAVVGNHEASQLLPTNPYSATKAGAEMLVMAYGRSYGLPVITTRGNNVYGPNQFPEKLIPKFILLAMRGKQLPIHGDGANVRSYLYCEDVAEAFEVILHKGEVGHVYNIGTKKERRVIDVAKDICKLMSMDPETNINFVENRPFNDQRYFLDDQKLKNLGWSERTTWEEGLKKTMDWYTSNPDWWGDVSGALLPHPRMLMMPGGIERHFDGSANCDSESSHKADKSTQSQVVVSNSKSSSSPQKPSFKFLIYGRTGWIGGLLGKLSEKQGIPYEYGKGRLEDRSQLLADIQTVKPTHVFNAAGVTGRPNVDWCESHKTETIRTNVAGTLNLADVCRDQGLLMINFATGCIFEYDAAHPEGSGIGFKEEDTPNFHGSFYSKTKAMVEELLKEYDNVCTLRVRMPISSDLSNPRNFITKISRYNKVVNIPNSMTILDELLPISIEMAKRNLRGIWNFTNPGVVSHNEILEMYKKYIDPAFQWANFTLEEQAKVIVAARSNNEMDASKLKKEFPELLSIKESLIKYVFEPNKKA

SEQ ID NO: 23984 - protein, 666 aa, Elaeis guineensis
MATYKPKNILITGAGGFIASHVANCLIRNYPEYKIVVLDKLDYCSNLKNLNPSRSSPNFKFVKGDIGSADLVNYLLITESIDTIMHFAAQTHVDNSFGNSFEFTKNNIYGTHVLLEACKVTGQIRRFIHVSTDEVYGETDEDAVVGNHEASQLLPTNPYSATKAGAEMLVMAYGRSYGLPVITTRGNNVYGPNQFPEKLIPKLILLAMRGLPLPIHGDGSNVRSYLYCEDVAEAFEVILHKGEVGHVYNIGTKKERRVIDVAKDICKLFSLDPDTVIKFVENRPFNDQRYFLDDEKLKNLGWSERTTWEEGLKKTMEWYTSNPDWWGDVSGALVPHPRMLMMPGIERCIDGSEEVKGMVSQFTNNQSRMVVPVSKGISGSPRKHSLKFLIYGRTGWIGGLLGKICEKQGIPFEYGRGRLEERSQLILDIQNVKPTHVFNAAGVTGRPNVDWCESHKTETIRTNVVGTLTLADVCRENGLLLMNYATGCIFEYDAGHPEGSGIGFKEEDKPNFTGSFYSKTKAMVEELLKEYENVCTLRVRMPISSDLSNPRNFITKITRYNKVVNIPNSMTILDELLPISVEMAKRNCRGIWNFTNPGVVSHNEILEMYKKYIDPSFTWANFTLEEQAKVIVAPRSNNEMDASKLKSEFPELLSIKESLIKYVFEP

SEQ ID NO: 23985 - protein, 672 aa, Panax ginseng
MANYTPKNILITGAAGFIASHVANRLIRSYPDYKIVVLDKLDYCSNLKNLNPSRSSPNFKFVKGDIGSADLVNYLLITESIDTIMHFAAQTHVDNSFGNSFEFTKNNIYGTHVLLEACKVTGQIRRFIHVSTDEVYGETEEDAVVGNHEASQLLPTNPYSATKAGAEMLVMAYGRSYGLPVITTRGNNVYGPNQFPEKLIPKFILLAMRGKQLPIHGDGANVRSYLYCEDVAEAFEVILHKGEVGHVYNIGTKKERRVIDVAKDICKLISIDPETNINFVENRPFNDQRYFLDDQKLKNLGWSERTTWEEGLKKTMDWYTSNPDWWGDVSGALLPHPRMLMMPGGIERHFDGSANCDSESSHKADKYTQSQVVVSNSKSSSSPQKPSFKFLIYGRTGWIGGLLGKLSEKQGIPYEYGKGRLEDRSQLLADIQTVKPSHVFNAAGVTGRPNVDWCESHKTETIRTNVAGTLNLADVCRDQGLLMINFATGCIFEYDAEHPEGSGIGFKEEDTPNFHGSFYSKTKAMVEELLKEYDNVCTLRVRMPISSDLSNPRNFITKISRYNKVVNIPNSMTILDELLPISIEMAKRNLRGIWNFTNPGVVSHNEILEMYKKYIDPAFQWANFTLEEQAKVIVAARSNNEMDASKLNKEFPELLSIKESLIKYVFEPNKKA

SEQ ID NO: 23986 - protein, 674 aa, Solanum phureja
MSTYTPKNILITGAAGFIACHVANRLVRSYPDYKIVVLDKLDYCSNLKNLIPSRSSPNFKFVKGDIASADLVNYLLITESIDTIMHFAAQTHVDNSFGNSFEFTKNNIYGTHVLLEACKVTGQIKRFIHVSTDEVYGETDEDAVVGNHEASQLLPTNPYSATKAGAEMLVMAYGRSYGLPVITTRGNNVYGPNQFPEKLIPKFILLAMRGKPLPIHGDGCNVRSYLYCEDVAEAFEVVLHKGEVGHVYNIGTTKERRVIDVAQDICKLFNIDSEKVIQFVENRPFNDQRYFLDDQKLKNLGWSETTMWEEGLKKTIEWYKNNPDWWGDVSGALLPHPRMLMMPGDIERNLDGAEKYDSGSTEFSGKSNETKTAAPASKTSNVPQKSPFKFLIYGRTGWIGGVLGKLCEKQGIPYEYGRGRLEDRSKLLADINSVKPTHVFNAAGVTGRPNVDWCESHKPETIRTNVAGTLNLADVCRENGLLMVNFATGCIFEYDAAHPEGSGIGFKEEDTPNFAGSFYSKTKAMVEDLLKNYDNVCTLRVRMPISSDLSNPRNFITKISRYNKVVNIPNSMTILDELLPISIEMAKRNLRGIWNFTNPGVVSHNEILEMYKKYIDPAFTYANFTVEEQAKVIVAARSNNEMDASKLKKEFPELLSIKESLIKNVFEPNKKTSA

SEQ ID NO: 23987 - protein, 674 aa, Solanum lycopersicum
MSTYTPKNILITGAAGFIACHVANRLVRSYPDYKIVVLDKLDYCSSLKNLIPSRSSPNFKFVKGDIASADLVNYLLITESIDTIMHFAAQTHVDNSFGNSFEFTKNNIYGTHVLLEACKVTGQIRRFIHVSTDEVYGETDEDAVVGNHEASQLLPTNPYSATKAGAEMLVMAYGRSYGLPVITTRGNNVYGPNQFPEKLIPKFILLAMRGKPLPIHGDGCNVRSYLYCEDVAEAFECVLHKGEVGHVYNIGTTKERRVIDVAQDICKLFDIDSDKVIQFVENRPFNDQRYFLDDQKLKNLGWSETTRWEEGLKKTIEWYKNNPDWWGDVSGALLPHPRMLMMPGDIERNLDGAEKYDSGSTEFSGKSNETKTAAPASKTSNVPQKSPFKFLIYGRTGWIGGVLGKLCEKQGIPYEYGKGRLEDRSKLLADINSVKPTHVFNAAGVTGRPNVDWCESHKPETIRTNVAGTLNLADVCRENGLLMVNFATGCIFEYDAAHPEGSGIGFKEEDTPNFAGSFYSKTKAMVEDLLKNYDNVCTLRVRMPISSDLSNPRNFITKISRYNKVVNIPNSMTILDELLPISIEMAKRNLRGIWNFTNPGVVSHNEILEMYKKYIDPAFTYANFTVEEQAKVIVAARSNNEMDASKLKKEFPELLSIKESLIKYVFEPNKKTSA

SEQ ID NO: 23988 - protein, 672 aa, Musa acuminata
MAAYNPKNILITGAAGFIASHVANRLVRNYPEYKIVVLDKLDYCSNLKNLNPSRSSPNFKFVKGDIGSADLVNYLLITESIDTIMHFAAQTHVDNSFGNSFEFTKNNIYGTHVLLEACKVTGQIRRFIHVSTDEVYGETDEDAVVGNHEASQLLPTNPYSATKAGAEMLVMAYGRSYGLPVITTRGNNVYGPNQFPEKLIPKFILLAMRGHPLPIHGDGSNVRSYLYCEDVAEAFEVVLHRGEVGHVYNIGTKKERRVIDVAKDVCKLFSLEADRVIEFVENRPFNDQRYFLDDQKLKNIGWSERTTWEEGLKKTMEWYTSNPDWWGDVSGALLPHPRMLMMPGIERHVDGAEETKVTVSQSANTNSQKRMVVPTPRTSSKKPHLKFLIYGKTGWIGGLLGMICEKQGIPYEYGRGRLEERSQLILDIQNVKPSHVFNAAGVTGRPNVDWCESHKQETIRTNVVGTLTLADVCREHGLLLMNYATGCIFEYDTEHLEGSGIGFKEEDKPNFTGSFYSKTKAMVEELLKEYENVCTLRVRMPISSDLSNPRNFITKITRYNKVVNIPNSMTVLDELLPISIEMAKRNCRGIWNFTNPGAVSHNEILEMYKSYIDPSFKWVNFTLEEQAKVIVAPRSNNEMDATKLKREFPELLSIKDSLIKYVFEPNKKVLSN

SEQ ID NO: 23989 - protein, 673 aa, Ambrosia trifida
MATYEPKNILITGAAGFIASHVANRLIRNYPDYKIVVLDKLDYCSNLKNLNPSRSSPNFKFVKGDIGSADLVNYLLITESIDTIMHFAAQTHVDNSFGNSFEFTKNNIYGTHVLLEACKVTGQIRRFIHVSTDEVYGETEEDAVVGNHEASQLLPTNPYSATKAGAEMLVMAYGRSYGLPVITTRGNNVYGPNQFPEKLIPKFILLAMRGQPLPIHGDGSNVRSYLYCEDVAEAFEVILHKGEVGHVYNIGTKKERRVIDVAKDMCKLFNMDPDSSIKFVENRPFNDQRYFLDDEKLKSLGWSERTLWEEGLKKTIEWYTSNPNWWGDVSGALLPHPRMLMMPGGVDRLVDGPENAEFDSAGVAINTSQIGVQIPSSKASGVSAKKPALKFLIYGKTGWIGGLLGKLCEKQQIQYEYGRGRLEDRSQLLTDIQTSKPTHVFNAAGVTGRPNVDWCESHKTETIRTNVSGTLNLADVCREHGLLMINFATGCIFEYDAKHPEGSGIGFKEEDTPNFTGSFYSKTKAMVEELLKEYDNVCTLRVRMPISSDLNNPRNFITKIARYDKVVNIPNSMTILDELLPISIEMAKRNLRGIWNFTNPGVVSHNEILEMYKKYINPEFKWENFTLEEQAKVIVAPRSNNELDASKLKKEFPELLSIKESLIKYVFEPNKKQ

SEQ ID NO: 23990 - protein, 669 aa, Arabidopsis lyrata
MASYTPKNILITGAAGFIASHVANRLIRSYPHYNIVVLDKLDYCSNLKNLNPSKQSPNFKFVKGDIASADLVNHLLITEGIDTIMHFAAQTHVDNSFGNSFEFTKNNIYGTHVLLEACKVTGQIRRFIHVSTDEVYGETDEDALVGNHEASQLLPTNPYSATKAGAEMLVMAYGRSYGLPVITTRGNNVYGPNQFPEKLIPKFILLAMRGQVLPIHGDGSNVRSYLYCEDVAEAFEVILHKGEVGHVYNIGTKKERRVNDVARDICKLFSMDPEANIKFVENRPFNDQRYFLDDQKLKKLGWSERTTWEEGLKKTMEWYTQNPEWWGDVSGALLPHPRMLMMPGGRHFDGSEDNSLAATLSEKPSQTHMVVPSPRSSGTPQKPSLKFLIYGKTGWIGGLLGKICEKQGIAYEYGKGRLEDRSSLLQDIQSVKPTHVFNSAGVTGRPNVDWCESHKTETIRANVAGTLTLADVCREHGLLMMNFATGCIFEYDDKHPEGSGIGFKEEDTPNFTGSFYSKTKAMVEELLKEYDNVCTLRVRMPISSDLNNPRNFITKISRYNKVVNIPNSMTVLDELLPISVEMAKRNLKGIWNFTNPGVVSHNEILEMYRDYINPEFKWANFTLEEQAKVIVAPRSNNEMDASKLKKEFPELLSIKESLIKYAFEPNKKT

SEQ ID NO: 23991 - protein, 673 aa, Flaveria ramosissima
MANYTPKNILITGAAGFIASHVANRLVRSYPDYKIVVLDKLDYCSNLKNLNPSRSSPNFKFVKGDIGSADLVNYLLITESIDTIMHFAAQTHVDNSFGNSFEFTKNNIYGTHVLLEACKVTGQIRRFIHVSTDEVYGETEEDAVVGNHEASQLLPTNPYSATKAGAEMLVMAYGRSYGLPVITTRGNNVYGPNQFPEKLIPKFILLAMRGQPLPIHGDGSNVRSYLYCEDVAEAFEVILHKGEVGHVYNIGTKRERRVIDVAKDMCKLFNMDPDSSIKFVENRPFNDQRYFLDDEKLKSLGWSERTVWEEGLKKTIEWYTSNPNWWGDVSGALLPHPRMLMMPGGVDRHIDGPENAEFDSANLAINTSQIGVQVPSSKTSSISSKKPTLKFLIYGKTGWIGGLLGKLCEKQQIQYEYGKGRLEDRSQLLADIQTIKPTHVFNAAGVTGRPNVDWCESHKTETIRTNVSGTLNLADVCREHGLLMINFATGCIFEYDAKHPEGSGIGFKEEDTPNFTGSFYSKTKAMVEELLKEYDNVCTLRVRMPISSDLNNPRNFITKIARYNKVVNIPNSMTILDELLPISIEMAKRNLTGIWNFTNPGVVSHNEILEMYKKYINPEFKWVNFTLEEQAKVIVAPRSNNELDASKLKNEFPELLSIKESLIKYVFEPNKKH

SEQ ID NO: 23992 - protein, 673 aa, Helianthus annuus
MATYEPKNILITGAAGFIASHVANRLIRNYPDYKIVVLDKLDYCSNLKNLNPSRSSPNFKFVKGDIGSADLVNYLLITESIDTIMHFAAQTHVDNSFGNSFEFTKNNIYGTHVLLEACKVTGQIRRFIHVSTDEVYGETEEDAVVGNHEASQLLPTNPYSATKAGAEMLVMAYGRSYGLPVITTRGNNVYGPNQFPEKLIPKFILLAMRGQPLPIHGDGSNVRSYLYCEDVAEAFEVILHKGEVGHVYNIGTKKERRVIDVAKDMCKLFNMDPDSSIKFVENRPFNDQRYFLDDEKLKSLGWSERTIWEEGLKKTIEWYTSNPNWWGDVSGALLPHPRMLMMPGGVDRLVDGPENADFDSADVAINTSQIGVQIPSSKASGIAPKKPALKFLIYGKTGWIGGLLGKLCEKQQIQYEYGKGRLEDRSQLLADIQTIKPTHVFNAAGVTGRPNVDWCESHKTETIRTNVSGTLNLADVCREHGLLMINFATGCIFEYDAKHPEGSGIGFKEEDTPNFTGSFYSKTKAMVEELLKEYDNVCTLRVRMPISSDLNNPRNFITKIARYDKVVNIPNSMTILDELLPISMEMAKRNLRGIWNFTNPGVVSHNEILEMYKEYINPEFKWVNFTLEEQAKVIVAARSNNELDASKLKKEFPELLSIKESLIKYVFEPNKQQ

SEQ ID NO: 23993 - protein, 672 aa, Helianthus annuus
MANYTPKNILITGAAGFIASHVANRLIRSYPDYKIVVLDKLDYCSNLKNLNPSRSSPNFKFVKGDIGSADLVNYLLITESIDTIMHFAAQTHVDNSFGNSFEFTKNNIYGTHVLLEACKVTGQIRRFIHVSTDEVYGETDEDAVVGNHEASQLLPTNPYSATKAGAEMLVMAYARSYGLPVITTRGNNVYGPNQFPEKLIPKFILLAMRGQPLPIHGDGSNVRSYLYCEDVAEAFEVILHKGEVGHVYNIGTKRERRVIDVAKDMCKLFNMDPDSSIKFVENRPFNDQRYFLDDEKLKSLGWSERTIWEEGLKKTIEWYTSNPNWWGDVSGALLPHPRMLMMPGGVDRLVDGPENAEFDSSNLAINTSQIGVQVPSSKTSVSSKKPALKFLIYGKTGWIGGLLGKLCEKQQIQYEYGKGRLEDRSQLLADIQTIKPTHVFNAAGVTGRPNVDWCESHKTETIRTNVSGTLNLADVCREHGLLMINFATGCIFEYDAKHPEGSGIGFKEEDTPNFIGSFYSKTKAMVEELLKEYDNVCTLRVRMPISSDLNNPRNFITKIARYNKVVNIPNSMTILDELLPISIEMAKRNLRGIWNFTNPGVVSHNEILEMYKKYINPEFKWVNFTLEEQAKVIVAPRSNNELDASKLKKEFPELMSIKESLIKYVFEPNKKH

SEQ ID NO: 23994 - protein, 674 aa, Nicotiana benthamiana
MSTYTPKNILITGAAGFIACHVANRLVRSYPDYKIVVLDKLDYCSNLKNLIPSRSSPNFKFVKGDIASADLVNYLLITESIDTIMHFAAQTHVDNSFGNSFEFTKNNIYGTHVLLEACKVTGQIRRFIHVSTDEVYGETDEDAVVGNHEASQLLPTNPYSATKAGAEMLVMAYGRSYGLPVITTRGNNVYGPNQFPEKLIPKFILLAMRGKTLPIHGDGCNVRSYLYCEDVAEAFEVILHKGEVGHVYNIGTTKERRVIDVAKDICKLFNMDPDKSIEFVENRPFNDQRYFLDDQKLKELGWSERTLWEEGLKKTIEWYTKNPDWWGDVSGALLPHPRMLMMPGGIERHLDGAEKYDSGSSEFSAKSNETKTVAPAPKSSEMPQKSPFKFLIYGRTGWIGGLLGKLCEKQGIPYEYGKGRLEDRSKLLADINALKPTHVFNAAGVTGRPNVDWCESHKPETIRTNVAGTLNLADVCREHGLLMMNFATGCIFEYDAKHPEGSGIGFKEEDTPNFAGSFYSKTKAMVEELLKEYDNVCTLRVRMPISSDLNNPRNFITKISGYNKVVNIPNSMTILDELLPISIEMAKRNLKDIWNFTNPGVVSHNEILEMYKKYIDPAFTWANFTVEEQAKVIVAARSNNEMDASKLKKEFPELLPIKESLIKYVFEPNKKTSA

SEQ ID NO: 23995 - protein, 671 aa, Daucus carota
MANYTPKNILITGAAGFIASHVANRLVRSYPEYKIVVLDKLDYCSNLKNLNPSRTAPNFKFVKGDIGSADLVNYLLITESIDTIMHFAAQTHVDNSFGNSFEFTKNNIYGTHVLLEACKVTGQIRRFIHVSTDEVYGETDEDAVVGNHEASQLLPTNPYSATKAGAEMLVMAYGRSYGLPVITTRGNNVYGPNQFPEKLIPKFILLAMRGMQLPIHGDGANVRSYLYCEDVAEAFEVVLHKGEVGHVYNIGTKKERRVTDVAQDICKLFSMDPQSNIKYVENRPFNDQRYFLDDQKLKNLGWAERTTWEEGLKKTMDWYTSNPDWWGDVSGALLPHPRMLMMPGGIERHFDGSENRDAESTRFVDKSAPSQVSSSDPKSTVPQKLALKFLIYGRTGWIGGLLGKLCEKQGIPYEYGRGRLEYRSQLVSDLQIVKPTHVFNAAGVTGRPNVDWCESHKTETIRTNVTGTLTLADVCREQGLLMINFATGCIFEYDAAHPEGSGIGFKEEDTPNFHGSFYSKTKAMVEELLKEYDNVCTLRVRMPISSDLSNPRNFITKISRYNKVVNIPNSMTVLDELLPISIEMAKRNLRGIWNFTNPGVVSHNEILEMYKNYIDPSFKWANFTLEEQAKVIVAARSNNEMDGSKLKTEFPELLSIKESLIKYVFEPNKKT

SEQ ID NO: 23996 - protein, 672 aa, Musa acuminata
MATYEPKNILITGAAGFIASHVANRLVRNYPKYKIVVLDKLDYCSNLKNLNPSRSSPNFRFVKGDIGSADLVNYLLITESIDTIMHFAAQTHVDNSFGNSFEFTTNNIYGTHVLLEACKVTGQVRRFIHVSTDEVYGETDEDAVVGNHEASQLLPTNPYSATKAGAEMLVMAYGRSYGLPVITTRGNNVYGPNQFPEKLIPKFILLAMRGQPLPIHGDGSNVRSYLYCEDVAEAYEVVLHKGEVGHVYNIGTKKERRVIDVAVDICKLFSLDTDTVIKFVENRPFNDQRYFLDDQKLKNLGWSEKTIWEEGLKKTMEWYMNNPDWWGDVSGALLPHPRMLMMPGIERHIDGSEETKDMVYQEMSTSNQNGMVVPSIRTSLKKPHLKFLIYGRTGWIGGLLGKLCEKQDIPYEYGRGRLEERSQLIRDIQNVKPSHVFNAAGVTGRPNVDWCESHKQETIRTNVVGTLTLADVCRENGLLLMNYATGCIFEYDARHPEGSGIGYKEEDKPNFTGSFYSKTKAMVEELLKEFDNVCTLRVRMPISSDLSNPRNFITKISRYNKVVNIPNSMTVLDELLPISIEMAKRSCRGIWNFTNPGVVSHNEILEMYKSYIDPSFKWTNFTLEEQAKVIVAPRSNNEMDASKLKREFPELLSIKDSIIKYVFEPNKKVLSN

SEQ ID NO: 23997 - protein, 611 aa, Echinochloa colona
KGDIASADLVNYLLITESIDTIMHFAAQTHVDNSFGNSFEFTKNNIYGTHVLLEACKVTGQIRRFIHVSTDEVYGETDEDAVVGNHEASQLLPTNPYSATKAGAEMLVMAYGRSYGLPVITTRGNNVYGPNQFPEKLIPKFILLAMRGLPLPIHGDGSNVRSYLYCEDVAEAFEVVLHKGEVGHVYNIGTVKERRVIDVAKDICRLFGLDTEKVIRFVENRPFNDQRYFLDDQKLKRLGWAERTPWEEGLKKTIEWYTTNPDYWGDVTGALLPHPRMLMTPGVDERHNWTEEIKSLSSSPMEASITAPATSTQNTTDTPQKPPYKFLIYGRTGWIGGLLGKICEKQGISYEYGKGRLEERSQLLEDIRNVKPTHVFNAAGVTGRPNVDWCETHKQDTIRTNVVGTLNLADVCREQGLLMINYATGCIFEYDAKHPEGSGIGFKEEDTPNFTGSFYSKTKAMVEELLKDYDNVCTLRVRMPISSDLSNPRNFITKIARYDKVVNIPNSMTILDELLPISIEMAKRDCRGIWNFTNPGVVSHNEILEMYKKYINPDFKWTNFTLEEQAKVIVAPRSNNEMDASKLKAEFPELLSIKDSLIKYVFEPNRKVPAN

SEQ ID NO: 23998 - protein, 673 aa, Ambrosia trifida
MATYEPKNILITGAAGFIASHVANRLIRNYPDYKIVVLDKLDYCSNLKNLNPSRSSPNFKFVKGDIGSADLVNYLLITESIDTIMHFAAQTHVDNSFGNSFEFTKNNIYGTHVLLEACKVTGQIRRFIHVSTDEVYGETEEDAVVGNHEASQLLPTNPYSATKAGAEMLVMAYGRSYGLPVITTRGNNVYGPNQFPEKLIPKFILLAMRGQPLPIHGDGSNVRSYLYCEDVAEAFEVILHKGEVGHVYNIGTKKERRVIDVAKDMCKLFNMDPDSSIKFVENRPFNDQRYFLDDEKLKSLGWSERTLWEEGLKKTIEWYTSNPNWWGDVSGALLPHPRMLMMPGGVDRLVDGPENAEFDSAGVAINTSQIGVQIPSSKTSGVSAKKPALKFLIYGKTGWIGGLLGKLCEKQQIQYEYGRGRLEDRSQLLADIQSIKPTHVFNAAGVTGRPNVDWCESHKTETIRTNVSGTLNLADVCREHGLLMINFATGCIFEYDAKHPEGSGIGFKEEDTPNFTGFIHFKTKAMVEELLKEYDNVCTLRVRMPISSDLNNPRNFITKIARYDKVVNIPNSMTILDELLPISIEMAKRNLRGIWNFTNPGVVSHNEILEMYKKYINPEFKWENFTLEEQAKVIVAPRSNNELDASKLKKEFPELLSIKESLIKYVFEPNKKQ

SEQ ID NO: 23999 - protein, 671 aa, Daucus carota
MANYTPKNILITGAAGFIASHVANRLVRSYPEYKIVVLDKLDYCSNLKNLNPSRTAPNFKFVKGDIGSADLVNYLLITESIDTIMHFAAQTHVDNSFGNSFEFTKNNIYGTHVLLEACKVTGQIRRFIHVSTDEVYGETDEDAVVGNHEASQLLPTNPYSATKAGAEMLVMAYGRSYGLPVITTRGNNVYGPNQFPEKLIPKFILLAMRGMQLPIHGDGANVRSYLYCEDVAEAFEVVLHKGEVGHVYNIGTKKERRVTDVAKDICKLFSVDPETNINYVENRPFNDQRYFLDDQKLKNLGWAERTTWEEGLKKTMDWYTSNPDWWGDVSGALLPHPRMLMMPGGIERHFDGSENRDAESTRFVDKSAPSQVSSSDPKSTVPQKLALKFLIYGRTGWIGGLLGKLCEKQGIPYEYGRGRLEYRSQLVSDLQIVKPTHVFNAAGVTGRPNVDWCESHKTETIRTNVTGTLTLADVCREQGLLMINFATGCIFEYDAAHPEGSGIGFKEEDTPNFHGSFYSKTKAMVEELLKEYDNVCTLRVRMPISSDLSNPRNFITKISRYNKVVNIPNSMTVLDELLPISIEMAKRNLKGIWNFTNPGVVSHNEILEMYKQYIDPSFKYSNFTLEEQAKVIVAARSNNEMDGAKLKAEFPELLSIKESLIKYVFEPNKKV

SEQ ID NO: 24000 - protein, 672 aa, Chrysanthemum coronarium
MATYTPKNILITGAAGFIASHVANRLIRSYPDYKIVVLDKLDYCSNLKNLNPSRSSPNFKFVKGDIGSADLVNYLLITESIDTIMHFAAQTHVDNSFGNSFEFTKNNIYGTHVLLEACKVTGQIRRFIHVSTDEVYGETEEDAIVGNHEASQLLPTNPYSATKAGAEMLVMAYGRSYGLPVITTRGNNVYGPNQFPEKLIPKFILLAMQGKPLPIHGDGSNVRSYLYCEDVAEAFEVILHKGEVGHVYNIGTKRERRVIDVAKDMCKLFNMDADASIKFVENRPFNDQRYFLDDEKLKSLGWSERTRWEEGLKKTIEWYTSNPNWWGDVSGALLPHPRMLMMPGGVDRLADGPDHSEFDAADPAINTAQIGVQVPSKTSSNAPKKPALKFLIYGKTGWIGGLLGKLCEKQGIQYEYGKGRLEDRSQLLSDIQTIKPTHVFNAAGVTGRPNVDWCESHKTETIRVNVCGTLNLADVCREQGLLMINFATGCIFEYDAKHPEGSGIGFKEEDTPNFTGSFYSKTKAMVEELLKEYDNVCTLRVRMPISSDLNNPRNFITKIARYNKVVNIPNSMTILDELLPISIEMAKRNLKGIWNFTNPGVVSHNEILEMYKKYINPEFKWQNFTLEEQALVIVAPRSNNELDASKLKKEFPELLSIKESLIKYVFEPNKKQ

SEQ ID NO: 24001 - protein, 668 aa, Glycine max
MASYTPKNILITGAAGFIASHVANRLVRSYPDYKIVVLDKLDYCSSLKNLLPSKSSPNFKFVKGDIGSADLVNYLLITESIDTIMHFAAQTHVDNSFGNSFEFTKNNIYGTHVLLEACKVTGQIRRFIHVSTDEVYGETEEDAVVGNHEASQLLPTNPYSATKAGAEMLVMAYGRSYGLPVITTRGNNVYGPNQFPEKLIPKFILLAMQGKNLPIHGDGSNVRSYLYCEDVAEAFEVVLHKGEVGHVYNIGTKKERRVVDVAKDICRLFSMDPETCIKFVENRPFNDQRYFLDDQKLKDLGWSERTTWEEGLKKTMDWYINNPDWWGDVTGALLPHPRMLMMPGGLERHFEGSEEGKPASFGSSNTRIVVPSSKNTSSQQKHPFMFLIYGRTGWIGGLLGKLCEKQGIPYEYGKGRLEDRSSLLADLQNVKPTHVFNAAGVTGRPNVDWCESHKTETIRTNVAGTLTMADVCREHGILMINYATGCIFEYNATHPEGSGIGFKEEDKPNFIGSFYSKTKAMVEELLRDYDNVCTLRVRMPISSDLSNPRNFITKISRYNKVVNIPNSMTILDELLPISIEMAKRNLKGIWNFTNPGVVSHNEILEMYRDYIDPNFKWSNFTLEEQAKVIVAPRSNNEMDASKLKTEFPELLSIKESLIKYVFEPNKKT

SEQ ID NO: 24002 - protein, 668 aa, Glycine max
MASYTPKNILITGAAGFIASHVANRLVRSYPDYKIVVLDKLDYCSNLKNLLPSKSSPNFKFVKGDIGSADLVNYLLITESIDTIMHFAAQTHVDNSFGNSFEFTKNNIYGTHVLLEACKVTGQIRRFIHVSTDEVYGETEEDAVVGNHEASQLLPTNPYSATKAGAEMLVMAYGRSYGLPVITTRGNNVYGPNQFPEKLIPKFILLAMQGKNLPIHGDGSNVRSYLYCEDVAEAFEVVLHKGEVGHVYNIGTKKERRVIDVAKDICRLFSMDPEICIKFVENRPFNDQRYFLDDQKLKDLGWSERTTWEEGLKKTMDWYINNPDWWGDVTGALLPHPRMLMMPGGLDRHFEGSEEEKPASFGSSNTRMVVPPSKNTSSQHKHPFKFLIYGRTGWIGGLLGKLCEKQGIPYEYGKGRLEDRSSLMADLQNVKPTHVFNAAGVTGRPNVDWCESHKTETIRTNVVGTLTMADVCREHGILMVNYATGCIFEYNATHPEGSGIGFKEEDKPNFIGSFYSKTKAMVEELLREYDNVCTLRVRMPISSDLSNPRNFITKISRYNKVVNIPNSMTILDELLPISIEMAKRNLRGIWNFTNPGVVSHNEILEMYRDYIDPNFKWANFTLEEQAKVIVAPRSNNEMDASKLKTEFPELLSIKESLIKYVFEPNKKT

SEQ ID NO: 24003 - protein, 668 aa, Castanea mollissima
MATYTPKNILITGAAGFIASHVANRLIRNYPDYKIVVLDKLDYCSNLKNLLPSKSSPNFKFVKGDIGSADLVNFLLITESIDTIMHFAAQTHVDNSFGNSFEFTKNNIYGTHVLLEACKVTGQIRRFIHVSTDEVYGETDEDAVVGNHEASQLLPTNPYSATKAGAEMLVMAYGRSYGLPVITTRGNNVYGPNQFPEKLIPKFILLAMQGKPLPIHGDGSNVRSYLYCEDVAEAFEVILHKGEVGHVYNIGTKKERRVIDVAKDICRLFSMDPEKSIKFVENRPFNDQRYFLDDQKLTILGWSEQTTWDEGLRKTMEWYINNPDWWGDVSGALLPHPRMLMMPGGIERHFDGSEEGKSASYVSNNTRMLVPPSKSIGSPRKHSLKFLIYGRTGWLGGLLGKICEKQGISFEYGRGRLEDRSSLLADIQNVKPTHVFNAAGVTGRPNVDWCESHKTETIRANVAGTLTLADVCREHGLLMMNFATGCIFEYDAAHPEGSGIGFKEEDKPNFIGSFYSKTKAMVEELLKEYDNVCTLRVRMPISSDLSNPRNFITKISRYNKVVNIPNSMTILDELLPISVEMAKRNLRGIWNFTNPGVVSHNEILEMYKQYIDPNFKWANFTLEEQAKVIVAPRSNNELDASKLKKEFPELLSIKESLIKYVFEPNKKN

SEQ ID NO: 24004 - protein, 675 aa, Actinidia deliciosa
MATYTPKNILITGAAGFIASHVANRLIRNYPEYKIVVLDKLDYCSNLKNLTPSRSSPNFKFVKGDIGSADLVNFLLITESIDTIMHFAAQTHVDNSFGNSFEFTKNNIYGTHVLLEACKVTGQIRRFIHVSTDEVYGETDEDAVVGNHEASQLLPTNPYSATKAGAEMLVMAYGRSYGLPVITTRGNNVYGPNQFPEKLIPKFILLAMQGKPLPIHGDGSNVRSYLYCEDVAEAFELILHRGEVGHVYNIGTKKERRVIDVAMDTCKLFSMDPYTSIKFVENRPFNDQRYFLDDEKLKNLGWSERTTWNEGLKKTMEWYINNPDWWGDVSGALLPHPRMLMMPGGIERHFDGTEKCSDGSSKFLSASNQTKMVVPVSKSTGSPRKPPFKFLIYGRTGWIGGLLGKLCEKQGIPYEYGRGRLEDRSQLLADIQNVKPTHVFNAAGVTGRPNVDWCETHKTETIRTNVAGTLNLADVCREHGLLMMNFATGCIFEYHAAHPEGSSIGYKEEDKPNFTGSFYSKTKAMVEELVKEYDNVCTLRVRMPISSDLSNPRNFITKISRYNKVVNIPNSMTILDELLPISIQMAKRNLRGIWNFTNPGVVSHNEILEMYKEYIDPSFKWVNFTLEEQAKVIVAPRSNNEMDASKLKKEFPELLAIKESLIKYVFEPNKKKVPE

SEQ ID NO: 24005 - protein, 668 aa, Quercus alba
MATYTPKNILITGAAGFIASHVANRLIRNYPDYKIVVLDKLDYCSNLKNLLPSKSSPNIKFVKGDIGSADLVNFLLITESIDTIMHFAAQTHVDNSFGNSFEFTKNNIYGTHVLLEACKVTGQIRRFIHVSTDEVYGETDEDAVVGNHEASQLLPTNPYSATKAGAEMLVMAYGRSYGLPVITTRGNNVYGPNQFPEKLIPKFILLAMQGKPLPIHGDGSNVRSYLYCEDVAEAFEVILHKGEVGHVYNIGTKKERRVIDVAEDICRLFSMDPEKSIKFVENRPFNDQRYFLDDQKLTILGWSEQTTWDEGLRKTMEWYINNPDWWGDVSGALLPHPRMLMMPGGIERHFDGSEEGKSASYVSNNTRMLVPPSKSIGSPRKHSLKFLIYGRTGWLGGLLGKICEKQGISFEYGRGRLEDRSSLLADIQNVKPTHVFNAAGVTGRPNVDWCESHKTETIRANVAGTLTLADVCREHGLLMMNFATGCIFEYDAAHPEGSGIGFKEEDKPNFIGSFYSKTKAMVEELLKEYDNVCTLRVRMPISSDLSNPRNFITKISRYNKVVNIPNSMTILDELLPISVEMAKRNLRGIWNFTNPGVVSHNEILEMYKQYIDPNFKWANFTLEEQAKVIVAPRSNNEMDASKLKKEFPELLSIKESLIKYVFEPNKKN

SEQ ID NO: 24006 - protein, 669 aa, Mimulus guttatus
MSTFTPKNILITGAAGFIASHVANRLIRNYPEYKIVVLDKLDYCSNLKNLLPSKASANFKFVKGDIGSADLVNYLLITENIDTIMHFAAQTHVDNSFGNSFEFTKNNIYGTHVLLEACKVTGQIRRFIHVSTDEVYGETEEDAVVGNHEASQLLPTNPYSATKAGAEMLVMAYGRSYGLPVITTRGNNVYGPNQFPEKLIPKFILLAMAGKTLPIHGDGSNVRSYLYCEDVAEAFEVVLHKGEVGHVYNIGTKKERRVIDVAEDICKLFNMDPEKSIKFVENRPFNDQRYFLDDQKLKNIGWSEKTAWEEGLKKTIEWYRSNPEWWGDVSGALLPHPRMLMMPGGIERHFDGAEKYESGKSEFTGESKPNPEISPSPQKPALKFLIYGKTGWIGGLLGKLCEKQGIAYEYGKGRLQDRSTLLADIKSVKPTHVFNAAGVTGRPNVDWCESHKTETIRTNVVGTLTLADVCREQGLLMMNYATGCIFEYDAAHPEGSGIGFKEEDTPNFHGSFYSKTKAMVEELLKEYDNVCTLRVRMPISSDLSNPRNFITKISKYNKVVNIPNSMTVLDELLPISIEMAKRNLRGIYNFTNPGVVSHNEILEMYKQYIDPDFKYSNFTLEEQAKVIVAARSNNEMDASKLKKEFPELLSIKDSLIKIVFEPNRKTPAA

SEQ ID NO: 24007 - protein, 667 aa, Cajanus cajan
MASYKPKNILITGAAGFIASHVANRLVRSYPDYKIVVLDKLDYCSNLKNLLPSNSSPNFKFVKGDIGSADLVNYLLITESIDTIMHFAAQTHVDNSFGNSFEFTKNNIYGTHVLLEACKVTGQIRRFIHVSTDEVYGETEEDALVGNHEASQLLPTNPYSATKAGAEMLVMAYGRSYGLPVITTRGNNVYGPNQFPEKLIPKFILLAMQGKNLPIHGDGSNVRSYLYCEDVAEAFEVVLHKGEVGHIYNIGTKKERRVIDVAKDICRLFKMDSETSIKFVENRPFNDQRYFLDDQKLKDLGWSERTTWEEGLKKTMDWYINNPDWWGDVTGALLPHPRMLMMPGGMERHADGSGEGKAAPVGSSNTKMVVPSSKSTSSQQKPPFKFLIYGRTGWIGGLLGKLCDKQGIPYEYGKGRLEDRASLLADIHNVKPTHVFNAAGVTGRPNVDWCESHKTETIRANVAGTLTLADVCRENGILMINYATGCIFEYNATHPEGSGIGFKEEDKPNFIGSFYSKTKAMVEELLKEYDNVCTLRVRMPISSDLSNPRNFITKISRYNKVVNIPNSMTILDELLPISIEMAKRNLKGIWNFTNPGVVSHNEILEMYRDYIDPKFKWANFTLEEQAKVIVAPRSNNEMDASKLKKEFPELLSIKESLIKYVFEPNKK

SEQ ID NO: 24008 - protein, 671 aa, Daucus carota
MANYTPKNILITGAAGFIASHVANRLVRSYPEYKIVVLDKLDYCSNLKNLNPSRTAPNFKFVKGDIGSADLVNYLLITESIDTIMHFAAQTHVDNSFGNSFEFTKNNIYGTHVLLEACKVTGQIRRFIHVSTDEVYGETDEDAVVGNHEASQLLPTNPYSATKAGAEMLVMAYGRSYGLPVITTRGNNVYGPNQFPEKLIPKFILLAMRGMQLPIHGDGANVRSYLYCEDVAEAFEVVLHKGEVGHVYNIGTKKERRVTDVARDICKLFSVDPETNINYVENRPFNDQRYFLDDQKLKNLGWAERTTWEEGLKKTMDWYTSNPDWWGDVSGALLPHPRMLMMPGGIERHFDGSENRDAESTRFVDKSAPSQVSSSDPKSTVPQKLALKFLIYGRTGWIGGLLGKLCEKQGIPYEYGRGRLEYRSQLVSDLQIVKPTHVFNAAGVTGRPNVDWCESHKTETIRTNVTGTLTLADVCREQGLLMINFATGCIFEYDAAHPEGSGIGFKEEDTPNFHGSFYSKTKAMVEELLKEFDNVCTLRVRMPISSDLSNPRNFITKISRYNKVVNIPNSMTVLDELLPISIEMAKRNLKGIWNFTNPGVVSHNEILEMYKQYIDPSFKYSNFTLEEQAKVIVAARSNNEMDGAKLKAEFPELLSIKESLIKYVFEPNKKV

SEQ ID NO: 24009 - protein, 671 aa, Daucus carota
MTSYTPKNILITGAAGFIASHVANRLVRSYPDYKIVVLDKLDYCSNLKNLNPSRSAPNFKFVKGDIGSADLVNYLLITESIDTIMHFAAQTHVDNSFGNSFEFTKNNIYGTHVLLEACKVTGQIRRFIHVSTDEVYGETEEDAVVGNHEASQLLPTNPYSATKAGAEMLVMAYGRSYGLPVITTRGNNVYGPNQFPEKLIPKFILLAMRGMQLPIHGDGANVRSYLYCEDVAEAFEVVLHKGEVGHVYNIGTKKERRVTDVARDICKLFSVDPETNINYVENRPFNDQRYFLDDQKLKNLGWAERTTWEEGLKKTMDWYTSNPDWWGDVSGALLPHPRMLMMPGGIERHFDGSENRDAESTRFVDKSAPSQVSSSDPKSTVPQKLALKFLIYGRTGWIGGLLGKLCEKQGIPYEYGRGRLEYRSQLVSDLQIVKPTHVFNAAGVTGRPNVDWCESHKTETIRTNVVGTLNLADICREQGLLMINFATGCIFEYDAAHPEGSGIGFKEEDTPNFHGSFYSKTKAMVEELLKEYDNVCTLRVRMPISSDLSNPRNFITKISRYNKVVNIPNSMTVLDELLPISIEMAKRNLKGIWNFTNPGVVSHNEILEMYKQYIDPSFKYSNFTLEEQAKVIVAARSNNEMDGAKLKAEFPELLSIKESLIKYVFEPNKKV

SEQ ID NO: 24010 - protein, 672 aa, Chrysanthemum coronarium
MATYTPKNILITGAAGFIASHVANRLIRSYPDYKIVVLDKLDYCSSLKNLNPSRSSPNFKFVKGDIGSADLVNYLLITESIDTIMHFAAQTHVDNSFGNSFEFTKNNIYGTHVLLEACKVTGQIRRFIHVSTDEVYGETEEDAIVGNHEASQLLPTNPYSATKAGAEMLVMAYGRSYGLPVITTRGNNVYGPNQFPEKLIPKFILLAMQGKPLPIHGDGSNVRSYLYCEDVAEAFEVILHKGEVGHVYNIGTKRERRVIDVAKDMCKLFNMDADASIKFVENRPFNDQRYFLDDEKLKSLGWSERTRWEEGLKKTIEWYTSNPNWWGDVSGALLPHPRMLMMPGGVDRLADGPDHTEFDASDPAINTAQIGVQVPSKTSSNAPKKPALKFLIYGKTGWIGGLLGKLCEKQGIQYEYGKGRLEDRSQLLSDIQTIKPTHVFNAAGVTGRPNVDWCESHKTETIRVNVCGTLNLADVCREQGLLMINFATGCIFEYDAKHPEGSGIGFKEEDTPNFTGSFYSKTKAMVEELLKEYDNVCTLRVRMPISSDLNNPRNFITKIARYNKVVNIPNSMTILDELLPISIEMAKRNLKGIWNFTNPGVVSHNEILEMYKKYINPEFKWQNFTLEEQALVIVAPRSNNELDASKLKKEFPELLSIKDSLIKYVFEPNKKQ

SEQ ID NO: 24011 - protein, 673 aa, Echinacea purpurea
MATYVPKNILITGAAGFIASHVANRLIRNYPDYKIVVLDKLDYCSNLKNLNPSKSSPNFKFVKGDIGSADLVNYLLITESIDTIMHFAAQTHVDNSFGNSFEFTKNNIYGTHVLLEACKVTGQIRRFIHVSTDEVYGETEEDAVVGNHEASQLLPTNPYSATKAGAEMLVMAYGRSYGLPVITTRGNNVYGPNQFPEKLIPKFILLAMRGQPLPIHGDGSNVRSYLYCEDVAEAFEVILHKGEVGHVYNIGTKKERRVIDVAKDMCKLFNMNPDSSIKFVENRPFNDQRYFLDDEKLKSLGWSERTTWEEGLKKTIEWYTSNPNWWGDVSGALLPHPRMLMMPGGVDRLVDGPENAEFDSADVAINTSQIGVQIPSSKACGISAKKPALKFLIYGKTGWIGGLLGKLCEKQQIPYEYGRGRLEDRSQLLADIQTIKPTHVFNAAGVTGRPNVDWCESHRTETIRTNVSGTLNLADVCREHGLLMINFATGCIFEYDAKHPEGSGIGFKEEDTPNFIGSFYSKTKAMVEELLKEYDNVCTLRVRMPISSDLNNPRNFITKIARYDKVVNIPNSMTILDELLPISIEMAKRNLRGIWNFTNPGVVSHNEILEMYKKYINPEFKWVNFTLEEQAKVIVAPRSNNELDASKLKKEFPELLSIKESLIKYVFEPNKKQ

SEQ ID NO: 24012 - protein, 672 aa, Artemisia annua
MATYTPKNILITGAAGFIASHVANRLIRSYPDYKIVVLDKLDYCSNLKNLNPSRSSPNFKFVKGDIGSADLVNYLLITESIDTIMHFAAQTHVDNSFGNSFEFTKNNIYGTHVLLEACKVTGQIRRFIHVSTDEVYGETEEDAIVGNHEASQLLPTNPYSATKAGAEMLVMAYGRSYGLPVITTRGNNVYGPNQFPEKLIPKFILLAMQGKPLPIHGDGSNVRSYLYCEDVAEAFEVILHKGEVGHVYNIGTKRERRVIDVAKDMCKLFNMDADASIKFVENRPFNDQRYFLDDEKLKSLGWSERTRWEEGLKKTIEWYTSNPNWWGDVSGALLPHPRMLMMPGGVDRLADGPDHSEFDAAGPAINTAQIGVQVPSKTSSNAAKKPALKFLIYGKTGWIGGLLGKLCEKQGIQYEYGKGRLEDRSQLLSDIQTIKPTHVFNAAGVTGRPNVDWCESHKTETIRVNVCGTLNLADVCREQGLLMINFATGCIFEYDAKHPEGSGIGFKEEDTPNFTGSFYSKTKAMVEELLKEYDNVCTLRVRMPISSDLNNPRNFITKIARYNKVVNIPNSMTILDELLPISIEMAKRNLKGIWNFTNPGVVSHNEILEMYKKYINPEFKWQNFTLEEQALVIVAPRSNNELDASKLKKEFPELLSIKESLIKYVFEPNKKQ

SEQ ID NO: 24013 - protein, 675 aa, Musa acuminata
MATYKPKNILITGAAGFIASHVANRLVWNYPEYKIVVLDKLDYCSNLKNLNLSRSSPNFKFVKGDIGSADLVNYLLITESIDTIMHFAAQTHVDNSFGNSFEFTKNNIYGTHVLLEACKVTGQIKRFIHVSTDEVYGETDEDAVVGNHEASQLLPTNPYSATKAGAEMLVMAYGRSYGLPVITTRGNNVYGPNQFPEKMIPKFILLAMRGQPLPIHGDGSNVRSYLYSEDVAEAFEVILHRGEVGHVYNIGTKRERRVIDVARDICALFSLDPVKVIQFVENRPFNDQRYFLDDQKLKNLGWSERTAWDDGLKKTMEWYMSHPDWWGDVSGALLPHPRMLMMPGIERHTDGSEETKSMSSQSTTTNSQNRMVVPAARSSVVPPKKPYLKFLIYGRTGWIGGLLGKICEKQGIPYEYGRGRLEERSHLILDIQNVKPTHVFNAAGVTGRPNVDWCESHKQETIRTNVVGTLNLADVCRDHDLLLMNYATGCIFEYDAKHPEGSGIGFKEEEKPNFIGSFYSKTKAMVEELLREYENVCTLRVRMPISSDLSNPRNFITKIARYDKVVNIPNSMTVLDELLPISIEMAKRNCRGIWNFTNPGVVSHNEILEMYRSYIDPSFKWTNFTLEEQAKVIVAPRSNNEMDATKLKREFPELLSIKDSLIKFVFEPNKKVLSH

SEQ ID NO: 24014 - protein, 671 aa, Eschscholzia californica
MANYTPKNILITGAAGFIASHVANRLIRSYPDYKIVVLDKLDYCSNLKNLLPSRSSANFKFVKGDIGSADLVNYLLITESIDTIMHFAAQTHVDNSFGNSFEFTKNNIYGTHVLLEACKVTGQIRRFIHVSTDEVYGETDEDAVVGNHEASQLLPTNPYSATKAGAEMLVMAYGRSYGLPVITTRGNNVYGPNQFPEKLIPKLILLAMKGKDLPIHGDGSNVRSYLYCEDVAEAFEVILHKGEIGHVYNIGTTKERRVIDVAKDVCKLFSLDAESVIKFVENRPFNDQRYFLDDQKLKILGWSERTSWEEGLKKTMEWYVNNPDWWGDVSGALLPHPRMLMMPGNERYCDGSEDGNAISSNGSNPTQNKMVTPAPKSTNSPRSKPSLKFLIYGRTGWIGGLLGKICEKQGILYEYGKGRLEERSQLIADIQNIKPTHVFNAAGVTGRPNVDWCESHKPETIRANVAGTLNLADVCREHGLLMMNFATGCIFEYDAAHPEGSGIGFKEEDTPNFAGSFYSKTKAMVEELLKEYDNVCTLRVRMPISSDLNNPRNFITKISRYNKVVNIPNSMTILDELLPIAVEMAKRNLRGIWNFTNPGVVSHNEILEMYKNYIDSDFKWGNFTIEEQAKVIVAARSNNEMDASKLKKEFPELLPIKESLIKYVFEPNKRT

SEQ ID NO: 24015 - protein, 672 aa, Allium cepa
MTAYKPKNILITGAAGFIACHVANRLVRSYPDYKIVVLDKLDYCSNLRNLSPSRSSPNFKFVKGDIASADLVNYLLITENIDTIMHFAAQTHVDNSFGNSFEFTKNNIYGTHVLLEACKVTGQIQRFIHVSTDEVYGETDEDAVVGNHEASQLLPTNPYSATKAGAEMLVMAYGRSYGLPVITTRGNNVYGPNQFPEKLIPKFILLAMKGKELPIHGDGSNVRSYLYCEDVAEAFEVVLHKGEVGHVYNIGTKKERRVIDVAKDVCKLFSLDPDSVIKFVENRPFNDQRYFLDDQKLKNLGWSEKTTWEEGLKKTMEWYMNNPDYWGDVSGALLPHPRMQMMPGIERQVECEEAKTVGANSAVSHTQKMVTPSLKSSSSPHKSSLKFLIYGRTGWIGGLLGKICEEKGISYEYGKGRLEERSTLAQDIQIVKPTHVFNAAGVTGRPNVDWCETHRPETIRTNVVGTLTLADVCRQHGLLMMNYATGCIFEYDAAHPEGSGIGFKEEDTPNFAGSFYSKTKAMVEELLKEFDNVCTLRVRMPISSDLSNPRNFITKISRYSKVVNIPNSMTVLDELLPISVEMAKRNLRGIYNFTNPGVVSHNEILEMYRDYIDPDYKWENFTLEEQAKVIVAARSNNEMDASKLKAEFPELLSIKDSLIKYVFEPNKKVGNK

SEQ ID NO: 24016 - protein, 671 aa, Allium cepa
MTTYKPKNILITGAAGFIACHVANRLVRSYPEYKIVVLDKLDYCSNLRNLSPSRSSPNFKFVKGDIASADLVNYLLITENIDTIMHFAAQTHVDNSFGNSFEFTKNNIYGTHVLLEACKVTGQIQRFIHVSTDEVYGETDEDAVVGNHEASQLLPTNPYSATKAGAEMLVMAYGRSYGLPVITTRGNNVYGPNQFPEKLIPKFILLAMKGKELPIHGDGSNVRSYLYCEDVAEAFEVVLHKGEVGHVYNIGTKKERRVIDVAKDVCKMFSLDPDSVIKFVENRPFNDQRYFLDDQKLKNLGWSEKTTWEEGLKKTMEWYMNNPDYWGDVSGALLPHPRMQMMPGIERQVECEEAKASSNSAVTYTQKMVTPSLKSSSSPHKGSLKFLIYGRTGWIGGLLGKICEEKGISYEYGKGRLEERSTLAQDIQIVKPTHVFNAAGVTGRPNVDWCETHRPETIRTNVVGTLTLADVCRQHGLLMMNYATGCIFEYDAAHPEGSGIGFKEEDTPNFAGSFYSKTKAMVEELLKEFDNVCTLRVRMPISSDLSNPRNFITKISRYNKVVNIPNSMTVLDELLPISVEMAKRNLRGIYNFTNPGVVSHNEILEMYRDYIDPNYKWQNFTLEEQAKVIVAARSNNEMDASKLKAEFPELLSIKDSLIKYVFEPNKKVGNK

SEQ ID NO: 24017 - protein, 667 aa, Theobroma cacao
MASYTPKNILITGAAGFIASHVANRLIRNYPDYKIVVLDKLDYCSNLKNLLPSKSSPNFKFVKGDIGSADLVNYLLITESIDTIMHFAAQTHVDNSFGNSFEFTKNNIYGTHVLLEACKVTGQIRRFIHVSTDEVYGETDEDAVVGNHEASQLLPTNPYSATKAGAEMLVMAYGRSYGLPVITTRGNNVYGPNQFPEKLIPKFILLAMRGKTLPIHGDGSNVRSYLYCEDVAEAFEVILHKGEVGHVYNIGTKKERRVIDVAKDICKLFSMDPEASIKFVENRPFNDQRYFLDDQKLKILGWSERTVWEEGLKKTIEWYTQNPDWWGDVSGALLPHPRMLMMPGGRHFDSEEGKGSSFVSGPNQTRMVVPTSKSSGSPRKPSLKFLLYGRTGWIGGLLGQLCEKQGIPFEYGRGRLEDRSSLLADIQNIKPTHVFNAAGVTGRPNVDWCESHKTETIRTNVAGTLTLADVCREHGLLVMNFATGCIFEYDAKHPEGSGIGFKEEDKPNFTGSFYSKTKAMVEELLKEYDNVCTLRVRMPISSDLNNPRNFITKISRYNKVVNIPNSMTILDELLPISIEMAKRNLRGIWNFTNPGVVSHNEILEMYKTYIDSNFQWTNFTLEEQAKVIVAPRSNNEMDASKLKNEFPELLPIKESLIKYVFEPNKRT

SEQ ID NO: 24018 - protein, 673 aa, Arnica chamissonis
MANYTPKNILITGAAGFIASHVANRLIRNYPDYKIVVLDKLDYCSNLKNLNPSRSSPNFKFVKGDIGSADLVNYLLITESIDTIMHFAAQTHVDNSFGNSFEFTKNNIYGTHVLLEACKVTGGQIRRFIHVSTDEVYGETEEDAVVGNHEASQLLPTNPYSATKAGAEMLVMAYARSYGLPVITTRGNNVYGPNQFPEKLIPKFILLAMRGKSLPIHGDGSNVRSYLYCEDVAEAFEVILHKGEVGHVYNIGTKRERRVIDVAKDMCKLFNMDPDSSIKFVENRPFNDQRYFLDDEKLKSLGWSERTIWEEGLKKTIEWYTSNPNWWGDVSGALLPHPRMLMMPGGVDRLVDGPEIAEFDSANLAINTSQIGVQVSKSKTSISSKKPTLKFLIYGKTGWIGGLLGKLCEKQQIQYEYGKGRLEDRSQLLADIQTIKPTHVFNAAGVTGRPNVDWCESHKTETIRANVSGTLNLADVCREHGLLMINFATGCIFEYDAKHPEGSGIGFKEEDKPNFIGSFYSKTKAMVEELLKEYDNVCTLRVRMPISSDLNNPRNFITKIARYDKVVNIPNSMTILDELLPISIEMAKRNLRGIWNFTNPGVVSHNEILEMYKKYINPEFKWANFTLEEQAKVIVAPRSNNELDASKLKKEFPELLSIKESLIKYVFEPNKKH

SEQ ID NO: 24019 - protein, 672 aa, Chrysanthemum coronarium
MATYTPKNILITGAAGFIASHVANRLIRSYPDYKIVVLDKLDYCSSLKNLNPSRSSPNFKFVKGDIGSADLVNYLLITESIDTIMHFAAQTHVDNSFGNSFEFTKNNIYGTHVLLEACKVTGQIRRFIHVSTDEVYGETEEDAIVGNHEASQLLPTNPYSATKAGAEMLVMAYGRSYGLPVITTRGNNVYGPNQFPEKLIPKFILLAMQGKPLPIHGDGSNVRSYLYCEDVAEAFEVILHKGEVGHVYNIGTKRERRVIDVAKDMCKLFNMDADASIKFVENRPFNDQRYFLDDEKLKSLGWSERTRWEEGLKKTIEWYTSNPNWWGDVSGALLPHPRMLMMPGGVDRLADGPDHSEFDAADPAINTAQIGVQVPSKTSSNAPKKPALKFLIYGKTGWIGGLLGKLCEKQGIQYEYGKGRLEDRSQLLSDIQTIKPTHVFNAAGVTGRPNVDWCESHKTETIRVNVCGTLNLADVCREQGLLMINFATGCIFEYDAKHPEGSGIGFKEEDTPNFTGSFYSKTKAMVEELLKEYDNVCTLRVRMPISSDLNNPRNFITKIARYNKVVNIPNSMTILDELLPISIEMAKRNLKGIWNFTNPGVVSHNEILEMYKKYINPEFKWQNFTLEEQALVIVAPRSNNELDASKLKKEFPELLSIKDSLIKYVFEPNKKQ

SEQ ID NO: 24020 - protein, 671 aa, Daucus carota
MANYTPKNILITGAAGFIASHVANRLVRSYPEYKIVVLDKLDYCSNLKNLNPSRTAPNFKFVKGDIGSADLVNYLLITESIDTIMHFAAQTHVDNSFGNSFEFTKNNIYGTHVLLEACKVTGQIRRFIHVSTDEVYGETDEDAVVGNHEASQLLPTNPYSATKAGAEMLVMAYGRSYGLPVITTRGNNVYGPNQFPEKLIPKFILLAMRGMQLPIHGDGANVRSYLYCEDVAEAFEVVLHKGEVGHVYNIGTKKERRVTDVAQDICKLFSMDPQSNIKYVENRPFNDQRYFLDDQKLKNLGWAERTTWEEGLKKTMDWYTSNPDWWGDVSGALLPHPRMLMMPGGIERHFDGSENRDAESTRFVDKSAPSQVSSSDPKSTVPQKLALKFLIYGRTGWIGGLLGKLCEKQGIPYEYGRGRLEYRSQLVSDLQIVKPTHVFNAAGVTGRPNVDWCESHKTETIRTNVTGTLTLADVCREQGLLMINFATGCIFEYDAAHPEGSGIGFKEEDTPNFHGSFYSKTKAMVEELLKEFDNVCTLRVRMPISSDLSNPRNFITKISRYNKVVNIPNSMTVLDELLPISIEMAKRNLKGIWNFTNPGVVSHNEILEMYKQYIDPSFKYSNFTLEEQAKVIVAARSNNEMDGAKLKAEFPELLSIKESLIKYVFEPNKKV

SEQ ID NO: 24021 - protein, 671 aa, Nicotiana benthamiana
MSTYTPKNILITGAAGFIASHVANRLVRSYPDYKIVVLDKLDYCSNLKNLNPSRSSPNFKFVKGDIGSADLVNYLLITESIDTIMHFAAQTHVDNSFGNSFEFTKNNIYGTHVLLEACKVTGQIRRFIHVSTDEVYGETDEDAVVGNHEASQLLPTNPYSATKAGAEMLVMAYGRSYGLPVITTRGNNVYGPNQFPEKLIPKFINLAMRGKPLPIHGDGSNVRSYLYCEDVAEAFEVVLHRGEVGHVYNIGTKKERRVIDVAKDLCKLFNKDPDASIQFVENRPFNDQRYFLDDQKLKNLGWSEGTTWEEGLKKTMDWYISNPDWWGDVSGALLPHPRMLMMPGGVERGAEKDDSGSSECSGNPNQTRMVVPASKIGNPPNESPYKFLIYGRTGWIGGLLGKLCEKQGIPYEYGRGRLQDRSQLLADIHAVKPTHVFNAAGVTGRPNVDWCESHKTETIRTNVAGTLNLADVCKEHGLLMMNFATGCIFEYDAAHPEGSGIGFKEEDTPNFAGSFYSKTKAMVEGLLKEYENVCTLRVRMPISSDLSNPRNFITKISRYNKVVNIPNSMTILDELLPISIEMAKRNLKGIWNFTNPGVVSHNEILEMFKKYINPDFTWANFTLEEQAKVIVAARSNNEMDASKLKKEFPELLPIKESLVKYVFEPNRKTAA

SEQ ID NO: 24022 - protein, 671 aa, Vinca minor
MATHTPKNILITGAAGFIASHVANRLIRNYPKYKIIVLDKLDYCSNLRNLLPSTSSPNFKFVKGDIASADLVNYLLITESIDTIMHFAAQTHVDNSFGNSFEFTKNNIYGTHVLLEACKVTGQIKRFIHVSTDEVYGETDEDAVVGNHEASQLLPTNPYSATKAGAEMLVMAYGRSYGLPVITTRGNNVYGPNQFPEKLIPKFILLAMRGKTLPIHGDGSNVRSYLYCEDVAEAFEVILHRGEVGHVYNIGTKRERRVIDVAQDICKLFNMDTETSIEFVENRPFNDQRYFLDDEKLKELGWSERTRWEEGLKKTIEWYTKNPDWWGDVSGALLPHPRMLMMPGGVEKLLDGSDKYNSGSPEFSGKSKQDSVAVSPAKSSPKPSLKFLIYGKTGWIGGLLGKLCEKQGIPYEYGRGRLEDCSQLLVDIQIVKPTHVFNAAGVTGRPNVDWCESHKTETIRTNVAGTLTLADICREHGLLMMNFATGCIFEYDAAHPEGSGIGYKEEDTPNFTGSFYSKTKAMVEELLKEYDNVCTLRVRMPISSDLSNPRNFITKISRYNKVVNIPNSMTILDELLPISIEMAKRNLRGIWNFTNPGVISHNEILEMYKKYIDPKFKWANFTLEEQAKVIVAPRSNNEMDASKLKKEFPELLSIKESLVKYVFEPNKKTSA

SEQ ID NO: 24023 - protein, 671 aa, Daucus carota
MTSYTPKNILITGAAGFIASHVANRLVRSYPDYKIVVLDKLDYCSNLKNLNPSRSAPNFKFVKGDIGSADLVNYLLITESIDTIMHFAAQTHVDNSFGNSFEFTKNNIYGTHVLLEACKVTGQIRRFIHVSTDEVYGETDEDAVVGNHEASQLLPTNPYSATKAGAEMLVMAYGRSYGLPVITTRGNNVYGPNQFPEKLIPKFILLAMRGMQLPIHGDGANVRSYLYCEDVAEAFEVVLHKGEVGHVYNIGTKKERRVTDVAQDICKLFSMDPQSNIKYVENRPFNDQRYFLDDQKLKNLGWAERTTWEEGLKKTMDWYTSNPDWWGDVSGALLPHPRMLMMPGGIERHFDGSENRDAESTRFVDKSSPSQVSSSDPKSTVPQKLALKFLIYGRTGWIGGLLGKLCEKQGIPYEYGRGRLEYRSQLVSDLQIVKPTHVFNAAGVTGRPNVDWCESHKTETIRTNVTGTLTLADVCREQGLLMINFATGCIFEYDAAHPEGSGIGFKEEDTPNFHGSFYSKTKAMVEELLKEFDNVCTLRVRMPISSDLSNPRNFITKISRYNKVVNIPNSMTVLDELLPISIEMAKRNLKGIWNFTNPGVVSHNEILEMYKQYIDPSFKYSNFTLEEQAKVIVAARSNNEMDGAKLKAEFPELLSIKESLIKYVFEPNKKV

SEQ ID NO: 24024 - protein, 670 aa, Daucus carota
MANYTPKNILITGAAGFIASHVANRLVRSYPEYKIVVLDKLDYCSNLKNLNPSRTAPNFKFVKGDIGSADLVNYLLITESIDTIMHFAAQTHVDNSFGNSFEFTKNNIYGTHVLLEACKVTGQIRRFIHVSTDEVYGETDEDAVVGNHEASQLLPTNPYSATKAGAEMLVMAYGRSYGLPVITTRGNNVYGPNQFPEKLIPKFILLAMRGMQLPIHGDGANVRSYLYCEDVAEAFEVVLHKGEVGHVYNIGTKKERRVTDVARDICKLFSVDPETNINYVENRPFNDQRYFLDDQKLKNLGWAERTTWEEGLKKTMDWYTSNPDWWGDVSGALLPHPRMLMMPGGNEKHFDGSDTRDSESRFVNKSIASQASATNPKGIIPQKAAVKFLIYGRTGWIGGLLGKLCEKEGIQYEYGRGRLENRSQLLSDLQLVKPTHVFNAAGVTGRPNVDWCESHKTETIRTNVVGTLNLADICREQGLLMINFATGCIFEYDAAHPEGSGIGFKEEDTPNFHGSFYSKTKAMVEELLKEFDNVCTLRVRMPISSDLSNPRNFITKISRYNKVVNIPNSMTVLDELLPISIEMAKRNLKGIWNFTNPGVVSHNEILEMYKQYIDPSFKYSNFTLEEQAKVIVAARSNNEMDGAKLKAEFPELLSIKESLIKYVFEPNKKV

SEQ ID NO: 24025 - protein, 673 aa, Cichorium intybus
MATYTPKNILITGAAGFIASHVANRLIRSYPDYKIVVLDKLDYCSSLKNLNPSRSSPNFKFVKGDIGSADLVNYLLITESIDTIMHFAAQTHVDNSFGNSFEFTKNNIYGTHVLLEACKVTGQIRRFIHVSTDEVYGETEEDAIVGNHEASQLLPTNPYSATKAGAEMLVMAYGRSYGLPVITTRGNNVYGPNQFPEKLIPKFILLAMRGKPLPIHGDGSNVRSYLYCEDVAEAFEVILHKGEVGHVYNIGTKRERRVIDVAKDMCKLFNMDPDSSIKFVENRPFNDQRYFLDDEKLKSLGWSERTIWEEGLKKTIEWYTSNPNWWGDVSGALLPHPRMLMMPGGVDRLVDGPENTEFDTPHEANNNSQIGISVSAPKTTSIPSKKPSLKFLIYGKTGWIGGLLGKICQKQGIQFEYGKGRLQDRSQLLVDIQNVKPTHVFNAAGITGRPNVDWCESHKTETISTNVSGTLNLADVCREHGLLMINFATGCIFEYDSAHPEGSGIGFKEEDTPNFTGSFYSKTKAMVEELLKEYDNVCTLRVRMPISSDLTNPRNFITKIARYNKVVNIPNSMTILDELLPISIEMAKRNLKGIWNFTNPGVVSHNEILEMYKKYINPEFKYVNFTLEEQALVIVAPRSNNELDASKLKKEFPELMSIKESLIKYVFEPNKKH

SEQ ID NO: 24026 - protein, 668 aa, Lactuca sativa
MTTYTPKNILITGAAGFIASHVANRLIRSYPDYKIVVLDKLDYCSNLKNLNPSKSSPNFKFVKGDIGSADLVNYLLITESIDTIMHFAAQTHVDNSFGNSFEFTKNNIYGTHVLLEACKVTRQIRRFIHVSTDEVYGETEEDAIVGNHEASQLLPTNPYSATKAGAEMLVMAYGRSYGLPVITTRGNNVYGPNQFPEKLIPKFILLAMRGKPLPIHGDGSNVRSYLYCEDVAEAFEVILHKGEVGHVYNIGTKKERRVIDVAKDMCNLFNMDPESSIKFVENRPFNDQRYFLDDEKLKSLGWAERTTWEEGLKKTMEWYISNPDWWGDVSGALLPHPRMLMMPGGVERVVDVSENIQSDSPHSAVNPSQFRKVGPVTKPNKPSFKFLIYGKTGWIGGLLGKLCEKQGIQYEYGKGRLENRSQILEDIQKIKPTHVFNAAGITGRPNVDWCESHKTETIRTNVSGTLTLADVCKESGILMINFATGCIFEYDEKHPEGSGIGFKEEDTPNFTGSFYSKTKAMVEELLKEYDNVCTLRVRMPISSDLNNPRNFITKIARYDKVVNIPNSMTILDELLPISIEMAKRNLRGIWNFTNPGVVSHNEVLEMYKEYINPGFKWTNFTLEEQARVIVAPRSNNELDMTKLKEEFPELLSIKESLIKYVFEPNKKV

SEQ ID NO: 24027 - protein, 670 aa, Aquilegia formosa
MASYTPKNILITGAAGFIASHVANRLIRNHPDYKIVILDKLDYCSNLKNLLPSRSSPNFKFVKGDIGSADLVNYLLIAESIDTIMHFAAQTHVDNSFGNSFEFTKNNIYGTHVLLEACKVTGQIKRFIHVSTDEVYGETDEDAVVGNHEASQLLPTNPYSATKAGAEMLVMAYGRSYGLPVITTRGNNVYGPNQFPEKLIPKFILLAMAGKPLPIHGDGSNVRSYLYCEDVAEAFEVILHKGEVGHVYNIGTKKERRVIDVAKDVCKLFSLDPETVIKFVENRPFNDQRYFLDDQKLTNLGWSERTTWEEGLKKTMDWYTSNPDWWGDVSGALLPHPRMLMMPGIERQFEGYEDGNAAASQAKSNSTQTQMVVPVKGNPSTPKSPLKFLIYGRTGWIGGLLKTICEKQGIPFEYGKGRLEERSTLAADIQNVKPTHVFNAAGVTGRPNVDWCESHKPETIRTNVAGTLNLADVCREHGLLMMNFATGCIFEYDAAHPEGSGIGFKEEDKPNFTGSFYSKTKAMVEELLKEYENVCTLRVRMPISSDLTNPRNFITKISRYNKVVNIPNSMTVLDELLPISVEMAKRNLTGIYNFTNPGVVSHNEILEMYKSYIDPNFQWKNFTLEEQAKVIVAPRSNNEMDASKLKKEFPELLSIKESLIKYVFEPNKKT

SEQ ID NO: 24028 - protein, 666 aa, Cyclamen graecum
MAAYTPKNILITGAAGFIASHVANRLIRNYPDYKIVVLDKLDYCSSLENLNPSQSSPNFKFVKGDIASADLVNYLLITESIDTIMHFAAQTHVDNSFGNSFEFTKNNIYGTHVLLEACKVTGQIRRFIHVSTDEVYGETDEDAVVGNHEASQLLPTNPYSATKAGAEMLVMAYGRSYGLPVITTRGNNVYGPNQFPEKLIPKFILLAMQGKVLPIHGDGSNVRSYLYCEDVAEAFEVILHKGEVGHVYNIGTKRERRVIDVAQDICKLFSMDPEKSIKFVENRPFNDQRYFLDDEKLKNLGWSERTIWEDGLKKTMEWYNNNPEWWGDVSGALLPHPRMLMMPGGIERHSDGIEKCYEESKSVSFAGNKKVETISGDSPFKFLIYGRTGWIGGLLGKLCEKQGIPYEYGKGRLEDRSSLKEDIRNVKPTHVLNAAGVTGRPNVDWCETHKPETIRANVAGTLTLADVCRENGLLMLNFATGCIFEYNASHPEGSGIGFKEEDTPNFIGSFYSKTKAMVEELLKEYDNVCTLRVRMPISSDLNNPRNFITKISRYDKVVNIPNSMTILDELLPISVEMAKRNLRGIWNFTNPGVVSHNEILEMYKKYIDPEFKWANFTLEEQAKVIVAQRSNNEMSASKLKDEFPELLPIKESLIKYVFEPNKKISV

SEQ ID NO: 24029 - protein, 674 aa, Vaccinium corymbosum
MASYTPKNILITGAAGFIASHVANRLIRNYPDYKIVVLDKLDYCSNLKNLLPARSSPNFKFVKGDIGSADLVNFLLITESIDTIMHFAAQTHVDNSFGNSFEFTKNNIYGTHVLLEACKVTGQIRRFIHVSTDEVYGETDEDAVVGNHEASQLLPTNPYSATKAGAEMLVMAYGRSYGLPVITTRGNNVYGPNQFPEKLIPKFILLAMQGKVLPIHGDGSNVRSYLYCEDVAEAFEVILHKGEVGHVYNIGTKKERRVIDVATDVCKLFSMDPETSIKFVDNRPFNDQRYFLDDEKLKNLGWSERTRWEEGLKKTMDWYINNPDWWGDVSGALLPHPRMLMMPGGIERHFDGAEKCNDGSSPYSTTSQTKMVVPVSKSSGSPRKPPLKFLIYGRTGWLGGLLGKICEKQGIAYEYGKGRLEDRSLLLADIQNVKPTHVFNAAGVTGRPNVDWCESHKTETIRANVAGTLTLADVCREHGLLVMNFATGCIFEYDANHPEGSGIGFKEEDTPNFTGSFYSKTKAMVEELLKEYDNVCTLRVRMPISSDLNNPRNFITKISRYNKVVNIPNSMTILDELLPISIEMAKRNLRGIWNFTNPGVVSHNEILEMYKKYINPDFKWANFTLEEQAKVIVAPRSNNEMDASKLKKEFPELLPIKESLIKYVFEPNKKTIAE

SEQ ID NO: 24030 - protein, 673 aa, Amsonia hubrichtii
MATHTPKNILITGAAGFIASHVANRLIRNYPEYKIVVLDKLDYCSNLKNLLPSQSSPNFKFVKGDIASADLVNYLLITESIDTIMHFAAQTHVDNSFGNSFEFTKNNIYGTHVLLEACKVTGQIKRFIHVSTDEVYGETDEDAVVGNHEASQLLPTNPYSATKAGAEMLVMAYGRSYGLPVITTRGNNVYGPNQFPEKLIPKFILLAMRGKNLPIHGDGSNVRSYLYCEDVAEAFEVILHRGEVGHVYNIGTKKERRVIDVAKDICKLFNMDTETSIEFVENRPFNDQRYFLDDQKLTNLGWSERTTWEEGLKKTMEWYTQNPDWWGDVSGALLPHPRMLMMPGGIEKLLDGSDKYESGSSEFSGKSNQDRMLVPPSKSPPNKPSLKFLIYGRTGWIGGLLGKLCEKQGIPYEYGRGRMEDRSQLLADIQIVKPTHVFNAAGVTGRPNVDWCESHKTETIRTNVAGTLTLADICREHGLLMINFATGCIFEYDAAHPEGSGIGYKEEDTPNFTGSFYSKTKAMVEELLKEYDNVCTLRVRMPISSDLSNPRNFITKISRYNKVVNIPNSMTILDELLPISIEMAKRNLRGIWNFTNPGVVSHNEILEMYKKYIDPEFKWSNFTLEEQAKVIIAPRSNNEMDATKLKNEFPELLPIKESLIKYVFEPNKKTSAA

SEQ ID NO: 24031 - protein, 673 aa, Olea europaea
MATYTPKNILITGAAGFIASHVANRLIRNYPDYKIVVLDKLDYCSNLKNLLPSSASPNFKFVKGDIGSDDLVNYLLITENIDTIMHFAAQTHVDNSFGNSFEFTKNNIYGTHVLLEACKVTGQIKRFIHVSTDEVYGETDEDAVVGNHEASQLLPTNPYSATKAGAEMLVMAYGRSYGLPVITTRGNNVYGPNQFPEKLIPKFILLAMRGQPLPIHGDGSNVRSYLYCEDVAEAFECVLHKGEVGHVYNIGTTRERRVIDVAQDICNLFNTDPDKSIQFVDNRPFNDQRYFLDDQKLKKLGWIERTTWNEGLRKTMEWYTSNPDWWGDVSGALVPHPRMLMMPGGIERLDGADKDESKKSEFLGKPNQSHMVVPSSKNNTSQKPPLKFLIYGRTGWIGGLLGKLCEKQGIPYEYGKGRLQDRSQLLADILSVKPTHVFNAAGVTGRPNVDWCESHKTETIRTNVAGTLTLADACREHGLLMMNFATGCIFEYNATHPEGSGIGFKEEDTPNFIGSFYSKTKAMVEELLKEYDNVCTLRVRMPISSDLNNPRNFITKISKYNKVVNIPNSMTILDELLPISIEMAKRNLRGIWNFTNPGVVSHNEILEMYKEYIDPEFKWVNFTLEEQAKVIIAPRSNNELDASKLKKEFPDLLSIKESLIQYVFEPNRKTPSA

SEQ ID NO: 24032 - protein, 671 aa, Prunus mume
MGSYTPKNILITGAAGFIASHVANRLIRSYPDYNIVVLDKLDYCSNLKNLLPSKSSPNFKFVKGDIGSADLVNYLLITESIDTIMHFAAQTHVDNSFGNSFEFTKNNIYGTHVLLEACKVTGQIRRFIHVSTDEVYGETDEDAVVGNHEASQLLPTNPYSATKAGAEMLVMAYGRSYGLPVITTRGNNVYGPNQFPEKLIPKFILLAMQGKPLPIHGDGSNVRSYLYCEDVAEAFELILHKGEVGHVYNIGTKKERRVIDVAKDICRLFSVDPETNIKFVENRPFNDQRYFLDDQKLKILGWSERTIWQEGLKKTIEWYTKNPNWWGDVSGALLPHPRMLMMPGGIERHLEGSEEEKSESFVPSNTRMLVPPSKSCSSPRKPPYKFLIYGKTGWIGGLLGKLCEKQGIPFEYGKGRLQDRSSLLADIQNVRPTHVFNAAGVTGRPNVDWCESHKAETIRANVAGTLTLADVCREHGLLMLNFATGCIFEYDAKHPEGSGVGFTEEDKPNFFGSFYSKTKAMVEELLKEYDNVCTLRVRMPISSDLNNPRNFITKISRYNKVVNIPNSVTILDELLPISIEMAKRNLRGIWNFTNPGVVSHNEILEMYKHYIDPKFTWANFTIEEQAKVIVAARSNNEMDASKLKKEFPELLPVKESLIKYVFEPNKTNSTQ

SEQ ID NO: 24033 - protein, 669 aa, Arabidopsis thaliana
MASYTPKNILITGAAGFIASHVANRLIRSYPDYKIVVLDKLDYCSNLKNLNPSKHSPNFKFVKGDIASADLVNHLLITEGIDTIMHFAAQTHVDNSFGNSFEFTKNNIYGTHVLLEACKVTGQIRRFIHVSTDEVYGETDEDALVGNHEASQLLPTNPYSATKAGAEMLVMAYGRSYGLPVITTRGNNVYGPNQFPEKLIPKFILLAMRGQVLPIHGDGSNVRSYLYCEDVAEAFEVVLHKGEVGHVYNIGTKKERRVNDVAKDICKLFNMDPEANIKFVDNRPFNDQRYFLDDQKLKKLGWSERTTWEEGLKKTMDWYTQNPEWWGDVSGALLPHPRMLMMPGGRHFDGSEDNSLAATLSEKPSQTHMVVPSQRSNGTPQKPSLKFLIYGKTGWIGGLLGKICDKQGIAYEYGKGRLEDRSSLLQDIQSVKPTHVFNSAGVTGRPNVDWCESHKTETIRANVAGTLTLADVCREHGLLMMNFATGCIFEYDDKHPEGSGIGFKEEDTPNFTGSFYSKTKAMVEELLKEYDNVCTLRVRMPISSDLNNPRNFITKISRYNKVVNIPNSMTVLDELLPISIEMAKRNLKGIWNFTNPGVVSHNEILEMYRDYINPEFKWANFTLEEQAKVIVAPRSNNEMDASKLKKEFPELLSIKESLIKYAYGPNKKT

SEQ ID NO: 24034 - protein, 672 aa, Chrysanthemum coronarium
MATYTPKNILITGAAGFIASHVANRLIRSYPDYKIVVLDKLDYCSNLKNLNPSRSSPNFKFVKGDIGSADLVNYLLITESIDTIMHFAAQTHVDNSFGNSFEFTKNNIYGTHVLLEACKVTGQIRRFIHVSTDEVYGETEEDAIVGNHEASQLLPTNPYSATKAGAEMLVMAYGRSYGLPVITTRGNNVYGPNQFPEKLIPKFILLAMQGKPLPIHGDGSNVRSYLYCEDVAEAFEVILHKGEVGHVYNIGTKRERRVIDVAKDMCKLFNLDADASIKFVENRPFNDQRYFLDDEKLKCLGWSERTRWEEGLKKTIEWYTSNPNWWGDVSGALLPHPRMLMMPGGVDRLADGPDHSEFDAADPAINTAQIGVQVPSKTSNNAAKKPALKFLIYGKTGWIGGLLGKLCEKQGIQYEYGRGRLEDRSQLMSDIQTIKPTHVFNAAGVTGRPNVDWCESHKTETIRTNVSGTLNLADVCRESGLLMINFATGCIFEYDAKHPEGSGIGFKEEDTPNFTGSFYSKTKAMVEELLKNYDNVCTLRVRMPISSDLNNPRNFITKIARYNKVVNIPNSMTILDELLPISIEMAKRNLKGIWNFTNPGVVSHNEILEMYKKYINPEFKWANFTLEEQALVIVAPRSNNELDASKLKKEFPELLSIKESLIKYVFEPNKTQ

SEQ ID NO: 24035 - protein, 674 aa, Solanum lycopersicum
MSNYTPKNILITGAAGFIASHVANRLVRSYPEYNIVVLDKLDYCSNLKNLSPSRSSPNFKFVKGDIGSADLVNYLLITENIDTIMHFAAQTHVDNSFGNSFEFTKNNIYGTHVLLEACKVTGQIRRFIHVSTDEVYGETDEDAVVGNHEASQLLPTNPYSATKAGAEMLVMAYARSYGLPVITTRGNNVYGPNQFPEKLIPKFILLALNGKPLPIHGDGSNVRSYLYCEDVAEAFEVVLHRGDVGHVYNIGTKKERRVIDVAKDISNLFNKDPDTSIQFVENRPFNDQRYFLDDQKLKNLGWSEKTTWEEGLKKTMEWYVNNPDWWGDVSGALLPHPRMLMMPGGVERNSDGAEKDDSGSSEISGNTKLNGMVVPASKISNSPSRSPYKFLIYGRTGWIGGLLSKLCEKQGIPYEYGKGRLEDRSQLLSDIHAVKPTHVFNAAGVTGRPNVDWCESHKTETIRTNVAGTLNLADVCKENGLLMMNFATGCIFEYDAAHPEGSGIGFKEEDTPNFTGSFYSKTKAMVEELLKEYPNVCTLRVRMPISSDLNNPRNFITKISRYNKVVNIPNSMTILDELLPISIEMAKRNLTGIWNFTNPGVVSHNEILEMYKKYINPEFKWSNFTLEEQAKVIVAPRSNNEMDASKLKKEFPELLSIKESLIKNVFEPNRKTSA

SEQ ID NO: 24036 - protein, 668 aa, Citrus clementina
MATYTPKNILITGAAGFIASHVCNRLIRNYPEYKIVVLDKLDYCSNLKNLIPSKASSNFKFVKGDIASADLVNFLLITESIDTIMHFAAQTHVDNSFGNSFEFTKNNIYGTHVLLEACKVTGQIRRFIHVSTDEVYGETDEDAVVGNHEASQLLPTNPYSATKAGAEMLVMAYGRSYGLPVITTRGNNVYGPNQFPEKLIPKFILLAMRGLPLPIHGDGSNVRSYLYCEDVAEAFECILHKGEVGHVYNVGTKKERRVIDVAKDICKLFSMDPETSIKFVENRPFNDQRYFLDDQKLTSLGWSERTIWEEGLRKTIEWYTQNPDWWGDVSGALLPHPRMLMMPGGRHFDGSEENKAVSSVSTNNIQSRMVVPVSKCSSPRKPSMKFLIYGRTGWIGGLLGKLCEKEGIPFEYGKGRLEDRSSLIADVQSVKPTHVFNAAGVTGRPNVDWCESHKTDTIRTNVAGTLTLADVCREHGILMMNYATGCIFEYDAAHPEGSGIGYKEEDTPNFTGSFYSKTKAMVEELLKEYDNVCTLRVRMPISSDLNNPRNFITKISRYNKVVNIPNSMTVLDELLPISIEMAKRNLRGIWNFTNPGVVSHNEILEMYKKYINPEFKWVNFTLEEQAKVIVAPRSNNEMDASKLKKEFPELLSIKDSLIKYVFEPNKKT

SEQ ID NO: 24037 - protein, 670 aa, Cucumis sativus
MATHTPKNILITGAAGFIASHVANRLVRNYPGYKIVVLDKLDYCSNLKNLLPSKPSPNFKFVKGDIGSADLVNYLLITESIDTIMHFAAQTHVDNSFGNSFEFTKNNIYGTHVLLEACKVTGQIRRFIHVSTDEVYGETDEDAVVGNHEASQLLPTNPYSATKAGAEMLVMAYGRSYGLPVITTRGNNVYGPNQFPEKLIPKFILLAMRGQPLPIHGDGSNVRSYLYCEDVAEAFEVILHKGEVGHVYNIGTKKERRVIDVAKDICRLFSMDADASIKFVENRPFNDQRYFLDDEKLKNLGWSERTTWEEGLKKTIEWYTKNPDWWGDVSGALLPHPRMLMMPGGVERHFEGSEEGKPAAYASSNTKMVVPTSRNPGTPHQSSFKFLIYGRTGWIGGLLGQLCDKQGIAYAYGKGRLEDRASLLADIQNIKPTHVFNAAGVTGRPNVDWCESHKTETIRANVAGTLSLADVCREHGLLMMNFATGCIFEYDAKHPEGSGIGFKEEDKPNFIGSFYSKTKAMVEELLKEYDNVCTLRVRMPISSDLNNPRNFITKISRYSKVVNIPNSMTILDELLPISIEMAKRNLRGIWNFTNPGVVSHNEILEMYKKYIDPEFKWANFTLEEQAKVIVAPRSNNEMDASKLKNEFPEMLGIKESLIKYVFEPNKKTSA

SEQ ID NO: 24038 - protein, 670 aa, Citrullus lanatus
MATHTPKNILITGAAGFIASHVANRLVRNYPGYKIVVLDKLDYCSNLKNLLPSKPSPNFKFVKGDIGSADLVNYLLITESIDTIMHFAAQTHVDNSFGNSFEFTKNNIYGTHVLLEACKVTGQIRRFIHVSTDEVYGETDEDAVVGNHEASQLLPTNPYSATKAGAEMLVMAYGRSYGLPVITTRGNNVYGPNQFPEKLIPKFILLAMRGQSLPIHGDGSNVRSYLYCEDVAEAFEVILHKGEVGHVYNIGTKKERRVIDVAKDICRLFSMDADASIKFVENRPFNDQRYFLDDEKLKNLGWSERTTWEEGLKKTIEWYTKNPDWWGDVSGALLPHPRMLMMPGGVERHFEGSEEGKPAAYASSNTKMVVPTSRNPGSPHQSSFKFLIYGRTGWIGGLLGQLCDKQGIAYAYGKGRLEDRASLLADIQNIKPTHVFNAAGVTGRPNVDWCESHKTETIRANVAGTLTLADVCREHGLLMMNFATGCIFEYDAKHPEGSGIGFKEEDKPNFIGSFYSKTKAMVEELLKEYDNVCTLRVRMPISSDLNNPRNFITKISRYNKVVNIPNSMTILDELLPISIEMAKRNLRGIWNFTNPGVVSHNEILEMYKKYIDPEFKWANFTLEEQAKVIVAPRSNNEMDASKLKNEFPEMLGIKESLIKYVFEPNKKTSA

SEQ ID NO: 24039 - protein, 670 aa, Trifolium pratense
MATHTPKNILITGAAGFIASHVANRLIRNYPDYKIVVLDKLDYCSNLKNLIPSKSSPNFKFVKGDIESADLVNYLLITESIDTIMHFAAQTHVDNSFGNSFEFTKNNIYGTHVLLEACKVTGQIKRFIHVSTDEVYGETDEDAVVGNHEASQLLPTNPYSATKAGAEMLVMAYGRSYGLPVITTRGNNVYGPNQFPEKLIPKFILLAMQGKVLPIHGDGSNVRSYLYCEDVAEAFEVILHKGEVGHVYNIGTKKERRVIDVATDICRLFSMDPETSIKFVENRPFNDQRYFLDDQKLKVLGWSERTTWEEGLKKTMDWYINNPNWWGDVSGALLPHPRMLMMPGGMERHFDGSEEENSANYVSSTNTRMVVPPTKNIGSSQKPPLKFLIYGRTGWIGGLLGKLCEKQGIPYEYGKGRLEDRSSLVADIQNVKPTHIFNAAGVTGRPNVDWCESHKTETIRVNVAGTLTLADVSREHDLLMINYATGCIFEYDEAHPEGSGIGFKEEDTPNFTGSFYSKTKAMVEELLKEYDNVCTLRVRMPISSDLSNPRNFITKISRYNKVVNIPNSMTILDELLPISIEMAKRNLRGIWNFTNPGAVSHNEILEMYRDYIDPNFKWVNFTLEEQAKVIVAARSNNEMDASKLKSEFPELLSIKESLIKNVFEPNKKSA

SEQ ID NO: 24040 - protein, 670 aa, Medicago truncatula
MATHTPKNILITGAAGFIASHVANRLIRNYPDYKIVVLDKLDYCSNLKNLIPSRSSPNFKFVKGDIESADLVNYLLITESIDTIMHFAAQTHVDNSFGNSFEFTKNNIYGTHVLLEACKVTGQIKRFIHVSTDEVYGETDEDAVVGNHEASQLLPTNPYSATKAGAEMLVMAYGRSYGLPVITTRGNNVYGPNQFPEKLIPKFILLAMQGKVLPIHGDGSNVRSYLYCEDVAEAFEVILHKGEVGHVYNIGTKKERRVIDVATDVCKLFSIDPETSIKFVENRPFNDQRYFLDDQKLKVLGWSERTTWEEGLKKTMDWYINNPNWWGDVSGALLPHPKMLMMPGGMERHFNGSEEENSAPFVSSTNTRMVVPPTKSIGSSQKPPLKFLIYGRTGWIGGLLGKLCEKQGIPYEYGKGRLEDRSSLVADIQNVKPTHIFNAAGVTGRPNVDWCESHKTETIRVNVVGTLTLADVSREHNLLMINYATGCIFEYDEAHPEGSGIGFKEEDTPNFAGSFYSKTKAMVEELLKDYDNVCTLRVRMPISSDLSNPRNFITKISRYNKVVNIPNSMTVLDELLPISIEMAKRNLRGIWNFTNPGAVSHNEILEMYRDYIDPNFKWANFTLEEQAKVIVAARSNNEMDASKLKNEFPELLSIKESLIKYVFEANKKSA

SEQ ID NO: 24041 - protein, 673 aa, Arnica chamissonis
MATYVPKNILITGAAGFIASHVANRLIRNYPDYKIVVLDKLDYCSNLKNLNPSRSSPNLKFVKGDIGSADLVNYLLITESIDTIMHFAAQTHVDNSFGNSFEFTKNNIYGTHVLLEACKVTGQIRRFIHVSTDEVYGETEEDAVVGNHEASQLLPTNPYSATKAGAEMLVMAYGRSYGLPVITTRGNNVYGPNQFPEKLIPKYILLAMRGQPLPIHGDGSNVRSYLYCEDVAEAFEVILHKGEVGHVYNIGTKKERRVIDVAKDMCKLFNMDPDSSIKFVENRPFNDQRYFLDDEKLKSLGWSERTIWEEGLKKTIEWYTSNPNWWGDVSGALLPHPRMLMMPGGADRLVDGPENSEFDSADVAINTSQIGVHMPSSKASGISAKKPALKFLIYGKTGWIGGLLGKLCDKQQIQYEYGRGRLEDRSQLLADIQTIKPTHVFNAAGVTGRPNVDWCESHKTETIRTNVSGTLNLADVCREHGLLMINFATGCIFEYDAKHPEGSGIGFKEEDKPNFIGSFYSKTKAMVEELLKEYDNVCTLRVRMPISSDLNNPRNFITKIARYDKVVNIPNSMTILDELLPISIEMAKRNLRGIWNYTNPGVVSHNEILEMYKKYINPEFKWVNFTLEEQAKVIVAPRSNNELDASKLKKEFPELLSIKESLIKYVFEPNKKQ

SEQ ID NO: 24042 - protein, 672 aa, Chrysanthemum coronarium
MATYTPKNILITGAAGFIASHVANRLIRSYPDYKIVVLDKLDYCSSLKNLNPSRSSPNFKFVKGDIGSADLVNYLLITESIDTIMHFAAQTHVDNSFGNSFEFTKNNIYGTHVLLEACKVTGQIRRFIHVSTDEVYGETEEDAIVGNHEASQLLPTNPYSATKAGAEMLVMAYGRSYGLPVITTRGNNVYGPNQFPEKLIPKFILLAMQGKPLPIHGDGSNVRSYLYCEDVAEAFEVILHKGEVGHVYNIGTKRERRVIDVAKDMCKLFNLDADASIKFVENRPFNDQRYFLDDEKLKCLGWSERTRWEEGLKKTIEWYTSNPNWWGDVSGALLPHPRMLMMPGGVDRLADGPDHSEFDAADPAINTAQIGVQVPSKTSNNAAKKPALKFLIYGKTGWIGGLLGKLCEKQGIQYEYGRGRLEDRSQLMSDIQTIKPTHVFNAAGVTGRPNVDWCESHKTETIRTNVSGTLNLADVCREHGLLMINFATGCIFEYDAKHPEGSGIGFKEEDTPNFTGSFYSKTKAMVEELLKNYDNVCTLRVRMPISSDLNNPRNFITKIARYNKVVNIPNSMTILDELLPISIEMAKRNLKGIWNFTNPGVVSHNEILEMYKKYINPEFKWANFTLEEQALVIVAPRSNNELDASKLKKEFPELLSIKESLIKYVFEPNKTQ

SEQ ID NO: 24043 - protein, 669 aa, Eutrema halophilum
MASYTPKNILITGAAGFIASHVANRLIRSYPDYKIVVLDKLDYCSNLKNLNPSKQSPNFKFVKGDIASADLVNHLLITEGIDTIMHFAAQTHVDNSFGNSFEFTKNNIYGTHVLLEACKVTGQIRRFIHVSTDEVYGETDEDALVGNHEASQLLPTNPYSATKAGAEMLVMAYGRSYGSPVITTRGNNVYGPNQFPEKLIPKFILLAMRGKVLPIHGDGSNVRSYLYCEDVAEAFEVILHKGEVGHVYNIGTKKERRVNDVARDVCKLFNMDPEASIKFVENRPFNDQRYFLDDEKLKKLGWSERTTWEEGLKKTMEWYTQNPEWWGDVSGALLPHPRMLMMPGGRHFDGSEENSLAASFTDKPSQNHMVVPSPRSSSTPQKPSLKFLIYGKTGWIGGLLGKLCEKQGIAYEYGKGRLEDRSSLLQDIVSVKPTHVFNSAGVTGRPNVDWCESHKTETIRANVAGTLTLADVCREHGLLMMNFATGCIFEYDDKHPEGSGIGFKEEDTPNFTGSFYSKTKAMVEELLKEFDNVCTLRVRMPISSDLNNPRNFITKISRYNKVVNIPNSMTVLDELLPISIEMAKRNLKGIWNFTNPGVVSHNEILEMYREYINPEFKWANFTLEEQAKVIVAPRSNNEMDASKLKKEFPELLSIKESLIKYAFEPNKKT

SEQ ID NO: 24044 - protein, 669 aa, Eutrema parvulum
MASYTPKNILITGAAGFIASHVANRLIRSYPDYKIVVLDKLDYCSNLKNLNPSKQSPNFKFVKGDIASADLVNHLLITEGIDTIMHFAAQTHVDNSFGNSFEFTKNNIYGTHVLLEACKVTGQIRRFIHVSTDEVYGETDEDALVGNHEASQLLPTNPYSATKAGAEMLVMAYGRSYGSPVITTRGNNVYGPNQFPEKLIPKFILLAMRGKVLPIHGDGSNVRSYLYCEDVAEAFEVILHKGEVGHVYNIGTKKERRVNDVARDVCKLFNMDPEANIKFVENRPFNDQRYFLDDEKLKKLGWSERTTWEEGLKKTMEWYTQNPEWWGDVSGALLPHPRMLMMPGGRHFDGSEENSLAASFTDKPSQNHMVVPSPRSSSTPQKPSLKFLIYGKTGWIGGLLGKLCEKQGIAYEYGKGRLEDRSSLLQDILSVKPTHVFNSAGVTGRPNVDWCESHKTETIRANVAGTLTLADVCREHGLLMMNFATGCIFEYDDKHPEGSGIGFKEEDTPNFTGSFYSKTKAMVEELLKEFDNVCTLRVRMPISSDLNNPRNFITKISRYNKVVNIPNSMTVLDELLPISIEMAKRNLKGIWNFTNPGVVSHNEILEMYRDYINPDFKWANFTLEEQAKVIVAPRSNNEMDASKLKKEFPELLSIKESLIKYAFEPNKKT

SEQ ID NO: 24045 - protein, 673 aa, Amorphophallus konjac
TPKNILITGAAGFIASHVANRLIRNYPDYKIVVLDKLDYCSNLKNLFLPFLPNFKFVKGDIASADLVNYLLITESIDTIMHFAAQTHVDNSFGNSLEFTKNNIYGTHVLLEACKVTGQIRRFIHVSTDEVYGETDEDAVVGNHEASQLLPTNPYSATKAGAEMLVMAYGRSYGLPVITTRGNNVYGPNQFPEKLIPKFILLAMRGKPLPIHGDGSNVRSYLYCEDVAEAFEVILHRGEVGHVYNIGTKKERRVIDVAKDICKLFDLDPDTVIKFVENRPFNDQRYFLDDQKLKNLGWSERTTWQEGLRKTMEWYTSNPDWWGDVSGALLPHPRMLMMPGIERQFDGSEEDRSVISQTTSNPGQTRMVVPFSKSTSGSPRKPSLKFLLYGKTGWIGGLLGKICEKQGIPFEYGKGRLEDRASLLADIQNVKPTHVFNAAGVTGRPNVDWCESHKPETIRTNVAGTLNLADVCREHGLLMMNFATGCIFEYDAEHPEGSAIGFKEEEKPNFTGSFYSKTKAMVEELLKEYENVCTLRVRMPISSDLSNPRNFITKITRYSKVVNIPNSMTILDELLPISVEMAKRNCRGIWNFTNPGVVSHNEILEMYKSYVDPKFTWVNFTLEEQAKVIVAPRSNNELDASKLKKEFPELLSIKESLIKYVFEPNKKSFGEGHV

SEQ ID NO: 24046 - protein, 669 aa, Euonymus alatus
MSTYTPKNILITGAAGFIASHVCNRLIRNYPDYKIVVLDKLDYCSNLKNLLPSKLSPNFKFVKGDIGSADLVNYLLITESIDTIMHFAAQTHVDNSFGNSFEFTKNNIYGTHVLLEACKVTGQIRRFIHVSTDEVYGETDEDAVVGNHEASQLLPTNPYSATKAGAEMLVMAYGRSYGLPVITTRGNNVYGPNQFPEKLIPKFILLAMRGKVLPIHGDGSNVRSYLYCEDVAEAFEVILHKGEVGHVYNIGTKKERRVIDVAEDICKIFGTDPETNIKFVENRPFNDQRYFLDDQKLKNLGWSERTIWEEGLRKTMEWYNQNPDWWGDVSGALLPHPRMLMMPGGRHFDGSEENKSPTHISSNSNQSKMVVPVSRSSGSPRKPPYKFLIYGRTGWIGGLLGKLSEKQGIPYEYGRGRLEDRSSLMADIQNVKPTHIFNAAGVTGRPNVDWCESHKTETIRTNVAGTLTLADVCREHGLLMINYATGCIFEYDAAHPEGSGIGFKEEDTPNFTGSFYSKTKAMVEELLKEYDNVCTLRVRMPISSDLNNPRNFITKISRYNKVVNIPNSMTILDELLPISIEMAKRNLKGIWNFTNPGVVSHNEILEMYKSYIDSNFKWANFTLEEQAKVIVAPRSNNEMDATKLKTEFPELLSIKESLIKYVFEPNKRT

SEQ ID NO: 24047 - protein, 673 aa, Centaurea maculosa
MATYTPKNILITGAAGFIASHVANRLIRSYPDYKIVVLDKLDYCSNLKNLNPSRSSPNFKFVKGDIGSADLVNYLLITESIDTIMHFAAQTHVDNSFGNSFEFTKNNIYGTHVLLEACKVTGQIRRFIHVSTDEVYGETEEDAVVGNHEASQLLPTNPYSATKAGAEMLVMAYGRSYGLPVITTRGNNVYGPNQFPEKLIPKFILLAMRGKPLPIHGDGSNVRSYLYCEDVAEAFEVILHKGEVGHVYNIGTKRERRVIDVAKDMCKLFNMDPDASIKFVENRPFNDQRYFLDDEKLKSLGWSERTRWEDGLKKTIEWYTSNPNWWGDVSGALLPHPRMLMMPGGVDRLVDGPDNSEFDSDNVAHSGSQIGIVVPTSKSSGNAAKKPSMKFLIYGRTGWIGGLLGKLCEKQQIPYEYGRGRLEDRSQLLADIQAIKPTHVFNAAGVTGRPNVDWCESHKTETIRTNVSGTLNLADVCRDHGLLMINFATGCIFEYDAKHPEGSGIGFKEEDKPNFTGSFYSKTKAMVEELLKEYENVCTLRVRMPISSDLNNPRNFITKIARYDKVVNIPNSMTILDELLPISIEMAKRKLTGIWNFTNPGVVSHNEILEMYKKYINPEFKWVNFTLEEQAQVIVAPRSNNELDASKLKKEFPELMSIKESLIKNVFEPNKKI

SEQ ID NO: 24048 - protein, 674 aa, Eucalyptus grandis
MATAYTPKNILITGAAGFIASHVCNRLIRNYPGYKIVVLDKLDYCSNLKNLLPSRSSPNFKFIKGDIASADLVNFILLTESIDTIMHFAAQTHVDNSFGNSFEFTKNNIYGTHVLLEACKVTGQIRRFIHVSTDEVYGETDEDAVVGNHEASQLLPTNPYSATKAGAEMLVMAYGRSYGLPVITTRGNNVYGPNQFPEKLIPKFILLAMKGQPLPIHGDGSNVRSYLYCEDVAEAFEVILHKGEVGHVYNIGTKKERRVIDVAKEICRLFKMDPDTHIKFVENRPFNDQRYFLDDQKLKNLGWFERTIWEEGLRKTMEWYVSNPDWWGDVSGALLPHPKMLMVPGIERKFDGPDVNNSSSYAVENHTPNGMVVRDPKSSPSAQKPTLKFLIYGRTGWIGGLLGKICEKQRIPFEYGKGRLENAAQILADIQTVKPTHVFNAAGVTGRPNVDWCETHKPETIRTNVVGTLTLADVCRERGLLMMNYATGCIFEYDETHPLGSGIGFKEEDKPNFIGSFYSKTKAMVEELLKEYDNVCTLRVRMPISSDLSNPRNFITKISRYNKVVNIPNSMTILDELLPISVEMAKRNLRGIWNFTNPGAVSHNEILEMYKAYIDPDFKWVNFTLEEQAKVIVAPRSNNEMDASKLKREFPELLSIKDSLIKYVFEPNKRTSIA

SEQ ID NO: 24049 - protein, 678 aa, Chelidonium majus
MTTYTPKNILITGAAGFIASHVANRLIRNYPDYKIVVLDKLDYCSNLKNLLPSRSSPNFKFVKGDIGSADLVNYLLITESIDTIMHFAAQTHVDNSFGNSFEFTKNNIYGTHVLLEACKVTGQIRRFIHVSTDEVYGETDEDAVVGNHEASQLLPTNPYSATKAGAEMLVMAYGRSYGLPVITTRGNNVYGPNQFPEKLIPKLMLLAMKGQTLPIHGDGSNVRSYLYCEDVAEAFEVVLHKGEIGHVYNIGTKKERRVIDVVKDVCQLFSLDPDAVIEFVENRPFNDQRYFLDDQKLKNLGWSERTSWDEGLKKTMEWYLKNPNWWGDVSGALLPHPRMLMMPGIERYCDGSEDSNAASSNANNTIQKQMVVPVPKITSSSPSKPSLKFLIYGRTGWIGGLLGQICEKQGIPYEYGRGRLEDRSQLVADIQNVKPTHVFNAAGVTGRPNVDWCESHKTETIRTNVVGTLNLADVCRENGLLMMNYATGCIFEYDAAHPEGSGIGFKEEDTPNFAGSFYSETKAVVEKLLKEFDNVCTLRVRMPISSDLNNPRNFITKISRYNKVVNIPNSMTILDELLPISVEMAKRNLRGIWNFTNPGAVSHNEILEMYKSYIDPDFKYSNFTLEEQAKVIVAARSNNEMDASKLKNEFPELLSIKDSLIKYVFEPNKKTSADGGAK

SEQ ID NO: 24050 - protein, 670 aa, Trifolium pratense
MATHTPKNILITGAAGFIASHVANRLIRNYPDYKIVVLDKLDYCSNLKNLIPSKSSPNFKFVKGDIASADLVNYLLITESIDTIMHFAAQTHVDNSFGNSFEFTKNNIYGTHVLLEACKVTGQIKRFIHVSTDEVYGETDEDAVVGNHEASQLLPTNPYSATKAGAEMLVMAYGRSYGLPVITTRGNNVYGPNQFPEKLIPKFILLAMQGKVLPIHGDGSNVRSYLYCEDVAEAFEVILHKGEVGHVYNIGTKKERRVIDVATDICRLFSIDPETNIKFVENRPFNDQRYFLDDEKLKVLGWSERTTWQEGLKKTMDWYINNPNWWGDVSGALLPHPRMLMMPGGMERHFDGSEEENSATYVSSTNTRMVVPPTKNPGSLQKPPLKFLIYGRTGWIGGLLGKLCEKQGIPYEYGKGRLEDRSSLVADIQNVKPTHIFNAAGVTGRPNVDWCESHKTETIRVNVAGTLTLADVSREHDLLMINYATGCIFEYDEAHPEGSGIGFKEEDTPNFSGSFYSKTKAMVEELLKEYDNVCTLRVRMPISSDLSNPRNFITKISRYNKVVNIPNSMTILDELLPISIEMAKRNLRGIWNFTNPGAVSHNEILEMYRDYIDPSFKWANFTLEEQAKVIVAARSNNEMDASKLKSEFPELLSIKESLIKNVFEPNKKSA

SEQ ID NO: 24051 - protein, 671 aa, Eucalyptus grandis
MANYTPKNILITGAAGFIASHVANRLIRNYPEYKIVVLDKLDYCSNLKNLSPSQSSPNFKFVKGDIGSADLVNYLLITESIDTIMHFAAQTHVDNSFGNSFEFTKNNIYGTHVLLEACKVTGQIRRFIHVSTDEVYGETDEDAAVGNHEASQLLPTNPYSATKAGAEMLVMAYGRSYGLPVITTRGNNVYGPNQFPEKLIPKFILLAMRGKPLPIHGDGSNVRSYLYCEDVAEAFEVVLHKGEVGHVYNIGTKKERRVIDVARDVCKLFSMDSETSIKFVENRPFNDQRYFLDDQKLKNIGWSERTTWEEGLKKTMDWYINNPDWWGDVSGALLPHPRMLMMPGGIERHFDDSEGGESPSNVPTASNQSKMVVPPSKNATSAKKPSLKFLIYGKTGWIGGLLGRLCENEGIPFEYGKGRLEERSQLVADIQNVKPTHVFNAAGVTGRPNVDWCESHKTETIRTNVAGTLTLADVCREHGLLMMNYATGCIFEYDAAHPEGSGIGYKEEDKPNFTGSFYSKTKAMVEELLKEYDNVCTLRVRMPISSDLNNPRNFITKISRYSKVVNIPNSMTILDELLPISIEMAKRNLRGIWNFTNPGVVSHNEILEMYKQYIDPQFKWMNFTLEEQAKVIVAPRSNNEMDATKLKKEFPDLLPIKESLIKYVFEPNRKN

SEQ ID NO: 24052 - protein, 667 aa, Lupinus angustifolius
MGSYTPKNILITGAAGFIASHVANRLVRSYPDYKIVVLDKLDYCSNLKNLIPSKSSPNFKFVKGDIGSADLVNYLLITESIDTIMHFAAQTHVDNSFGNSFEFTKNNIYGTHVLLEACKVTGQIRRFIHVSTDEVYGETDEDAVVGNHEASQLLPTNPYSATKAGAEMLVMAYGRSYGLPVITTRGNNVYGPNQFPEKLIPKFILLAMQGKNLPIHGDGSNVRSYLYCEDVAEAFEVILHKGEVGHVYNIGTKKERRVIDVAKDICTLFSMDREASIKFVENRPFNDQRYFLDDQKLKNLGWSERTTWEEGLKKTMDWYTQNPDWWGDVTGALLPHPRMLMMPGGLERHFEGSEDEKPASLGSSNTRMVVPSTKNTGAQQKPPFKFLLYGRTGWIGGLLGKLCEKQGIPYEYGKGRLEDRASLIADLQNVKPTHVFNAAGVTGRPNVDWCESHKTETIRTNVAGTLTLADVCREQGILVINYATGCIFEYNAAHPEGSGIGYKEEDKPNFIGSFYSKTKAMVEELLREYDNVCTLRVRMPISSDLNNPRNFITKISRYNKVVNIPNSMTILDELLPISIEMAKRNLKGIWNFTNPGVVSHNEILEMYRDYIDPNFKWTNFTLEEQAKVIVAPRSNNEMDASKLKKEFPELLSIKESLIKHVFEPNKK

SEQ ID NO: 24053 - protein, 674 aa, Capsicum annuum
MSTYTPKNILITGAAGFIASHVANRLVRSYPEYKIVVLDKLDYCSNLKNLSPSRSSPNFKFVKGDIGSADLVNYLLITENIDTIMHFAAQTHVDNSFGNSFEFTKNNIYGTHVLLEACKVTGQIRRFIHVSTDEVYGETEEDAVVGNHEASQLLPTNPYSATKAGAEMLVMAYGRSYGLPVITTRGNNVYGPNQFPEKLIPKFILLAMQGKSLPIHGDGSNVRSYLYCEDVAEAFEVILHRGDVGHVYNIGTKKERRVIDVAKDISKLFDKDPDASIQFVENRPFNDQRYFLDDQKLKSLGWSERTTWEEGLKKTMQWYINNPNWWGDVSGALLPHPRMLMMPGGIERTMDGAEKDDSVASEISGKSNHTGMVVPASKISNSPSKSPNKFLIYGRTGWIGGLLGKLCEKQGISYEYGRGRLEDRSLLLADIHAVKPTHVFNAAGVTGRPNVDWCESHKTETIRTNVAGTLNLADVCKEHGLLMMNFATGCIFEYDAAHPEGSGIGFKEEDTPNFTGSFYSKTKAMVEELLKEYPNVCTLRVRMPISSDLNNPRNFITKISRYNKVVNIPNSMTILDELLPISIEMAKRNLTGIWNFTNPGVVSHNEILEMYKKYINPEFKWSNFTLEEQAKVIVAPRSNNEMDASKLKKEFPELLSIKESLIKNVFEPNRKTAA

SEQ ID NO: 24054 - protein, 671 aa, Prunus persica
MGSYTPKNILITGAAGFIASHVANRLIRSYPDYNIVVLDKLDYCSNLKNLLPSKSSPNFKFVKGDIGSADLVNYLLITESIDTIMHFAAQTHVDNSFGNSFEFTKNNIYGTHVLLEACKVTGQIRRFIHVSTDEVYGETDEDAVVGNHEASQLLPTNPYSATKAGAEMLVMAYGRSYGLPVITTRGNNVYGPNQFPEKLIPKFILLAMQGKPLPIHGDGSNVRSYLYCEDVAEAFELILHKGEVGHVYNIGTKKERRVIDVAKDICRLFSVDPETNIKFVENRPFNDQRYFLDDQKLKILGWSERTIWQEGLKKTIEWYTKNPNWWGDVSGALLPHPRMLMMPGGIERHLEGSEEEKSESFVPSNTRMLVPPSKSCSSPRKPPFKFLIYGKTGWIGGVLGKLCEKQGIPFEYGKGRLQDRSSLLADIQNVRPTHVFNAAGVTGRPNVDWCESHKAETIRTNVAGTLTLADVCREHGLLMMNFATGCIFEYDAKHPEGSGVGFTEEDKPNFFGSFYSKTKAMVEELLKEFDNVCTLRVRMPISSDLNNPRNFITKISRYNKVVNIPNSLTILDELLPISIEMAKRNLRGIWNFTNPGVVSHNEILEMYKQYIDPKFTWANFTIEEQAKVIVAARSNNEMDASKLKKEFPELLPVKESLIKYVFEPNKTNSTQ

SEQ ID NO: 24055 - protein, 670 aa, Brassica oleracea
MASYTPKNILITGAAGFIASHVANRLIRTYPHYKIVVLDKLDYCSNLKNLNPSKNSPSFKFVKGDIASADLVNHLLITEGIDTIMHFAAQTHVDNSFGNSFEFTKNNIYGTHVLLEACKVTGQIRRFIHVSTDEVYGETDEDALVGNHEASQLLPTNPYSATKAGAEMLVMAYGRSYGLPVITTRGNNVYGPNQFPEKLIPKFILLAMRGKVLPIHGDGSNVRSYLYCEDVAEAFEVILHKGEVGHVYNIGTKKERRVNDVARDVCKLFGMDPEASIKFVENRPFNDQRYFLDDEKLKKLGWSERTTWEEGLKKTMEWYTQNPEWWGDVSGALLPHPRMLMMPGGRHFDGSDEISSAASASDKPSQTHMVVPSTRSSTSAPQKPSLKFLIYGKTGWIGGLLGKLCEKQGIAYEYGKGRLEDRASLLQDVVSVKPTHVFNSAGVTGRPNVDWCESHKAETIRANVAGTLTLADVCREHGLLMMNFATGCIFEYDEKHPEGSGVGFKEEDTPNFTGSFYSKTKAMVEELLKEFDNVCTLRVRMPISSDLNNPRNFITKISRYNKVVNIPNSMTVLDELLPISIEMAKRNLKGIWNFTNPGVVSHNEILEMYRDYINPDFKWANFTLEEQAKVIVAPRSNNEMDASKLKKEFPELLSIKESLIKYAFEPNKKT

SEQ ID NO: 24056 - protein, 671 aa, Panax ginseng
MATYTPQNILITGAAGFIASHVANRLIRSYPDYKIVVLDKLDYCSNLKNLNPSRSSPNFKFVKGDIGSADLVNYLLITESIDTIMHFAAQTHVDNSFGNSFEFTKNNIYGTHVLLEACKVTGQIRRFIHVSTDEVYGETEEDAVVGNHEASQLLPTNPYSATKAGAEMLVMAYGRSYGLPVITTRGNNVYGPNQFPEKLIPKFILLAMRGKQLPIHGDGANVRSYLYCEDVAEAFEVILHRGEVGHVYNIGTKKERRVIDVAKDICKLFSIDPEANINFVDNRPFNDQRYFLDDQKLKDLGWSERTTWVEGLKKTMDWYISNPDWWGDVSGALLPHPRMLMMPGGIERHFDGSDNCDSESSHFADKSSKSQMVVPIPKSSNSQKRSIKFLIYGRSGWIGGLLGKLSEKQEIPYEYGRGRLEDRSQLLVDIQTVKPTHVFNAAGVTGRPNVDWCESHKTETIRTNVAGTLNLADVCRENGLLMMNFATGCIFEYDAAHPEGSGIGFKEEDKPNFHGSFYSKTKAMVEELLREYDNVCTLRVRMPISSDLSNPRNFITKISRYNKVVNIPNSMTILDELLPISIEMAKRNLRGIWNFTNPGVVSHNEILEMYKQYIDPAFQWANFTLEEQAKVIVAARSNNEMDASKLKTEFPELLSIKESLIKYVFEPNKKC

SEQ ID NO: 24057 - protein, 667 aa, Cirsium arvense
MATYTPKNILITGAAGFIASHVANRLIRSYPDYKIVVLDKLDYCSNLKNLNPSRSSPNFKFVKGDIGSADLVNYLLITESIDTIMHFAAQTHVDNSFGNSFEFTKNNIYGTHVLLEACKVTGQIRRFIHVSTDEVYGETEEDAVVGNHEASQLLPTNPYSATKAGAEMLVMAYGRSYGLPVITTRGNNVYGPNQFPEKLIPKFILLAMRGKPLPIHGDGSNVRSYLYCEDVAEAFEVILHKGEVGHVYNIGTKRERRVIDVAKDMCKLFNMDADASIKFVENRPFNDQRYFLDDEKLKSLGWSERTRWEDGLKKTIEWYTSNPNWWGDVSGALLPHPRMLMMPGGVDRLVDGPENAEFDSDNVANSGSQIGIVVNPKSSSTSTKKPSLKFLIYGRTGWIGGLLGKLCDKQQIPYEYGRGRLEDRSQLLADIQAIKPTHVFNAAGVTGRPNVDWCESHKTETIRTNVAGTLNLADVCREHGLLMINFATGCIFEYDAKHPEGSGIGFKEEDKPNFTGSFYSKTKAMVEELLKEYDNVCTLRVRMPISSDLNNPRNFITKIARYDKVVNIPNSMTILDELLPISIEMAKRKLKGIWNFTNPGVVSHNEILEMYKKYINPEFKWVNFTLEEQARVIVAPRSNNELDASKLKKEFPELMSIKESLIKYVFE

SEQ ID NO: 24058 - protein, 669 aa, Glycine max
MATHTPKNILITGAAGFIASHVANRLIRNYPQYKIVVLDKLDYCSNLKNLIPSKSSPNFKFVKGDIGSADLVNYLLITESIDTIMHFAAQTHVDNSFGNSFEFTKNNIYGTHVLLEACKVTGQIKRFIHVSTDEVYGETDEDAVVGNHEASQLLPTNPYSATKAGAEMLVMAYGRSYGLPVITTRGNNVYGPNQFPEKLIPKFILLAMQGKPLPIHGDGSNVRSYLYCEDVAEAFELILHKGEVGHVYNIGTKKERRVIDVAKDMCRLFKMDPETSIKFVENRPFNDQRYFLDDEKLKILGWSERTTWEEGLKKTMDWYINNPDWWGDVSGALLPHPRMLMMPGGLERHFDGSDEEKPASYVSTNTRMVVPTSKNVNSSQKPALKFLIYGRTGWIGGLLGKLCEKQGIPYEYGKGRLEDRSSLVADIQNVKPTHIFNAAGVTGRPNVDWCESHKTETIRTNVAGTLTLADVSREHGLLMINYATGCIFEYDAAHPEGSGIGFKEEDRPNFFGSFYSKTKAMVEELLKEYDNVCTLRVRMPISSDLSNPRNFITKISRYNKVVNIPNSMTILDELLPISIEMAKRNLRGIWNFTNPGAVSHNEILEMYRDYIDPSFKWANFNLEEQAKVIIAARSNNEMDASKLKNEFPELLSIKESLIKYVFEPNKKTA

SEQ ID NO: 24059 - protein, 674 aa, Olea europaea
MATYTPKNILITGAAGFIASHVANRLIRNYPDYKIVVLDKLDYCSNLKNLLPSKSSANFKFVRGDIGSADLVNYLLITENIDTIMHFAAQTHVDNSFGNSFEFTKNNIYGTHVLLEACKVTGQIKRFIHVSTDEVYGETDEDAVVGNHEASQLLPTNPYSATKAGAEMLVMAYGRSYGLPVITTRGNNVYGPNQFPEKLIPKFILLAMRGQPLPIHGDGSNVRSYLYCEDVAEAFECVLHKGEVGHVYNIGTKKERRVIDVAKDICNLFSMDPDKSIQFVDNRPFNDQRYFLDDQKLKNLGWFERTTWDEGLRKTMEWYTSNPDWWGDVSGALVPHPRMLMMPGGIERLDGADKDESKMSEFSGKSNQSHMVVPASKNNATQKSPYKFLIYGRTGWIGGLLGKLCEKQDIPYEYGKGRLQDRSQLVADILSVKPTHVFNAAGVTGRPNVDWCESHKTETIRTNVAGTLTLADVCRDHGLLMMNFATGCIFEYNASHPEGSGIGFKEEDTPNFIGSFYSKTKAMVEELLKEYDNVCTLRVRMPISSDLNNPRNFITKISKYNKVVNIPNSMTILDELLPISIEMAKRNLRGIWNFTNPGVVSHNEILEMYKKYIDPEFKWVNFTLEEQAKVIVAPRSNNEMDASKLKKEFPDLLSIKESLIKYVFEPNKKTPASA

SEQ ID NO: 24060 - protein, 673 aa, Aristolochia fimbriata
MASYKPKNILITGAAGFIASHVANRLIRNYPEYKIVVLDKLDYCSNLKNLLPSRSSPNFKFVKGDIGSADLVNFLLITESIDTIMHFAAQTHVDNSFGNSFEFTKNNIYGTHVLLEACKVTGQIRRFIHVSTDEVYGETDEDAVVGNHEASQLLPTNPYSATKAGAEMLVMAYGRSYGLPVITTRGNNVYGPNQFPEKLIPKFILLAMRGKPLPIHGDGTNVRSYLYCEDVAEAFEVILHRGEVGHVYNIGTKKERRVIDVAKDICRLFNLDSDSNIKFVENRPFNDQRYFLDDEKLKNLGWSERTIWEEGLKKTIEWYTNNPDWWGDVSGALLPHPRMLMMPGIERQFDGSEDSSAAAAPRAVSSGRQDRMVVPSPKSSSSSPKLSYKFLIYGRTGWIGGLLGKLCERQGISYEYAKGRLEERSQLVADITNVKPTHVFNGAGVTGRPNVDWCESHKTETIRTNVVGTLNLADVCKEHNLLMMNFATGCIFEYDSGHPEGSGIGFKEEDKPNFTGSFYSKTKAMVEELLKEYDNVCTLRVRMPISSDLNNDRNFITKITRYNRVVNIPNSMTVLDELLPISIEMAKRNLRGIWNFTNPGVVSHNEILEMYQKYIDPEFKWVNFTLEEQAKVIVAPRSNNEMDASKLKKEFPELLHIKDSLIKYVFEPNKKVK

SEQ ID NO: 24061 - protein, 668 aa, Citrus sinensis
MATYTPKNILITGAAGFIASHVCNRLIRNYPEYKIVVLDKLDYCSNLKNLIPSKASSNFKFVKGDIASADLVNFLLITESIDTIMHFAAQTHVDNSFGNSFEFTKNNIYGTHVLLEACKVTGQIRRFIHVSTDEVYGETDEDAVVGNHEASQLLPTNPYSATKAGAEMLVMAYGRSYGLPVITTRGNNVYGPNQFPEKLIPKFILLAMRGLPLPIHGDGSNVRSYLYCEDVAEAFECILHKGEVGHVYNVGTKKERRVIDVAKDICKLFSMDPETSIKFVENRPFNDQRYFLDDQKLTSLGWSERTIWEEGLRKTIEWYTQNPDWWGDVSGALLPHPRMLMMPGGRHFDGSEENKAVSSVSTNNIQSRMVVPVSKCSSPRKPSMKFLIYGRTGWIGGLLGKLCEKEGIPFEYGKGRLEDCSSLIADVQSVKPTHVFNAAGVTGRPNVDWCESHKTDTIRTNVAGTLTLADVCRDHGILMMNYATGCIFEYDAAHPEGSGIGYKEEDTPNFTGSFYSKTKAMVEELLKEYDNVCTLRVRMPISSDLNNPRNFITKISRYNKVVNIPNSMTVLDELLPISIEMAKRNLRGIWNFTNPGVVSHNEILEMYKKYINPEFKWVNFTLEEQAKVIVAPRSNNEMDASKLKKEFPELLSIKDSLIKYVFEPNKKT

SEQ ID NO: 24062 - protein, 670 aa, Trifolium pratense
MATHTPKNILITGAAGFIASHVANRLIRNYPDYKIVVLDKLDYCSNLKNLIPSKSSPNFKFVKGDIESADLVNYLLITESIDTIMHFAAQTHVDNSFGNSFEFTKNNIYGTHVLLEACKVTGQIKRFIHVSTDEVYGETDEDAVVGNHEASQLLPTNPYSATKAGAEMLVMAYGRSYGLPVITTRGNNVYGPNQFPEKLIPKFILLAMQGKVLPIHGDGSNVRSYLYCEDVAEAFEVILHKGEVGHVYNIGTKKERRVIDVATDICRLFSIDPETNIKFVENRPFNDQRYFLDDQKLKVLGWSERTTWQEGLKKTMDWYINNPNWWGDVSGALLPHPRMLMMPGGMERHFDGSEEENSANYVSSTNTRMVVPPTKNLGSSQKPPLKFLIYGRTGWIGGLLGKLCEKQGIPYEYGKGRLEDRSSLVADIQNVKPTHIFNAAGVTGRPNVDWCESHKTETIRVNVAGTLTLADVSREHDLLMINYATGCIFEYDEAHPDGSGIGFKEEDTPNFTGSFYSKTKAMVEELLKEYDNVCTLRVRMPISSDLSNPRNFITKISRYNKVVNIPNSMTILDELLPISIEMAKRNLRGIWNFTNPGAVSHNEILEMYRDYIDPSFKWANFTLEEQAKVIVAARSNNEMDASKLKSEFPELLSIKESLIKNVFEPNKKSA

SEQ ID NO: 24063 - protein, 667 aa, Gossypium hirsutum
MSSYTPKNILITGAAGFIASHVANRLIRNYPDYKIVVLDKLDYCSNLKNLLPSKSSPNFKFVKGDIGSADLVNYLLITESIDTIMHFAAQTHVDNSFGNSFEFTKNNIYGTHVLLEACKVTGQIRRFIHVSTDEVYGETDEDAVVGNHEASQLLPTNPYSATKAGAEMLVMAYGRSYGLPVITTRGNNVYGPNQFPEKLIPKFILLAMRGKTLPIHGDGSNVRSYLYCEDVAEAFEVILHKGEVGHVYNIGTKKERRVIDVAKDICKLFSMDPETSIKFVENRPFNDQRYFLDDEKLKNLGWSEQTVWEEGLKKTIEWYTQNPEWWGDVSGALLPHPRMLMMPGGRHFDSEEGKGTSFASGPNQTRMVVPTFKTSSSTQKPALKFLIYGRTGWIGGLLGQLCEKQGIPFEYGRGRLEDRSSLMADIQNIKPTHVFNAAGVTGRPNVDWCESHKTETIRTNVAGTLTLADVCREHGLLMMNFATGCIFEYDAGHPEGSGIGYKEEDKPNFTGSFYSKTKAMVEELLKEYDNVCTLRVRMPISSDLNNPRNFITKIARYNKVVNIPNSMTILDELLPISIEMAKRNLNGIWNFTNPGVVSHNEILEMYKAYIDPKFQWVNFTLEEQAKVIVAPRSNNEMDASKLKNEFPDLLPIKESLIKYVFEPNKRT

SEQ ID NO: 24064 - protein, 671 aa, Cannabis sativa
MATYTPKNILITGAAGFIASHVANRLIRSYPDYKIVVLDKLDYCSNLKNLLPSKSSPNFKFVKGDIGSADLVNFLLITEKIDTIMHFAAQTHVDNSFGNSFEFTKNNIYGTHVLLEACKVTGQIRRFIHVSTDEVYGETDEDAVVGNHEASQLLPTNPYSATKAGAEMLVMAYGRSYGLPVITTRGNNVYGPNQFPEKLIPKFILLAMRGKPLPIHGDGSNVRSYLYCEDVAEAFEVILHKGEVGHVYNIGTKKERRVIDVAKDICRLFSVDSDACIEFVENRPFNDQRYFLDDQKLTNLGWSERTTWDEGLKKTIEWYTKNPEWWGDVSGALLPHPRMLMMPGGLERHFDGSEEDKSESYVSSNTRMLVPPTKSTNSPRKPPLKFLIYGRTGWIGGLLGKLCEKQGIPFEYGKGRLEDRASLLADLQNVKPTHVFNAAGVTGRPNVDWCESHKPEVIRANVAGTLTIADVCREQGLLLMNYATGCIFEYDAAHPEGSGIGFKEEDKPNFIGSFYSKTKAMVEELLREYDNVCTLRVRMPISSDLNNPRNFITKITRYNKVVNIPNSMTILDELLPISIEMAKRNLRGIWNFTNPGVVSHNEILEMYQKYIDPDFKWQNFTLEEQAKVIVAPRSNNELDASKLSNEFPEMLPIKEALIKFVFEPNKKTSAE

SEQ ID NO: 24065 - protein, 668 aa, Cichorium intybus
PKNILITGAAGFIASHVANRLIRSYPDYKIVVLDKLDYCSSLKNLNPSRSSPNFKFVKGDIGSADLVNYLLITESIDTIMHFAAQTHVDNSFGNSFEFTKNNIYGTHVLLEACKVTGQIRRFIHVSTDEVYGETEEDAIVGNHEASQLLPTNPYSATKAGAEMLVMAYGRSYGLPVITTRGNNVYGPNQFPEKLIPKFILLAMRGKPLPIHGDGSNVRSYLYCEDVAEAFEVILHKGEVGHVYNIGTKRERRVIDVAKDMCKLFNMDPDSSIKFVENRPFNDQRYFLDDEKLKSLGWSERTIWEEGLKKTIEWYTSNPNWWGDVSGALLPHPRMLMMPGGVDRLVDGPENTEFDTPHEANNNSQIGISVSAPKTTSIPSKKPSLKFLIYGKTGWIGGLLGKICQKQGIQFEYGKGRLQDRSQLLVDIQNVKPTHVFNAAGITGRPNVDWCESHKTETISTNVSGTLNLADVCREHGLLMINFATGCIFEYDSAHPEGSGIGFKEEDTPNFTGSFYSKTKAMVEELLKEYDNVCTLRVRMPISSDLTNPRNFITKIARYNKVVNIPNSMTILDELLPISIEMAKRNLKGIWNFTNPGVVSHNEILEMYKKYINPEFKYVNFTLEEQALVIVAPRSNNELDASKLKKEFPELMSIKESLIKYVFEPNKKH

SEQ ID NO: 24066 - protein, 670 aa, Cichorium intybus
MTTYTPKNILITGAAGFIASHVANRLIRSYPDYKIVVLDKLDYCSNLKNLNPSKSSPNFKFVKGDIGSADLVNYLLITESIDTIMHFAAQTHVDNSFGNSFEFTKNNIYGTHVLLEACKVTGQIRRFIHVSTDEVYGETEEDAIVGNHEASQLLPTNPYSATKAGAEMLVMAYGRSYGLPVITTRGNNVYGPNQFPEKLIPKFILLAMRGKPLPIHGDGSNVRSYLYCEDVAEAFEVILHKGEVGHVYNIGTKKERRVIDVAKDMCQLFNMDPESSIKFVENRPFNDQRYFLDDEKLKSLGWSERTTWQEGLKKTMDWYTSNPDWWGDVSGALLPHPRMLMMPGGVERVVDVPENIQSDSPHAAVNSSQFRKVSPVQKTIPNKQSLKFLIYGKTGWIGGLLGKLCEKQGIQYEYGKGRLENRSQLLEDIQKNKPTHVFNAAGITGRPNVDWCESHKTETIRTNVSGTLTLADVCKEHGILMINFATGCIFEYDTAHPEGSGIGFKEEDTPNFTGSFYSKTKAMVEELLKEYDNVCTLRVRMPISSDLNNPRNFITKIARYDKVVNIPNSMTILDELLPISIEMAKRNLKGIWNFTNPGVVSHNEVLELYKKYINPEFKWKNFTVEEQARVIVAPRSNNELDMTKLKKEFPELLSIKESLIKYVFEPNKKV

SEQ ID NO: 24067 - protein, 671 aa, Panax ginseng
MANYTPKNILITGAAGFIASHVANRLIRSYPDYKIVVLDKLDYCSNLKNLNPSRSSPNFKFVKGDIGSADLVNYLLITESIDTIMHFAAQTHVDNSFGNSFEFTKNNIYGTHVLLEACKVTGQIRRFIHVSTDEVYGETEEDAVVGNHEASQLLPTNPYSATKAGAEMLVMAYGRSYGLPVITTRGNNVYGPNQFPEKLIPKFILLAMRGKQLPIHGDGANVRSYLYCEDVAEAFEVILHRGEVGHVYNIGTKKERRVIDVAKDICKLFSIDPEANINFVDNRPFNDQRYFLDDQKLKDLGWSERTTWVEGLKKTMDWYISNPDWWGDVSGALLPHPRMLMMPGGIERHFDGSDNCDSESSHFADKSSKSQMVVPSPKSSNSQKPSIKFLIYGRSGWIGGLLGKLSEKQEIPYEYGKGRLEDRSQLLADIQTVKPTHVFNAAGVTGRPNVDWCESHKTETIRTNVAGTLNLADVCRENGLLMMNFATGCIFEYDAAHPEGSGIGFKEEDKPNFHGSFYSKTKAMVEELLREYDNVCTLRVRMPISSDLSNPRNFITKISHYNKVVNIPNSMTVLDELLPISIEMAKRNLRGIWNFTNPGVVSHNEILEMYKKYIDPAFQWANFTLEEQAKVIVAARSNNEMDASKLKTEFPELLSIKESLIKYVFEPNKKC

SEQ ID NO: 24068 - protein, 669 aa, Glycine max
MATHTPKNILITGAAGFIASHVANRLIRNYPQYKIVVLDKLDYCSNLKNLIPSKSSPNFKFVKGDIGSADLVNYLLITESIDTIMHFAAQTHVDNSFGNSFEFTKNNIYGTHVLLEACKVTGQIKRFIHVSTDEVYGETDEDAVVGNHEASQLLPTNPYSATKAGAEMLVMAYGRSYGLPVITTRGNNVYGPNQFPEKLIPKFILLAMQGKPLPIHGDGSNVRSYLYCEDVAEAFEVILHKGEVGHVYNIGTKKERRVIDVAKDICRLFKMDPETSIKFVENRPFNDQRYFLDDEKLKILGWSERTTWEEGLKKTMDWYINNPDWWGDVSGALLPHPRMLMMPGGLERHFDGSDEEKPPSYVSTNTRMVVPTSKNVNSSQKPALKFLLYGRTGWIGGLLGKLCEKQEIPYEYGKGRLEDRSSLVADIQNVKPTHIFNAAGVTGRPNVDWCESHKTETIRTNVAGTLTLADVSREHGILMINYATGCIFEYDKAHPEGSGIGFKEEDKPNFIGSFYSKTKAMVEELLKEYDNVCTLRVRMPISSDLSNPRNFITKISRYNKVVNIPNSMTILDELLPISIEMAKRNLRGIWNFTNPGAVSHNEILEMYRDYIDPSFKWTNFNLEEQAKVIIAPRSNNEMDASKLKNEFPELLSIKESLIKYVFEPNKKTA

SEQ ID NO: 24069 - protein, 675 aa, Vitis vinifera
MATHTPKNILITGAAGFIASHVANRLIRNYPDYKIVVLDKLDYCSNLKNLLPSKSSPNFKFVKGDIGSADLVNFLLITESIDTIMHFAAQTHVDNSFGNSFEFTKNNIYGTHVLLEACKVTGQIRRFIHVSTDEVYGETDEDAVVGNHEASQLLPTNPYSATKAGAEMLVMAYGRSYGLPVITTRGNNVYGPNQFPEKLIPKFILLAMRGKPLPIHGDGSNVRSYLYCEDVAEAFEVILHRGEVGHVYNIGTKKERRVIDVAKDVCNLFSMDPETSIKFVENRPFNDQRYFLDDQKLKILGWSERTTWQEGLKKTMEWYINNPNWWGDVSGALLPHPRMLMMPGGIERHFDGSEDSDSTASPVSSNLNQTRMVVPVPKSVSSPRKPSLKFLLYGRTGWIGGLLGKLCEKQGIPYEYGRGRLEDRASLLADIQNVKPTHVFNAAGVTGRPNVDWCESHKPETIRANVAGTLTLADVCREHGLLMMNFATGCIFEYDAAHPEGSGIGFKEEDTPNFAGSFYSKTKAMVEELLKEFDNVCTLRVRMPISSDLNNPRNFITKISRYNKVVNIPNSMTVLDELLPISIEMAKRNCRGIWNFTNPGVVSHNEILEMYKSYIDPNFKWANFTLEEQAKVIVAARSNNEMDASKLKNEFPELLPIKDSLIKYVFEPNQKSLAA

SEQ ID NO: 24070 - protein, 673 aa, Papaver somniferum
MANYTPKNILITGAAGFIASHVANRLIRNYPDYKIVVLDKLDYCSNLKNLLPSRSSPNFKFVKGDIGSADLVNFLLITESIDTIMHFAAQTHVDNSFGNSFEFTKNNIYGTHVLLEACKVTGQIRRFIHVSTDEVYGETDEDAVVGNHEASQLLPTNPYSATKAGAEMLVMAYGRSYGLPVITTRGNNVYGPNQFPEKLIPKLILLAMKGKPLPIHGDGSNVRSYLYCEDVAEAFEVVLHKGEIGHVYNIGTKKERRVIDVVKDVCQLFSLDPEAVIKFVENRPFNDQRYFLDDQKLKNLGWSERTSWEEGLKKTMDWYLKNPDWWGDVSGALLPHPRMLMMPGIERFCDGSEDSNGVSSNADSLVQNKMVDPVQKTTNPPTAEPSLKFLIYGRTGWIGGLLGKICEKQGIAYEYGSGRLEERSTLVADIQKVKPTHVFNAAGVTGRPNVDWCEDHRTETIKTNVTGTLTLADVCRQNGLLMMNFATGCIFEYDAEHPEGSGIGFKEEDTPNFAGSFYSKTKAMVEELLKEYDNVCTLRVRMPISSDLSNPRNFITKISRYNKVVNIPNSMTVLDELLPIAVEMAKRNLRGIYNFTNPGVVSHNEILEMYKEYINQDFKWSNFTLEEQAKVIVAARSNNEMDASKLKNEFPELLSIKDSLIKYVFEPNKKTSA

SEQ ID NO: 24071 - protein, 667 aa, Gossypium raimondii
MSSYTPKNILITGAAGFIASHVANRLIRNYPDYKIVVLDKLDYCSNLKNLLPSKSSPNFKFVKGDIGSADLVNYLLITESIDTIMHFAAQTHVDNSFGNSFEFTKNNIYGTHVLLEACKVTGQIRRFIHVSTDEVYGETDEDAVVGNHEASQLLPTNPYSATKAGAEMLVMAYGRSYGLPVITTRGNNVYGPNQFPEKLIPKFILLAMRGKTLPIHGDGSNVRSYLYCEDVAEAFEVILHKGEVGHVYNIGTKKERRVIDVAKDICKLFSMDPETSIKFVENRPFNDQRYFLDDQKLKNLGWSERTVWEEGLKKTIEWYTQNPEWWGDVSGALLPHPRMLMMPGGRHFDSEEGKGTSFESGPNQTRMVVPTFKTSSSTQKPALKFLIYGRTGWIGGLLGQLCEKQGIPFEYGRGRLEDRSSLMADIQNIKPTHVFNAAGVTGRPNVDWCESHKTETIRTNVAGTLTLADVCREHGLLMMNFATGCIFEYDAGHPEGSGIGYKEEDKPNFTGSFYSKTKAMVEELLKEYENVCTLRVRMPISSDLNNPRNFIAKIARYNKVVNIPNSMTILDELLPISIEMAKRNLKGIWNFTNPGVVSHNEILEMYKTYIDPKFQWVNFTLEEQAKVIVAPRSNNEMDASKLKNEFPDLLPIKESLIKYVFEPNKRT

SEQ ID NO: 24072 - protein, 666 aa, Petroselinum crispum
MTSYTPKNILITGAAGFIASHVANRLVRSYPDYKIVVLDKLDYCSNLKNLNPSRSAPNFKFVKGDIGSADLVNYLLITESIDTIMHFAAQTHVDNSFGNSFEFTKNNIYGTHVLLEACKVTGQIRRFIHVSTDEVYGETEEDAIVGNHEASQLLPTNPYSATKAGAEMLVMAYGRSYGLPVITTRGNNVYGPNQFPEKLIPKFILLAMRGMQLPIHGDGANVRSYLYCEDVAEAFEVVLHKGEVGHVYNIGTKKERRVTDVARDICQLFSMDPQTNIKYVENRPFNDQRYFLDDQKLKNLGWAERTTWEEGLKKTMDWYITNPDWWGDVSGALLPHPRMLMMPGGNEKHFDGSESSSFVNKSAASQASSKNPKGIIPQKAAVKFLIYGRSGWIGGLLGKLCDEQGIHYEYGRGRLENRSQLLSDIQIVKPTHVFNAAGVTGRPNVDWCESHKTETIRTNVTGTLNLADICREQGLLMINFATGCIFEYDAAHPEGSGIGFKEEDTPNFHGSFYSKTKAMVEELLKEYDNVCTLRVRMPISSDLSNPRNFITKISRYNKVVNIPNSMTVLDELLPISIEMAKRNLRGIWNFTNPGVVSHNEILEMYKEYIDPSFKWANFTLEEQAKVIVAARSNNEMDGSKLKAEFPELLSIKESLIKYVFEPNKKA

SEQ ID NO: 24073 - protein, 671 aa, Panax ginseng
MATYTPKNILITGAAGFIASHVANRLIRSYPNYKIVVLDKLDYCSNLKNLNPSRSSANFKFVKGDIGSADLVNYLLITESIDTIMHFAAQTHVDNSFGNSFEFTKNNIYGTHVLLEACKVTGQIRRFIHVSTDEVYGETEEDAVVGNHEASQLLPTNPYSATKAGAEMLVMAYGRSYGLPVITTRGNNVYGPNQFPEKLIPKFILLAMRGKQLPIHGDGANVRSYLYCEDVAEAFEVILHRGEVGHVYNIGTKKERRVIDVAKDICKLFSIDPEANINFVDNRPFNDQRYFLDDQKLKDLGWSERTMWVEGLKKTMDWYISNPDWWGDVSGALLPHPRMLMMPGGIERHFDGSDNCDSESSHFADKSSKSQMVVPSPKSSNSQKPSIKFLIYGRSGWIGGLLGKLSEKQEIPYEYGKGRLEDRSQLLADIQTVKPTHVFNAAGVTGRPNVDWCESHKTETIRTNVAGTLNLADVCRENGLLMMNFATGCIFEYDAAHPEGSGIGFKEEDKPNFHGSFYSKTKAMVEELLREYDNVCTLRVRMPISSDLSNPRNFITKISHYNKVVNIPNSMTVLDELLPISIEMAKRNLRGIWNFTNPGVVSHNEILEMYKKYIDPAFQWANFTLEEQAKVIVAARSNNEMDASKLKTEFPELLSIKESLIKYVFEPNKKC

SEQ ID NO: 24074 - protein, 666 aa, Pennisetum glaucum
MATAYKPKNILITGAAGFIASHVAIRIIKKYPDYKIVVLDKLDYCSNLKNLLPVSSSPNFKFVKGDIASADLVNFLLVTENIDTIMHFAAQTHVDNSFGNSFEFTKNNIYGTHVLLEACKITGQIKRFIHVSTDEVYGETDEDAVVGNKEASQLLPTNPYAATKAGAEMLVMAYGRSYGLPVITTRGNNVYGPNQFPEKLIPKFILLAMRGEPLPIHGDGANVRSYLYCEDVAEAFEVILHHGEVGHVYNIGTKRERTVIDVAKDVCKLFNLEADKVIMFVENRPFNDQRYFLDDEKLKSLGWAERTPWEEGLKKTMEWYVANSDYWGDVSGALLPHPRTLMMPGYEGSEEVKGILSQFNNIHTKVASTSDSAPETHAFKFLIYGRTGWIGGLLGKICEKQGIPYEYGKGRLQERSSLILDIQTIKPTHVFNAAGVTGRPNVDWCESHKPDTIRTNVVGTLTLADVCREHGLLMINYATGCIFEYDALHPEGSGIGFKEEDTPNFTGSFYSKTKAMVEELLKEYENVCTLRVRMPISSDLSNPRNFVTKISRYNKVVNIPNSMTILDELLPISVEMAKRNLRGIYNFTNPGVVSHNEILEMYKQYIDPSFKWTNFNLEEQAKVIIAPRSNNEMDASKLKEEFPELLSIKDSLIKYVFEPNRKVPIN

SEQ ID NO: 24075 - protein, 671 aa, Fragaria vesca
MASYTPKNILITGAAGFIASHVANRLVRSHPEYKIVVLDKLDYCSNLKNLLPSKSSPNFKFVKGDIGSADLVNYLLITESIDTIMHFAAQTHVDNSFGNSFEFTKNNIYGTHVLLEACKVTGQIRRFIHVSTDEVYGETDEDAVVGNHEASQLLPTNPYSATKAGAEMLVMAYGRSYGLPVITTRGNNVYGPNQFPEKLIPKFILLAMQGKPLPIHGDGANVRSYLYCEDVAEAFELILHKGEVGHVYNIGTKKERRVIDVAQDICKLFNIDAEACIKFVENRPFNDQRYFLDDQKLTVLGWSERTAWEEGLKKTIEWYTKNPNWWGDVSGALLPHPRMLMMPGGIERHFDEPEEEISESYVSSNPRMLVPPTKCSGSPRKPPYKFLIYGKTGWIGGVLGKLCEKQGIPYEYGKGRLEDRSSLAADIQNIKPTHVFNAAGVTGRPNVDWCESHKAETIRTNVAGTLTLADVCREHGLLMINFATGCIFEYDAKHPEGSGIGFTEEDKPNFFGSFYSKTKAMVEELLNEFDNVCTLRVRMPISSDLNNPRNFITKISRYNKVVNIPNSMTILDELLPISIEMAKRNLRGIWNFTNPGVVSHNEILEMYKQYIDPSFKYSNFTIEEQAKVIVAARSNNEMDASKLKKEFPELLPIKESLIKYVFEPNKKTSAK

SEQ ID NO: 24076 - protein, 670 aa, Brassica napus
MASYTPKNILITGAAGFIASHVANRLIRTYPHYKIVVLDKLDYCSNLKNLNPSKNSPSFKFVKGDIASADLVNHLLITEGIDTIMHFAAQTHVDNSFGNSFEFTKNNIYGTHVLLEACKVTGQVRRFIHVSTDEVYGETDEDALVGNHEASQLLPTNPYSATKAGAEMLVMAYGRSYGLPVITTRGNNVYGPNQFPEKLIPKFILLAMGGKVLPIHGDGSNVRSYLYCEDVAEAFEVILHKGEVGHVYNIGTKKERRVNDVARDVCKLFGMDPEASIKFVENRPFNDQRYFLDDEKLKKLGWSERTTWEEGLKKTMDWYTQNPEWWGDVSGALLPHPRMLMMPGGRHFDGSDEISSAASVSDKPSQTHMVVPSTRSSTSTPQKPSLKFLIYGKTGWIGGLLGKLCEKQGIAYEYGKGRLEDRASLLQDVMSVKPTHVFNSAGVTGRPNVDWCESHKTETIRANVAGTLTLADVCREHGLLMMNFATGCIFEYDEKHPEGSGIGFKEEDTPNFTGSFYSKTKAMVEELLKEYDNVCTLRVRMPISSDLNNPRNFITKISRYNKVVNIPNSMTVLDELLPISIEMAKRNLKGIWNFTNPGVVSHNEILEMYRDYINPEFKWANFTLEEQAKVIVAPRSNNEMDASKLKKEFPELLSIKESLIKYAFEPNKKT

SEQ ID NO: 24077 - protein, 674 aa, Chrysanthemum coronarium
MATYTPKNILITGAAGFIASHVANRLIRSYPDYKIVVLDKLDYCSNLKNLNPSRSSPNFKFVKGDIGSADLVNYLLITENIDTIMHFAAQTHVDNSFGNSFEFTKNNIYGTHVLLEACKVTRGQIRRFIHVSTDEVYGETEEDAVVGNHEASQLLPTNPYSATKAGAEMLVMAYGRSYGLPVITTRGNNVYGPNQFPEKLIPKFILLAMRGQPLPIHGDGSNVRSYLYCEDVAEAFEVVLHKGEVGHVYNIGTKKERRVNDVARDVCNLFNIDPESSIKFVENRPFNDQRYFLDDEKLKCLGWSERTTWQEGLKKTMEWYTSNPDWWGDVSGALLPHPRMLMMPGGVEKVIDVPENVQSDSPHAAVNSSQFQKVVPAAKTSTNSATKPSFKFLIYGKTGWIGGLLGKICEKQGIQYEYGKGRLEDRSSIVADIKNVKPTHVFNAAGVTGRPNVDWCESHKTETIRTNVSGTLTLADVCRDQGILVMNFATGCIFEYDAAHPEGSGIGFLEEDTPNFTGSFYSKTKAMVEELLKEYDNVCTLRVRMPISSDLNNPRNFVTKIARYDKVVNIPNSMTILDELLPISIEMAKRNLKGIWNFTNPGVVSHNEVLELYKQYINPEFKWKNFTLEEQAQVIVAPRSNNELDTSKLKKEFPELLSIKESLVKYVFAPNKKA

SEQ ID NO: 24078 - protein, 670 aa, Cicer arietinum
MATHTPKNILITGAAGFIASHVANRLIRNYPDYKIVVLDKLDYCSNLKNLIPSRSSPNFKFVKGDIESADLVNYLLITESIDTIMHFAAQTHVDNSFGNSFEFTKNNIYGTHVLLEACKVTGQIKRFIHVSTDEVYGETDEDAVVGNHEASQLLPTNPYSATKAGAEMLVMAYGRSYGLPVITTRGNNVYGPNQFPEKLIPKFILLAMQGKVLPIHGDGSNVRSYLYCEDVAEAFEVILHKGEVGHVYNIGTKKERRVIDVATDICRLFSMDPETSIKFVENRPFNDQRYFLDDQKLKNLGWSEKTIWEEGLKKTMDWYINNPNWWGDVSGALLPHPRMLMMPGGMERLFDGSEEENSAQYVSTNNTRMLVPTAKSVGSSQKPPLKFLIYGRTGWIGGLLGKLCEKQEIPYEYGKGRLEDRSSLVADIQNVKPTHIFNAAGVTGRPNVDWCESHKTETIRVNVAGTLTLADVSREHDLLMINYATGCIFEYDQAHPEGSGIGFKEEDTPNFAGSFYSKTKAMVEELLKEYDNVCTLRVRMPISSDLNNPRNFITKISRYNKVVNIPNSMTILDELLPISIEMAKRNLRGIWNFTNPGAVSHNEILEMYRDYIDPNFKWANFTLEEQAKVIVAARSNNEMDASKLKNEFPELLSIKESLIKYVFEPNKKSA

SEQ ID NO: 24079 - protein, 667 aa, Gossypium hirsutum
MSSYTPKNILITGAAGFIASHIANRLIRNYPDYKIVVLDKLDYCSNLKNLLPSKSSPNFKFVKGDIGSADLVNYLLITESIDTIMHFAAQTHVDNSFGNSFEFTKNNIYGTHVLLEACKVTGQIRRFIHVSTDEVYGETDEDAVVGNHEASQLLPTNPYSATKAGAEMLVMAYGRSYGLPVITTRGNNVYGPNQFPEKLIPKFILLAMRGKTLPIHGDGSNVRSYLYCEDVAEAFEVILHKGEVGHVYNIGTKKERRVIDVAKDICKLFSMDPETSIKFVENRPFNDQRYFLDDQKLKNLGWSERTVWEEGLKKTIEWYTQNPEWWGDVSGALLPHPRMLMMPGGRHFDSEEGKGTSFESGPNQTRMVVPTFKTSSSTQKPALKFLIYGRTGWIGGLLGQLCEKQGIPFEYGRGRLEDRSSLMADIQNIKPTHVFNAAGVTGRPNVDWCESHKTETIRTNVAGTLTLADVCREHGLLMMNFATGCIFEYDAGHPEGSGIGYKEEDKPNFTGSFYSKTKAMVEELLKEYENVCTLRVRMPISSDLNNPRNFIAKIARYNKVVNIPNSMTILDELLPISIEMAKRNLKGIWNFTNPGVVSHNEILEMYKTYIDPKFQWVNFTLEEQAKVIVAPRSNNEMDASKLKNEFPDLLPIKESLIKYVFEPNKRT

SEQ ID NO: 24080 - protein, 667 aa, Lupinus angustifolius
MGSYTPKNILITGAAGFIASHVANRLVRSYPDYKIVVLDKLDYCSNLKNLIPSKSSPNFKFVKGDIGSADLVNYLLITESIDTIMHFAAQTHVDNSFGNSFEFTKNNIYGTHVLLEACKVTGQIRRFIHVSTDEVYGETDEDAVVGNHEASQLLPTNPYSATKAGAEMLVMAYGRSYGLPVITTRGNNVYGPNQFPEKLIPKFILLAMQGKNLPIHGDGSNVRSYLYCEDVAEAFEVILHKGEVGHVYNIGTKKERRVVDVAKDICTLFKTDPETSIKFVENRPFNDQRYFLDDQKLKILGWSERTTWEEGLKKTMDWYAQNPDWWGDVTGALLPHPRMLMMPGGLERHFEGSEDEKPASVVSSSTRMVVPSTKNTGALQKSPFKFLLYGRTGWIGGLLGKLCEKQGIPYEYGKGRLEDRASLIADLRNVKPTHVFNAAGVTGRPNVDWCESHKTETIRTNVAGTLTLADVCRERGILVINYATGCIFEYDAAHPEGSGIGYKEEDKPNFIGSFYSKTKAMVEELLREYDNVCTLRVRMPISSDLKNPRNFITKISRYNKVVNIPNSMTILDELLPISIEMAKRNLKGIWNFTNPGVVSHNEILEMYRDYIDPNFKWTNFTLEEQAKVIVAPRSNNELDASKLKKEFPELLSIKESLIKYVFEPNKK

SEQ ID NO: 24081 - protein, 670 aa, Trigonella foenum-graecum
MATHTPKNILITGAAGFIASHVANRLIRNYPDYKIVVLDKLDYCSNLKNLIPSKSSPNFKFVKGDIESADLVNYLLITESIDTIMHFAAQTHVDNSFGNSFEFTKNNIYGTHVLLEACKVTGQIKRFIHVSTDEVYGETDEDAVVGNHEASQLLPTNPYSATKAGAEMLVMAYGRSYGLPVITTRGNNVYGPNQFPEKMIPKFILLAMQGKVLPIHGDGSNVRSYLYCEDVAEAFEVILHKGEVGHVYNIGTKKERRVIDVATDICKLFSIDPETSIKFVENRPFNDQRYFLDDQKLKVLGWAERTTWEEGLKKTMDWYINNPNWWGDVSGALLPHPRMLMMPGCMERHFDGSEEENSVPVVSSTNTRMLVPPTKNISSSQKPPLKFLIYGRTGWIGGLLGKLCEKQGIPYEYGKGRLEDRSSLVADIQNVKPTHIFNAAGVTGRPNVDWCESHKAETIRANVAGTLTLADVTREHNLLMINYATGCIFEYDEAHPEGSGIGFKEEDTPNFAGSFYSKTKAMVEELLKEYDNVCTLRVRMPITSDLSNPRNFITKISRYNKVVNIPNSMTILDELLPISIEMAKRNLSGIWNFTNPGAVSHNEILEMYRDYIDPNFKWANFTLEEQAKVIVAARSNNEMDASKLKNEFPELLPIKESLIKYVFEPNKKSA

SEQ ID NO: 24082 - protein, 673 aa, Arachis hypogaea
MATHTPKNILITGAAGFIASHVANRLIRKYPDYKIVVLDKLDYCSNLKNLIPSKSCPNFKFVKGDIGSADLVNYLLITESIDTIMHFAAQTHVDNSFGNSFEFTKNNIYGTHVLLEACKVTGQIKRFIHVSTDEVYGETEEDAVVGNHEASQLLPTNPYSATKAGAEMLVMAYGRSYGLPVITTRGNNVYGPNQFPEKLIPKFILLAMQGKPLPIHGDGSNVRSYLYCEDVAEAFEVILHKGEVGHVYNIGTKKERRVIDVAKDICRLFSMDPETSIKFVENRPFNDQRYFLDDQKLKDLGWSERTTWEEGLKKTMDWYINNPDWWGDVSGALLPHPRMLMMPGGMERHFDGSEEEKPASYVSTNTKMVVPPTKSATGTPQKPALKFLIYGRTGWIGGLLGKLCEKQGIAYEYGKGRLEDRSSLVADIQNIKPTHIFNAAGVTGRPNVDWCETHKTETIRTNVAGTLTLADVSREHGLLMINYATGCIFEYDEAHPLGSGKGFKEEDTPNFAGSFYSKTKAMVEELLKEYDNVCTLRVRMPISSDLSNPRNFITKISRYNKVVNIPNSMTILDELLPISIEMAKRNLSGIWNFTNPGAVSHNEILEMYRDYIDPNFKWVNFTLEEQAKVIVAARSNNEMDASKLKKEFPELLSIKESLIKYVFEPNKKTGLKN

SEQ ID NO: 24083 - protein, 678 aa, Musa acuminata
MASYTPKNILITGAAGFIASHVANRLVRNYPDYKVVVLDKLDYCSNLKNLHPSLCSPNFKFVKGDIASADLVHFLLLTESIDTIMHFAAQTHVDNSFGNSFEFTKNNIYGTHVLLEACKVTGQIRRFIHVSTDEVYGETDEDAVVGNHEASQLLPTNPYSATKAGAEMLVMAYGRSYGLPVITTRGNNVYGPNQFPEKLIPKFILLAMRGLQLPIHGDGSNVRSYLYCEDVAEAFEVVLHRGEVGHVYNIGTKKERRVIDVAKDICGLFNLDPDSVIKCVDNRPFNDQRYFLDDQKLKNLGWSERTTWEEGLRKTMEWYTSNPGWWGDVSGALVPHPRMLMMPGIERHFDASEATKDMASHFTNNLSQTRMVVPAPRNAAASQKPPLKFLIYGRTGWIGGLLGKICTKQGIPFEYGKGRLEERSQLILDIQSVKPTHVFNAAGVTGRPNVDWCESHKTETIRTNVVGTLTLADVCREHGLLMMNYATGCIFEYDDAHPEGSGIGFKEEDKPNFTGSYYSKTKAMVEELLREYDNVCTLRVRMPISSDLNNPRNFITKISRYNKVVNIPNSMTILDELLPISIEMAKRNCRGIWNFTNPGVVSHNEILEMYKKYIDPSFKWANFTLEEQAKVIVAPRSNNEMDASKLKKEFPELCSIKESLIKYVFEPNRKVPLGGETK

SEQ ID NO: 24084 - protein, 675 aa, Prunus persica
MATAYKPKNILITGAAGFIASHVCNRLIRNYPEYKIVVLDKLDYCSNLKNLHPSRSSSNFKFIKGDIGSADLVNFILLTESIDTIMHFAAQTHVDNSFGNSFEFTKNNIYGTHVLLEACKVTGQIKRFIHVSTDEVYGETDEDAVVGNHEASQLLPTNPYSATKAGAEMLVMAYGRSYGLPVITTRGNNVYGPNQFPEKMIPKFILLAMKGKPLPIHGDGSNVRSYLYCEDVAEAFEVILHKGEVGHVYNIGTKKERRVVDVAKEICQLFSLNPDTQIKFVENRPFNDQRYFLDDQKLKNLGWSERTSWEEGLRKTMDWYVKNPEWWGDVSGALLPHPKMLMVPGIERKFDGTDTGASAFSLSASDSRESHMVVPPPKNNPSTQKPSLKFLIYGKTGWIGGLLGKICEKQGIPYEYGQGRLQERSHLLADIQSVKPTHVFNAAGVTGRPNVDWCESHKPETIRTNVVGTLTLADVCRDHNLLMINYATGCIFEYDAAHPSRSGIGFKEEDTPNFTGSFYSKTKAMVEELLKEYDNVCTLRVRMPISSDLSNPRNFITKISRYDKVVDIPNSMTILDELLPISVEMAKRNLRGLWNFTNPGVVSHNEILEMYKKYIDPSFKWTNFTLEEQAKVIVAPRSNNEMDASKLKKEFPELLPIKESLIKYVFEPNKKAFSG

SEQ ID NO: 24085 - protein, 667 aa, Gossypium hirsutum
  Sequence also found in Organisms: Gossypium raimondii
MATYTPKNILITGAAGFIASHVANRLVRNYPDYKIVVLDKLDYCSNLKNLLPSQSSRNFKFVKGDIGSADLVNYLLITESIDTIMHFAAQTHVDNSFGNSFEFTKNNIYGTHVLLEACKVTGQIRRFIHVSTDEVYGETDEDAVVGNHEASQLLPTNPYSATKAGAEMLVMAYGRSYGLPVITTRGNNVYGPNQFPEKLIPKFILLAMRGKVLPIHGDGTNVRSYLYCEDVAEAFEVILHKGEVGHVYNVGTKKERRVIDVAKDICKLFSMDPETSIKFVENRPFNDQRYFLDDQKLKNLGWSEQTVWEDGLKKTIEWYTQNPDWWGDVSGALLPHPRMLMMPGGRQFDSEEGKDTSYISSPNQTQMVVPTSKSSVSSQKPALKFLIYGRTGWIGGLLGQLCDKQGIPFEYGKGRLEDRSSLTADIRNIKPTHVFNAAGLTGRPNVDWCESHKTETIRTNVAGTLTLADVCREHGLLMLNFATGCIFEYDAGHPQGSGIGFKEEDIPNFTGSFYSKTKAMVEELLKEYNNVCTLRVRMPISSDLNNPRNFITKISRYSKVVNIPNSMTILDELLPISIEMAKRNLTGIWNFTNPGVVSHNEILEMYKKYIDPKFQWANFTLEEQAKVIVAPRSNNEMDASKLKKEFPELLPIKESLIKYVFEPNKRT

SEQ ID NO: 24086 - protein, 669 aa, Prunus mume
MATAYKPKNILITGAAGFIASHVCNRLIRNYPEYKIVVLDKLDYCSNLKNLHPSRSSSNFKFIKGDIGSADLVNFILLTESIDTIMHFAAQTHVDNSFGNSFEFTRNNIYGTHVLLEACKVTGQIKRFIHVSTDEVYGETDEDAVVGNHEASQLLPTNPYSATKAGAEMLVMAYGRSYGLPVITTRGNNVYGPNQFPEKMIPKFILLAMKGKPLPIHGDGSNVRSYLYCEDVAEAFEVILHKGEVGHVYNIGTKKERRVVDVAKEICQLFSLNPDTQIKFVENRPFNDQRYFLDDQKLKNLGWSERTSWEEGLRKTMDWYVKNPEWWGDVSGALLPHPKMLMVPGIERKFDGTDTGASAFSLSANMFVPPPKNNPSTQKPSLKFLIYGKTGWIGGLLGKICEKQGIPYEYGQGRLQERSQLLADIQSIKPTHVFNAAGVTGRPNVDWCESHKPETIRTNVVGTLTLADVCRDHNLLMINYATGCIFEYDAAHPSRSGIGFKEEDTPNFTGSFYSKTKAMVEELLKEYDNVCTLRVRMPISSDLSNPRNFITKISRYDKVVDIPNSMTILDELLPISVEMAKRNLRGLWNFTNPGVVSHNEILEMYKKYIDPSFKWTNFTLEEQAKVIVAPRSNNEMDASKLKKEFPELLPIKESLIKYVFEPNKKAFSG

SEQ ID NO: 24087 - protein, 672 aa, Tabernaemontana elegans
MATHTPRNILITGAAGFIASHVANRLIRNYPEYKIVVLDKLDYCSNLKNLIPSQSSPNFKFVKGDIASADLVNYLLITESIDTIMHFAAQTHVDNSFGNSFEFTKNNIYGTHVLLEACKVTGQIKRFIHVSTDEVYGETDEDAVVGNHEASQLLPTNPYSATKAGAEMLVMAYGRSYGLPVITTRGNNVYGPNQFPEKLIPKFILLAMRGKTLPIHGDGSNVRSYLYCEDVAEAFEVILHRGEVGHVYNIGTKKERGVIDVAKDICKIFNMDPETSIEFVENRPFNDQRYFLDDQKLKNLGWSERTTWEEGLRKTMEWYTKNPDWWGDVSGALLPHPRMLMMPGGIERLLDGSDKYDSGSSEFSGKSNQDRMVVPPSKSPTNKPSLKFLIYGRTGWIGGLLGKLCEKQGIPYEYGRGRLEDRSQLLADIQIAKPTHVFNAAGVTGRPNVDWCESHKTETIRTNVAGTLTLADICREHGLLMMNFATGCIFEYDAAHPEGSGTGFKEEDTPNFTGSFYSKTKAMVEELLKEYDNVCTLRVRMPISSDLSNPRNFITKISRYNKVVNIPNSMTILDELLPISIEMAKRNLRGIWNFTNPGVVSHNEILEMYKKYIDPEFKWANFTLEEQAKVIIAPRSNNELDATKLKNEFPELLPIKESLIKYVFEPNKKTSA

SEQ ID NO: 24088 - protein, 674 aa, Silene vulgaris
MSSYTPKNILITGAAGFIASHVANKLIRSYPDYKIVVLDKLDYCSNLKNLRPSQKSPNFKFVKGDIASADLVNYLLITESIDTIMHFAAQTHVDNSFGNSFEFTKNNIYGTHVLLEACKVTGQIRRFIHVSTDEVYGETDEDAVVGNHEASQLLPTNPYSATKAGAEMLVMAYGRSYGLPVITTRGNNVYGPNQFPEKLIPKFILLAMQGKPLPIHGDGSNVRSYLYCEDVAEAFEVILHKGEVGHVYNIGTKRERRVIDVARDVCKLFSVDPETVIKFVENRPFNDQRYFLDDEKLKILGWSERTPWEEGLKKTMEWYISHPEWWGDVSGALLPHPRMLMMPGGIERHFEDSDNDNSASSELPNSQSKMVVPVAKTTASPKKPSLKFLIYGRTGWIGGLLGQMCEKQGIAYEYGKGRLQDRASLIADIQNVKPTHVFNAAGVTGRPNVDWCESHKPETIRTNVVGTLTLADVCREHGLLVMNYATGCIFEYDAAHPLGSGIGFKEEDTPNFAGSFYSKTKAMVEELLKEFDNVCTLRVRMPISGDLTNPRNFITKISRYNKVVDIPNSMTILDELLPISIEMAKRNLRGIWNFTNPGVVSHNEILEMYKNYIDPSFKWANFTVEEQAKVIVAARSNNEMDASKLKKEFPELLSIKESLIKYAFEPNKKTDYSA

SEQ ID NO: 24089 - protein, 666 aa, Setaria italica
MATAYKPKNILITGAAGFIASHVAIRITKKYPDYKIVVLDKLDYCSNLKNLLPVSSSPNFKFVKGDIASADLVNFLLVTENIDTIMHFAAQTHVDNSFGNSFEFTKNNIYGTHVLLEACKITGQIKRFIHVSTDEVYGETDEDAVVGNKEASQLLPTNPYAATKAGAEMLVMAYGRSYGLPVITTRGNNVYGPNQFPEKLIPKFILLAMRGEPLPIHGDGTNVRSYLYCEDVAEAFEVILHHGEVGHVYNIGTKRERTVIDVAKDVCKLFNLEADKVIMFVENRPFNDQRYFLDDEKLKSLGWAERTPWEEGLKKTMEWYVANSDYWGDVSGALLPHPRTLMMPGYEGSEEIKGILSQFNNIQTKVASTSDSAPETHAFKFLIYGRTGWIGGLLGKICEKQGIPYEYGKGRLQERSSLILDIQTIKPTHVFNAAGVTGRPNVDWCESHKPDTIRTNVVGTLTLADVCREHGLLMINYATGCIFEYDACHPEGSGIGFKEEDTPNFTGSFYSKTKAMVEELLKEYENVCTLRVRMPISSDLSNPRNFVTKISRYNKVVNIPNSMTILDELLPISVEMAKRNLRGIYNFTNPGVVSHNEILEMYKQYIDPSFKWTNFNLEEQAKVIIAPRSNNEMDASKLKKEFPELLSIKDSLIKYVFEPNQKLPIN

SEQ ID NO: 24090 - protein, 674 aa, Rosmarinus officinalis
MSNFTPKNILITGAAGFIASHVANRLIRNYPEYKIVVLDKLDYCSNLKNLLPSKSSPNFKFVKGDIGSADLVNYLLIAENIDTIMHFAAQTHVDNSFGNSFEFTKNNIYGTHVLLEACKVTGQIRRFIHVSTDEVYGETEEDAVVGNHEASQLLPTNPYSATKAGAEMLVMAYGRSYGLPVITTRGNNVYGPNQFPEKLIPKFILLAMRGKTLPIHGDGSNVRSYLYCEDVAEAFEVILHKGEVGHVYNIGTKKERRVIDVARDMCKLFNMDPDKSIQFVDNRPFNDQRYFLDDQKLKNLGWSERTTWEEGLRKTMEWYTNNPDWWGDVAGALLPHPRMLMMPGGIERHFDDAEKYESGKSEFAGNSTQKMVVPPSKTSQSTDKPAFKFLIYGRTGWIGGLLGKLCEKQGIAYEYGKGRLENRHQILADIVTVKPTHVLNAAGLTGRPNVDWCESHKTETIRVNVAGTLTLADVCRENGLLMLNFATGCIFEYNSKHPEGSGIGYKEEDTPNFIGSFYSKTKAMVEELLKEYDNVCTLRARMPISSDLSNPRNFITKISKYNKVVNIPNSMTILDELLPIAIEMAKRNLRGIWNFTNPGVVSHNEILEMYKQYIDPDFKYTNFTLEEQAKVIIAPRSNNEMDASKLKKEFPELLSIKESLIKYVFEPNRKTLAK

SEQ ID NO: 24091 - protein, 667 aa, Lotus japonicus
MASYTPKNILITGAAGFIASHVANRLVRTYPDYKIVVLDKLDYCSNLKNLLPSKSSPNFKFVKGDIGSADLVNHLLITESIDTIMHFAAQTHVDNSFGNSFEFTKNNIYGTHVLLEACKVTGQIRRFIHVSTDEVYGETDEDAVVGNHEASQLLPTNPYSATKAGAEMLVMAYGTSYGLPVITTRGNNVYGPNQFPEKLIPKFILLAMQGKTLPIHGDGSNVRSYLYCEDVAEAFEVILHRGEVGHVYNIGTKKERRVIDVAKDICNLFSKDPETSIKFVDNRPFNDQRYFLDDQKLKVLGWSERTTWEEGLKKTMEWYTQNPDWWGDVTGALLPHPRMLMMPGGMERHYEGSEGENPASLASSNTRMVVPSSKSNGTQQKPPFKFLIYGRTGWIGGLLGKLCDKQGIPYEYGKGRLEDRSSVVADINNVKPTHVFNAAGVTGRPNVDWCESHKTETIRTNVAGTLTLADVCRENGILVINYATGCIFEYDASHPEGSGIGFKEEDKPNFIGSFYSKTKAMVEELLREYDNVCTLRVRMPISSDLSNPRNFITKISRYNKVVNIPNSMTILDELLPISIEMAKRNLRGIWNFTNPGVVSHNEILEMYRDYIDPNFKWVNFNLEEQAKVIVAPRSNNELDASKLNTEFPELLPIKESLIKYVFEPNKK

SEQ ID NO: 24092 - protein, 674 aa, Solanum phureja
MSNYTPKNILITGAAGFIASHVANRLVRSYPEYNIVVLDKLDYCSNLKNLSPSRSSPNFKFVKGDIGSADLVNYLLMTENIDTIMHFAAQTHVDNSFGNSFEFTKNNIYGTHVLLEACKVSGQIRRFIHVSTDEVYGETDEDAVVGNHEASQLLPTNPYSATKAGAEMLVMAYGRSYGLPIITTRGNNVYGPNQFPEKLIPKFILLSLQGKPLPIQGDGSNVRSYLYCEDVAEAFEVVLHRGDVGHVYNIGTKKERRVIDVAKDISNLFNRDPDASIQFVENRPFNDQRYFLDDQKLKNLGWSQKTTWEEGLKKTMDWYVNNPDWWGDVSGALLPHPRMPMMPGGVERNWYGAEKDDSGSSEVSGNANHTRMVVPASKISNSPSKSPYKFLIYGRTGWIGGLLSKLCEKQGIPYEYGKGRLEDRSQLLSDIHAVKPTHVFNAAGVTGRPNVDWCESHKTETIRTNVAGTLNLADVCKENGLLMMNFATGCIFEYNAAHPEGSGIGFKEEDSPNFTGSFYSKTKAMVEELLKEYPNVCTLRVRMPISSDLNNPRNFITKISRYNKVVNIPNSMTILDELLPISIEMAKRNLTGIWNFTNPGVVSHNEILEMYKKYINPEFKWSNFTLDEQAKVLVAPRSNNEMDASKLKKEFPELLSIKESLIKNVFEPNRKTSA

SEQ ID NO: 24093 - protein, 669 aa, Lupinus angustifolius
MATHTPKNILITGAAGFIASHFANRLVRNYPEYKIVVLDKLDYCSNLKNLIPSKSSPNFKFVKGDIGSADLVNYLLITESIDTIMHFAAQTHVDNSFGNSFEFTKNNIYGTHVLLEACKVTGQIKRFIHVSTDEVYGETDEDAVVGNHEASQLLPTNPYSATKAAAEMLVMAYGRSYGLPVITTRGNNVYGPNQFPEKLIPKFILLAMQGKPLPIHGDGSNVRSYLYCEDVAEAFELILHKGEVGHVYNIGTKRERSVIDVAQDICRLFSMDPETSIKFVENRPFNDQRYFLDDEKLKILGWSERTTWDEGLKKTIDWYTKNPNWWGDVSGALLPHPRMLMMPGGLERHSDGSEDEKPESYVSSNTRMVVPPTKNVVTSQKHPLKFLIYGRTGWIGGLLGKLCESQGILYEYGKGRLEDRSSLVADIQSVKPTHIFNAAGVTGRPNVDWCEIHKTETIRANVAGTLTLADVSREHGLLMINYATGCIFEYDAAHPDGSGIGFKEEDTPNFMGSFYSKTKAMVEELLKEYDNVCTLRVRMPISSDLSNPRNFITKISRYNKVVNIPNSMTILDELLPISVEMAKRNLRGIWNFTNPGAVSHNEILEMYRDYINPNFKWNNFTLEEQAKVIVAARSNNEMDASKLKNEFPELLSIKESLIKYVFEPNKKTN

SEQ ID NO: 24094 - protein, 667 aa, Lupinus angustifolius
MGSYTPKNILITGAAGFIASHVANRLVRSYPDYKIVVLDKLDYCSNLKNLIPSKSSPNFKFVKGDIGSADLVNYLLITESIDTIMHFAAQTHVDNSFGNSFEFTKNNIYGTHVLLEACKVTGQIRRFIHVSTDEVYGETDEDAVVGNHEASQLLPTNPYSATKAGAEMLVMAYGRSYGLPVITTRGNNVYGPNQFPEKLIPKFILLAMQGKNLPIHGDGSNVRSYLYCEDVAEAFEVILHKGEVGHVYNIGTKKERRVIDVAKDICTLFKKDPEASIKFVENRPFNDQRYFLDDQKLKILGWSEKTTWEEGLKKTMDWYTQNPDWWGDVTGALIPHPRMLMMPGGLERHFEGSEDEKSASFGSTNTRMVVPSTKNTGTQQKPPFKFLLYGRTGWIGGLLGKLCEKQGIPYEYGKGRLEDRNSLIADLQHVKPTHVFNAAGVTGRPNVDWCESHKTETIRTNVAGTLTLADVCREQGILMINFATGCIFEYDAAHPEGSGIGYKEEDKPNFIGSFYSKTKAMVEELLREYDNVCTLRVRMPISSDLNNPRNFITKISRYNKVVNIPNSMTILDELLPISIEMAKRNLKGIWNFTNPGVVSHNEILEMYRDYIDPSFKWTNFTLEEQAKVIVAPRSNNEMDGSKLKKEFPELLSIKESLIKFVFEPNKK

SEQ ID NO: 24095 - protein, 675 aa, Olea europaea
MTKHTPKNILITGAAGFIASHVANRLIRNYPDYKIVVLDKLDYCSNLKNLLPSNSSPNFKFVKGDIGSADLVNYLLIAESIDTIMHFAAQTHVDNSFGNSFAFTKNNIYGTHVLLEACKVTGQIKRFIHVSTDEVYGETDEDAVVGNHEASQLLPTNPYSATKAGAEMLVMAYGRSYGLPVITTRGNNVYGPNQFPEKLIPKFILLAMRGKPLPIHGDGSNVRSYLYCEDVAEAFDVVLHMGEVGHIYNIGTKKERRVIDVAKDICKLFNIDPDKSIECVDNRPFNDQRYFLDDQKLKNLGWTERTTWEEGLKKTMEWYISNPGWWGDVSGALLPHPRMLMMPGGIERNVDGPEKSDSGKSEFSGKSNQTRMLVPASKSNGTSQKPPFKFLIFGRTGWIGGLLGKLCEKQGIPYEYGKGRLEDRPQLLADILAVKPTHVFNAAGVTGRPNVDWCEGHKTETIRTNVAGTLNLADVCREHGLLMINFGTGCIFEYNATHPEGSGIGFKEEDKPNFSGSFYSETKAMVEELLKEYDNVCTLRVRMPISSDLNNPRNLITKISRYNKVVNIPNSMTILDELLPISIEMAKRNLRGIWNFTNPGVVSHNEVLEMYKKYIDQNFKWANFTLEEQAKVIVAPRSNNEIDASKLKKEFPELLSIKESLIKYVFEPNRKTPVE

SEQ ID NO: 24096 - protein, 674 aa, Artemisia annua
MTSYTPKNILITGAAGFIASHVANRLVRSYPDYKIVVLDKLDYCSNLKNLNPSRSSPNFKFVKGDIGSADLVNYLLITENIDTIMHFAAQTHVDNSFGNSFEFTKNNIYGTHVLLEACKVTRGQIRRFIHVSTDEVYGETEEDAVVGNHEASQLLPTNPYSATKAGAEMLVMAYGRSYGLPVITTRGNNVYGPNQFPEKLIPKFILLAMRGQPLPIHGDGSNVRSYLYCEDVAEAFEVVLHKGEVGHVYNIGTKKERRVNDVARDVCNLFNIDPESSIKFVENRPFNDQRYFLDDEKLKCLGWSERTTWQEGLKKTMEWYTSNPDWWGDVSGALLPHPRMLMMPGGVEKVIDVPENVQSDSPHAAVNSSQFQKVVPAAKTSTNSATKPSFKFLIYGKTGWIGGLLGKICEKQGIQYEYGKGRLEDRSSIVADIKNVKPTHVFNAAGVTGRPNVDWCESHKTETIRTNVSGTLTLADVCRDQGILVMNFATGCIFEYDAAHPEGSGIGFLEEDTPNFTGSFYSKTKAMVEELLKEYDNVCTLRVRMPISSDLNNPRNFVTKIARYDKVVNIPNSMTILDELLPISIEMAKRNLKGIWNFTNPGVVSHNEVLELYKQYINPEFKWKNFTLEEQAQVIVAPRSNNELDTSKLKKEFPELLSIKESLVKYVFAPNKKA

SEQ ID NO: 24097 - protein, 670 aa, Brassica rapa
MASYTPKNILITGAAGFIASHVANRLIRTYPHYKIVVLDKLDYCSNLKNLNPSKNSPSFKFVKGDIASADLVNHLLITEGIDTIMHFAAQTHVDNSFGNSFEFTKNNIYGTHVLLEACKVTGQVRRFIHVSTDEVYGETDEDALVGNHEASQLLPTNPYSATKAGAEMLVMAYGRSYGLPVITTRGNNVYGPNQFPEKLIPKFILLAMRGKVLPIHGDGSNVRSYLYCEDVAEAFEVILHKGEVGHVYNIGTKKERRVNDVARDVCKLFGMDPEASIKFVENRPFNDQRYFLDDEKLKKLGWSERTTWEEGLKKTMEWYTQNPEWWGDVSGALLPHPRMLMMPGGRHFDGSDEISSAASVSDKPSQTHMVVPSTRSSTSTPQKPSLKFLIYGKTGWIGGLLGKLCEKQGIAYEYGKGRLEDRASLLQDVMSVKPTHVFNSAGVTGRPNVDWCESHKTETIRANVAGTLTLADVCREHGLLMMNFATGCIFEYDEKHPEGSGVGFKEEDTPNFTGSFYSKTKAMVEELLKEYDNVCTLRVRMPISSDLNNPRNFITKISRYNKGVNSPNSMTVLDELFPISIEMAKRNLKGIWNFTNPGVVSHNEILEMYRDYINPEFKWANFTLEEQAKVIVAPRSNNEMDASKLKKEFPELLSIKESLIKYAFEPNKKT

SEQ ID NO: 24098 - protein, 674 aa, Chrysanthemum coronarium
MTSYTPKNILITGAAGFIASHVANRLVRSYPDYKIVVLDKLDYCSNLKNLNPSRSSPNFKFVKGDIGSADLVNYLLITENIDTIMHFAAQTHVDNSFGNSFEFTKNNIYGTHVLLEACKVTRGQIRRFIHVSTDEVYGETEEDAVVGNHEASQLLPTNPYSATKAGAEMLVMAYGRSYGLPVITTRGNNVYGPNQFPEKLIPKFILLAMRGQPLPIHGDGSNVRSYLYCEDVAEAFEVVLHKGEVGHVYNIGTKKERRVNDVARDVCNLFNIDPESSIKFVENRPFNDQRYFLDDEKLKCLGWSERTTWQEGLKKTMEWYTSNPDWWGDVSGALLPHPRMLMMPGGVEKVIDVPENVQSDSPHAAVNSSQFQKVVPAAKSSTNSAAKPSFKFLIYGKTGWIGGLLGKICEKQGIQYEYGKGRLEDRSSIVADIKNVKPTHVFNAAGVTGRPNVDWCESHKTETIRTNVSGTLTLADVCRDQGILVMNFATGCIFEYDAAHPEGSGIGFLEEDTPNFTGSFYSKTKAMVEELLKEYDNVCTLRVRMPISSDLNNPRNFVTKIARYDKVVNIPNSMTILDELLPISIEMAKRNLKGIWNFTNPGVVSHNEVLELYKQYINPEFKWKNFTLEEQAQVIVAPRSNNELDTSKLKKEFPELLSIKESLVKYVFAPNKKA

SEQ ID NO: 24099 - protein, 674 aa, Chrysanthemum coronarium
MTSYTPKNILITGAAGFIASHVANRLVRSYPDYKIVVLDKLDYCSNLKNLNPSRSSPNFKFVKGDIGSADLVNYLLITENIDTIMHFAAQTHVDNSFGNSFEFTKNNIYGTHVLLEACKVTRGQIRRFIHVSTDEVYGETEEDAVVGNHEASQLLPTNPYSATKAGAEMLVMAYGRSYGLPVITTRGNNVYGPNQFPEKLIPKFILLAMRGQPLPIHGDGSNVRSYLYCEDVAEAFEVVLHKGEVGHVYNIGTKKERRVNDVARDVCNLFNIDPESSIKFVENRPFNDQRYFLDDEKLKCLGWAERTTWQEGLKKTMEWYTNNPDWWGDVSGALLPHPRMLMMPGGVEKVVEVPENVQSDSPHAAVNSSQFQKVVPAAKTTTDSATKPSFKFLIYGKTGWIGGLLGKICEKQGIQYEYGKGRLEDRLSIVADIKNVKPTHVFNAAGVTGRPNVDWCESHKTETIRANVSGTLTLADVCREQGILVINFATGCIFEYDAAHPEGSGIGFLEEDTPNFTGSFYSKTKAMVEELLKEYDNVCTLRVRMPISSDLNNPRNFVTKIARYDKVVNIPNSMTILDELLPISIEMAKRNLKGIWNFTNPGVVSHNEVLELYKQYINPEFKWKNFTLEEQAQVIVAPRSNNELDTSKLKKEFPELLSIKESLVKYVFAPNKKA

SEQ ID NO: 24100 - protein, 676 aa, Lippia dulcis
MATFTPKNILITGAAGFIASHVANRLIRSYPEYKIVVLDKLDYCSNLKNLLPSKSSANYKFVKGDIASADLVNYLLITEEIDTIMHFAAQTHVDNSFGNSFEFTKNNIYGTHVLLEACKVTGQIRRFIHVSTDEVYGETDEDAAVGNHEASQLLPTNPYSATKAGAEMLVMAYGRSYGLPVITTRGNNVYGPNQFPEKLIPKFILLAMRGKSLPIHGDGSNVRSYLYCEDVAEAFEVILHKGEVGHVYNIGTKKERCVLDVARDVCKLFNMDPDKSIQFVENRPFNDQRYFLDDQKLKKLGWAERTTWEEGLRKTMDWYTSHPDWWGDVSGALLPHPRMLIVPGGAERHLDGGERYESGKSEFNGNSSGTKMLVPPSRSSQSSSNKPAFKFLVYGRTGWIGGLLGKLCEKQGIVYEYGRGRLEDRAQLIADIHAIKPTHVFNAAGVTGRPNVDWCESHKTETIRTNVAGTLNLADVCREHGLLMMNFATGCIFEYDAAHPQGSGIGFKEEDKPNFTGSFYSKTKAMVEELLKEYDNVCTLRVRMPISSDLTNPRNFITKISKYNKVVNIPNSMTILDELLPISIEMAKRNLRGIWNFTNPGVVSHNEILEMYKKYIDPDFKYTNFTLEEQAKVIVAPRSNNEMDASKLKNEFPELLPIKESLIKYVFEPNRKTPNV

SEQ ID NO: 24101 - protein, 675 aa, Spinacia oleracea
MSSYTPKNILITGAAGFIASHVANRLIRSYPDYKIVVLDKLDYCSNLKNLRPSQSSPNFKFVKGDIASADLVNYLLITESIDTIMHFAAQTHVDNSFGNSFEFTKNNIYGTHVLLEACKVTGQIRRFIHVSTDEVYGETDEDAVVGNHEASQLLPTNPYSATKAGAEMLVMAYGRSYGLPVITTRGNNVYGPNQFPEKLIPKFILLAMRGKPLPIHGDGSNVRSYLYCEDVAEAFEVILHKGEVGHVYNIGTKKERRVIDVATDVCKLFSKDPDASIKFVENRPFNDQRYFLDDEKLKILGWSERTTWEEGLKKTMEWYTSNPDWWGDVSGALLPHPRMLMMPGGIERHVEEADENGAASSEFTKTQTRMVVPITKNTVSSPRKPCFKFLIYGRTGWIGGVLGQLCEKQEIAFEYGKGRLENRESLIADIQNVKPTHVFNAAGVTGRPNVDWCESHKPETIRANVVGTLTLADVCREYGLLMMNFATGCIFEYDATHPMGSGIGFKEEDTPNFAGSFYSKTKAMVEELLKEYDNVCTLRVRMPISSDLNNPRNFITKISRYSKVVDIPNSMTVLDELLPISIEMAKRNLRGIWNFTNPGVVSHNEILEMYKNYMDPEFKWANFTIEEQAKVIVAARSNNEMDASKLNKEFPELLSIKDSLIKYVFEPNKKTNYSA

SEQ ID NO: 24102 - protein, 676 aa, Citrus clementina
MATVYTPKNILITGAAGFIASHVCNRLIGNYPEYKIVVLDKLDYCSNLKNLNPSRLSPNFKFIKGDVASADLVHFILLTEKIDTIMHFAAQTHVDNSFGNSFEFTKNNIYGTHVLLEACKITGQIKRFIHVSTDEVYGETDEDAVVGNHEASQLLPTNPYSATKAGAEMLVMAYGRSYGLPVITTRGNNVYGPNQFPEKLIPKFILLAMKGKPLPIHGDGSNVRSYLYCEDVAEAFDTILHKGEVGHVYNIGTKKERRVIDVATDICKLFSLNPDTQIKFVENRPFNDQRYFLDVQKLKQLGWYERVTWEEGLQKTMKWYISNPDWWGDVSGALLPHPRTSMAPAIEGKVDGHDTTFMLKINNSSQSRMVVRASKSNSSRQKPSLKFLIYGRTGWIGGLLSKICEKQGIPFEYGKGRLENRSQLLADIQNVKPTHVFNAAGVTGRPNVDWCETHKPETIRTNVVGTLTLADVCRENGLLMMNYATGCIFEYDAKHPEGTGIGFKEEDKPNFTGSFYSKTKAMVEELLKEYDNVCTLRVRMPISSDLNNPRNFITKISRYNKVVNIPNSMTILDELLPISVEMAKRNLSGIWNFTNPGVVSHNEILEMYKAYIDPGFKWTNFTLEEQAKVIVAPRSNNELDASKLKKEFPELLSIKESLIKNVFEPNKKSTFGRVAK

SEQ ID NO: 24103 - protein, 670 aa, Brassica oleracea
MASSYTPKNILITGAAGFIASHVANRLIRTYPDYKIVVLDKLDYCSNLKNLNPSKHSPNFKFVKGDIASADLVNYLLITEGIDTIMHFAAQTHVDNSFGNSFEFTKNNIYGTHVLLEACKVTGQIRRFIHVSTDEVYGETDEDAVVGNHEASQLLPTNPYSATKAGAEMLVMAYGRSYGLPVITTRGNNVYGPNQFPEKLIPKFILLAMRGKVLPIHGDGSNVRSYLYCEDVAEAFEVILHKGEVGHVYNIGTKKERRVNDVAQDICKLFNMDPEANIKFVENRPFNDQRYFLDDEKLKILGWSERTTWEEGLKKTMEWYTQNPDWWGDVSGALLPHPRMLVMPGGRHFDGSEENSGSVALSGNSSQSQMVVPTPRSSGATQNPSLKFLIYGKTGWIGGLLGQICEKQGIAFEYGKGRLEDRSSLLQDILNVKPTHVFNAAGVTGRPNVDWCESHKTETIRANVAGTLTLADVCREHSLLLMNFATGCIFEYDENHPLGSGIGFKEEDTPNFTGSFYSKTKAMVEELLKEFDNVCTLRVRMPISSDLNNPRNFITKISRYSKVVNIPNSMTVLDELLPISIEMAKRNLKGIWNFTNPGVVSHNEVLEMYRDYIDSDFKWANFTLEEQAKVIVAPRSNNEMDASKLKKEFPELLSIKESLIKYAFEPNKRT

SEQ ID NO: 24104 - protein, 676 aa, Amaranthus tuberculatus
MSSYTPKNILITGAAGFIASHVANRLVRSYPDYKIVVLDKLDYCSNLKNLRPSQSSPNFKFVKGDIASADLVNYLLITESIDTIMHFAAQTHVDNSFGNSFEFTKNNIYGTHVLLEACKVTGQIRRFIHVSTDEVYGETDEDAVVGNHEASQLLPTNPYSATKAGAEMLVMAYGRSYGLPVITTRGNNVYGPNQFPEKLIPKFILLALRGKPLPIHGDGSNVRSYLYCEDVAEAFEVILHKGEVGHVYNIGTKRERRVIDVARDVCKLFNMDPEASIKFVENRPFNDQRYFLDDEKLKILGWSERTTWDEGLKKTMEWYTSNPDWWGDVSGALLPHPRMLMMPGGIERHFEETDNEKAASSDFPNTQSHMVVPVSRTSNASSPRKPSHKFLIYGRTGWIGGLLGQLCEKQGIAFEYGKGRLEDRASLIADIQNVKPTHVFNAAGVTGRPNVDWCESHKTETIRANVAGTLTLADVCKEHGLLMMNFATGCIFEYNDSHPLGSGIGFKEEDKPNFIGSFYSKTKAMVEELLKEYDNVCTLRVRMPISSDLNNPRNFITKISRYNKVVNIPNSMTVLDELLPISIEMAKRNLRGIWNFTNPGVVSHNEILEMYKNYMDPDFKWANFTLEEQAKVIVAPRSNNEMDATKLKTEFPELLNIKDSLIKYVFEPNKKTNYSA

SEQ ID NO: 24105 - protein, 665 aa, Brassica napus
  Sequence also found in Organisms: Brassica oleracea
MATYKPKNILITGAAGFIASHVANRLVRTYPDYKIVVLDKLDYCSNLKNLNPSKSSPNFKFVKGDIASADLVNYLLITENIDTIMHFAAQTHVDNSFGNSFEFTKNNIYGTHVLLEACKVTGQIRRFIHVSTDEVYGETDEDASVGNHEASQLLPTNPYSATKAGAEMLVMAYGRSYGLPVITTRGNNVYGPNQFPEKLIPKFILLAMSGKPLPIHGDGSNVRSYLYCEDVAEAFEVVLHKGEVNHVYNIGTTKERRVIDVANDISKLFGINPDSTIQFVENRPFNDQRYFLDDQKLKKLGWAERTTWEEGLKKTMEWYTANPEWWGDVSGALLPHPRMLMMPGDRLCDSGDEHKDADGNQTFTVVTPPKTGGSGDNKTSLKFLIYGKTGWLGGLLGKLCEKQGIAYEYGKGRLEDRASLVADIRRVKPTHVFNAAGLTGRPNVDWCESHKTETIRVNVAGTLTLADVCRENGLLMMNFATGCIFEYDAAHPEGSGIGFKEEDKPNFTGSFYSKTKAMVEELLREFDNVCTLRVRMPISSDLNNPRNFITKISRYNKVVNIPNSMTILDELLPISIEMAKRNLRGIWNFTNPGVVSHNEILEMYKSYIEPGFKWSNFTLEEQAKVIVAPRSNNEMDGAKLSKEFPELLSIKDSLIKYVFEPNKRT

SEQ ID NO: 24106 - protein, 665 aa, Brassica napus
MATYKPKNILITGAAGFIASHVANRLVRTYPDYKIVVLDKLDYCSNLKNLNPSKSSPNFKFVKGDIASADLVNYLLITENIDTIMHFAAQTHVDNSFGNSFEFTKNNIYGTHVLLEACKVTGQIRRFIHVSTDEVYGETDEDASVGNHEASQLLPTNPYSATKAGAEMLVMAYGRSYGLPVITTRGNNVYGPNQFPEKLIPKFILLAMSGKPLPIHGDGSNVRSYLYCEDVAEAFEVVLHKGEVNHVYNIGTTKERRVIDVANDISKLFGINPDSTIQFVENRPFNDQRYFLDDQKLKKLGWAERTTWEEGLKKTMEWYTANPEWWGDVSGALLPHPRMLMMPGDRLCDSGDEHKDADGNQTFTVVTPPKTGGSGDNKTSLKFLIYGKTGWLGGLLGKLCEKQGIAYEYGKGRLEDRASLVADIRRVKPTHVFNAAGLTGRPNVDWCESHKTETIRVNVAGTLTLADVCRENGLLMMNFATGCIFEYDAAHPEGSGIGFKEEDKPNFTGSFYSKTKAMVEELLREFDNVCTLRVRMPISSDLNNPRNFITKISRYNKVVNIPNSMTILDELLPISIEMAKRNLKGIWNFTNPGVVSHNEILEMYKSYIEPDFKWSNFTLEEQAKVIVAPRSNNEMDGAKLSKEFPELLSIKDSLIKYVFEPNKRT

SEQ ID NO: 24107 - protein, 669 aa, Trifolium pratense
MASYTPKNILITGAAGFIASHVANRLVRSHPEYKIVVLDKLDYCSNLKNLLPSKSSPNFKFVKGDIGSADLVNYLLITESIDTIMHFAAQTHVDNSFGNSFEFTKNNIYGTHVLLEACKVTGQIRRFIHVSTDEVYGETDEDAVVGNHEASQLLPTNPYSATKAGAEMLVMAYGRSYGLPVITTRGNNVYGPNQFPEKLIPKFILLAMQGKNLPIHGDGSNVRSYLFCEDVAEAFEVVLHKGEVGHVYNIGTKKERGVIDVAKDICRLFKMDPEKSIKFVENRPFNDQRYFLDDQKLKNIGWSERTTWDEGLKKTIEWYTKNPDWWGDVSGALLPHPRMLMMPGGMERHFEGSEGENTASLNSSNNTHMVVPSTKNTGGQQKRPLKFLLFGRTGWIGGLLGKLCEKQGIPYEYAKGRLEDRASLIADIQNVKPTHVFNAAGVTGRPNVDWCETHKTETIRANVAGTLTLADVCRENGVLMINYATGCIFEYDAAHPEGSGIGFKEEDKPNFMGSFYSKTKAMVEELLREYDNVCTLRVRMPISSDLSNPRNFITKISRYNKVVNIPNSMTVLDELLPISIEMAKRNLSGIWNFTNPGAVSHNQILEMYRDYIDPSFKWQNFTLEEQAKVIVAARSNNEMDGTKLKKEFPELLSIKESLIKYVFEPNKKK

SEQ ID NO: 24108 - protein, 669 aa, Trifolium pratense
MASYTPKNILITGAAGFIASHVANRLVRSHPEYKIVVLDKLDYCSNLKNLLPSKSSPNFKFVKGDIGSADLVNYLLITESIDTIMHFAAQTHVDNSFGNSFEFTKNNIYGTHVLLEACKVTGQIRRFIHVSTDEVYGETDEDAIVGNHEASQLLPTNPYSATKAGAEMLVMAYGRSYGLPVITTRGNNVYGPNQFPEKLIPKFILLAMQGKTLPIHGDGSNVRSYLYCEDVAEAFEVVLHKGEVGHVYNIGTKKERGVIDVAKDICRLFSMDPEKSIKFVENRPFNDQRYFLDDQKLKNIGWSERTTWDEGLKKTIEWYTKNPDWWGDVSGALLPHPRMLMMPGGMERHFEGSEGENPASFNSSNNTHMVVPSSKNTGGQQKHPLKFLLFGRTGWIGGLLGKLCEKQGIPYEYAKGRLEDRASLIADIQNVKPTHVFNAAGVTGRPNVDWCETHKTETIRANVAGTLTLADVCRENGILMINYATGCIFEYDAAHPEGSGIGFKEEDKPNFMGSFYSKTKAMVEELLREYDNVCTLRVRMPISSDLSNPRNFITKISRYNKVVNIPNSMTVLDELLPISIEMAKRNLSGIWNFTNPGAISHNQILEMYRDYIDPSFKWQNFTLEEQAKVIVAARSNNEMDGAKLKKEFPELLSIKESLIKYVFEPNKKT

SEQ ID NO: 24109 - protein, 674 aa, Chrysanthemum coronarium
MTSYTPKNILITGAAGFIASHVANRLVRSYPDYKIVVLDKLDYCSNLKNLNPSRSSPNFKFVKGDIGSADLVNYLLITENIDTIMHFAAQTHVDNSFGNSFEFTKNNIYGTHVLLEACKVTRGQIRRFIHVSTDEVYGETEEDAVVGNHEASQLLPTNPYSATKAGAEMLVMAYGRSYGLPVITTRGNNVYGPNQFPEKLIPKFILLAMREQPLPIHGDGSNVRSYLYCEDVAEAFEVVLHKGEVGHVYNIGTKKERRVNDVARDVCNLFNIDPESSIKFVENRPFNDQRYFLDDEKLKCLGWAERTTWQEGLKKTMEWYTNNPDWWGDVSGALLPHPRMLMMPGGVEKVVEVPENVQSDSPHAAVNSSQFQKVVPAAKTTTDSATKPSFKFLIYGKTGWIGGLLGKICEKQGIQYEYGKGRLEDRLSIVADIKNVKPTHVFNAAGVTGRPNVDWCESHKTETIRANVSGTLTLADVCREQGILVINFATGCIFEYDAAHPEGSGIGFLEEDTPNFTGSFYSKTKAMVEELLKEYDNVCTLRVRMPISSDLNNPRNFVTKIARYDKVVNIPNSMTILDELLPISIEMAKRNLKGIWNFTNPGVVSHNEVLELYKQYINPEFKWKNFTLEEQAQVIVAPRSNNELDTSKLKKEFPELLSIKESLVKYVFAPNKKA

SEQ ID NO: 24110 - protein, 666 aa, Panicum virgatum
MATNYKPKNILITGAAGFIASHVAIRITKKYPDYKIVVLDKLDYCSNLKNLLPVSSSPNFKFVKGDIASADLVNFLLVTENIDTIMHFAAQTHVDNSFGNSFEFTKNNIYGTHVLLEACKITGQIKRFIHVSTDEVYGETDEDALVGNKEASQLLPTNPYAATKAGAEMLVMAYGRSYGLPVITTRGNNVYGPNQFPEKLIPKFILLAMRGEPLPIHGDGTNVRSYLYCEDVAEAFEVILHHGEVGHVYNIGTKRERTVIDVAKDVCKLFNLEADKVIMFVENRPFNDQRYFLDDEKLKSLGWAERTPWEEGLKRTMEWYVANSDYWGDVSGALLPHPRTLMMPGYEGSEEIKVILSQFNNIKTKVDSTSDSASETHAFKFLIYGRTGWIGGLLGKICEKQGIPYEYGKGRLQDRSSLILDIQTIKPTHVFNAAGVTGRPNVDWCESHKPDTIRTNVVGTLTLADVCREHGLLMMNYATGCIFEYDAHHPEGSGIGFKEEDAPNFTGSFYSKTKAMVEELLKEYENVCTLRVRMPISSDLSNPRNFVTKISRYNKVVNIPNSMTILDELLPISVEMAKRNLRGIYNFTNPGVVSHNEILEMYKQYIDPSFKWTNFTLEEQAKVIIAPRSNNEMDASKLKKEFPELLSIKDSLIKYVFEPNRKVPVN

SEQ ID NO: 24111 - protein, 669 aa, Lupinus angustifolius
MATHTPKNILITGAAGFIASHFANRLVRNYPEYKIVVLDKLDYCSNLKNLIPSKSSPNFKFVKGDIGSADLVNYLLITESIDTIMHFAAQTHVDNSFGNSFEFTKNNIYGTHVLLEACKVTGQIKRFIHVSTDEVYGETDEDAIVGNHEASQLLPTNPYSATKAGAEMLVMAYGRSYGLPVITTRGNNVYGPNQFPEKLIPKFILLALQGKPLPIHGDGSNVRSYLYCEDVAEAFEVILHKGEVGHVYNIGTKKERRVIDVAQDICRLFSMDPDASIKFVENRPFNDQRYFLDDEKLKILGWSERTTWEEGLKKTLDWYTKNPDWWGDVSGALLPHPRMLMMPGGLERHLDGSEDEKPESYVSTNTRMVVPPSKSVGASQKHPLKFLIYGRTGWIGGLLGKLCEKQGIPYEYGKGRLEDRSSLVADIQSVKPTHIFNAAGVTGRPNVDWCETHKTETIRANVAGTLTLADVSREHGLLVINYATGCIFEYDAAHPEGSGIGFKEEDKPNFMGSFYSKTKAMVEELLREYDNVCTLRVRMPISSDLSNPRNFITKISRYNKVVNIPNSMTILDELLPISIEMAKRNLRGIWNFTNPGAVSHNEILEMYRDYIDPNFKWSNFTLEEQAKVIVAARSNNEMDASKLKNEFPELLSIKESLVKFVFEPNKKTA

SEQ ID NO: 24112 - protein, 675 aa, Mimulus guttatus
MSTFTPKNILITGAAGFIASHVANRLVRTYPGYKIVVLDKLDYCSNLKNLLPSNSSPNFKFVQGDIGSADLVNYLLITENIDTIMHFAAQTHVDNSFGNSFEFTKNNIYGTHVLLEACKVTGQIRRFIHVSTDEVYGETDEDAVVGNHEASQLLPTNPYSATKAGAEMLVMAYGRSYGLPVITTRGNNVYGPNQFPEKLIPKFILLAMRGKTLPIHGDGSNVRSYLYCEDVAEAFEVILHKGEVGHVYNIGTKKERRVTDVARDVCNLFNMDPDKSIQFVENRPFNDQRYFLDDQKLTNLGWSERTTWTEGLKKTMEWYTSNPDWWGDVSGALLPHPRMLMMPGGLERHTEAAAKGESGKSDFSLSQSKMLVPSPKSSASPHKPAFKFLIYGRTGWIGGLLGKLCEKQGISYEYGKGRLQDRASILADLVAVKPTHVFNAAGVTGRPNVDWCESHKTETIRTNVAGTLTLADVCREHGLLVVNFATGCIFEYDAAHPEGSGIGFKEEDTPNFIGSFYSKTKAMVEELLKEYDNVCTLRVRMPISADLDNPRNFITKISRYNKVVNIPNSMTILDELLPISIEMAKRNLRGIWNFTNPGVVSHNEILEMYKEYIDADFKWSNFTLEEQAKVIIAPRSNNELDASKLKKEFPELLSIKESLIKNVFGPNRKTPKTAA

SEQ ID NO: 24113 - protein, 665 aa, Brassica rapa
MATYKPKNILITGAAGFIASHVANRLVRTYPDYKIVVLDKLDYCSNLKNLNPSKSSPNFKFVKGDIASADLVNYLLITENIDTIMHFAAQTHVDNSFGNSFEFTKNNIYGTHVLLEACKVTGQIRRFIHVSTDEVYGETDEDASVGNHEASQLLPTNPYSATKAGAEMLVMAYGRSYGLPVITTRGNNVYGPNQFPEKLIPKFILLAMSGKPLPIHGDGSNVRSYLYCEDVAEAFEVVLHKGEVNHVYNIGTTKERRVIDVANDISKLFGINPDSTIQFVENRPFNDQRYFLDDQKLKKLGWAERTTWEEGLKKTMEWYTANPEWWGDVSGALLPHPRMLMMPGDRLCDSGDEHKDADGNQTFTVVTPPKTGGSGDNKTSLKFLIYGKTGWLGGLLGKLCEKQGIAYEYGKGRLEDRASLVADIRRVKPTHVFNAAGLTGRPNVDWCESHKTETIRVNVAGTLTLADVCRENGLLMMNFATGCIFEYDAAHPEGSGIGFKEEDKPNFTGSFYSKTKAMVEELLREFDNVCTLRVRMPISSDLNNPRNFITKISRYNKVVNIPNSMTILDELLPISIEMAKRNLRGIWNFTNPGVVSHNEILEMYKSYIEPGFKWSNFTLEEQAKVIVAPRSNNEMDGAKLSKEFPELLSIQDSLIKYVFEPNKRT

SEQ ID NO: 24114 - protein, 667 aa, Gossypium hirsutum
MASYKPKNILITGAAGFIASHVANRLVRNYPEYKIVVLDKLDYCSNTKNLFPSKLSPSFKFVKGDIESADLVNYLLITESIDTIMHFAAQTHVDNSFGNSFEFTKNNIYGTHVLLEACKVTGQIRRFIHVSTDEVYGETDEDAVVGNHEASQLLPTNPYSATKAGAEMLVMAYGRSYGLPVITTRGNNVYGPNQFPEKLIPKFILLAMRGKTLPIHGDGSNVRSYLYCEDVAEAFEVILHKGEVGRVYNIGTKKERRVIDVAKDICKLFSMDPETSIEFVENRPFNDQRYFLDDQRLKNLGWSERTVWEDGLKKTIEWYTQNPDWWGDVTGALLPHPRMLMMAGSTHFDSEDSKETSYVSGPNQTRMVVPTPKGGSSPQKQSLKFLIYGRTGWIGGLLGQLCEKQGIAFAYGKGRLEDRSSLNADIQNIKPTHVFNAAGVTGRPNVDWCESHKTETIRANVAGTLTLADVCRDHGLLMMNFATGCIFEYDAAHPQGSGIGFKEEDKPNFIGSFYSKTKAMVEELFKEYDNVCTLRVRMPISSDLNNPRNFITKISRYNKVVNIPNSMTVLDELLPISIEMAKRNLRGIWNFTNPGVVSHNEILEMYKTYIDPKFKWENFTLEEQAKVIVAPRSNNEMDASKLKKEFPELLSIKESLIKYAFEPNRRT

SEQ ID NO: 24115 - protein, 693 aa, Lippia dulcis
MSTFQPKNILITGAAGFIASHVANRLVRNYPHYKIVVLDKLDYCSNLKNLLPSNSSPNFKFVKGDIGSADLVNYLLITENIDTIMHFAAQTHVDNSFGNSFEFTKNNIYGTHVLLEACKVTGQIRRFIHVSTDEVYGETEEDAVVGNHEASQLLPTNPYSATKAGAEMLVMAYGRSYGLPVITTRGNNVYGPNQFPEKLIPKFILLAMRGQTLPIHGDGSNVRSYLYCEDVAEAFETVLHKGEVGHVYNIGTKKERRVIDVATDICKLFNMDPDKSIKYVENRPFNDQRYFLDDQKLKNLGWFEKTTWEEGLKKTMEWYTSNPDWWGDVSGALIPHPRMLMMPGGLDRHSDGSEKSAKCEVSENANLTKMVVPTSKTNSSPQKQGFKFLIYGKTGWIGGLLGKLCEKQGIAYEYGKGRLQDRASLVADILAVKPTHVFNAAGVTGRPNVDWCETHKTETIRTNVVGTLTLADVCREHGLLMMNYATGCIFEYDAAHPEGSGIGFKEEDTPNFAGSFYSKTKAMVEDLLKEYDNVCTLRVRMPISSDLSNPRNFITKISKYNKVVNIPNSMTILDELLPISIEMAKRNLRGIWNFTNPGVVSHNEILDMYKDYIDPDFKYTNFTLEEQAKVIVAARSNNEMDASKLKKEFPELLSIKESLIKNVFEPNRKPPLHKCEFCQLVGCLHFVFFTCLS

SEQ ID NO: 24116 - protein, 676 aa, Citrus sinensis
MATVYTPKNILITGAAGFIASHVCNRLIGNYPEYKIVVLDKLDYCSNLKNLNPSRLSPNFKFIKGDVASADLVHFILLTEKIDTIMHFAAQTHVDNSFGNSFEFTKNNIYGTHVLLEACKITGQIKRFIHVSTDEVYGETDEDAVVGNHEASQLLPTNPYSATKAGAEMLVMAYGRSYGLPVITTRGNNVYGPNQFPEKLIPKFILLAMKGKPLPIHGDGSNVRSYLYCEDVAEAFDTILHKGEVGHVYNIGTKKERRVIDVATDICKLFSLNPDTQIKFVENRPFNDQRYFLDVQKLKQLGWYERVTWEEGLQKTMKWYISNPDWWGDVSGALLPHPRTSMAPAIEGKVDGHDTTFMLKINNSSQSRMVVRASKSNSSRQKPFLKFLIYGRTGWIGGLLSKICEKKGIPFEYGKGRLENRSQLLADIQNVKPTHVFNAAGVTGRPNVDWCETHKPETIRTNVVGTLTLADVCRENGLLMMNYATGCIFEYDAKHPEGTGIGFKEEDKPNFTGSFYSKTKAMVEELLKEYDNVCTLRVRMPISSDLNNPRNFITKISRYNKVVNIPNSMTILDELLPISVEMAKRNLSGIWNFTNPGVVSHNEILEMYKAYIDPGFKWTNFTLEEQAKVIVAPRSNNELDASKLKKEFPELLSIKESLIKNVFEPNKKPTFGGVAK

SEQ ID NO: 24117 - protein, 676 aa, Phalaenopsis aphrodite
MESYKPKSILITGAAGFIASHVANRLIRNYPDYKIVVLDKLDYCSNLKNLSPSGYSPNLKFVKGDIASADLLHYLLITESIDTIMHFAAQTHVDNSFGNSFEFTKNNIYGTHVLLEACKVSGQIRRFIHVSTDEVYGETDENAIVGNHEASQLLPTNPYSATKAGAEMLVMAYGRSYGLPVITTRGNNVYGPNQFPEKLIPKFILLAMRGQTLPIHGDGSNVRSYLYCEDVAEAFEVILHRGEIGHVYNIGTKKERRVIDVAKDICKLFARDTTTAIKFVDNRPFNDQRYFLDDQKLKILGWSERTTWEEGLKKTMDWYTNNPDWWGDVSGALLPHPRMLMMPGTERHSDGPEEIIKSMLSPPNNINIPSQLITPPVSETSSFGIKTQSLKFLIYGKTGWIGGLLGKICEKQGISFEYGKGRLEDRSQLQSDIHNVKPTHVFNAAGVTGRPNVDWCESHRLETIRTNVVGTLTLADVCSENSLLLINYATGCIFEYDANHPEGSGYGFKEEDSPNFVGSYYSKTKAMVEELLKEYDNVCTLRVRMPISSDLNNPRNFITKISRYDKVVNIPNSMTVLDELLPISIEMAKRNCRGIWNFTNPGVVSHNEILELYKAYVDPGFSWVNFTLEEQAKVIVAPRSNNELDASKLKNEFPELLSIKESLIKYVFEPNGKQVK

SEQ ID NO: 24118 - protein, 666 aa, Panicum virgatum
MATNYKPKNILITGAAGFIASHVAIRITKKYPDYKIVVLDKLDYCSNLKNLLPVSSSPNFKFVKGDIASADLVNFLLVTENIDTIMHFAAQTHVDNSFGNSFEFTKNNIYGTHVLLEACKITGQIKRFIHVSTDEVYGETDEDAVVGNKEASQLLPTNPYAATKAGAEMLVMAYGRSYGLPVITTRGNNVYGPNQFPEKLIPKFILLAMRGEPLPIHGDGTNVRSYLYCEDVAEAFEVILHHGEVGHVYNIGTKRERTVIDVAKDVCKLFSLEADKVIMFVENRPFNDQRYFLDDEKLKSLGWAERTPWEEGLKKTMEWYVANSDYWGDVSGALLPHPRTLMMPGYEGSVEIKGILSQFNNIRTKVDSTSDSAPETHAFKFLIYGRTGWIGGLLGKICEKQGIPYEHGKGRLQDRSSLILDIQTIKPTHVFNAAGVTGRPNVDWCESHKPDTIRTNVVGTLTLADVCREHGLLMMNYATGCIFEYDAHHPEGSGIGFKEEDTPNFTGSFYSKTKAMVEELLKEYENVCTLRVRMPISSDLSNPRNFVTKISRYNKVVNIPNSMTILDELLPISVEMAKRNLRGIYNFTNPGVVSHNEILEMYKQYIDPSFEWTNFTLEEQAKVIIAPRSNNEMDASKLKKEFPELLSIKDSLIKYVFEPNRKVPVN

SEQ ID NO: 24119 - protein, 667 aa, Eutrema halophilum
MATTYKPKNILITGAAGFIASHVANRLIRSYPDYKIVVLDKLDYCSDLKNLDPSFSSPNFRFVKGDIASDDLVNYLLITENIDTIMHFAAQTHVDNSFGNSFEFTKNNIYGTHVLLEACKVTGQIRRFIHVSTDEVYGETDEDAAVGNHEASQLLPTNPYSATKAGAEMLVMAYGRSYGLPVITTRGNNVYGPNQFPEKLIPKFILLAMSGKPLPIHGDGSNVRSYLYCEDVAEAFEVVLHKGEVGHVYNIGTKRERRVIDVARDICKLFGKDPESSIQFVENRPFNDQRYFLDDQKLKKLGWSERTAWEDGLKKTMEWYTQNPEWWGDVSGALLPHPRMLMMPGGRLSSDEKKDASSNTVQTFTVVTPTHNKTGGSSDKASLKFLIYGKTGWIGGLLGKLCEKQGIAYEYGKGRLEDRASLLADIRSIKPTHVFNAAGLTGRPNVDWCESHKPETIRVNVAGTLTLADVCRENGLLMMNFATGCIFEYDAAHPEGSGIGFKEEDKPNFTGSFYSKTKAMVEELLREFDNVCTLRVRMPISSDLNNPRNFITKISRYNKVVNIPNSMTILDELLPISIEMAKRNLRGIWNFTNPGVVSHNEILEMYKSYIEPGFKWSNFTVEEQAKVIVAPRSNNEMDGSKLSKEFPEMLPIKEALIKYVFEPNKRT

SEQ ID NO: 24120 - protein, 674 aa, Chrysanthemum coronarium
MTSYTPKNILITGAAGFIASHVANRLVRSYPDYKIVVLDKLDYCSNLKNLNPSRSSPNFKFVKGDIGSADLVNYLLITENIDTIMHFAAQTHVDNSFGNSFEFTKNNIYGTHVLLEACKVTRGQIRRFIHVSTDEVYGETEEDAVVGNHEASQLLPTNPHSATKAGAEMLVMAYGRSYGLPVITTRGNNVYGPNQFPEKLIPKFILLAMREQPLPIHGDGSNVRSYLYCEDVAEAFEVVLHKGEVGHVYNIGTKKERRVNDVARDVCNLFNMDPESSIKFVENRPFNDQRYFLDDEKLKCLGWSERTTWQEGLKKTMEWYTSNPDWWGDVSGALLPHPRMLMMPGGVEKVIDVPENVQSDSPHAAVNSSQFQKVVSAAKTSTNSATKPSFKFLIYGKTGWIGGLLGKICEKQGIQYEYGKGRLEDRSSIVADIKNVKPTHVFNAAGVTGRPNVDWCESHKTETIRTNVSGTLTLADVCRDQGILVMNFATGCIFEYDAAHPEGSGIGFLEEDTPNFTGSFYSKTKAMVEELLKEYDNVCTLRVRMPISSDLNNPRNFVTKIARYDKVVNIPNSMTILDELLPISIEMAKRNLKGIWNFTNPGVVSHNEVLELYKQYINPEFKWKNFTLEEQAQVIVAPRSNNELDTSKLKKEFPELLSIKESLVKYVFAPNKKA

SEQ ID NO: 24121 - protein, 664 aa, Eutrema parvulum
MATYKPKNILITGAAGFIASHVANRLVRSYPDYKIVVLDKLDYCSNLKNLNPSKSSPNFKFVKGDIASADLVNYLLITENIDTIMHFAAQTHVDNSFGNSFEFTKNNIYGTHVLLEACKVTGQIRRFIHVSTDEVYGETDEDASVGNHEASQLLPTNPYSATKAGAEMLVMAYGRSYGLPVITTRGNNVYGPNQFPEKLIPKFILLAMNGKPLPIHGDGSNVRSYLYCEDVAEAFEVVLHKGEVNHVYNIGTTRERRVIDVANDISKLFGTDPDSTIQFVENRPFNDQRYFLDDQKLKKLGWSERTTWEEGLRKTMEWYTENPEWWGDVSGALLPHPRMLMMPGDRLSDGCDEHKDADGNQTFTVVTPTKSGSSGDKAFLKFLIYGKTGWLGGLLGKLCEKQGILYEYGKGRLEDRASLMADIRSVRPTHVFNAAGLTGRPNVDWCESHKTETIRVNFAGTLTLADVCRENDLLMMNFATGCIFEYDAAHPEGSGIGFKEEDKPNFTGSFYSKTKAMVEELLREFDNVCTLRVRMPISSDLNNPRNFITKISRYNKVVNIPNSMTILDELLPISIEMAKRNLRGIWNFTNPGVVSHNEILEMYKSYMEPGFKWSNFTLEEQAKVIVAPRSNNEMDGSKLSKEFPEMLSIKDSLIKYVFEPNKRT

SEQ ID NO: 24122 - protein, 667 aa, Hordeum vulgare
MATPYTPKSILITGAAGFIASHVTNRIVRNYPDYKIVVLDKLDYCSNLKNLLPASSSPNFKFVKGDIASADLVNFLLVTENIDTIMHFAAQTHVDNSFGNSFEFTKNNIYGTHVLLEACKVTGQIRRFIHVSTDEVYGETDEDAVVGNHEASQLLPTNPYSATKAGAEMLVMAYGRSYGLPVITTRGNNVYGPNQFPEKLIPKFILLAMRGKPLPIHGDGSNVRSYLYCEDVAEAFEVILHRGEVGHVYNIGTKRERTVTDVAKDVCRLFNLEADKVIQFVDNRPFNDQRYFLDDEKLKSLGWSERTRWEEGLRKTMEWYVANSDYWGDVSGALLPHPRTLMMPGCEGSEEIKGMLNLFTNNQTKMVAPTSEGSSQTRSLKFLIYGRTGWIGGLLGKICEKQGIPYEYGKGRLEERFSIVLDIQTVKPTHVFNAAGVTGRPNVDWCESHKPDTIRTNVVGTLTLADVCREHGLLVINYATGCIFEYDANHPEGSGIGFKEENKPNFTGSFYSKTKAMVEELLKEYENVCTLRVRMPISSDLNNPRNFITKISRYDKVVNIPNSMTVLDELLPISVEMAKRNLRGIWNFTNPGVVSHNEILEMYKMYMDPSYKWTNFTLEEQAKVIVAPRSNNEMDAAKLKREFPELLSIKDSLIKYVFEPNRKVPAT

SEQ ID NO: 24123 - protein, 667 aa, Hordeum vulgare
MATPYTPKSILITGAAGFIASHVTNRIVRNYPDYKIVVLDKLDYCSNLKNLLPASSSPNFKFVKGDIASADLVNFLLVTENIDTIMHFAAQTHVDNSFGNSFEFTKNNIYGTHVLLEACKVTGQIRRFIHVSTDEVYGETDEDAVVGNHEASQLLPTNPYSATKAGAEMLVMAYGRSYGLPVITTRGNNVYGPNQFPEKLIPKFILLAMRGKPLPIHGDGSNVRSYLYCEDVAEAFEVILHRGEVGHVYNIGTKRERTVTDVAKDVCRLFNLEADKVIQFVDNRPFNDQRYFLDDEKLKSLGWSERTRWEEGLRKTMEWYVANSDYWGDVSGALLPHPRTLMMPGCEGSEEIKGMLNLFTNNQTKMVAPTSEGSSQTRSLKFLIYGRTGWIGGLLGKICEKQGIPYEYGKGRLEERFSIVLDIQTVKPTHVFNAAGVTGRPNVDWCESHKPDTIRTNVVGTLTLADVCREHGLLVINYATGCIFEYDANHPEGSGIGFKEENKPNFTGSFYSKTKAMVEELLKEYENVCTLRVRMPISSDLNNPRNFITKISRYDKVVNIPNSMTVLDELLPISVEMAKRNLRGIWNFTNPGVVSHNEILEMYKKYMDPSYKWTNFTLEEQAKVIVAPRSNNEMDAAKLKREFPELLSIKDSLIKYVFEPNRKVPAT

SEQ ID NO: 24124 - protein, 667 aa, Secale cereale
MATPYTPKSILITGAAGFIASHVTNRIVRNYPDYKIVVLDKLDYCSNLKNLLPASSSPNFKFVKGDIASADLVNFLLVTENIDTIMHFAAQTHVDNSFGNSFEFTKNNIYGTHVLLEACKVTGQIRRFIHVSTDEVYGETDEDAVVGNHEASQLLPTNPYSATKAGAEMLVMAYGRSYGLPVITTRGNNVYGPNQFPEKLIPKFILLAMRGKPLPIHGDGSNVRSYLYCEDVAEAFEVILHRGEVGHVYNIGTKRERTVTDVAKDVCRLFNLEADKVIQLVDNRPFNDQRYFLDDEKLKSLGWSERTRWEEGLRKTMEWYVANSDYWGDVSGALLPHPRTLMMPGYEGSEEIKGMLNLFTNSHTKMVAPTSEGSSQTRSLKFLIYGRTGWIGGLLGKICEKQGIPYEYGKGRLEERFSIVLDIQTVKPTHVFNAAGVTGRPNVDWCESHKPDTIRTNVVGTLTLADVCREHGLLVINYATGCIFEYDANHPEGSGIGFKEEDKPNFTGSFYSKTKAMVEELLKEYENVCTLRVRMPISSDLNNPRNFITKISRYDKVVNIPNSMTVLDELLPISVEMAKRNLRGIWNFTNPGVVSHNEILEMYKKYMDPSYKWTNFTLEEQAKVIVAPRSNNEMDAAKLKREFPELLSIKDSLIKYVFEPNRKVPAT

SEQ ID NO: 24125 - protein, 667 aa, Triticum aestivum
MATPYTPKSILITGAAGFIASHVTNRIVRNYPDYKIVVLDKLDYCSNLKNLLPASSSPNFKFVKGDIASADLVNFLLVTENIDTIMHFAAQTHVDNSFGNSFEFTKNNIYGTHVLLEACKVTGQIRRFIHVSTDEVYGETDEDAVVGNHEASQLLPTNPYSATKAGAEMLVMAYGRSYGLPVITTRGNNVYGPNQFPEKLIPKFILLAMRGKPLPIHGDGSNVRSYLYCEDVAEAFEVILHRGEVGHVYNIGTKRERTVTDVAKDVCRLFNLEADKVIQLVDNRPFNDQRYFLDDEKLKSLGWSERTRWEEGLRKTMEWYVANSDYWGDVSGALLPHPRTLMMPGYEGSEEIKGMLNLFTNNQTKMVAPTSEGSSQTRLLKFLIYGRTGWIGGLLGKICEKQGIPYEYGKGRLEERFSIVLDIQTVKPTHVFNAAGVTGRPNVDWCESHKPDTIRTNVVGTLTLADVCREHGLLVINYATGCIFEYDANHPEGSGIGFKEEDKPNFTGSFYSKTKAMVEELLKEYENVCTLRVRMPISSDLNNPRNFITKISRYDKVVNIPNSMTVLDELLPISVEMAKRNLRGIWNFTNPGVVSHNEILEMYKKYMDPSYKWTNFTLEEQAKVIVAPRSNNEMDATKLKREFPELLSIKDSLIKYVFEPNRKVPAT

SEQ ID NO: 24126 - protein, 679 aa, Fragaria vesca
MATTYKPKNILITGAAGFIASHVCNRLIRNYPEYNIVVLDKLDYCSNLKNLHPSRSSPNFKFIKGDIGSADLVNFILLTESIDTIMHFAAQTHVDNSFGNSFEFTKNNIYGTHVLLEACKVTGQIKRFIHVSTDEVYGETDEDAVVGNHEASQLLPTNPYSATKAGAEMLVMAYGRSYGLPVITTRGNNVYGPNQFPEKMIPKFILLAMKGKTLPIHGDGSNVRSYLYCEDVAEAFEVILHKGEVGHVYNIGTKKERRVIDVAREICQLFSLNPDTYINFVENRPFNDQRYFLDDQKLKNLGWSESTAWEEGLRKTMEWYVKNPHWWGDVSGALLPHPRMLMVPGIERNFDGPDTSNSDSPLPATDSSLSEVVVPAPRGIPSTQKPSLKFLIYGRTGWIGGLLGKICEKQGILFEYGRGRLQECSQLLADIQRVKPTHVFNAAGVTGRPNVDWCESHKPETIRTNVVGTLTLADVCREHNLLMMNYATGCIFEYDAAHPLRSGIGFKEEDTPNFTGSFYSKTKAMVEELLKEYDNVCTLRVRMPISSDLSNPRNFITKISKYNKVVDIPNSMTILDELLPISVEMAKRNLKGIWNFTNPGVVSHNEILEMYKKYIDPSFKWVNFTLEEQAKVIVAPRSNNEMDASKLKKEFPELLSIKESLIKYVFEPNKKTSAGGAAN

SEQ ID NO: 24127 - protein, 670 aa, Populus trichocarpa
MATYTPKNILITGAAGFIASHVCNRLIRNYPDYKIVVLDKLDYCSNLKNLLPSKSSPNFKFVKGDVGSADLVNFLLITESIDTIMHFAAQTHVDNSFGNSFEFTKNNIYGTHVLLEACKVTGQIRRFIHVSTDEVYGETDEDAVVGNHEASQLLPTNPYSATKAGAEMLVMAYGRSYGLPVITTRGNNVYGPNQFPEKLIPKFILLAMQGKHLPIHGDGSNVRSYLYCEDVAEAFEVILHKGEVGHVYNIGTKKERRVIDVAKDICNLFSRDPDTSIKFVDNRPFNDQRYFLDDQKLNNLGWSEHTTWQEGLRKTMEWYTQNPDWWGDVSGALLPHPRMLMMPGGRHFDGSEEKDASYVSNNSNQTRMVIPVSKGSGSGSPRKPSLKFLIYGRTGWIGGLLGKLCEKQGISYEYGKGRLEDRSSLLSDIQNVRPTHVFNAAGVTGRPNVDWCESHKTETIRTNVTGTLTLADLCREHNLLMMNFATGCIFEYNAGHPEGSGIGFTEEDKPNFIGSYYSKTKAMVEELLKEYDNVCTLRVRMPISSDLNNPRNFITKISRYNKVVNIPNSMTILDELLPISIEMAKRNLRGIWNFTNPGVVSHNEILEMYKNYINPDFTWVNFDLEEQAKVIVAPRSNNEMDASKLKNEFPELLPIKESLIKYVFEPNKRT

SEQ ID NO: 24128 - protein, 667 aa, Cicer arietinum
MASYTPKNILITGAAGFIASHVANRLVRSHPEYKIVVLDKLDYCSNLKNLLPSKSSSNFKFVKGDIGSADLVNYLLITESIDTIMHFAAQTHVDNSFGNSFEFTKNNIYGTHVLLEACKVTGQIRRFIHVSTDEVYGETDEDAIVGNHEASQLLPTNPYSATKAGAEMLVMAYGRSYGLPVITTRGNNVYGPNQFPEKLIPKFILLAMQGKNLPIHGDGTNVRSYLYCEDVAEAFEVVLHKGEVGHVYNIGTKKERGVIDVAKDICRLFSMDAETSIKFVENRPFNDQRYFLDDQKLKNLGWSERTTWEEGLKKTIEWYTKNPDWWGDVSGALLPHPRMLMMPGGMERHFEGSEGENPASFNSSNTRMVVPTSKNTGAQQKHALKFLIFGRTGWIGGLLGKLCEKQEIPYEYAKGRLEDRASLIADIQNVKPTHVFNAAGVTGRPNVDWCESHKTETIRANVAGTLTLADVCRESSILMVNYATGCIFEYDAAHQEGSGIGFKEEDKPNFHGSFYSKTKAMVEELLREYDNVCTLRVRMPISSDLSNPRNFITKISRYNKVVNIPNSMTILDELLPISIEMAKRNLSGIWNFTNPGAVSHNEILEMYRDYIDPNYKWENFTLEEQAKVIVAARSNNEMDATKLKNEFPELLPIKESLIKYVFEPNKK

SEQ ID NO: 24129 - protein, 652 aa, Flaveria ramosissima
VANRLIRNYPDYKIVVLDKLDYCSNLKNLNPSRSSPNFKFVKGDIGSADLVNYLLITESIDTIMHFAAQTHVDNSFGNSFEFTKNNIYGTHVLLEACKVTGQIRRFIHVSTDEVYGETEEDAVVGNHEASQLLPTNPYSATKAGAEMLVMAYGRSYGLPVITTRGNNVYGPNQFPEKLIPKFILLAMRGKPLPIHGDGSNVRSYLYCEDVAEAFEVILHKGEVGHVYNIGTKKERRVIDVAKDMCKLFNMDPDSSIKFVENRPFNDQRYFLDDEKLKSLGWSERTTWEEGLKKTIEWYTSNPNWWGDVSGALLPHPRMLMMPGGVDRHVDGHENAELDSAGVAINTSQIGVQIPSSKTSGVSAKKPALKFLIYGKTGWIGGLLGKLCDKQQIPYEYGRGRLEDRSQLLADIQTIKPTHVFNAAGVTGRPNVDWCESHKTETIRTNVSGTLNLADVCREHGLLMINFATGCIFEYDANHPEGSGIGFKEEDKPNFIGSFYSKTKAMVEELLKEYDNVCTLRVRMPISSDLNNPRNFITKIARYDKVVNIPNSMTILDELLPISIEMAKRNLRGIWNFTNPGVVSHNEILEMYKKYINPEFKWVNFTLEEQAKVIVAPRSNNELDASKLKKEFPELLSIKESLIKYVFEPNKKQ

SEQ ID NO: 24130 - protein, 662 aa, Centaurea maculosa
TGAAGFIASHVANRLIRSYPDYKIVVLDKLDYCSNLKNLNPSRSSPNFKFVKGDIGSADLVNYLLITESIDTIMHFAAQTHVDNSFGNSFEFTKNNIYGTHVLLEACKVTGQIRRFIHVSTDEVYGETEEDAVVGNHEASQLLPTNPYSATKAGAEMLVMAYGRSYGLPVITTRGNNVYGPNQFPEKLIPKFILLAMRGKPLPIHGDGSNVRSYLYCEDVAEAFEVILHKGEVGHVYNIGTKRERRVIDVAKDMCKLFNMDPDASIKFVENRPFNDQRYFLDDEKLKSLGWSERTRWEDGLKKTIEWYTSNPNWWGDVSGALLPHPRMLMMPGGVDRLVDGPDNSEFDSDNVAHSGSQIGIVVPTSKSSGNAAKKPSMKFLIYGRTGWIGGLLGKLCEKQQIPYEYGRGRLEDRSQLLADIQAIKPTHVFNAAGVTGRPNVDWCESHKTETIRTNVSGTLNLADVCRDHGLLMINFATGCIFEYDAKHPEGSGIGFKEEDKPNFTGSFYSKTKAMVEELLKEYENVCTLRVRMPISSDLNNPRNFITKIARYDKVVNIPNSMTILDELLPISIEMAKRKLTGIWNFTNPGVVSHNEILEMYKKYINPEFKWVNFTLEEQAQVIVAPRSNNELDASKLKKEFPELMSIKESLIKNVFEPNKKI

SEQ ID NO: 24131 - protein, 667 aa, Gossypium raimondii
MASYKPKNILITGAAGFIASHVANRLVRNYPEYKIVVLDKLDYCSNTKNLLPSKLSPSFKFVKGDIESADLVNYLLITESIDTIMHFAAQTHVDNSFGNSFEFTKNNIYGTHVLLEACKVTGQIRRFIHVSTDEVYGETDEDAVVGNHEASQLLPTNPYSATKAGAEMLVMAYGRSYGLPVITTRGNNVYGPNQFPEKLIPKFILLAMRGKTLPIHGDGSNVRSYLYCEDVAEAFEVILHKGEVGRVYNIGTKKERRVIDVARDICKLFSMDPETSIEFVENRPFNDQRYFLDDQRLKNLGWSERTVWEDGLKKTIEWYTQNPDWWGDVTGALLPHPRMLMMAGSTHFDSEDSKETSYVSGPNQTRMVVPTPKGGSSPQKQSLKFLIYGRTGWIGGLLGQLCEKQGIAFEYGKGRLEDRSSLNADIQNITPTHVFNAAGVTGRPNVDWCESHKTETIRANVAGTLTLADVCRDHGLLMMNFATGCIFEYDTAHPQGSGIGFKEEDKPNFIGSFYSKTKAVVEELLKEYDNVCTLRVRMPISSDLNNPRNFITKISRYNKVVNIPNSMTVLDELLPISIEMAKKNLRGIWNFTNPGVVSHNEILEMYKTYIDPKFKWENFTLEEQAKVIVAPRSNNEMDASKLKKEFPELLSIKESLIKYAFEPNRRT

SEQ ID NO: 24132 - protein, 672 aa, Silene vulgaris
MTTHTPKNILITGAAGFIASHVANRLVRSYPDYKIVVLDKLDYCSNLKNLRPSQSSPNFKFVKGDIASADLVNYLLITESIDTIMHFAAQTHVDNSFGNSFEFTKNNIYGTHVLLEACKVTGQIKRFIHVSTDEVYGETDEDAVVGNHEASQLLPTNPYSATKAGAEMLVMAYGRSYGLPVITTRGNNVYGPNQFPEKLIPKFILLAMRGKPLPIHGDGSNVRSYLYCEDVAEAFEVILHKGVVGHVYNIGTKRERRVLDVAQDVCKLFSMDSEKVIKFVENRPFNDQRYFLDDEKLKELGWSERTPWEEGLKKTMEWYISNPEWWGDVSGALLPHPRMLMMPGGIERHFEEADKDNSGELSSIQSKTVVPVAKSNASQKESSYKFLIYGRTGWIGGLLGQMCDKQGIAYEYGKGRLQDRASLIADIQNIKPTHVFNAAGVTGRPNVDWCESHKTETIRTNVVGTLTLADVCKEHGLLMMNYATGCIFEYDATHPLGSGIGFKEEDTPNFMGSYYSKTKAMVEELLKEFDNVCTLRVRMPISGDLSNPRNFVTKISRYNKVVNIPNSMTILDELLPISIEMAKRNLRGIWNFTNPGVVSHNEVLEMYKNYIDPSYTYANFTLEEQAKVIVAARSNNEMDASKLKGEFPELLSIKDSLIKYVFEPNKKTNYSA

SEQ ID NO: 24133 - protein, 669 aa, Phaseolus vulgaris
MATHTPKNILITGAAGFIASHVANRLIRNYPQYKIVVLDKLDYCSNLKNLIPSKSSPNFKFVKGDIGSADLVNYLLITESIDTIMHFAAQTHVDNSFGNSFEFTKNNIYGTHVLLEACKVTGQIKRFIHVSTDEVYGETDEDAIVGNHEASQLLPTNPYSATKAGAEMLVMAYGRSYGLPVITTRGNNVYGPNQFPEKLIPKFILLAMQGKPLPIHGDGSNVRSYLYCEDVAEAFELILHKGEVGHVYNIGTKKERRVIDVAKDICRLFKMDSEASIKFVENRPFNDQRYFLDDEKLKVLGWSERTTWDEGLKKTMDWYINNPGWWGDVSGALLPHPRMLMMPGGLERHFDGSEEEIHASYVSTNTRMVVPTSKNVTSSQKHPLKFLLYGRTGWIGGLLGKLCEKQEIPYEYGRGRLEDRSSLVADIQNVKPTHIFNAAGVTGRPNVDWCESHKTETIRTNVAGTLTLADVCREHGILMINYATGCIFEYDEAHPQGSGIGFKEEDKPNFIGSFYSKTKAMVEELLREYDNVCTLRVRMPISSDLSNPRNFITKISRYNKVVNIPNSMTILDELLPISIEMAKRNLRGIWNFTNPGAVSHNEILEMYRDYIDPSFKWVNFNLEEQAKVIVAPRSNNEMDGAKLKKEFPELLSIKDSLIKYVFEPNKKTA

SEQ ID NO: 24134 - protein, 662 aa, Brassica oleracea
MATYKPKNILITGAAGFIASHVANRLVRTYPHYKIVVLDKLDYCSNLKNLNPSKSSPNFKFVKGDIASDDLVSYLLITENIDTIMHFAAQTHVDNSFGNSFEFTKNNIYGTHVLLEACKVTGQIRRFIHVSTDEVYGETDEDASVGNHEASQLLPTNPYSATKAGAEMLVMAYGRSYGLPVITTRGNNVYGPNQFPEKLIPKFMLLAMNGKPLPIHGDGSNVRSYLYCEDVAEAFEVVLHKGEVNHVYNIGTTRERRVIDVANDISKLFGTDPDSTIQFVENRPFNDQRYFLDDQKLKKLGWSERTTWEEGLRKTMEWYTENPDWWGDVTGALLPHPRMLMMPGDRLCDNCDDDHKDVADGNQTFTVVTPSGDNKTPFKFLIYGKTGWLGGLLGKLCEKQGIPYEYGKGRLEDRASVMADIRSVKPTHVFNAAGVTGRPNVDWCESHKTETIRANVAGTLTLADVCRENGLLMMNFATGCIFEYDAAHPEGSGIGFKEEDKPNFTGSFYSKTKAMVEELLREYDNVCTLRVRMPISSDLNNPRNFITKISRYNKVVNIPNSMTILDELLPISIEMAKRNLRGVWNFTNPGVVSHNEILEMYKSYIEPSFKWSNFTLEEQAKVIVAPRSNNEMDGAKLSKEFPEMLPIKESLIKYVFEPNKRT

SEQ ID NO: 24135 - protein, 669 aa, Vigna unguiculata
MATHTPKNILITGAAGFIASHVANLLIRSYPQYKIVVLDKLDYCSNLKNLIPSKSSPNFKFVKGDIGSADLVNYLLITESIDTIMHFAAQTHVDNSFGNSFEFTKNNIYGTHVLLEACKVTGQIKRFIHVSTDEVYGETDEDAVVGNHEASQLLPTNPYSATKAGAEMLVMAYGRSYGLPVITTRGNNVYGPNQFPEKLIPKFILLAMQGKPLPIHGDGSNVRSYLYCEDVAEAFELILQKGEVGHVYNIGTKKERRVIDVAKDICRLFKMDSETSIKFVENRPFNDQRYFLDDEKLKVLGWSERTTWEEGLKKTMDWYINNPNWWGDVSGALLPHPRMLMMPGGLERHLDGTDEEKPASYVSTNTHMVVPSSKNVSSSQKPPLKFLIYGRTGWIGGLLGKLCEKQGISYEYGRGRLEDRTSLVADIQNVKPTHIFNAAGVTGRPNVDWCESHKTETIRTNVAGTLTLADVSKEHGILMINYATGCIFEYDEAHPEGSGIGFKEEDKPNFMGSFYSKTKAMVEELLKEYDNVCTLRVRMPISSDLSNPRNFITKISRYNKVVNIPNSMTVLDELLPISIEMAKRNLRGIWNFTNPGAVSHNEILEMYRDYIDPSFKWANFNLEEQAKVIVAQRSNNEMDGTKLKTEFPELLSIKESLMKYVFEPNKKTA

SEQ ID NO: 24136 - protein, 667 aa, Brachypodium distachyon
MATPYTPKSILITGAAGFIASHVTNRIVRNYPDYKIVVLDKLDYCSNLKNLLPASSSPNFKFVKGDIASADLVNFLLVTENIDTIMHFAAQTHVDNSFGNSFEFTKNNIYGTHVLLEACKVTGQIRRFIHVSTDEVYGETDEDAVVGNHEASQLLPTNPYSATKAGAEMLVMAYGRSYGLPVITTRGNNVYGPNQFPEKLIPKFILLAMRGKPLPIHGDGSNVRSYLYCEDVAEAFEVILHRGEVGHVYNIGTKRERTVTDVAKDVCKLFNLEADKVIQYVDNRPFNDQRYFLDDAKLKSLGWSERTRWEEGLRKTMEWYVANSDYWGDVSGALLPHPRTLMMPGCEGSEEIKGMLNLFTNNQTKMKTTTSNGSSQTHSLKFLIYGRTGWIGGLLGKICEKQGIPHEYGKGRLEERSSLILDIQTVKPTHVFNAAGVTGRPNVDWCESHKPDTIRTNVAGTLTLADVCREHGLLVMNYATGCIFEYDANHPEGSGIGFKEEDKPNFTGSFYSKTKAMVEELLKEYDNVCTLRVRMPISSDLNNPRNFITKISRYNKVVNIPNSMTVLDELLPISVEMAKRNLRGIWNFTNPGVVSHNEILEMYKKYLDPSYKWTNFTLEEQAKVIVAPRSNNEMDATKLKKEFPELLSIKDSLVKYVFEPNRKVPAN

SEQ ID NO: 24137 - protein, 667 aa, Secale cereale
MSTPYTPKSILITGAAGFIASHVTNRIVRNYPDYKIVVLDKLDYCSNLKNLLPASSSPNFKFVKGDIASADLVNFLLVTENIDTIMHFAAQTHVDNSFGNSFEFTKNNIYGTHVLLEACKVTGQIRRFIHVSTDEVYGETDEDAVVGNHEASQLLPTNPYSATKAGAEMLVMAYGRSYGLPVITTRGNNVYGPNQFPEKLIPKFILLAMRGKPLPIHGDGSNVRSYLYCEDVAEAFEVILHRGEVGHVYNIGTKRERTVTDVAKDVCRLFNLEADKVIQLVDNRPFNDQRYFLDDEKLKSLGWSERTRWEEGLRKTMEWYVANSDYWGDVSGALLPHPRTLMMPGYEGSEEIKGMLNLFTNSHTKMVAPTSEGSSQTRSLKFLIYGRTGWIGGLLGKICEKQGIPYEYGKGRLEERFSIVLDIQTVKPTHVFNAAGVTGRPNVDWCESHKPDTIRTNVVGTLTLADVCREHGLLVINYATGCIFEYDANHPEGSGIGFKEEDKPNFTGSFYSKTKAMVEELLKEYENVCTLRVRMPISSDLNNPRNFITKISRYDKVVNIPNSMTVLDELLPISVEMAKRNLRGIWNFTNPGVVSHNEILEMYKKYMDPSYKWTNFTLEEQAKVIVAPRSNNEMDAAKLKREFPELLSIKDSLIKYVFEPNRKVPAT

SEQ ID NO: 24138 - protein, 667 aa, Triticum aestivum
MATPYTPKSILITGAAGFIASHVTNRIVRNYPDYKIVVLDKLDYCSNLKNLLPASSSPNFKFVKGDIASADLVNFLLVTENIDTIMHFAAQTHVDNSFGNSFEFTKNNIYGTHVLLEACKVTGQIRRFIHVSTDEVYGETDEDAVVGNHEASQLLPTNPYSATKAGAEMLVMAYGRSYGLPVITTRGNNVYGPNQFPEKLIPKFILLAMRGKPLPIHGDGSNVRSYLYCEDVAEAFEVILHRGEVGHVYNIGTKRERTVTDVAKDVCRLFNLEADKVIQLVDNRPFNDQRYFLDDEKLKSLGWSERTRWEEGLRKTMEWYVANSDYWGDVSGALLPHPRTLMMPGYEGSEEIKGMLNLFTNNQTKMVAPTSEGSSQTRLLKFLIYGRTGWIGGLLGKICEKQGIPYEYGKGRLEERFSIVLDIQTVKPTHVFNAAGVTGRPNVDWCESHKPDTIRTNVVGTLTLADVCREHGLLVINYATGCIFEYDANHPEGSGIGFKEEDKPNFTGSFYSKTKAMVEELLNEYENVCTLRVRMPISSDLNNPRNFITKISRYDKVVNIPNSMTVLDELLPISVEMAKRNLRGIWNFTNPGVVSHNEILEMYKKYMDPSYKWTNFTLEEQAKVIVAPRSNNEMDATKLKREFPELLSIKDSLIKYVFEPNRKVPAT

SEQ ID NO: 24139 - protein, 679 aa, Quercus alba
MATTYEPKNILITGAAGFIASHVCNRLIRNHPNYNIVVLDKLDYCSNLKNLLPSKSSPNFKFVKGDIGSADLVNFILLSESIDTIMHFAAQTHVDNSFGNSFEFTKNNIYGTHVLLEACKVTGQIKRFIHVSTDEVYGETDEDAVVGNHEASQLLPTNPYSATKAGAEMLVMAYGRSYGLPVITTRGNNVYGPNQFPEKMIPKFILLAMKGQPLPIHGDGSNVRSYLYCEDVAEAFEVILHRGEVGHVYNIGTLKERRVIDVAKEICQLFSLNPDTYIKLVENRPFNDQRYFLDDQKLKSLGWFERTSWEEGLKKTMEWYVNNPDWWGDVSGALLPHPRMLMVPGIERKFDGPDISNSDSTFVVNNSNQSHMIVPTPKNNPSIQKPALKFLIYGRTGWIGGLLGKICEKQGIPFEYGRGRLQERSQILADIQTVKPTHVFNAAGVTGRPNVDWCETHKPETIRTNVVGTLTLADVCREHNLLMMNYATGCIFEFDAAHPLGSGIGFKEEDKPNFTGSFYSKTKAMVEELLRDYDNVCTLRVRMPISSDLSNPRNFITKITRYNKVVDIPNSMTILDELLPISVEMAKRNCRGIWNFTNPGVVSHNEILEMYKNYIDSNFKWVNFTLEEQAKVIVAPRSNNELDASKLKKEFPELLPIKDSLIKYVFEPNKKTSAGGVSK

SEQ ID NO: 24140 - protein, 670 aa, Populus trichocarpa
MATYTPKNILITGAAGFIASHVCNRLIRNYPDYKIVVLDKLDYCSNLKNLLPSKSSPNFKFVKGDIGSADLVNFLLITESIDTIMHFAAQTHVDNSFGNSFEFTKNNIYGTHVLLEACKVTGQIRRFIHVSTDEVYGETDEDAVVGNHEASQLLPTNPYSATKAGAEMLVMAYGRSYGLPVITTRGNNVYGPNQFPEKLIPKFILLAMQGKDLPIHGDGSNVRSYLYCEDVAEAFEVILHKGEVGHVYNVGTKKERRVIDVAKDICNLFSMDPDKSIKFVENRPFNDQRYFLDDQKLKILGWSEHTTWEEGLRKTIEWYTQNPDWWGDVTGALLPHPRMLMMPGGRHFDGSEENRDASYVSNNSNQARMVIPVTKVGTGSPRKPSLKFLIYGRTGWIGGLLGKLCEKQGISFEYGKGRLEDRSSLLSDIQNIRPTHVFNAAGVTGRPNVDWCESHKTETIRTNVAGTLTLADVCREHNLLMVNFATGCIFEYDAGHPEGSGIGFTEEDKPNFIGSFYSKTKAMVEELLREYDNVCTLRVRMPISSDLSNPRNFITKISRYNKVVNIPNSMTILEELLPISIEMAKRNLRGIWNFTNPGVVSHNEILDMYKNYIDPNFTWVNFNLEEQAKVIVAPRSNNELDASKLKNEFPELLPIKESLIKYVFEPNKRT

SEQ ID NO: 24141 - protein, 664 aa, Arabidopsis thaliana
MATYKPKNILITGAAGFIASHVANRLVRSYPDYKIVVLDKLDYCSNLKNLNPSKSSPNFKFVKGDIASADLVNYLLITEEIDTIMHFAAQTHVDNSFGNSFEFTKNNIYGTHVLLEACKVTGQIRRFIHVSTDEVYGETDEDASVGNHEASQLLPTNPYSATKAGAEMLVMAYGRSYGLPVITTRGNNVYGPNQFPEKLIPKFILLAMNGKPLPIHGDGSNVRSYLYCEDVAEAFEVVLHKGEVNHVYNIGTTRERRVIDVANDISKLFGIDPDSTIQYVENRPFNDQRYFLDDQKLKKLGWCERTNWEEGLRKTMEWYTENPEWWGDVSGALLPHPRMLMMPGDRHSDGSDEHKNADGNQTFTVVTPTKAGCSGDKRSLKFLIYGKTGWLGGLLGKLCEKQGIPYEYGKGRLEDRASLIADIRSIKPSHVFNAAGLTGRPNVDWCESHKTETIRVNVAGTLTLADVCRENDLLMMNFATGCIFEYDAAHPEGSGIGFKEEDKPNFTGSFYSKTKAMVEELLREFDNVCTLRVRMPISSDLNNPRNFITKISRYNKVVNIPNSMTILDELLPISIEMAKRNLRGIWNFTNPGVVSHNEILEMYKSYIEPDFKWSNFNLEEQAKVIVAPRSNNEMDGAKLSKEFPEMLSIKDSLIKYVFEPNKRT

SEQ ID NO: 24142 - protein, 675 aa, Triphysaria pusilla
MSTFTPKNILITGAAGFIASHVANRLIRNYPDYKIVVLDKLDYCSSLKNLFPSKSSPNFKFVKGDIASADLVNYLLITENIDTIMHFAAQTHVDNSFGNSFEFTKNNIYGTHVLLEACKVTGQIRRFIHVSTDEVYGETEEDAVVGNHEASQLLPTNPYSATKAGAEMLVMAYGRSYGLPVITTRGNNVYGPNQFPEKLIPKFVLLAMRGQTLPIHGDGSNVRSYLYCEDVAEAFECVLHKGEVGHVYNIGTKKERRVIDVAKDICRLFNMDSDKDIKFVDNRPFNDQRYFLDDQKLKNLGWSEKTTWEDGLRKTIDWYKSNPEWWGDVSGALLPHPKMLMMPGGIERNFDGAEKYESGKSEFDGKSDQTNKTVVPVSKNSPSVEKPGLKFLIYGKTGWIGGLLGKLCEKQGIAYEYGKGRLENRSQIVADILAVKPTHVFNAAGVTGRPNVDWCETHKTETIRANVAGTLTLADVCREKDLLMINYATGCIFEYDATHLEGSGVGFKEEDKPNFLGSFYSKTKAMVEELLREYDNVCTLRVRMPISSDLSNPRNFITKISKYNKVVNIPNSMTVLDELLPISIEMAKRNLRGIWNFTNPGVVSHNEILEMYKKYIDPEFKYSNFTLEEQAKVIVAQRSNNEMDASKLKNEFPELMSIKEALIKIVFEPNRKTLA

SEQ ID NO: 24143 - protein, 671 aa, Euphorbia peplus
MASYSPKNILITGAAGFIASHVCNRLIRNYPDYKIVVLDKLDYCSNLKNLLPSKSSPNFKFVKGDIGSADLVNFLLITESIDTIMHFAAQTHVDNSFGNSFEFTKNNIYGTHVLLEACKVTGQIRRFIHVSTDEVYGETDEDAVVGNHEASQLLPTNPYSATKAGAEMLVMAYGRSYGLPVITTRGNNVYGPNQFPEKLIPKFMLLAMEGKPLPIHGDGSNVRSYLYCEDVAEAFEVILHKGEVGHVYNIGTKRERRVIDVAQDICNILSRNPETSIKFVENRPFNDQRYFLDDEKLKILGWAEHTTWEEGLRKTMEWYKQNPDWWGDVTGALLPHPRMLMMPGGRHFDGSEESKSASYVSNTSTQSKMVIPIPRSTSSGSPRKPSLKFLIYGRTGWIGGLLGKLCEKQGIAYEYGRGRLEDRSSLLADIQNVKPTHVFNAAGVTGRPNVDWCESHKAETIRANVAGTLTLADVCRENNLLMMNFATGCIFEYDAAHPEGSGIGYKEEDKPNFTGSFYSKTKAMVEELLKEYDNVCTLRVRMPISSDLNNPRNFITKISRYDKVVNIPNSMSVLDELLPISIEMAKRNLRGIWNFTNPGVVSHNEILEMYKKYINPEFKWANFTLDEQAKVIVAPRSNNEMDASKLKKEFPELLSIKESLIKYVYEPNKRT

SEQ ID NO: 24144 - protein, 676 aa, Phalaenopsis aphrodite
MESYKPKSILITGAAGFIASHVANRLIRNYPNYKIVVLDKLDYCSNLKNLSPSGSSTNLKFVKGDIASADLLHYLLITEYIDTIMHFAAQTHVDNSFGNSFEFTKNNIYGTHVLLEACKVSGQIRRFIHVSTDEVYGETDENAIVGNHEASQLLPTNPYSATKAGAEMLVMAYGRSYGLPVITTRGNNVYGPNQFPEKLIPKFILLAMRGQTLPIHGDGSNVRSYLYCEDVAEAFEVILHRGEIGHVYNIGTKKERRVIDVAKDICKLFARDPTTAIKYVDNRPFNDQRYFLDDQKLKILGWSERTTWQEGLKKTMDWYTNNPDWWGDVSGALLPHPRMLMMPGTERHYDGPEVIIKSMLSSPNNINISSQMITPPVSETSSFGTKMQSLKFLIYGKTGWIGGLLGKICEKQGIPFEYGKGRLECRSQLQSDIHNVKPTHVFNAAGVTGRPNVDWCESHRQETIRTNVIGTLTLADVCSENGLLLMNYATGCIFEYDANHPEGSGYGFKEEDSPNFIGSYYSKTKAMVEELLKEYDNVCTLRVRMPISSDLNNPRNFITKISRYNKVVNIPNSMTVLDELLPISIEMAKRNCRGIWNFTNPGVVSHNEILELYKAYIDPGFSWVNFTLEEQAKVIVAPRSNNELDALKLKSEFPELLSITESLIKYVFEPNRKQGK

SEQ ID NO: 24145 - protein, 666 aa, Zea mays
MARPYKPKNILITGAAGFIASHVAIRITKKYPDYKIIVLDKLDYCSNLKNLLPVSSSPNFKFVKGDIASVDLVNFLLVTENIDTIMHFAAQTHVDNSFGNSFEFTKNNIYGTHVLLEACRISGQIKRFIHVSTDEVYGETDEDAVVGNHEASQLLPTNPYAATKAGAEMLVMAYGRSYGLPVITTRGNNVYGPNQFPEKLIPKFILLAMRGEPLPIHGDGVNVRSYLYCEDVAEAFEVILHHGEVGHVYNIGTKRERTVLDVAKDVCRLFNLEPDKVIMFVENRPFNDQRYFLDDEKLKSLGWAERTPWEEGLKKTMEWYVANSDYWGDVSGALLPHPRTLMMPGCEGSEEIKGILSRFNNIQTKVGSTSDNAPEPHAFKFLIYGRTGWIGGLLGKICEKKGIPYEYGNGRLQERSSLVLDIQTIKPTHVFNAAGVTGRPNVDWCESHKPDTIRTNVVGTLNLADVCRKHGLLMMNYATGCIFEYDAHHPEGSGIGFKEEDTPNFTGSFYSKTKAMVEELLKEYENVCTLRVRMPISSDLSNPRNFVTKISRYNKVVNIPNSMTILDELLPISVEMAKRNLRGIYNFTNPGVVSHNEILEMYKQYIDPSFKWTNFTLEEQAKVIVAPRSNNEMDATKLKNEFPELLSIKDSLIKYVFEPNRKVPTD

SEQ ID NO: 24146 - protein, 675 aa, Triphysaria pusilla
MSTFTPKNILITGAAGFIASHVANRLIRNYPDYKIVVLDKLDYCSSLKNLFPSKSSPNFKFVKGDIASADLVNYLLITENIDTIMHFAAQTHVDNSFGNSFEFTKNNIYGTHVLLEACKVTGQIRRFIHVSTDEVYGETEEDAVVGNHEASQLLPTNPYSATKAGAEMLVMAYGRSYGLPVITTRGNNVYGPNQFPEKLIPKFVLLAMRGQTLPIHGDGSNVRSYLYCEDVAEAFECVLHKGEVGHVYNIGTKKERRVIDVAKDICRLFNMDSDKDIKFVDNRPFNDQRYFLDDQKLKNLGWSEKTTWEDGLRKTIDWYKSNPEWWGDVSGALLPHPKMLMMPGGIERNFDGAEKYESGKSEFDGKSDQTNKTVVPVSKNSPSVEKPGLKFLIYGKTGWIGGLLGKLCEKQGIAYEYGKGRLENRSQIVADILAVKPTHVFNAAGVTGRPNVDWCESHKTETIRANVAGTLTLADVCREKDLLMINYATGCIFEYDATHLEGSGVGFKEEDKPNFLGSFYSKTKAMVEELLREYDNVCTLRVRMPISSDLSNPRNFITKISKYNKVVNIPNSMTVLDELLPISIEMAKRNLRGIWNFTNPGVVSHNEILEMYKKYIDPEFKYSNFTLEEQAKVIVAQRSNNEMDASKLKNEFPELMSIKEALIKIVFEPNRKTLA

SEQ ID NO: 24147 - protein, 664 aa, Arabidopsis lyrata
MATYKPKNILITGAAGFIASHVANRLVRSYPEYKIVVLDKLDYCSNLKNLNPSKSSPNFKFVKGDIASADLVNYLLITEEIDTIMHFAAQTHVDNSFGNSFEFTKNNIYGTHVLLEACKVTGQIRRFIHVSTDEVYGETDEDASVGNHEASQLLPTNPYSATKAGAEMLVMAYGRSYGLPVITTRGNNVYGPNQFPEKLIPKFILLAMNGKPLPIHGDGSNVRSYLYCEDVAEAFEVVLHKGEVNHVYNIGTTRERRVIDVANDISKLFGIDPDSTIQFVENRPFNDQRYFLDDQKLKKLGWCERTNWEEGVRKTMEWYTENPEWWGDVSGALLPHPRMLMIPGDRHSDGSDEHKDSDGNQTFTVVTPTKAGASGDKRSLKFLIYGKTGWLGGLLGKLCEKQGISYEYGKGRLEDRASLMADIRSIKPSHVFNAAGLTGRPNVDWCESHKCETIRVNVAGTLTLADVCRENDLLMMNFATGCIFEYDAAHPEGSGIGFKEEDKPNFTGSFYSKTKAMVEELLREFDNVCTLRVRMPISSDLNNPRNFITKISRYNKVVNIPNSMTILDELLPISIEMAKRNLRGIWNFTNPGVVSHNEILEMYKSYIEPDFKWSNFNLEEQAKVIVAPRSNNEMDGSKLSKEFPEMLSIKDSLIKYVFEPNKRT

SEQ ID NO: 24148 - protein, 669 aa, Eutrema parvulum
MASYTPKNILITGAAGFIASHVANRLIRTYPDYKIVVLDKLDYCSNLKNLNPSKQSPNFKFVKGDIASADLVNYLLITEGIDTIMHFAAQTHVDNSFGNSFEFTKNNIYGTHVLLEACKVTGQIRRFIHVSTDEVYGETDEDAVVGNHEASQLLPTNPYSATKAGAEMLVMAYGRSYGLPVITTRGNNVYGPNQFPEKLIPKFILLAMRGKVLPIHGDGTNVRSYLYCEDVAEAFEVILHKGEVGHVYNIGTKKERRVNDVAQDVCKLFNKDPEANIKFVENRPFNDQRYFLDDEKLKILGWSERTTWEEGLKKTMEWYTQNPDWWGDVSGALLPHPRMLVMPGGRHSDGSEENSGAVSLSGNSRQSQMVVPTPRSSGSTQNPSLKFLIYGKTGWIGGLLGQICEKQGIAFEYGKGRLEDRSSLLQDILNVKPTHVFNAAGVTGRPNVDWCESHKTETIRANVAGTLTLADVCREHSLLLMNFATGCIFEYDENHPLGSGIGFKEEDTPNFTGSFYSKTKAMVEELLKEFDNVCTLRVRMPISSDLNNPRNFITKISRYSKVVNIPNSMTVLDELLPISIEMAKRNLKGIWNFTNPGVVSHNEVLEMYRDYIDSDFKWANFTLDEQAKVIVAPRSNNEMDASKLRKEFPELLSIKESLLKYAFEPNKRT

SEQ ID NO: 24149 - protein, 684 aa, Cycas rumphii
MASENAKPSPNTKYTPKNILITGAAGFIASHVANRLIRNYPQYKIVVLDKLDYCSNLKNLLPSKSSPNFKFVRGDIGSADLVNYLLITEGIDTIMHFAAQTHVDNSFGNSFEFTKNNIYGTHVLLEACKVTGQIRRFIHVSTDEVYGETEEDAVVGNHEASQLLPTNPYSATKAGAEMLVMAYGRSYGLPVITTRGNNVYGPNQFPEKLIPKFILLAMKGHPLPIHGDGSNVRSYLYCEDVAEAFEVVLHSGEVGHVYNIGTKKERRVIDVAKDICKLFSQDPERVIKFVENRPFNDQRYFLDDQKLKDLGWSERTTWEDGLKKPMEWYTSHPDWWGDVSGALLPHPRMLTMAGVERHSDGSEDNGLNVSPVANNSVQSRMVVPSRSSSQKPALKFLIYGRNGWIGGLLGQICEKQGISFEYGNGRLENRPQLQQDIQNVKPTHVFNAAGVTGRPNVDWCESHKPETIRTNVVGTLNLADICREQGLLLVNFATGCIFEYDCAHPEGSGVGFKEEDKPNFVGSFYSKTKAMVEELLNEYENVCTLRVRMPISSDLNNPRNFITKISRYNKVVNIPNSMTVLDELLPISVEMAKRNCRGIWNFTNPGVVSHNEILEMYREYIDPSFKWVNFNLEEQAKVIVAPRSNNELDASKLKREFPQLLSIKDSLLKYVFEPNKKSRLANGS

SEQ ID NO: 24150 - protein, 666 aa, Sorghum bicolor
MARPYKPKNILITGAAGFIASHVAIRVTKKYPDYKIVVLDKLDYCSNLKNLLPVSSSPNFKFVKGDIASADLVNFLLVTEKIDTIMHFAAQTHVDNSFGNSFEFTKNNIYGTHVLLEACRITGQIKRFIHVSTDEVYGETDEDAVVGNHEASQLLPTNPYAATKAGAEMLVMAYGRSYGLPVITSRGNNVFGPNQFPEKLIPKFILLAMRGEPLPIHGDGGNVRSYIYCEDVAEAFEVILHHGEVGHVYNIGTKRERTVIDVAKDVCKLFSLEAGKVIMFVENRPFNDQRYFLDDEKLKSLGWAERTPWEEGLKKTMEWYVANSDYWGDVSGALLPHPRTLMMPGYEGSEEIKGILSQFNNIQTKVTSTLDTALETHAFKFLVYGRTGWIGGLLGKICEKKGIPYEYGKGRLQERSSLNLDIQTIKPTHVFNAAGVTGRPNVDWCESHKPDTIRTNVVGTLNLADVCREHGLLMMNYATGCIFEYDADHPEGSGIGFKEEDTPNFTGSFYSKTKAMVEELLREYENVCTLRVRMPISSDLNNPRNFVTKISRYNKVVNIPNSMTMLDELLPISVEMAKRNLRGIYNFTNPGVVSHNEILEMYKQYIDPSFKWTNFTLEEQAKVIVAPRSNNEMDATKLKKEFPELLSIKDSLIKFVFEPNRKVPIN

SEQ ID NO: 24151 - protein, 681 aa, Amborella trichopoda
MAQSGQTSPGSVGYTPKNILITGAAGFIASHVANRLIRNYPNYKIVVLDKLDYCSNLKNLLPSRSSPNFKFVKGDIASADLVNFLLITEKIDTIMHFAAQTHVDNSFGNSFEFTKNNIYGTHVLLEACKVTGQVTRFIHVSTDEVYGETDEDAVVGNHEASQLLPTNPYSATKAGAEMLVMAYGRSYGLPVITTRGNNVYGPNQFPEKLIPKFILLAMKGKPLPIHGDGSNVRSYLYCEDVAEAFEVILHRGEVGHVYNIGTKKERRVIDVAKDICKLFSLNPNEVIKFVENRPFNDQRYFLDDQKLTNLGWSERTTWQEGLRKTMEWYTSHPDWWGDVSGALLPHPRMLMMPGIKTQFDGSEDTNGGASHVENSSGQSHMVVPPSKGSGSSTKPSLKFLIYGRTGWIGGLLGKICEKQGIAYDYGRGRLEERSQLLADIQNVKPTHVFNAAGVTGRPNVDWCESHKPETIRTNVVGTLNLADVCREQGLLMVNFATGCIFEYDVEHPEGSGIGFKEEDKPNFTGSFYSQTKAMVEELLSEYENVCTLRVRMPISSDLTNPRNFITKIANYNKVVNIPNSMTILDELLPISIEMAKKNCRGIWNYTNPGVVSHNEILEMYRDYIDPSFKWVNFNLEEQAKVIVAPRSNNELDASKLKKEFPELLSIKESLIKYVFEPNKRV

SEQ ID NO: 24152 - protein, 650 aa, Flaveria ramosissima
NRLIRNYPDYKIVVLDKLDYCSSLKNLNPSRSSPNFKFVKGDIGSADLVNYLLITESIDTIMHFAAQTHVDNSFGNSFEFTKNNIYGTHVLLEACKVTGQIRRFIHVSTDEVYGETEEDAVVGNHEASQLLPTNPYSATKAGAEMLVMAYGRSYGLPVITTRGNNVYGPNQFPEKLIPKFILLAMRGKPLPIHGDGSNVRSYLYCEDVAEAFEVILHKGEVGHVYNIGTKKERRVIDVAKDMCKLFNMDPDSSIKFVENRPFNDQRYFLDDEKLKSLGWSERTTWEEGLKKTIEWYTSNPNWWGDVSGALLPHPRMLMMPGGVDRHVDGPENAELDSAGVAINTSQVGVQIPSSKTSGVSAKKPALKFLIYGKTGWIGGLLGKLCDKQQIPYEYGRGRLEDRSQLLADIQTIKPTHVFNAAGVTGRPNVDWCESHKTETIRTNVSGTLNLADVCREHGLLMINFATGCIFEYDANHPEGSGIGFKEEDKPNFIGSFYSKTKAMVEELLKEYDNVCTLRVRMPISSDLNNPRNFITKIARYDKVVNIPNSMTILDELLPISIEMAKRNLRGIWNFTNPGVVSHNEILEMYKKYINPEFKWVNFTLEEQAKVIVAPRSNNELDASKLKKEFPELLSITDSLIKYVFEPNKKQ

SEQ ID NO: 24153 - protein, 673 aa, Zostera marina
MATYTPKNILITGAAGFIASHVANRLVRNHPEYKIVVLDKLDYCSNLKNLLPSRPSPNFTFVKGDIGSADLVSYLLITESIDTIMHFAAQTHVDNSFGNSFEFTKNNIYGTHVLLEACKTNGQIKRFIHVSTDEVYGETDEDAVVGNHETSQLLPTNPYSATKAGAEMLVMAYGSSYGLPVITTRGNNVYGPNQFPEKLIPKFILLAMSGKPLPIHGDGSNVRSYLYCEDVAEAFEVILHKGEIGQVYNIGTKKERRVIDVARDICKLFSLDTDSVIKYVENRPFNDQRYFLDDQKLAVLGWSEHTTWEEGLKKTLDWYTSHPDWWGDVSGALLPHPRMLMMAGTERQNDEPAEHAKETPYKETNHNNQNGHVVQSLQNTLGQKDQSLKFLIYGKTGWIGGLLGKICEKQGILYEYGRGRLQERSQLIEDVKRVKPSHVFNAAGVTGRPNVDWCESHKPETIRTNVVGTLNLADVCKDYGLLLVNYATGCIFEYDLEHPERSGIGFKEENTPNFIGSFYSKTKAMVEELLKEYDNVCTLRVRMPISSDLKNQRNFITKIVSYNKVVNIPNSMTILDELLPISVEMAKRNCRGIWNFTNPGVVSHNEILEMYKKYINPKFTWKNFTLDEQAKVIVAPRSNNELDASKLKKEFPELLSIKDALIKFVFEPNQTTC

SEQ ID NO: 24154 - protein, 668 aa, Festuca arundinacea
MATPYTPKSILITGAAGFIASHVTNRIVRNYPDYKIVVLDKLDYCSNLKNLLPASSSPNFKFVKGDIASADLVNYLLVTENIDTIMHFAAQTHVDNSFGNSFEFTKNNIYGTHVLLEACKVTGGQIRRFIHVSTDEVYGETDEDAVVGNHEASQLLPTNPYSATKAGAEMLVMAYGRSYGLPVITTRGNNVYGPNQFPEKLIPKFILLALRGKPLPIHGDGSNVRSYLYCEDVAEAFEVILHRGEVGHVYNIGTKRERTVTDVAKDVCNLFNLEADKVIQYVDNRPFNDQRYFLDDEKLKSLGWSERTRWEEGLRKTMEWYVANSDYWGDVSGALLPHPRTLMMPGSEGSEEVKGMLNLFTNNQTKMVTPVSKGSSKTHSLKFLIYGRTGWIGGLLGKICEKQGIPYEYGKGRLEERSSIVLDIQSVKPTHVFNAAGVTGRPNVDWCESHKPETIRTNVVGTLTLADVCREHGLLVMNYATGCIFEYDANHPEGSGIGFKEEDTPNFTGSFYSKTKAMVEELLKEYENVCTLRVRMPISSDLSNPRNFITKISRYDKVVNIPNSMTVLDELLPISVEMAKRNLRGIWNFTNPGVVSHNEILEMYKKYIDSSYKWSNFTLEEQAKVIVAPRSNNEMDGAKLRKEFPELLSIKDSLIKYVFEPNRKVPAN

SEQ ID NO: 24155 - protein, 668 aa, Avena sativa
MATPYTPKSILITGAAGFIASHVTNRIVRNYPDYKIVVLDKLDYCSNLKNLLPASSSPNFKFVKGDIASADLVNYLLVTENIDTIMHFAAQTHVDNSFGNSFEFTKNNIYGTHVLLEACKVTGGQIRRFIHVSTDEVYGETDEDAVVGNHEASQLLPTNPYSATKAGAEMLVMAYGRSYGLPVITTRGNNVYGPNQFPEKLIPKFILLALRGKPLPIHGDGSNVRSYLYCEDVAEAFEVILHRGEVGHVYNIGTKRERTVTDVAKDVCNLFNLEADKVIQYVDNRPFNDQRYFLDDEKLKGLGWSERTRWEEGLRKTMEWYVANSDYWGDVSGALLPHPRTLMMPGSEGSEEVKGMLNLFTNNQTKMVTPTSKGSSKTHSLKFLIYGRTGWIGGLLGKICEKQGIPYEYGKGRLEERSSIVLDIQSVKPTHVFNAAGVTGRPNVDWCESHKPETIRTNVAGTLTLADVCREHGLLVMNYATGCIFEYDANHPEGSGIGFKEEDTPNFTGSFYSKTKAMVEELLKEYENVCTLRVRMPISSDLNNPRNFITKISRYDKVVNIPNSMTVLDELLPISVEMAKRNLRGIWNFTNPGVVSHNEILEMYKKYMDPSYKWSNFTLEEQAKVIVAPRSNNEMDATKLSREFPELLSIKDSLIKYVFEPNRKVPAN

SEQ ID NO: 24156 - protein, 668 aa, Avena sativa
MATPYTPKSILITGAAGFIASHVTNRIVRNYPDYKIVVLDKLDYCSNLKNLLPASSSPNFKFVKGDIASADLVNYLLVTENIDTIMHFAAQTHVDNSFGNSFEFTKNNIYGTHVLLEACKVTGGQIRRFIHVSTDEVYGETDEDAVVGNHEASQLLPTNPYSATKAGAEMLVMAYGRSYGLPVITTRGNNVYGPNQFPEKLIPKFILLALRGKPLPIHGDGSNVRSYLYCEDVAEAFEVILHRGEVGHVYNIGTKRERTVTDVAKDVCNLFNLEADKVIQYVDNRPFNDQRYFLDDEKLKGLGWSERTRWEEGLRKTMEWYVANSDYWGDVSGALLPHPRTLMMPGSEGSEEVKGMLNLFTNNQTKMVTPTSKGSSKTHSLKFLIYGRTGWIGGLLGKICEKQGIPYEYGKGRLEERSSIVLDIQSVKPTHVFNAAGVTGRPNVDWCESHKPETIRTNVAGTLTLADVCREHGLLVMNYATGCIFEYDANHPEGSGIGFKEEDTPNFTGSFYSKTKAMVEELLKEYENVCTLRVRMPISSDLNNPRNFITKISRYDKVVNIPNSMTVLDELLPISVEMAKRNLRGIWNFTNPGVVSHNEILEMYKKYMDPSYKWSNFTLEEQAKVIVAPRSNNEMDATKLSREFPELLSIKDSLIKYVFEPNRKVPSN

SEQ ID NO: 24157 - protein, 654 aa, Vinca minor
MATHTPKNILITGAAGFIASHVANRLIRNYPEYKIVVLDKLDYCSNLKNLLPSTSSPNFKFVKGDIASADLVNYLLITESIDTIMHFAAQTHVDNSFGNSFEFTKNNIYGTHVLLEACKVTGQIKRFIHVSTDEVYGETDEDAVVGNHEASQLLPTNPYSATKAGAEMLVMAYGRSYGLPVITTRGNNVYGPNQFPEKLIPKFILLAMRGKTLPIHGDGSNVRSYLYCEDVAEAFEVILHRGEVGHVYNIGTKRERGVIDVAKDICKLFNMDPKTSIEFVENRPFNDQRYFLDDEKLKKLGWSERTIWEEGLKKTMEWYTKNPDWWGDVSGALLPHPRMLMMPGGTEKLLDGSDKYDSGSSEFSAKSKQNYLVVTPAKSSPKPSLKFLIYGRTGWIGGLLGKLCEKQGIPYEYGRGRLEDRSQLLVDIQIVKPTHVFNAAGVTGRPNVDWCESHKTETIRTNVAGTLTLADICREHGLLMMNFATGCIFEYDAAHPEGSGIGYKEEDTPNFTGSFYSKTKAMVEELLKEYGNVCTLRVRMPISSDLSNPRNFITKISRYNKVVNIPNSMTVLDELLPISIEMAKRNLGGIWNFTNPGVVSHNEILEMYKKYIDPKFKWANFTLEEQAKVIVAPRSNNEMDASKLKKEFPELLSI

SEQ ID NO: 24158 - protein, 672 aa, Brassica rapa
MASSYTPKNILITGAAGFIASHVANRLIRTYPDYKIVVLDKLDYCSNLKNLNPSKHSPNFKFVKGDIASADLVNYLLITERIDTIMHFAAQTHVDNSFGNSFEFTKNNIYGTHVLLEACKVTGQIRRFIHVSTDEVYGETDEDAVVGNHEASQLLPTNPYSATKAGAEMLVMAYGRSYGLPVITTRGNNVYGPNQFPEKLIPKFMLLAMRGKVLPIHGDGSNVRSYLYCEDVAEAFEVILHKGEVGHVYNIGTKKERRVNDVAQDICKLFNMDPEANIKFVENRPFNDQRYFLDDEKLKILGWSERTTWEEGLKKTMEWYTQNPDWWGDVSGALLPHPRMLVMPGGRHFDGSEENSGAVALSGNSSQSQSQMMVPTPRSSGSTQNPSLKFLIYGKTGWIGGLLGQICEKQGIAFEYGKGRLEDRSSLLQDILTVKPTHVFNAAGVTGRPNVDWCESHKTETIRANVAGTLTLADVCREHSLLLMNFATGCIFEYDENHPLGSGIGFKEEDTPNFTGSFYSKTKAMVEELLKEFDNVCTLRVRMPISSDLNNPRNFITKISRYSKVVNIPNSMTVLDELLPISIEMAKRNLKGIWNFTNPGVVSHNEVLEMYRDYVDSDFKWANFTLEEQAKVIVAPRSNNELDASKLKKEFPELLSIKESLIKYAFEPNKRT

SEQ ID NO: 24159 - protein, 681 aa, Theobroma cacao
MATRYTPKNILITGAAGFIASHVCNRLIRNYPDYKIVVLDKLDYCSSLKNLNPARLSPNFKFIKGDIASADLVQFILLTESIDTIMHFAAQTHVDNSFGNSFEFTKNNIYGTHVLLEACKVTGQVKRFIHVSTDEVYGETDEDAVVGNHEASQLLPTNPYSATKAGAEMLVMAYGRSYGLPVITTRGNNVYGPNQFPEKLIPKFILLAMNGKPLPIHGDGSNVRSYLYCEDVAEAFEVILHKGEVGHVYNIGTKKERRVIDVAKDICRLFSLDPDAQIKFVDNRPFNDQRYFLDDQKLKSLGWYEKTTWEEGLKKTMEWYVRNPDWWGDVSGALLPHPRMLMVPGIERQFNAPDTSNNDSAPVTNNFSQSRMLVPAPKNNLPAQKPSLKFLIYGRTGWIGGLLGKICEKQGIPFEYGKGRLEQRSQLLADIQTVKPTHVFNAAGVTGRPNVDWCETHKPETIRTNVVGTLTLADICREHDLLMVNYATGCIFEYDATHPLGSGIGFKEEDKPNFTGSFYSKTKAMVEELLREYDNVCTLRVRMPISSDLSNPRNFITKIARYSKVVDIPNSMTILDELLPISIEMAKRNLRGIWNFTNPGVVSHNEILQMYKDYIDPNFNWVNFTLEEQARVIVAPRSNNELDASKLKEEFPEILSIKDSLIKYVFEPNSNRKTFTGGLPK

SEQ ID NO: 24160 - protein, 668 aa, Arabidopsis lyrata
MDDTTTYKPKNILITGAAGFIASHVANRLIRSYPDYKIVVLDKLDYCSDLKNLDPSFSSPNFKFVKGDIASDDLVNYLLITENIDTIMHFAAQTHVDNSFGNSFEFTKNNIYGTHVLLEACKVTGQIRRFIHVSTDEVYGETDEDAAVGNHEASQLLPTNPYSATKAGAEMLVMAYGRSYGLPVITTRGNNVYGPNQFPEKMIPKFILLAMSGKPLPIHGDGSNVRSYLYCEDVAEAFEVVLHKGEIGHVYNIGTKRERRVIDVARDICKLFGKDPESSIQFVENRPFNDQRYFLDDQKLKKLGWQERTTWEDGLKKTMDWYTQNPEWWGDVSGALLPHPRMLMMPGGRLSDGSSEKKDASSNTVQTFTVVTPKGGGSGDKASLKFLIYGKTGWLGGLLGKLCEKQGITYEYGKGRLEDRASLVADIRSIKPTHVFNAAGLTGRPNVDWCESHKPETIRVNVAGTLTLADVCRENDLLMMNFATGCIFEYDAAHPEGSGIGFKEEDKPNFFGSFYSKTKAMVEELLREYDNVCTLRVRMPISSDLNNPRNFITKISRYNKVVDIPNSMTILDELLPISIEMAKRNLRGIWNFTNPGVVSHNEILEMYTNYIEPGFKWSNFTLEEQAKVIVAARSNNEMDGSKLSKEFPEMLPIKESLIKYVFEPNKRT

SEQ ID NO: 24161 - protein, 658 aa, Valeriana officinalis
MAYTPKNILITGAAGFIAGHVANRLVKNHPEYNIVVLDKLDYCSNLKNLNPSRSSPNYKFVKGDIASADLVNYILKSESIDTIMHFAAQTHVDNSFGNSFEFTKNNVLGTHVLLEACKVTGQIKRFIHVSTDEVYGETDEDAVVGNHEASQLLPTNPYAATKAGAEMLVMAYHRSYGLPVITTRGNNVYGPNQFPEKLIPKFILLAMAGRTLPIHGDGSNVRSYLYCEDVAEAFDVVLHKGEVGHVYNIGTKKERRVIDVAKDICKLFSRDPESCIKFVENRPFNDQRYFLDDEKLKKLGWSEKTTWEEGLKKTMEWYTSNPGWWGDVSGALLPHPRMLVLPGVVDRHSDVTENEVAAVAAPVAAVAAPVKSSFKFLIYGRTGWIGGLLGKICEKQGIVYEYGKGRLEDRSTLVADIRNVKPTHVFNAAGVTGRPNVDWCESHKTETVRTNVVGTLTLADVCRDEGLIMINFATGCIFEYDAAHPEGSGIGFKEEDTPNFHGSYYSYTKAMVEDLLKPFENVCTLRVRMPISSDLSNPRNFVTKISRYDKVVNIPNSMTILDELLPISIEMAKRNLTGIWNFTNPGVVSHNEVLEMYKKYIDPAYKYSNFTLEEQAKVIVAARSNNEMDASKLKKEFPELLGIKESLVKYVFEPNKRV

SEQ ID NO: 24162 - protein, 680 aa, Lactuca sativa
MTMYTPKNILITGAAGFIASHVANRLVRSYPDYKIVVLDKLDYCSNFKNLNPSKSSPNFKFVKGDIGSADLVNHILITESIDTIMHFAAQTHVDNSFGNSFEFTKNNIGGTHVLLEACKVTRQIRRFIHVSTDEVYGETEKDAVVGNHEASQLLPTNPYSATKAGAEMLVMAYGRSYGLPVITTRGNNVYGPNQFPEKLIPKFILLAMRGNPLPIHGDGSNVRSYLYCEDVAEAFEVILHKGEVGHVYNIGTKKERRVIDVAKDMCTLFNMDPESSIKFVENRPFNDQRYFLDEEKLKSLGWAERTTWEEGLKKTMEWYISNPDWWGDVSGALLPHPRMLMMPGGVERVVDVSENIQSDSPHAAVNASQFRKVGPVAKTSKPSFKFLIYGKTGWIGGLLGKLCEKQGIGYEYGKGRLENRSQIVEDVQKIKPTHVFNAAGITGRPNVDWCESHKTETIRTNVSGTLTLADVCKESGILMINFATGCIFEYDEKHPEGSGIGFKEEDTPNFTGSFYSKTKAMVEELLREYDNVCTLRVRMPISSDLNNPRNFITKIARYDKVVNIPNSMTILDELLPLSIEMAKRNLRGIWNFTNPGVVSHNEVLEMYKEYINPGFKWTNFTLEEQALVIVAARSNNELDVTKLKKEFPELLSIKESLIKYVFGPNKKEIKMCNNGYTMPT

SEQ ID NO: 24163 - protein, 665 aa, Brassica oleracea
MATEYKPKNILITGAAGFIASHVANRLIRSYPDYKIVVLDKLDYCSDLKNLDPSFSSPNFRFVKGDIASDDLVNYLLITENIDTIMHFAAQTHVDNSFGNSFEFTKNNIYGTHVLLEACKVTGQIKRFIHVSTDEVYGETDEDAAVGNHEASQLLPTNPYSATKAGAEMLVMAYGRSYGLPVITTRGNNVYGPNQFPEKMIPKFMLLAMSGKPLPIHGDGSNVRSYLYCEDVAEAFEVVLHKGEVGHVYNIGTKRERRVIDVARDICKLLGKDPEASIQFVENRPFNDQRYFLDDQKLKNLGWSERTGWEDGLKKTMEWYTQNPEWWGDVSGALLPHPRMLMMPGGRVSDEKKDASSNTVQTFTVVTPNNKTSDPKDKASLKFLIYGKTGWIGGLLGKLCEKQGITYEYGKGRLEDRASLVADIRSIKPTHVFNAAGLTGRPNVDWCESHKPETIRVNVAGTLTLADVCRENGLLMMNFATGCIFEYDAAHPEGSGIGFKEEDKPNFTGSFYSKTKAMVEELLREFDNVCTLRVRMPISSDLNNPRNFITKISRYNKVVNIPNSMTILDELLPISIEMAKRNLRGIWNFTNPGVVSHNEILEMYKSYIEPGFKWSNFTVEEQAKVIVAPRSNNEMDGAKLSKEFPEMLPIKEALIKYVFEPNKRT

SEQ ID NO: 24164 - protein, 646 aa, Daucus carota
LVRSYPDYKIVVLDKLDYCSNLKNLNPSRSAPNFKFVKGDIGSADLVNYLLITESIDTIMHFAAQTHVDNSFGNSFEFTKNNIYGTHVLLEACKVTGQIRRFIHVSTDEVYGETDEDAVVGNHEASQLLPTNPYSATKAGAEMLVMAYGRSYGLPVITTRGNNVYGPNQFPEKLIPKFILLAMRGMQLPIHGDGANVRSYLYCEDVAEAFEVVLHKGEVGHVYNIGTKKERRVTDVAKDICKLFSVDPETNINYVENRPFNDQRYFLDDQKLKNLGWAERTTWEEGLKKTMDWYTSNPDWWGDVSGALLPHPRMLMMPGGIERHFDGSENRDAESTRFVDKSAPSQVSSSDPKSTVPQKLALKFLIYGRTGWIGGLLGKLCEKQGIPYEYGRGRLEYRSQLVSDLQIVKPTHVFNAAGVTGRPNVDWCESHKTETIRTNVTGTLTLADVCREQGLLMINFATGCIFEYDAAHPEGSGIGFKEEDTPNFHGSFYSKTKAMVEELLKEFDNVCTLRVRMPISSDLSNPRNFITKISRYNKVVNIPNSMTVLDELLPISIEMAKRNLKGIWNFTNPGVVSHNEILEMYKQYIDPSFKYSNFTLEEQAKVIVAARSNNEMDGAKLKAEFPELLSIKESLIKYVFEPNKKV

SEQ ID NO: 24165 - protein, 664 aa, Eutrema halophilum
MATYKPKNILITGAAGFIASHVANRLVRSYPDYKIVVLDKLDYCSNLKNLNPSKSSPNFKFVKGDIASADLVNYLLITENIDTIMHFAAQTHVDNSFGNSFEFTKNNIYGTHVLLEACKVTGQIRRFIHVSTDEVYGETDEDASVGNHEASQLLPTNPYSATKAGAEMLVMAYGSSYGLPVITTRGNNVYGPNQFPEKLIPKFILLAMNGKPLPIHGDGSNVRSYLYCEDVAEAFEVVLHKGEVNHVYNIGTTRERRVIDVANDISKLFGIDPDSTIQFVENRPFNDQRYFLDDQKLKKLGWSERTTWEEGLRKTMEWYTENPEWWGDVSGALLPHPRMLMMPGDRLSDGSDEHKDAGGNQTFTVITPTKTGSSGDKTSLKFLIYGKTGWLGGLLGKLCEKQGIPYEYGKGRLEDRASLSPGYSQHQTHSCLHAAGLTGRPNVDWCESHKTETIRVNVAGTLTLADVCRENDLLIMNFATGCIFEYDAAHPEGSGIGFKEEDKPNFTGSFYSKTKAMVEELLREFDNVCTLRVRMPISSDLNNPRNFITKISRYNKVVNIPNSMTILDELLPISIEMAKRNLRGIWNFTNPGVVSHNEILEMYKSYIEPGFKWSNFTLEEQAKVIVAPRSNNEMDGSKLSKEFPEMLSIKDSLIKYVFEPNKRT

SEQ ID NO: 24166 - protein, 681 aa, Gossypium raimondii
MANKYTPKNILITGAAGFIASHVCNRLIRNYPDYKIVVLDKLDYCSSLKNLDPSRSSPNFKFIKGDIASADLVHFILQTEFIDTIMHFAAQTHVDNSFGNSFEFTKNNIYGTHVLLEACKVTGQIKRFIHVSTDEVYGETDEDAVVGNHEASQLLPTNPYSATKAGAEMLVMAYGRSYGLPVITTRGNNVYGTNQFPEKLIPKFILLAMNGKILPIHGDGSNVRSYLYCEDVAEAFEVILHRGEVGHVYNIGTKKERRVFDVARDICRLFNLDPESQIKFVENRPFNDQRYFLDDQKLKSLGWYERTTWEEGLKKTMEWYVSNPDWWGDVSGALLPHPRMLMLPGIERQFNAPDTSNSGLGSAPVTNKFNQSRMLVPSPKHNIPSQKPSLKFLIYGRTGWIGGLLGKLCEKQGIPFEYGKGRLEQRSQLLDDIQTVKPTHVFNAAGVTGRPNVDWCETHKPETIRTNVVGTLTLADICREHDLLMINYATGCIFEYDATHPLGTGVGFKEEDKPNFTGSFYSKTKAVVEELLREFDNVCTLRVRMPISSDLSNPRNFITKITRYNKVVDISNSMTILDELLPVSIEMAKRNLRGIWNFTNPGVVSHNEILQMYKDYIDPNFNWVNFSLQEQAKVIVAPRSNNELDASKLKNEFPELLSIKDSLIKYVFEPNRKTFAWELSN

SEQ ID NO: 24167 - protein, 675 aa, Eutrema parvulum
ADTLISTMATTYKPKNILITGAAGFIASHVANRLIRSYPDYKIVVLDKLDYCSDLKNLNPSNSSPNFKFVKGDIASDDLVNYLLITENIDTIMHFAAQTHVDNSFGNSFEFTKNNIYGTHVLLEACKVTGQIRRFIHVSTDEVYGETDEDAAVGNHEASQLLPTNPYSATKAGAEMLVMAYGRSYGLPVITTRGNNVYGPNQFPEKLIPKFILLAMSGKPLPIHGDGSNVRSYLYCEDVAEAFEVVLHKGEVGHVYNIGTKRERRVIDVATDICKLFGKDPESSIQFVENRPFNDQRYFLDDQKLKNLGWSERTAWEDGLKKTMEWYTQNPEWWGDVSGALLPHPRMLMMPGGRLSDVSDEKKDASSNTVQTFTVVTPNNKTGGSNDKASLKFLIYGKTGWIGGLLGKLCEKQGITYEYGKGRLEDRASLIADICSIKPTHVFNAAGLTGRPNVDWCESHKPETIRVNVAGTLTLADVCRENDLLMMNFATGCIFEYDAAHPEGSGIGFKEEDKPNFTGSFYSKTKAMVEELLREFDNVCTLRVRMPISSDLNNPRNFITKISRYNKVVNIPNSMTILDELLPISIEMAKRNLRGIWNFTNPGVVSHNEILEMYKSYIDPVFKWSNFTVEEQAKVIVAPRSNNEMDGSKLSKEFPEMLPIKEALIKYVFEPNKRT

SEQ ID NO: 24168 - protein, 668 aa, Brassica rapa
MATTYKPKNILITGAAGFIASHVANRLIRSYPDYKIVVLDKLDYCSDLKNLNPSHSSPNFKFVKGDIASDDLVSYLLITENIDTIMHFAAQTHVDNSFGNSFEFTKNNIYGTHVLLEACKVTRQIRRFIHVSTDEVYGETDEDAAVGNHEASQLLPTNPYSATKAGAEMLVMAYGRSYGLPVITTRGNNVYGPNQFPEKMIPKFMLLAMSGKPLPIHGDGSNVRSYLYCEDVAEAFEVVLHKGEVGHVYNIGTKRERRVIDVARDICKLLGKDPESSIQFVENRPFNDQRYFLDDQKLKNLGWSERTGWEDGLKKTMEWYTQNPEWWGDVSGALLPHPRMLMMPGGRLSDVSDEKKDASSNTVQTFTVVTPNNKTAGSNDKASLKFLIYGKTGWIGGLLGKLCEKQGITYEYGKGRLEDRASLIADIRSIKPTHVFNAAGLTGRPNVDWCESHKAETIRVNVAGTLTLADVCRESGLLMMNFATGCIFEYDAAHPEGSGLGFKEEDKPNFTGSFYSKTKAMVEELLREFDNVCTLRVRMPISSDLNNPRNFITKISRYNKVVNIPNSMTILDELLPISIEMAKRNLRGIWNFTNPGVVSHNEILEMYKSYIEPGFKWSNFTVEEQAKVIVAPRSNNEMDGAKLSKEFPEMLPIKEALIKYVFGPNKRT

SEQ ID NO: 24169 - protein, 704 aa, Capsicum annuum
MKLIFSLLDPSLVLNVNVYLEFVICRSCLKMSTYTPKNILITGAAGFIACHVANRLVHSYPDYKIVVLDKLDYCSNLKNLIPSRSSANFKFVKGDIASADLVNYLLITESIDTIMHFAAQTHVDNSFGNSFEFTKNNIYGTHVLLEACKVTGQIRRFIHVSTDEVYGETDEDAVVGNHEASQLLPTNPYSATKAGAEMLVMAYGRSYGLPVITTRGNNVYGPNQFPEKLIPKFILLAMRGKPLPIHGDGCNVRSYLYCEDVAEAFEVILHKGEVGHVYNIGTTKERRVIDVAQDICKLFNIDADKSIQFVENRPFNDQRYFLDDQKLKDLGWSERTVWEDGLRKTIEWYTNNPDWWGDVTGALLPHPRMLMMPGGIERNLDGAEKFDLGSNKFSGKSNETKMVTPASKTSNVPPKSPFKFLIYGKTGWIGGVLGKLCEKQGIPYEYGRGRLEDRSKLLADINTIKPTHVFNAAGVTGRPNVDWCESHKPETIRTNVAGTLNLADVCREKGLLMINFATGCIFEYDAAHPEGSGIGFKEEDTPNFHGSFYSKTKAMVEELLKNYDNVCTLRVRMPISSDLNNPRNFITKISRYNKVVNIPNSMTILDELLPISIEMAKRNLKGIWNFTNPGVVSHNEILEMYKKYIDPTFTYANFTLEEQAKVIVAARSNNEMDASKLKKEFPELLSIKESLIKYVFEPNKKTSA

SEQ ID NO: 24170 - protein, 668 aa, Brassica oleracea
MATTYKPKNILITGAAGFIASHVANRLIRSYPDYKIVVLDKLDYCSDLKNLNPSHSSPNFKFVKGDIASDDLVSYLLITENIDTIMHFAAQTHVDNSFGNSFEFTKNNIYGTHVLLEACKVTGQIRRFIHVSTDEVYGETDEDAAVGNHEASQLLPTNPYSATKAGAEMLVMAYGRSYGLPVITTRGNNVYGPNQFPEKMIPKFMLLAMSGKPLPIHGDGSNVRSYLYCEDVAEAFEVVLHKGEVGHVYNIGTKRERRVIDVARDICKLLGKDPESSIQFVENRPFNDQRYFLDDQKLKNLGWSERTRWEDGLKKTMEWYIQNPEWWGDVSGALLPHPRMLMMPGGRLSDVSDEKKEASSNTVQTFTVVTPNNKTAGSNDKASLKFLIYGKTGWIGGLLGKLCEKQGITYEYGKGRLEDRASLIADIRSIKPTHVFNAAGLTGRPNVDWCESHKAETIRVNVAGTLTLADVCRESGLLMMNFATGCIFEYDAAHPEGSGLGFKEEDKPNFTGSFYSKTKAMVEELLREFDNVCTLRVRMPISSDLKNPRNFITKISRYNKVVNIPNSMTILDELLPISIEMAKRNLRGIWNFTNPGVVSHNEILEMYKSYIEPGFKWSNFTVEEQAKVIVAPRSNNELDGAKLSKEFPEMLPIKEALIKYVFGPNKRT

SEQ ID NO: 24171 - protein, 665 aa, Brassica rapa
MATEYKPKNILITGAAGFIASHVANRLIRSYPDYKIVVLDKLDYCSDLKNLDPSFSSPNFRFVKGDIASDDLVNYLLITENIDTIMHFAAQTHVDNSFGNSFEFTKNNIYGTHVLLEACKVTGQIKRFIHVSTDEVYGETDEDAAVGNHEASQLLPTNPYSATKAGAEMLVMAYGRSYGLPVITTRGNNVYGPNQFPEKMIPKFMLLAMSGKPLPIHGDGSNVRSYLYCEDVAEAFEVVLHKGEVGHVYNIGTKRERRVIDVARDICKLLGKDPEASIQFVENRPFNDQRYFLDDQKLKNLGWCERTGWEDGLKKTMEWYTQNPEWWGDVSGALLPHPRMLMMPGGRVSDEKKDTSSNTVQTFTVVTPNNKTHDPKDKASLKFLIYGKTGWIGGLLGKLCEKQGITYEYGKGRLEDRASLMADIRSNKPTHVFNAAGLTGRPNVDWCESHKPETIRVNVAGTLTLADVCRENGLLMMNFATGCIFEYDAAHPEGSGIGFKEEDNPNFTGSFYSKTKAMVEELLREFDNVCTLRVRMPISSDLNNPRNFITKISRYNKVVNIPNSMTILDELLPISIEMAKRNLRGIWNFTNPGVVSHNEILEMYKSYIEPGFKWSNFTVEEQAKVIVAPRSKHEMDGAKLSKEFPEMLPIKEALIKYVFEPNKRT

SEQ ID NO: 24172 - protein, 657 aa, Phalaenopsis aphrodite
SHVANRLIRNYPDYKIVVLDKLDYCSNLKNLSPSGYSPNLKFVKGDIASADLLHYLLITESIDTIMHFAAQTHVDNSFGNSFEFTKNNIYGTHVLLEACKVSGQIRRFIHVSTDEVYGETDENAIVGNHEASQLLPTNPYSATKAGAEMLVMAYGRSYGLPVITTRGNNVYGPNQFPEKLIPKFILLAMRGQTLPIHGDGSNVRSYLYCEDVAEAFEVILHRGEIGHVYNIGTKKERRVIDVAKDICKLFARDTTTAIKFVDNRPFNDQRYFLDDQKLKILGWSERTTWEEGLKKTMDWYTNNPDWWGDVSGALLPHPRMLMMPGTERHSDGPEEIIKSMLSPPNNINIPSQLITPPVSETSSFGIKTQSLKFLIYGKTGWIGGLLGKICEKQGIPFEYGKGRLEDRSKLQSDIHNVKPTHVFNAAGVTGRPNVDWCESHRLETIRTNVVGTLTLADVCSENGLLLINYATGCIFEYDANHPEGSGYGFKEEDSPNFVGSFYSKTKAMVEELLKEYDNVCTLRVRMPISSDLNNPRNFITKISRYDKVVNIPNSMTVLDELLPISIEMARRNCRGIWNFTNPGVVSHNEILELYKAYVDPGFSWVNFTLEEQAKVIVAPRSNNELDASKLKNEFPELLSIKESLIKYVFEPNRKQVK

SEQ ID NO: 24173 - protein, 668 aa, Panicum virgatum
MATPYKPKNILITGAAGFIASHVATRIVKNYPDYKIVVLDKLDYCSNLKNLLPVSSLPNFKFVKGDIASADLVNFILVTENIDTVMHFAAQTHVDNSFGNSFEFTKNNIYGTHVLLEACRQITGQIKRFIHVSTDEVYGETDEDAVVGNHEMSQLLPTNPYAATKAGAEMLVMAYGRSYGLPVITTRGNNVYGPNQFPEKLIPKFILLAMRGEPLPIHGDGSNVRSYLYCEDVAEAFEVILHRGEVGHVYNIGTKKERTVMNVAKDICKLFNLEADKAIKFVDNRPFNDQRYFLNNEKLKSLGWSERTHWEEGLRKTMEWYVANSDYWGDVSGALLPHPKAMVMPGGFEGSKEIKGMLSQFNNIQTKVAPTSDSVLETHPFKFLIYGRTGWIGGLLGKICEKQGIPYEYGKGRLQDRSSLILDIQTIKPTHVFNAAGVTGRPNVDWCESHKPDTIRTNVVGTLTLADVCREHGLLMINYATGCIFEYDAQHPEGSGIGFKEEDTPNFTGSFYSKTKAMVEELLKEYENVCTLRVRMPISSDLSNPRNFVTKISRYDKVVNIPNSMTILDELLPISVEMAKRNLRGIYNFTNPGVVSHNEVLEMYKQYIDPSYKWTNFTLEEQAKVIVAPRSNNELDTTKLKKEFPELLSIKDSLIKYVFEPNRKVAAN

SEQ ID NO: 24174 - protein, 667 aa, Arabidopsis thaliana
MDDTTYKPKNILITGAAGFIASHVANRLIRNYPDYKIVVLDKLDYCSDLKNLDPSFSSPNFKFVKGDIASDDLVNYLLITENIDTIMHFAAQTHVDNSFGNSFEFTKNNIYGTHVLLEACKVTGQIRRFIHVSTDEVYGETDEDAAVGNHEASQLLPTNPYSATKAGAEMLVMAYGRSYGLPVITTRGNNVYGPNQFPEKMIPKFILLAMSGKPLPIHGDGSNVRSYLYCEDVAEAFEVVLHKGEIGHVYNVGTKRERRVIDVARDICKLFGKDPESSIQFVENRPFNDQRYFLDDQKLKKLGWQERTNWEDGLKKTMDWYTQNPEWWGDVSGALLPHPRMLMMPGGRLSDGSSEKKDVSSNTVQTFTVVTPKNGDSGDKASLKFLIYGKTGWLGGLLGKLCEKQGITYEYGKGRLEDRASLVADIRSIKPTHVFNAAGLTGRPNVDWCESHKPETIRVNVAGTLTLADVCRENDLLMMNFATGCIFEYDATHPEGSGIGFKEEDKPNFFGSFYSKTKAMVEELLREFDNVCTLRVRMPISSDLNNPRNFITKISRYNKVVDIPNSMTVLDELLPISIEMAKRNLRGIWNFTNPGVVSHNEILEMYKNYIEPGFKWSNFTVEEQAKVIVAARSNNEMDGSKLSKEFPEMLSIKESLLKYVFEPNKRT

SEQ ID NO: 24175 - protein, 679 aa, Malus domestica
MDTAYKPKNILLTGAAGFIASHVCNRLIRNYPAYKIVVLDKLDYCSNLKNLNPSKSSPKFKFIKGDIGSADLVNFILLTENIDTIMHFAAQTHVDNSFGNSFEFTKNNIYGTHVLLEACKVTGQIKRFIHVSTDEVYGETDEDAVVGNHEASQLLPTNPYSATKAGAEMLVMAYGRSYGLPVITTRGNNVYGPNQFPEKMIPKFILLAMQGKPLPIHGDGSNVRSYLYCEDVAEAFEVILHRGEVGHVYNIGTKKERRVVDVAREICQLFSLNPDTYVKFVENRPFNDQRYFLDDQKLKSLGWSERTLWEEGLRKTMEWYVKNPQWWGDVSGALLPHPKMLMVPGIERQFDGSDTGDSAYPLSASDSSQSKMVVPAPRNIQSTEKPSLKFLIYGKTGWIGGLLGKICEKQGLPYEYGRGRLQERSQLMADILSVKPTHVFNAAGVTGRPNVDWCESHKPETIRTNVVGTLTLADVCRDHGLLMVNYATGCIFEYDDAHPPRSGIGFKEEDTPNFAGSFYSKTKAMVEELLKEYENVCTLRVRMPISSDLSNPRNFITKISRYNKVVDIPNSMTILDELLPISVEMAKRNLRGIWNFTNPGVVSHNEILEMYKNYIDPSFKWTNFTVEEQAKVIVAARSNNEMDASKLKKEFPELLPIKESLIKYVFEPNKKTFAGGAAI

SEQ ID NO: 24176 - protein, 664 aa, Manihot esculenta
NILITGAAGFIASHVCNRLIRNYPDYKIVVLDKLDYCSNLKNLLPSKSSANFKFVKGDIGSADLVNFLLITESIDTIMHFAAQTHVDNSFGNSFEFTKNNIYGTHVLLEACKVTGQIKRFIHVSTDEVYGETDEDAVVGNHEASQLLPTNPYSATKAGAEMLVMAYGRSYGLPVITTRGNNVYGPNQFPEKLIPKFILLAMQGKPLPIHGDGSNVRSYLYCEDVAEAFEVILHKGEVGHVYNIGTKKERRVIDVAKDICKLFSMDPETSIKFVENRPFNDQRYFLDDQKLKILGWSERTIWEEGLKKTMEWYIQNPDWWGDVTGALLPHPRMLMMPGGRHFDGSEENKSAPYASNNSNQTRMVIPVSRTSTSGSPRKSSLKFLIYGRTGWIGGLLGKLCEKQGIAYEYGRARLEDRSSVLSDIQNVRPTHVLNAAGITGRPNVDWCESHKTETIRTNVAGTLTLADVCREHNILMVNYATGCIFEYDSTHPEHSGIGFTEEEKPNFIGSFYSKTKAMVEELLKEYDNVCTLRLRMPISSDLNNPRNFIYKISRYNKVVNIPNSMTVLDELLPISIEMAKRNLRGIWNFTNPGVVSHNEILEMYKSHVNPNFTWVNFTLEEQSKVIVAPRSNNEMDASKLKKEFPELLSIKESLLKYVFVPNKKV

SEQ ID NO: 24177 - protein, 642 aa, Fagus grandifolia
MASYTPKNILITGAAGFIASHVANRLIRNYPDYKIVVLDKLDYCSNLKNLLPSRSSPNFKFVKGDIGSADLVNFLLITESIDTIMHFAAQTHVDNSFGNSFEFTKNNIYGTHVLLEACKVTGQIRRFIHVSTDEVYGETDEDAVVGNHEASQLLPTNPYSATKAGAEMLVMAYGRSYGLPVITTRGNNVYGPNQFPEKLIPKFILLAMQGKPLPIHGDGSNVRSYLYCEDVAEAFEVILHKGEVGHVYNIGTKKERRVIDVAEDICRLFSMDPEKSIKFVENRPFNDQRYFLDDQKLKILGWSEQTRWEEGLKKTMEWYINNPDWWGDVTGALLPHPRMLMMPGGIERHFDGSEEGKSASYVSNNTRMLVPTSKSCGSPRKPSLKFLIYGRTGWLGGLLGKICEKQGIPYEYGRGRLEDRSSLLADIQNVKPTHVFNAAGVTGRPNVDWCESHKTETIRANVAGTLTLADVCREHGLLMMNFATGCIFEYDAEHPEGSGIGYKEEDKPNFIGSFYSKTKAMVEELLKEYDNVCILRVRMPISSDLNNPRNFITKISRYNKVVNIPNSMTILDELLPISVEMAKRNLRGIWNFTNPGVVSHNEILEMYKQYINPEFKWANFTLEEQAKVIVAPEATMRWTRQS

SEQ ID NO: 24178 - protein, 668 aa, Panicum virgatum
MATPYKPKNILITGAAGFIASHVATRIVKKYPDYKIVVLDKLDYCSNLKNLLSVSSSPNFKFVKGDIASADLVNFILVTENIDTVMHFAAQTHVDNSFGNSFEFTKNNIYGTHVLLEACRQITGQIKRFIHVSTDEVYGETDEDAVVGNHEMSQLLPTNPYAATKAGAEMLVMAYGRSYGLPVITTRGNNVYGPNQFPEKLIPKFILLAMRGQPLPIHGDGSNVRSYLYCEDVAEAFEVILHRGEVGHVYNIGTKKERTVMNVAKDICKLFNLEADKAIKFVDNRPFNDQRYFLNNEKLMSLGWSERTHWEEGLRKTMEWYVSNSDYWGDVSGALLPHPKAMVMPGGYEGSKEIKGMLAQFNNIQTKVAPTSDSVLETHPFKFLIYGRTGWIGGLLGKICEKQGIPYEYGKGRLQERSSLILDIQTIKPTHVFNAAGVTGRPNVDWCESHKPETIRTNVVGTLTLADVCREHGLLMINYATGCIFEYDAQHPEGSGIGFKEEDTPNFTGSFYSKTKAMVEELLKEYENVCTLRVRMPISSDLSNPRNFVTKISRYDKVVNIPNSMTILDELLPISIEMAKRNLRGIYNFTNPGVVSHNEVLEMYKQYIDPSFKWTNFTLEEQAKVIVAPRSNNELDTTKLEQEFPELLSIKDSLIKYVFEPNRKVPAN

SEQ ID NO: 24179 - protein, 643 aa, Medicago truncatula
MASYTPKNILITGAAGFIASHVANRLVRSHPEYKIVVLDKLDYCSNLKNLLPSKASPNFKFVKGDIGSADLVNYLLITESIDTIMHFAAQTHVDNSFGNSFEFTKNNIYGTHVLLEACKVTGQIRRFIHVSTDEVYGETDEDAVVGNHEASQLLPTNPYSATKAGAEMLVMAYGRSYGLPVITTRGNNVYGPNQFPEKLIPKFILLAMQGKTLPIHGDGSNVRSYLYCEDVAEAFEVVLHKGEVGHVYNIGTKKERGVIDVAKDICRLFSIDPEANIKFVENRPFNDQRYFLDDQKLKNLGWAERTTWDEGLKKTIEWYTKNPDWWGDVSGALLPHPRMLMMPGGMERHFEGSEGENPASVNSSNTRMVVPSTKNTATPQKHPFKFLLFGRTGWIGGLLGKLCEKQGIPYEYAKGVTGRPNVDWCETHKTETIRANVAGTLTLADVCREHGILMINYATGCIFEYDAAHPEGSGIGFKEEDKPNFMGSFYSKTKAMVEELLREYDNVCTLRVRMPISSDLSNPRNFITKISRYNKVVNIPNSMTVLDELLPISIEMAKRNLSGIWNFTNPGAVSHNEILEMYRDYIDPSFKWQNFTLEEQAKVIVAARSNNEMDGAKLKKEFPELLSIKESLIKYVFVPNKKK

SEQ ID NO: 24180 - protein, 690 aa, Conyza canadensis
MWMLSNICLTCLCLESSRMSTYTPKNILITGAAGFIASHVANRLVRTYPDYKIVVLDKLDYCSNLKNLNPSRSSPNFKFVKGDIGSADLVNYLLITENIDTIMHFAAQTHVDNSFGNSFEFTKNNIYGTHVLLEACKVTRQIRRFIHVSTDEVYGETEEDAVVGNHEASQLLPTNPYSATKAGAEMLVMAYGRSYGLPVITTRGNNVYGTNQFPEKLIPKFILLAMRGEPLPIHGDGSNVRSYLYCEDVAEAFEVVLHKGEVGHVYNIGTKKERRVIDVARDVCKLFNRDPEASIKFVENRPFNDQRYFLDDEKLKGLGWAERTTWEEGLKKTMEWYTSNPEWWGDVSGALLPHPRMLMMPGGTERVVDVPENVQSDSPHAAVNPSQFRKVVSAPKSNCSANKPSFKFLIYGKTGWIGGLLGQICEKQGIQYEYGKGRMEDRAQIVADIQKIKPTHVFNAAGVTGRPNVDWCESHRAETIRTNVAGTLTLADVCRESGILMINFATGCIFEYDDAHPEGSGIGFKEEDTPNFTGSFYSKTKAMVEELLKEFDNVCTLRVRMPISSDLNNPRNFVTKISRYDKVVNIPNSMTILDELLPISIEMAKRNLKGIWNFTNPGVVSHNEVLELYKEYINPEFKWKNFTLEEQARVIVAPRSNNELDTSKLKKEFPELLSIKESLIKYVFAPNKKV

SEQ ID NO: 24181 - protein, 679 aa, Malus domestica
MDTAYKPKNILLTGAAGFIASHVCNRLIQNYPGYKIVVLDKLDYCSNLKNLNPSKSSPNLKFIKGDIGSADLVNFILLTENIDTIMHFAAQTHVDNSFGNSFEFTQNNIYGTHVLLEACKVTGQIKRFIHVSTDEVYGETDEDAVVGNHEASQLLPTNPYSATKAGAEMLVMAYGRSYGLPVITTRGNNVYGPNQFPEKMIPKFILLAMQGKPLPIHGDGSNVRSYLYCEDVAEAFEVILHRGEVGHVYNIGTKKERRVVDVAKEICQLFSLNPDTHVKFVENRPFNDQRYFLDDSKLKSLGWLERTLWEEGLRKTMEWYVKNPQWWGDVSGALLPHPRMLMVPGIERQFDGSDTGDSAYPLSASDSSHSKLVVPAPRNIPSTEKPSLKFLIYGKTGWIGGLLGKICEKQGISCEYGRGRLQERSQLMADILRVKPTHVFNAAGVTGRPNVDWCESHKPETIRTNVVGTLTLADVCRDHGLLVVNYATGCIFEYDDAHPPRSGIGFKEEDTPNFAGSFYSKTKAMVEELLKEYDNVCTLRVRMPISSDLSNPRNFITKISRYNKVVDIPNSMTILDELLPISVEMAKRNLRGIWNFTNPGVVSHNEILEMYKKYIDPSFKWTNFTVEEQAKVIVAARSNNEMDASKLKKEFPELLPIKESLIKYVFEPNKKTFAGGAAI

SEQ ID NO: 24182 - protein, 666 aa, Eucalyptus grandis
MTSYTPKNILITGAAGFIACHVANRLTRNFTEYKIVVLDKLDYCSNLKNLLPSKSAPNFKFVQGDIASADLVNHLLITESIDTIMHFAAQTHVDNSFGNSFEFTKNNIYGTHVLLEACRVTGQIRRFIHVSTDEVYGETDEDAVVGNHEASQLLPTNPYSATKAGAEMLVMAYGRSYGLPVITTRGNNVYGPNQYPEKSIPKFILLAMAGKPLPIHGDGCNVRSYLYCEDVAEAFEVILHQGEVGHVYNIGTKKERRVIDVAKDICKLFSMNPEISIQFVENRPFNDQRYFLDDEKLKNLGWSERTSWEEGLKRTMEWYVKNPDWWGDVSGALLPHPRMLMMAGGVERHYDGPEEGEALPLPSNSDQTNMAVSGEKPSFKFLIYGRSGWIGGLLGKLCKMQGIPFEYGRGRLEDRSQLLADIANVKPTHVFNAAGVTGRPNVDWCESHKTETIRTNVAGTLTLADVCRERRLLVINFATGCIFEYDASHPEGSGIGFKEEDKPNFTGSFYSKTKAMVEELLKEYDNVCTLRVRMPISSDLNNPRNFITKISRYNKVVNIPNSMTVLDEVLPVSIEMAKRNLRGIWNFTNPGAVSHNEILEMYKSYIDPDFQWVNFTLEEQAQVIVAPRSNNELDATKLKNEFPDLLSIKDSLIKYVFEPNKKNVTE

SEQ ID NO: 24183 - protein, 689 aa, Pinus taeda
MAPESYTPKNILITGAAGFIASHVANRLVRKYPQYKIVVLDKLDYCSNLKNLLPSKSSPNFKFVRGDIASADLVNYLLITEGIDTIMHFAAQTHVDNSFGNSFEFTKNNIYGTHVLLEACKVTGQIRRFIHVSTDEVYGETEQDALVGNHEASQLLPTNPYSATKAGAEMLVMAYGRSYGLPVITTRGNNVYGPNQFPEKLIPKFILLAMQGKPLPIHGDGSNVRSYLYCEDVAEAFEVVLHSGEVGNVYNIGTKKERRVIDVAKDICKLFSLNHEKVIKFVDNRPFNDQRYFLDDQKLKDLGWSERTTWQDGLKKTMDWYISHPDWWGDVTGALLPHPRMLTMAGVGRLSDGLEMMAGVGRLSDSLDENASAISPEVNNSKQDRMLIPSKSISQKPALKFLIYGRTGWIGGLLGQICEKQGISFEYGNGRLENRSQIQMDIQNVKPTHVFNAAGVTGRPNVDWCESHKPETIRTNVVGTLNLADVCREQGLLLMNFATGCIFEYNDAHPEGSGIGFGEEDSPNFTGSFYSKTKAMVEELLKEFENVCTLRVRMPISSDLSNPRNFITKITRYNKVVNIPNSMTVLDELLPISIEMAKKNCKGIWNFTNPGVVSHNEILEMYRDYIDPNFKWVNFNLEEQAKVIVAPRSNNELDTFKLKEAFPELLPIKDSLLKYVFEPNKKSSLANGA

SEQ ID NO: 24184 - protein, 650 aa, Chenopodium quinoa
MSSYTPKNILITGAAGFIASHVANRLIRSYPDYKIVVLDKLDYCSNLKNLRPSQSSPNFKFVKGDIASADLVNYLLITESIDTIMHFAAQTHVDNSFGNSFEFTKNNIYGTHVLLEACKVTGQIRRFIHVSTDEVYGETDEDAVVGNHEASQLLPTNPYSATKAGAEMLVMAYGRSYGLPVITTRGNNVYGPNQFPEKLIPKFILLAMRGKPLPIHGDGSNVRSYLYCEDVAEAFEVILHRGEVGHVYNIGTKKERRVIDVATDVCKLFSMDPDASIKFVENRPFNDQRYFLDDEKLKILGWSERTTWEEGLRKTMEWYTSNPDWWGDVSGALLPHPRMLMMPGGIERHFEEADNENAASSEFSNTQSKMVVPPTKSVSSPRKPSFKFLIYGRTGWIGGLLGQLCEKQGITFEYGKGRLENRASLIADIQNVKPTHVFNAAGVTGRPNVDWCESHKAETIRANVAGTLTLADVCREHGLLMMNFATGCIFEYDAAHPLGSGIGFKEEDTPNFTGSFYSKTKAMVEELLKEFDNVCTLRVRMPISSDLNNPRNFITKISRYSKVVDIPNSMTVLDELLPISIEMAKRNLKGIYNFTNPGVVSHNEILEMYKNYMDPEFKWANFTLEEQAKVIVAPRSNNEMDASQVEKGIP

SEQ ID NO: 24185 - protein, 689 aa, Pseudotsuga menziesii
MAPERYTPKNILITGAAGFIASHVANRLVRKYPQYKIVVLDKLDYCSNLKNLLPSNSSPNFKFVRGDIASADLVNYLLITEGIDTIMHFAAQTHVDNSFGNSFEFTKNNIYGTHVLLEACKVTGQIRRFIHVSTDEVYGETEQDALVGNHEASQLLPTNPYSATKAGAEMLVMAYGRSYGLPVITTRGNNVYGPNQFPEKLIPKFILLAMQGKPLPIHGDGSNVRSYLYCEDVAEAFEVVLHNGEVGNVYNIGTKKERRVLDVAKDICQLFSLDHEKVIKLVDNRPFNDQRYFLDDQKLKDLGWSERTTWQDGLKKTMDWYIGHPDWWGDVTGALLPHPRMLTMAGVGRLSDGLEMMAGVGRFPDGLDENVSALSPEVNKSKQDRMLIPSKSFSQKPALKFLIYGRTGWIGGLLGQICEKQGIPFEYANGRLENRAQIQMDIQNVKPTHVFNAAGVTGRPNVDWCESHKPETIRANVVGTLNLADVCREQGLLLMNFATGCIFEYNDAYPEGSGIGFKEEDSPNFTGSFYSKTKAMVEELLKQFENVCILRVRMPISSDLSNPRNFITKITRYNKVVNIPNSMTVLDELLPISIEMAKRNCRGIWNFTNPGVVSHNEILEMYRDYIDPNFKWVNFNLEEQAKVIVAPRSNNELDTSKLKGEFPELLSIKDSLLKYVFEPNKKNKFANGA

SEQ ID NO: 24186 - protein, 543 aa, Zea mays
MRAGAAARGDSPRAMSAAATPRHRLGVALLLLLVLGGADAKAHSYEDALRKSLLYFEAQRSGRLPHSQRVTWRHHSGLTDGLEQGVDLVGGYYDAGDHVKFGLPMAFTVTMLSWSLIEYGADVAAAGELGHALEAVKWGTDYFVKAHTRPDELWAEVGDGDTDHYCWQRPEDMTTSRQAYKVDRDHPGSDVAGETAAAMAAASIVFRDSNPHYAHLLLHHAQQLFEFADKYRGKYDSSIAEVKSYYASVSGYKDELLWAALWLHRATGRADYLDYVVDNADSFGGTGWAINEFSWDVKYAGVQILAARLLLRGEHATRHRSTLERYRAKAERYVCACLGRNTEGGADANVERSPGGMLYVRQWNNMQYVTSAAFLLSAYSDYLAEAGVRTVSCAGGETVAAREVAALARAQVDYVLGTNPRGVSYLVGYGPKYPSRVHHRAASIVPYKHSKEFIGCTQGFDHWFGRRSSNPNVLVGAIVGGPDRRDRFRDNRENYMQTEACTYNTAPMVGMFAKLHRLARQEREQGPTPAPAPAPVTSAAADV

SEQ ID NO: 24187 - protein, 539 aa, Panicum virgatum
MRRRRAGGSPLAMSGVGTASSCRRRRRQLGGALLLVLVALAAGVLEGAEGKAHNYEDALQKSLLYFEAQRSGRLPHSQRVTWRHHSGLTDGLEQGVDLVGGYYDAGDHVKFGLPMAFTVTMLSWSLIEYGGDVAAAGELGHALEAVKWGTDYFIKAHTQPDELWAEVGDGDTDHYCWQRPEDMTTSRQAYKVDRDHPGSDVAGETAAAMAAASIVFRDANPHYAHLLLHHAQQLFEFADKYRGKYDSSIAEVKSYYASVSGYKDELLWAALWLHRATGRAEYLDYVVDNADSFGGTGWAINEFSWDVKYAGVQILATRLLLRGEHASRHRSTLERYRAKAERYVCACLGRNADANVERSPGGMLYIRQWNNMQYVTSAAFLLSAYSDYLAEAGVGAVSCGEGAVAAAEVFALARAQVDYVLGTNPRGVSYLVGYGPKYPNRVHHRAASIVPYKHSKEFIGCTQGFDHWFGRRSSNPNVLVGAIVGGPDRRDRFRDNRENYMQTEACTYNTAPMVGMFAKLHRMARQEREQGPTPAAAEV

SEQ ID NO: 24188 - protein, 535 aa, Sorghum bicolor
MSSAAATATSCHRLGVALPLLLLLAAAAVLGGAEGKAHSYEDALQKSLLYFEAQRSGRLPHSQRVAWRHHSGLTDGLEQGVDLVGGYYDAGDHVKFGLPMAFTVTMLSWSLIEYGGDVADAGELGHALEAVKWGTDYFIKAHTRPDELWAEVGDGDTDHYCWQRPEDMTTSRQAYKVDRDHPGSDVAGETAAAMAAASIVFRDSNPHYAHLLLHHAQQLFEFADKYRGKYDSSIAEVKSYYASVSGYKDELLWAALWLHRATGRADYLDYVVDNADSFGGTGWAINEFSWDVKYAGVQIIAARLLLRGEHATRHRSTLERYRAKAERYVCACLGRNTEGGADANVERSPGGMLYIRQWNNMQYVTSAAFLLSVYSDYLAEAGAPTVSCAGGETVAAEEVFALARAQVDYVLGTNPRGVSYLVGYGSKYPNRVHHRAASIVPYKHSKEFIGCTQGFDHWFGRRSSNPNVLVGAIVGGPDRQDRFRDNRENYMQTEACTYNTAPMVGMFAKLHRMARQEREHGSPAPVPVTSTAAEV

SEQ ID NO: 24189 - protein, 532 aa, Zea mays
MSSAASSPCHRLRRVALLLLVAAVLAGGTEGKAHDYGDALRKSLLYFEAQRSGRLPHSQRVAWRHHSGLTDGLEQGVDLVGGYYDAGDHVKFGLPMAFTVTMLSWSLIEYGGDVADAGELGHALEAVKWGTDYFIKAHTRPDELWAEVGDGDTDHYCWQRPEDMTTSRQAYKVDRDHPGSDVAGETAAAMAAASIVFRGSNPHYAHLLLHHAQQLFEFADKYRGTYDSSIAEVKSYYASVSGYKDELLWAALWLHRATGRDDYLDYVVDNADSFGGTGWAINEFSWDVKYAGVQILAARLLLRGEHAPRHRSTLERYRAKAERYVCACLGRNTEGGADANVERSPGGMLYVRQWNNMQYVTGAALLLSAYSDYLAAAEAGGAARAVSCAAAAEEVFALARAQADYVLGTNPRGASYLVGYGSRYPGRVHHRAASIVPYKHSREFIGCTQGFDHWFGRRGSNPNLLVGAIVGGPDRRDRFRDSRDNYMQTEACTYNTAPMVGVFAKLRRMAWLEREQGSTSVPVTVTSTAAEV

SEQ ID NO: 24190 - protein, 543 aa, Triticum aestivum
MRSGGATAVILSRRLGAVSLLVLLLIAAAAEGSKSGSGDGKAHNYEEALRKSLLYFEAQRSGRLPHGQRVPWRDHSGLTDGLEQGVDLVGGYYDAGDHVKFGLPMAFTVTMLSWSMLEYGDDVAAAGELAHALEAIKWGTDYFIKAHTQPDELWAEVGDGDTDHYCWQRPEDMTTSRQAYKVDRDHPGSDVAGETAAAMAAASMVFRKSNPHYAHLLLHHAQQLFEFADGYRGQYDSSIAEVKSYYASVSGYKDELLWAALWLHRATGKAAYLDYVVDNAHDFGGTGWAITEFSWDVKYAGVQILAARLLLRGEHTAEQKRTLERYQAKAEHYVCACLGRNAQAGGEDANVERSPGGMLYIRQWNNMQYVTNAAFLLSTYADYLAEAGVETVTCAGGETAGAGEVAALARAQVDYVLGTNPRGVSYLVGYGAKYPARVHHRAASIVPYKHSKQFIGCSQGFDHWYGRRSSNPNVLVGAIVGGPDRRDRFRDNRENYMQTEACTYNTAPMVGMFAKLNRMAREEREQRAATARSGTAPRCKWIR

SEQ ID NO: 24191 - protein, 181 aa, Brachypodium distachyon
MGLAFGKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATTGEGLYEGLDWLSSNIASKS

SEQ ID NO: 24192 - protein, 181 aa, Festuca arundinacea
  Sequence also found in Organisms: Fraxinus spp, Lolium multiflorum, Avena sativa, Pseudoroegneria spicata, Secale cereale
MGLAFGKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATSGEGLYEGLDWLSSNIASKA

SEQ ID NO: 24193 - protein, 181 aa, Leymus cinereus x Leymus triticoides
MGLAFGKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATSGEGLYEGLDWLSNNIASKA

SEQ ID NO: 24194 - protein, 181 aa, Oryza sativa
  Sequence also found in Organisms: Festuca arundinacea
MGLTFTKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATTGEGLYEGLDWLSSNIASKA

SEQ ID NO: 24195 - protein, 181 aa, Eragrostis curvula
MGLAFGTLFGRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATTGEGLYEGLDWLSSNIASKA

SEQ ID NO: 24196 - protein, 181 aa, Festuca arundinacea
  Sequence also found in Organisms: Allium cepa
MGLAFGKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATSGEGLYEGLDWLSSNIASKS

SEQ ID NO: 24197 - protein, 181 aa, Triticum aestivum
MGLAFGKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDSVLLVFANKQDLPNAMNAAEITDKLGLHSLRQRHWYIQSTCATSGEGLYEGLDWLSSNIASKA

SEQ ID NO: 24198 - protein, 181 aa, Olea europaea
MGLAFGKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATSGEGLYEGLEWLSSNIASKA

SEQ ID NO: 24199 - protein, 181 aa, Olea europaea
MGLAFGKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATSGEGLYEGLDWLSSNIAGKA

SEQ ID NO: 24200 - protein, 181 aa, Amorphophallus konjac
  Sequence also found in Organisms: Musa acuminata, Cirsium arvense, Coffea canephora, Gossypium raimondii, Avena sativa
MGLTFTKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATSGEGLYEGLDWLSSNIASKA

SEQ ID NO: 24201 - protein, 181 aa, Sorghum bicolor
  Sequence also found in Organisms: Brachypodium distachyon, Echinochloa colona, Setaria italica, Leymus cinereus x Leymus triticoides, Avena sativa, Pseudoroegneria spicata, Secale cereale, Saccharum officinarum, Panicum virgatum, Triticum aestivum
MGLTFTKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATTGEGLYEGLDWLSSNIASKS

SEQ ID NO: 24202 - protein, 181 aa, Triticum aestivum
MGLTFTKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATTGEGLYEGLDWLSSNIASKP

SEQ ID NO: 24203 - protein, 181 aa, Arabidopsis thaliana
  Sequence also found in Organisms: Amaranthus tuberculatus
MGLSFGKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATSGEGLYEGLDWLSNNIASKA

SEQ ID NO: 24204 - protein, 181 aa, Sorghum bicolor
MGLSFTKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATTGEGLYEGLDWLSSNIANKA

SEQ ID NO: 24205 - protein, 181 aa, Allium cepa
MGLAFGKLFSKLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATSGEGLYEGLDWLSSNIASKS

SEQ ID NO: 24206 - protein, 181 aa, Platanus occidentalis
MGLTFGKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATSGEGLYEGLDWLSSNIANKA

SEQ ID NO: 24207 - protein, 181 aa, Brassica napus
  Sequence also found in Organisms: Antirrhinum majus, Arabidopsis lyrata, Brassica juncea, Centaurea maculosa, Cleome gynandra, Cleome spinosa, Solanum melongena, Capsicum annuum, Petunia hybrida and additional organisms as disclosed in Tables xx and yy
MGLSFGKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATSGEGLYEGLDWLSNNIANKA

SEQ ID NO: 24208 - protein, 180 aa, Musa acuminata
MGLTFGKLFSRLFAKKEMRILMVGLDAAGKTTILYKLKLGEIVTTIPTIGFNVETVEYKNISFTVWDVGGQDKIRPLWRHYFQNTQGLIFVVDSNDRDRIVEARDELHRMLNEDELRDAVLLVFANKQDLPNAMNAAEITDKLGLHSLRQRHWYIQSTCATSGEGLYEGLDWLSSNIASK

SEQ ID NO: 24209 - protein, 181 aa, Gossypium hirsutum
  Sequence also found in Organisms: Glycine max, Amaranthus tuberculatus, Beta vulgaris, Daucus carota, Cleome spinosa, Eschscholzia californica, Fraxinus spp, Gossypium raimondii and additional organisms as disclosed in Tables xx and yy
MGLSFTKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATSGEGLYEGLDWLSNNIASKA

SEQ ID NO: 24210 - protein, 181 aa, Cucurbita pepo
MGLTFGKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATSGEGLYEGLDWLSNNIANKA

SEQ ID NO: 24211 - protein, 180 aa, Musa acuminata
  Sequence also found in Organisms: Curcuma longa, Zingiber officinale
MGLTFAKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATSGEGLYEGLDWLSSNIASK

SEQ ID NO: 24212 - protein, 180 aa, Musa acuminata
  Sequence also found in Organisms: Zingiber officinale
MGLSFAKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATSGEGLYEGLDWLSSNIASK

SEQ ID NO: 24213 - protein, 181 aa, Zingiber officinale
MGLTFTKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLNSLRQRHWYIQSTCATSGEGLYEGLDWLSSNIASKA

SEQ ID NO: 24214 - protein, 181 aa, Malus domestica
  Sequence also found in Organisms: Persea americana, Vaccinium corymbosum, Cicer arietinum, Trifolium pratense, Cucumis sativus, Cucurbita pepo, Cyclamen graecum, Eucalyptus grandis and additional organisms as disclosed in Tables xx and yy
MGLTFTKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATSGEGLYEGLDWLSNNIASKA

SEQ ID NO: 24215 - protein, 181 aa, Allium cepa
MGLTFTKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATSGEGLYEGLDWLSSNIASKG

SEQ ID NO: 24216 - protein, 181 aa, Arabidopsis lyrata
  Sequence also found in Organisms: Eutrema halophilum, Eutrema parvulum
MGLNFTKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATSGEGLYEGLDWLSNNIASKA

SEQ ID NO: 24217 - protein, 181 aa, Gossypium hirsutum
  Sequence also found in Organisms: Zea mays
MGLTFTKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATTGEGLYEGLDWLSSNIATKS

SEQ ID NO: 24218 - protein, 181 aa, Pennisetum glaucum
MGLTFTKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATSGEGLYEGLDWLSSNIASKS

SEQ ID NO: 24219 - protein, 181 aa, Hordeum vulgare
  Sequence also found in Organisms: Triticum aestivum
MGLTFTKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATTGEGLYEGLDWLSSNIANKS

SEQ ID NO: 24220 - protein, 181 aa, Cynodon dactylon
MGLTFTKLFSRLFAKREMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATTGEGLYEGLDWLSSNIASKS

SEQ ID NO: 24221 - protein, 181 aa, Brassica napus
  Sequence also found in Organisms: Brassica juncea, Brassica rapa
MGLSFGKLFSKLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATTGEGLYEGLDWLSNNIANKA

SEQ ID NO: 24222 - protein, 181 aa, Echinochloa colona
MGLTFTKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDNLGLHSLRQRHWYIQSTCATTGEGLYEGLDWLSSNIASKS

SEQ ID NO: 24223 - protein, 181 aa, Adiantum capillus-veneris
  Sequence also found in Organisms: Pteridium aquilinum
MGLSFTKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATSGEGLYEGLDWLSGNIASKA

SEQ ID NO: 24224 - protein, 181 aa, Amorphophallus konjac
MGLTFAKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATSGEGLYEGLDWLSSNIVSKA

SEQ ID NO: 24225 - protein, 181 aa, Arabidopsis thaliana
MGLSFAKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATSGEGLYEGLDWLSNNIASKA

SEQ ID NO: 24226 - protein, 181 aa, Cleome gynandra
  Sequence also found in Organisms: Raphanus sativus, Eutrema halophilum
MGLSFAKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATTGEGLYEGLDWLSNNIANKA

SEQ ID NO: 24227 - protein, 181 aa, Oryza sativa
MGLTFTKLFSRLFSKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATTGEGLYEGLDWLSSNIANKA

SEQ ID NO: 24228 - protein, 181 aa, Amsonia hubrichtii
  Sequence also found in Organisms: Aristolochia fimbriata, Castanea mollissima, Quercus alba, Tabernaemontana elegans
MGLTFTKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATSGEGLYEGLDWLSSNIANKA

SEQ ID NO: 24229 - protein, 181 aa, Zostera marina
MGLSFSRLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATSGEGLYEGLDWLSSNIASKA

SEQ ID NO: 24230 - protein, 181 aa, Musa acuminata
MGLTFAKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATSGEGLYEGLDWLSNNIASKA

SEQ ID NO: 24231 - protein, 181 aa, Musa acuminata
MGLTFAKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATTGEGLYEGLDWLSNNIANKA

SEQ ID NO: 24232 - protein, 180 aa, Musa acuminata
MGLSFGKLFSRLFAKKEMRILMVGLDAAGKTTILYKLKLGEIVTTIPTIGFNVETVEYKNISFTVWDVGGQDKIRPLWRHYFQNTQGLIFVVDSNDRDRIVEARDELHRMLNEDELRDAVLLVFANKQDLPNAMNAAEITDKLGLHSLRQRHWYIQSTCATSGEGLYEGLDWLSSNIASK

SEQ ID NO: 24233 - protein, 181 aa, Platanus occidentalis
MGLTFAKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATSGEGLYEGLDWLSSNIANKA

SEQ ID NO: 24234 - protein, 181 aa, Gossypium hirsutum
  Sequence also found in Organisms: Glycine max, Solanum lycopersicum, Abies balsamea, Acacia harpophylla, Ambrosia trifida, Antirrhinum majus, Malus domestica, Aquilegia formosa and additional organisms as disclosed in Tables xx and yy
MGLTFTKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATSGEGLYEGLDWLSNNIANKA

SEQ ID NO: 24235 - protein, 181 aa, Gossypium hirsutum
  Sequence also found in Organisms: Glycine max, Acacia harpophylla, Ambrosia trifida, Aquilegia formosa, Aristolochia fimbriata, Persea americana, Phaseolus vulgaris and additional organisms as disclosed in Tables xx and yy
MGLSFTKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATSGEGLYEGLDWLSNNIANKA

SEQ ID NO: 24236 - protein, 181 aa, Arabidopsis thaliana
  Sequence also found in Organisms: Brassica napus, Arabidopsis lyrata, Brassica oleracea, Brassica rapa, Raphanus sativus
MGLSFGKLFSKLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATSGEGLYEGLDWLSNNIANKA

SEQ ID NO: 24237 - protein, 180 aa, Musa acuminata
MGLSFAKLFSRLFAKKEMRILMVGLDAAGKTTILYKLKLGEIVTTIPTIGFNVETVEYKNISFTVWDVGGQDKIRPLWRHYFQNTQGLIFVVDSNDRDRIVEARDELHRMLNEDELRDAVLLVFANKQDLPNAMNAAEITDKLGLHSLRQRHWYIQSTCATSGEGLYEGLDWLSSNIASK

SEQ ID NO: 24238 - protein, 181 aa, Catharanthus roseus
MGLTFTKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELREAVLLVFANKQDLPNAMNAAEITDKLGLHSLRQRHWYIQSTCATSGEGLYEGLDWLSSNIANKA

SEQ ID NO: 24239 - protein, 181 aa, Centaurea maculosa
  Sequence also found in Organisms: Cirsium arvense
MGMSFGKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATSGEGLYEGLDWLSNNIAGKA

SEQ ID NO: 24240 - protein, 181 aa, Artemisia annua
  Sequence also found in Organisms: Chrysanthemum coronarium
MGLSFGKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLQSLRQRHWYIQSTCATSGEGLYEGLDWLSNNIANKA

SEQ ID NO: 24241 - protein, 181 aa, Cirsium arvense
MGLSFTKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATSGEGLYEGLDWLSTNIANKA

SEQ ID NO: 24242 - protein, 181 aa, Cleome spinosa
  Sequence also found in Organisms: Cucurbita pepo, Cucumis melo, Momordica charantia, Citrullus lanatus
MGLTFAKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATSGEGLYEGLDWLSNNIANKA

SEQ ID NO: 24243 - protein, 181 aa, Cucurbita pepo
MGLTFTKLFSKLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATSGEGLYEGLDWLSNNIASKA

SEQ ID NO: 24244 - protein, 181 aa, Amaranthus tuberculatus
  Sequence also found in Organisms: Cleome gynandra, Euonymus alatus, Solanum tuberosum, Solanum phureja
MGLSFTKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELREAVLLVFANKQDLPNAMNAAEITDKLGLHSLRQRHWYIQSTCATSGEGLYEGLDWLSNNIASKA

SEQ ID NO: 24245 - protein, 180 aa, Zingiber officinale
MGLPFAKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATSGEGLYEGLDWLSNNIASK

SEQ ID NO: 24246 - protein, 181 aa, Actinidia deliciosa
MGLTFTKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAALLVFANKQDLPNAMNAAEITDKLGLHSLRQRHWYIQSTCATSGEGLYEGLDWLSNNIASKA

SEQ ID NO: 24247 - protein, 181 aa, Euphorbia peplus
  Sequence also found in Organisms: Glycyrrhiza uralensis, Platanus occidentalis
MGLTFTKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATSGEGLYEGLDWLSNNIATKA

SEQ ID NO: 24248 - protein, 181 aa, Tropaeolum majus
  Sequence also found in Organisms: Solanum phureja
MGLSFGKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATSGEGLYEGLDWLSNNIANKS

SEQ ID NO: 24249 - protein, 181 aa, Tropaeolum majus
MGLSFAKLFSRLFAKKEMRILMVGLDAAGKTTILYKLKLGEIVTTIPTIGFNVETVEYKNISFTVWDVGGQDKIRPLWRHYFQNTQGLIFVIDSNDRDRVVEARDELHRMLNEDELRDAVLLVFANKQDLPNAMNAAEITDKLGLHSLRQRHWYIQSTCATSGEGLYEGLDWLSNNIASKA

SEQ ID NO: 24250 - protein, 181 aa, Raphanus sativus
MGVSFGKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATSGEGLYEGLDWLSNNIANKA

SEQ ID NO: 24251 - protein, 181 aa, Raphanus sativus
MGLSFGKLFSTLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATSGEGLYEGLDWLSNNIANKA

SEQ ID NO: 24252 - protein, 181 aa, Arabidopsis thaliana
  Sequence also found in Organisms: Brassica napus, Arabidopsis lyrata, Brassica juncea, Brassica oleracea, Brassica rapa, Raphanus sativus, Eutrema halophilum
MGLSFAKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATSGEGLYEGLDWLSNNIAGKA

SEQ ID NO: 24253 - protein, 181 aa, Oryza sativa
MGLTFTKLFSRLFAKKEMRILMVGLDAAGKTTILYKLKLGEIVTTIPTIGFNVETVEYKNISFTVWDVGGQDKIRPLWRHYFQNTQGLIFVVDSNDRERVVEARDELHRMLNEDELRDAVLLVFANKQDLPNAMNAAEITDKLGLHSLRQRHWYIQSTCATSGEGLYEGLDWLSNNIASKA

SEQ ID NO: 24254 - protein, 181 aa, Rosmarinus officinalis
MGLTFTKLFSRLFAKREMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATSGEGLYEGLDWLSNNIASKA

SEQ ID NO: 24255 - protein, 181 aa, Spinacia oleracea
MGLSFGKLFSRLFSKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELKDAVLLVFANKQDLPNAMNAAEITDKLGLHSLRQRHWYIQSTCATSGEGLYEGLDWLSNNIASKA

SEQ ID NO: 24256 - protein, 181 aa, Pennisetum glaucum
  Sequence also found in Organisms: Cenchrus ciliaris, Echinochloa colona, Festuca arundinacea, Setaria italica, Panax ginseng, Lolium multiflorum, Panicum virgatum
MGLSFGKLFSRLFAKKEMRILMVGLDAAGKTTILYKLKLGEIVTTIPTIGFNVETVEYKNISFTVWDVGGQDKIRPLWRHYFQNTQGLIFVVDSNDRERVVEARDELHRMLNEDELRDAVLLVFANKQDLPNAMNAAEITDKLGLHSLRQRHWYIQSTCATSGEGLYEGLDWLSNNIANKA

SEQ ID NO: 24257 - protein, 181 aa, Valeriana officinalis
MGLTFTKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATSGEGLYEGLDWLSNNIASRA

SEQ ID NO: 24258 - protein, 181 aa, Jatropha curcas
MGLSFAKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATSGEGLYEGLEWLSNNIASKA

SEQ ID NO: 24259 - protein, 181 aa, Brassica oleracea
MGLSFGKLFSKLFAKKEMRILMVGLDAAGKTTILYKFKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATTGEGLYEGLDWLSNNIANKA

SEQ ID NO: 24260 - protein, 181 aa, Manihot esculenta
  Sequence also found in Organisms: Carica papaya, Sciadopitys verticillata
MGLTFTKLFSRLFAKKEMRILMVGLDAAGKTTILYKLKLGEIVTTIPTIGFNVETVEYKNISFTVWDVGGQDKIRPLWRHYFQNTQGLIFVVDSNDRDRIVEARDELHRMLNEDELRDAVLLVFANKQDLPNAMNAAEITDKLGLHSLRQRHWYIQSTCATSGEGLYEGLDWLSNNIASKA

SEQ ID NO: 24261 - protein, 181 aa, Cenchrus ciliaris
MGLTFTKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLNSLRQRHWYIQSTCATSGEGLYEGLDWLSSNIASKS

SEQ ID NO: 24262 - protein, 181 aa, Hevea brasiliensis
MGLSFTKLFSRLFAKKEMRILMVGLDAAGKTTILYKLKLGEIVTTIPTIGFNVETVEYKNISFTVWDVGGQDKIRPLWRHYFQNTQGLIFVVDSNDRDRIVEARDELHRMLNEDELRDAVLLVFANKQDLPNAMNAAEITDKLGLHSLRQRHWYIQSTCATSGEGLYEGLDWLSNNIASKA

SEQ ID NO: 24263 - protein, 181 aa, Cynodon dactylon
  Sequence also found in Organisms: Echinochloa colona, Setaria italica, Saccharum officinarum, Panicum virgatum
MGLTFTKLFSRLFSKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATTGEGLYEGLDWLSNNIANKA

SEQ ID NO: 24264 - protein, 181 aa, Arnica chamissonis
  Sequence also found in Organisms: Cirsium arvense, Tropaeolum majus
MGLSFTKLFSRLFAKREMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATSGEGLYEGLDWLSNNIASKA

SEQ ID NO: 24265 - protein, 181 aa, Daucus carota
  Sequence also found in Organisms: Medicago truncatula
MGLSFTKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATSGEGLYEGLDWLSNNIASKS

SEQ ID NO: 24266 - protein, 181 aa, Gossypium hirsutum
  Sequence also found in Organisms: Arabidopsis lyrata, Theobroma cacao, Cleome gynandra, Euonymus alatus, Gossypium raimondii
MGLSFAKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATSGEGLYEGLDWLSNNIANKA

SEQ ID NO: 24267 - protein, 181 aa, Vigna unguiculata
MGLSFTKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATSGEGLYEGLEWLSNNIASKA

SEQ ID NO: 24268 - protein, 181 aa, Cynodon dactylon
MGLSFRKLFSRLFAKKEMRILMVGLDAAGKTTILYKLKLGEIVTTIPTIGFNVETVEYKNISFTVWDVGGQDKIRPLWRHYFQNTQGLIFVVDSNDRERVVEARDELHRMLNEDELRDAVLLVFANKQDLPNAMNAAEITDKLGLHSLRQRHWYIQSTCATSGEGLYEGLDWLSNNIASKA

SEQ ID NO: 24269 - protein, 181 aa, Festuca arundinacea
  Sequence also found in Organisms: Avena sativa
MGLTFGKLFSRLFAKKEMRILMVGLDAAGKTTILYKLKLGEIVTTIPTIGFNVETVEYKNISFTVWDVGGQDKIRPLWRHYFQNTQGLIFVVDSNDRERVVEARDELHRMLNEDELRDAVLLVFANKQDLPNAMNAAEITDKLGLHSLRQRHWYIQSTCATSGEGLYEGLDWLSNNIANKA

SEQ ID NO: 24270 - protein, 181 aa, Theobroma cacao
  Sequence also found in Organisms: Fraxinus spp, Humulus lupulus, Prunus persica, Sarracenia psittacina
MGLTFTKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATSGEGLYEGLEWLSNNIASKA

SEQ ID NO: 24271 - protein, 181 aa, Lippia dulcis
MGLSFTKLFSRLFAKKEMRILMVGLDAAGKTTILYKLKLGEIVTTIPTIGFNVETVEYKNISFTVWDVGGQDKIRPLWRHYFQNTQGLIFVIDSNDRDRVVEARDELHRMLNEDELRDAVLLVFANKQDLPNAMNAAEITDKLGLHSLRQRHWYIQSTCATTGEGLYEGLDWLSNNIANKA

SEQ ID NO: 24272 - protein, 181 aa, Chenopodium quinoa
MGLSFTKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMTAAEITDKLGLHSLRQRHWYIQSTCATSGEGLYEGLDWLSNNIASKA

SEQ ID NO: 24273 - protein, 181 aa, Cucumis melo
  Sequence also found in Organisms: Citrullus lanatus
MGLTFTKLFSRLFSKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATSGEGLYEGLDWLSNNIASKA

SEQ ID NO: 24274 - protein, 181 aa, Amaranthus tuberculatus
MGLSFGKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMTAAEITDKLGLHSLRQRHWYIQSTCATSGEGLYEGLDWLSNNIANKA

SEQ ID NO: 24275 - protein, 181 aa, Daucus carota
MGLSFTKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATSGEGLYEGLDWLSNNIASKG

SEQ ID NO: 24276 - protein, 181 aa, Eschscholzia californica
MGLSFGKLFSRLFAKREMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATSGEGLYEGLDWLSNNIANKA

SEQ ID NO: 24277 - protein, 181 aa, Zea mays
MGLSFGKLFSRLFAKKEMRILMVGLDAAGKTTILYKLKLGEIVTTIPTIGFNVETVEYKNISFTVWDVGGQDKIRPLWRHYFQNTQGLIFVVDSNDRERVVEARDELHRMLNEDELRDAVLLVFANKQDLPNAMNAAEITDKLGLHSLRQRHWYIQSTCATSGEGLYEGLDWLSSNISSKS

SEQ ID NO: 24278 - protein, 181 aa, Raphanus sativus
MGLSFGKLFSKLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATSGEGLYEGLDWLSNNIAGKA

SEQ ID NO: 24279 - protein, 181 aa, Scabiosa columbaria
MGLTFTKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATSGEGLYEGLDWLSNNIASKS

SEQ ID NO: 24280 - protein, 181 aa, Sciadopitys verticillata
MGLTFTKLFQRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATSGEGLYEGLDWLSNNIASKA

SEQ ID NO: 24281 - protein, 181 aa, Saccharum officinarum
MGLSFGKLFSRLFAKKEMRILMVGLDAAGKTTILYKLKLGEIVTTIPTIGFNVETVEYKNISFTVWDVGGQDKIRPLWRHYFQNTQGLIFVVDSNDRERVVEARDELHRMLNEDELRDAVLLVFANKQDLPNAMNAAEITDKLGLHSLRQRHWYIQSTCATSGEGLYEGLDWLSNNIASKS

SEQ ID NO: 24282 - protein, 180 aa, Amaranthus tuberculatus
GLSFGKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELREAVLLVFANKQDLPNAMNAAEITDKLGLHSLRQRHWYIQSTCATSGEGLYEGLDWLSNNIASKA

SEQ ID NO: 24283 - protein, 181 aa, Amorphophallus konjac
MGLSFTKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATSGEGLYEGLDWLSNNIASKV

SEQ ID NO: 24284 - protein, 181 aa, Gossypium hirsutum
MGLSFTKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSACATSGEGLYEGLDWLSNNIASKA

SEQ ID NO: 24285 - protein, 181 aa, Cyamopsis tetragonoloba
MGLCFTKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATSGEGLYEGLDWLSNNIANKA

SEQ ID NO: 24286 - protein, 181 aa, Lupinus angustifolius
MGLSFTKLFSRLFAKKEMRILMVGLDAAGKTTILYKLKLGEIVTTIPTIGFNVETVEYKNISFTVWDVGGQDKIRPLWRHYFQNTQGLIFVIDSNDRDRVVEARDELHRMLNEDELRDAVLLVFANKQDLPNAMNAAEITDKLGLHSLRQRHWYIQSTCATSGEGLYEGLDWLSNNIASKA

SEQ ID NO: 24287 - protein, 181 aa, Quercus alba
MGLTFTKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATSGEGLYEGLEWLSSNIANKA

SEQ ID NO: 24288 - protein, 181 aa, Allium cepa
MGLTFTKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATSGEGLYEGLEWLSSNIASKG

SEQ ID NO: 24289 - protein, 181 aa, Solanum lycopersicum
  Sequence also found in Organisms: Solanum melongena, Nicotiana benthamiana, Petunia hybrida, Nicotiana tabacum
MGLSFGKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATSGEGLYEGLDWLSNNIANKG

SEQ ID NO: 24290 - protein, 181 aa, Pteridium aquilinum
MGLSFTKLFQRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATSGEGLYEGLDWLSNNIASKA

SEQ ID NO: 24291 - protein, 181 aa, Cleome gynandra
MGLSFAKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATTGEGLYEGLDWLSNNIANKS

SEQ ID NO: 24292 - protein, 181 aa, Brassica juncea
MGLSFGKLFSRLFAKKEMRILMVGLDAAGKTTILYRLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATSGEGLYEGLDWLSNNIANKA

SEQ ID NO: 24293 - protein, 181 aa, Brassica napus
  Sequence also found in Organisms: Brassica juncea, Brassica oleracea, Brassica rapa, Raphanus sativus
MGLNFTKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATSGEGLYEGLDWLSNNIANKA

SEQ ID NO: 24294 - protein, 181 aa, Actinidia deliciosa
MGLTFTKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAILLVFANKQDLPNAMNAAEITDKLGLHSLRQRHWYIQSTCATSGEGLYEGLDWLSNNIASKA

SEQ ID NO: 24295 - protein, 181 aa, Vicia sativa
MGLTFTKLFNRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATSGEGLYEGLDWLSNNIASKA

SEQ ID NO: 24296 - protein, 181 aa, Acacia harpophylla
  Sequence also found in Organisms: Chrysanthemum coronarium, Fraxinus spp, Ananas comosus, Camellia sinensis, Utricularia gibba
MGLTFTKLFSRLFAKREMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATSGEGLYEGLDWLSNNIANKA

SEQ ID NO: 24297 - protein, 181 aa, Amaranthus tuberculatus
MGLSFTKLFSRLFSKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATSGEGLYEGLDWLSNNIASKG

SEQ ID NO: 24298 - protein, 181 aa, Amborella trichopoda
  Sequence also found in Organisms: Amorphophallus konjac, Amsonia hubrichtii, Citrus clementina, Cocos nucifera, Gnetum gnemon, Hevea brasiliensis, Ipomoea batatas, Ipomoea nil, Elaeis guineensis, Podocarpus macrophillus
MGLTFTKLFSRLFAKKEMRILMVGLDAAGKTTILYKLKLGEIVTTIPTIGFNVETVEYKNISFTVWDVGGQDKIRPLWRHYFQNTQGLIFVVDSNDRDRIVEARDELHRMLNEDELRDAVLLVFANKQDLPNAMNAAEITDKLGLHSLRQRHWYIQSTCATSGEGLYEGLDWLSNNIANKA

SEQ ID NO: 24299 - protein, 181 aa, Amsonia hubrichtii
  Sequence also found in Organisms: Malus domestica, Fagus grandifolia, Castanea mollissima, Tropaeolum majus, Quercus alba, Platanus occidentalis, Prunus persica, Prunus mume, Rosa hybrid cultivar, Rosmarinus officinalis, Fragaria vesca, Tripterygium wilfordii
MGLSFTKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELREAVLLVFANKQDLPNAMNAAEITDKLGLHSLRQRHWYIQSTCATSGEGLYEGLDWLSNNIANKA

SEQ ID NO: 24300 - protein, 181 aa, Brassica juncea
MGVSFGKLFSKLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATSGEGLYEGLDWLSNNIANKA

SEQ ID NO: 24301 - protein, 181 aa, Musa acuminata
MGLTFAKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVIEARDELHRMLNEDELRDAVLLVFANKQDLPNAMNAAEITDKLGLHSLRQRHWYIQSTCATSGEGLYEGLDWLSNNIANKA

SEQ ID NO: 24302 - protein, 181 aa, Manihot esculenta
  Sequence also found in Organisms: Linum usitatissimum
MGLSFTKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLNSLRQRHWYIQSTCATSGEGLYEGLDWLSNNIANKA

SEQ ID NO: 24303 - protein, 181 aa, Ocimum basilicum
  Sequence also found in Organisms: Daucus carota, Cicer arietinum, Petroselinum crispum, Sarracenia psittacina, Triphysaria pusilla
MGLSFTKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATSGEGLYEGLDWLSNNIANKG

SEQ ID NO: 24304 - protein, 181 aa, Conyza canadensis
MGLSFTKLFSRLFAKREMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLQSLRQRHWYIQSTCATSGEGLYEGLDWLSSNIANKA

SEQ ID NO: 24305 - protein, 181 aa, Gossypium hirsutum
  Sequence also found in Organisms: Taraxacum officinale, Gossypium raimondii, Primula obconica
MGLTFTKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLNSLRQRHWYIQSTCATSGEGLYEGLDWLSNNIANKA

SEQ ID NO: 24306 - protein, 181 aa, Phaseolus vulgaris
  Sequence also found in Organisms: Vigna unguiculata, Cyamopsis tetragonoloba, Vitis vinifera, Chenopodium quinoa, Rosa hybrid cultivar, Spinacia oleracea, Fragaria vesca, Vinca minor
MGLTFTKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELREAVLLVFANKQDLPNAMNAAEITDKLGLHSLRQRHWYIQSTCATSGEGLYEGLDWLSNNIANKA

SEQ ID NO: 24307 - protein, 181 aa, Abies balsamea
  Sequence also found in Organisms: Cedrus atlantica, Cephalotaxus harringtonia, Cryptomeria japonica, Cycas rumphii, Pinus pinaster, Pinus taeda, Pseudotsuga menziesii, Sequoia sempervirens, Picea glauca, Taxus baccata, Zamia vazquezii
MGLTFTKLFQRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATSGEGLYEGLDWLSNNIANKA

SEQ ID NO: 24308 - protein, 181 aa, Chelidonium majus
  Sequence also found in Organisms: Cynara scolymus, Eschscholzia californica, Panax ginseng, Mimulus guttatus, Olea europaea, Allium cepa, Papaver somniferum, Senecio madagascariensis, Triphysaria pusilla
MGLSFTKLFSRLFAKREMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATSGEGLYEGLDWLSNNIANKA

SEQ ID NO: 24309 - protein, 181 aa, Oryza sativa
  Sequence also found in Organisms: Sorghum bicolor, Hordeum vulgare, Brachypodium distachyon, Cynodon dactylon, Echinochloa colona, Festuca arundinacea, Setaria italica and additional organisms as disclosed in Tables xx and yy
MGLTFTKLFSRLFAKKEMRILMVGLDAAGKTTILYKLKLGEIVTTIPTIGFNVETVEYKNISFTVWDVGGQDKIRPLWRHYFQNTQGLIFVVDSNDRERVVEARDELHRMLNEDELRDAVLLVFANKQDLPNAMNAAEITDKLGLHSLRQRHWYIQSTCATSGEGLYEGLDWLSNNIANKA

SEQ ID NO: 24310 - protein, 181 aa, Euonymus alatus
MGLSFTKLFSRLFAKKEMRILMVGLDAAGKTTILYKLKLGEIVTTIPTIGFNVETVEYKNISFTVWDVGGQDKIRPLWRHYFQNTQGLIFVVDSNDRDRAVEARDELHRMLNEDELREAVLLVFANKQDLPNAMNAAEITDKLGLHSLRQRHWYIQSTCATSGEGLYEGLDWLSNNIASKA

SEQ ID NO: 24311 - protein, 181 aa, Solanum lycopersicum
  Sequence also found in Organisms: Daucus carota, Fagopyrum esculentum, Humulus lupulus, Petroselinum crispum, Phalaenopsis aphrodite, Plantago ovata, Rosmarinus officinalis, Valeriana officinalis, Vinca minor
MGLSFTKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATSGEGLYEGLDWLSNNIANKS

SEQ ID NO: 24312 - protein, 180 aa, Zingiber officinale
MGLTFAKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATSGEGLYEGLDWLSNNIANK

SEQ ID NO: 24313 - protein, 181 aa, Panax ginseng
MGLSFTKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEAKDELHRMLNEDELRDAVLLVFANKQDLPNAMNAAEITDKLGLHSLRQRHWYIQSTCATSGEGLYEGLDWLSNNIANKA

SEQ ID NO: 24314 - protein, 181 aa, Panax ginseng
MGLSFTKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLSLHSLRQRHWYIQSTCATSGEGLYEGLDWLSNNIANKA

SEQ ID NO: 24315 - protein, 181 aa, Panax ginseng
MGLSFTKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDMPNAMNAAEITDKLGLHSLRQRHWYIQSTCATSGEGLYEGLDWLSNNIANKA

SEQ ID NO: 24316 - protein, 181 aa, Panax ginseng
MGLSFTKLFSRLFAKKEMRILMVGLDAAGKTTILYKLKLGEIVTTIPTIGFNVETVEYKNISFTVWDVGGQDKIRPLWRHYFQNTQGLIFVVDSNDRERVVEARDELHRMLNEDELRDAVLLVFANKQDLPNAMNAAEITDKLGLHSLRQRHWYIQSTCATSGEGLYEGLDWLSNNIANKA

SEQ ID NO: 24317 - protein, 181 aa, Carpinus betulus
MGLSFTKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVAEARDELHRMLNEDELRDAVLLVFANKQDLPNAMNAAEITDKLGLHSLRQRHWYIQSTCATSGEGLYEGLDWLSNNIANKA

SEQ ID NO: 24318 - protein, 181 aa, Mesembryanthemum crystallinum
MGLSFTKLFSRLFAKKEMRILMVGLDAAGKTTILYKLKLGEIVTTIPTIGFNVETVEYKNISFTVWDVGGQDKIRPLWRHYFQNTQGLIFVVDSNDRDRAVEARDELHRMLNEDELRDAVLLVFANKQDLPNAMTAAEITDKLGLHSLRQRHWYIQSTCATSGEGLYEGLDWLSNNIASKA

SEQ ID NO: 24319 - protein, 181 aa, Ipomoea nil
  Sequence also found in Organisms: Jatropha curcas, Elaeis guineensis, Ananas comosus
MGLSFTKLFSRLFAKKEMRILMVGLDAAGKTTILYKLKLGEIVTTIPTIGFNVETVEYKNISFTVWDVGGQDKIRPLWRHYFQNTQGLIFVVDSNDRDRIVEARDELHRMLNEDELRDAVLLVFANKQDLPNAMNAAEITDKLGLHSLRQRHWYIQSTCATSGEGLYEGLDWLSNNIANKA

SEQ ID NO: 24320 - protein, 181 aa, Actinidia deliciosa
MGLSFTKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVIEARDELHRMLNEDELRDAVLLVFANKQDLPNAMNAAEITDKLGLHSLRQRHWYIQSTCATSGEGLYEGLDWLSNNIATKA

SEQ ID NO: 24321 - protein, 181 aa, Liriodendron tulipifera
MGLTFTKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSACATSGEGLYEGLEWLSNNIASKA

SEQ ID NO: 24322 - protein, 181 aa, Zea mays
  Sequence also found in Organisms: Sorghum bicolor
MGLSFGKLFSRLFAKKEMRILMVGLDAAGKTTILYKLKLGEIVTTIPTIGFNVETVEYKNISFTVWDVGGQDKIRPLWRHYFQNTQGLIFVVDSNDRERVVEARDELHRMLNEDELRDAVLLVFANKQDLPNAMNAAEITDKLGLHSLRQRHWYIQSTCATSGEGLYEGLDWLSNNIANKS

SEQ ID NO: 24323 - protein, 181 aa, Nicotiana benthamiana
  Sequence also found in Organisms: Nicotiana tabacum
MGLSFGKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELREAVLLVFANKQDLPNAMNAAEITDKLGLHSLRQRHWYIQSTCATSGEGLYEGLDWLSNNISNKA

SEQ ID NO: 24324 - protein, 181 aa, Nicotiana benthamiana
MGLSFGKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATSGEGLYEGLDWLSNNIANFV

SEQ ID NO: 24325 - protein, 181 aa, Nicotiana benthamiana
  Sequence also found in Organisms: Scabiosa columbaria, Solanum phureja, Nicotiana tabacum, Valeriana officinalis
MGLTFTKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATSGEGLYEGLDWLSNNIANKS

SEQ ID NO: 24326 - protein, 181 aa, Nuphar advena
MGLTFTKLFSRLFAKREMRILMVGLDAAGKTTILYKLKLGEIVTTIPTIGFNVETVEYKNISFTVWDVGGQDKIRPLWRHYFQNTQGLIFVVDSNDRDRVIEARDELHRMLNEDELRDAVLLVFANKQDLPNAMNAAEITDKLGLHSLRQRHWYIQSTCATSGEGLYEGLDWLSNNIASKA

SEQ ID NO: 24327 - protein, 181 aa, Nuphar advena
MGLTFTKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVIEARDELHRMLNEDELRDAVLLVFANKQDLPNAMNAAEITDKLGLQSLRQRHWYIQSTCATSGEGLYEGLDWLSNNIASKA

SEQ ID NO: 24328 - protein, 181 aa, Carica papaya
MGLSFAKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATSGEGLYEGLEWLSNNIANKA

SEQ ID NO: 24329 - protein, 181 aa, Petunia hybrida
MGLSFTKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELREAVLLVFANKQDLPNAMNAAEITDKLGLHSLRQRHWYIQSTCATSGEGLYEGLDWLSNNIASKS

SEQ ID NO: 24330 - protein, 181 aa, Raphanus sativus
MGLSFGKLFSKLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCTTSGEGLYEGLDWLSNNIANKA

SEQ ID NO: 24331 - protein, 181 aa, Solanum phureja
MGLTFTKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSACATSGEGLYEGLDWLSNNIANKA

SEQ ID NO: 24332 - protein, 181 aa, Glycine max
  Sequence also found in Organisms: Manihot esculenta
MGLSFTKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATSGEGLYEGLEWLSNNIANKA

SEQ ID NO: 24333 - protein, 181 aa, Tabernaemontana elegans
MGLTFTKLFSRLFAKKEMRILMVGLDAAGKTTILYKLKLGEIVTTIPTIGFNVETVEYKNISFTVWDVGGQDKIRPLWRHYFQNTQGLIFVVDSNDRDRIVEARDELHRMLNEDELREAVLLVFANKQDLPNAMNAAEITDKLGLHSLRQRHWYIQSTCATSGEGLYEGLDWLSNNIASKA

SEQ ID NO: 24334 - protein, 181 aa, Solanum lycopersicum
MGLTFTKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVGEARDELHRMLNEDELRDAVLLVFANKQDLPNAMNAAEITDKLGLHSLRQRHWYIQSTCATSGEGLYEGLDWLSNNIANKA

SEQ ID NO: 24335 - protein, 181 aa, Flaveria ramosissima
  Sequence also found in Organisms: Juglans hindsii x Juglans regia
MGLTFTKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATSGEGLYEGLEWLSNNIANKA

SEQ ID NO: 24336 - protein, 178 aa, Pennisetum glaucum
SFGKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATSGEGLYEGLDWLSSNIASKS

SEQ ID NO: 24337 - protein, 181 aa, Petroselinum crispum
  Sequence also found in Organisms: Lippia dulcis
MGLSFTKLFSRLFAKKEMRILMVGLDAAGKTTILYKLKLGEIVTTIPTIGFNVETVEYKNISFTVWDVGGQDKIRPLWRHYFQNTQGLIFVVDSNDRDRAVEARDELHRMLNEDELRDAVLLVFANKQDLPNAMNAAEITDKLGLHSLRQRHWYIQSTCATSGEGLYEGLDWLSNNIANKA

SEQ ID NO: 24338 - protein, 181 aa, Brassica rapa
MGLSFAKLFSKLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATSGEGLYEGLDWLSNNIAGKA

SEQ ID NO: 24339 - protein, 181 aa, Heritiera littoralis
MGLTFTKLFSWLFAKKEMRILMVGLDAAGKTTILYKLKLGEIVTTIPTIGFNVETVEYKNISFTVWDVGGQDKIRPLWRHYFQNTQGLIFVVDSNDRDRIVEARDELHRMLNEDELRDAVLLVFANKQDLPNAMNAAEITDKLGLHSLRQRHWYIQSTCATSGEGLYEGLDWLSNNIASKA

SEQ ID NO: 24340 - protein, 181 aa, Eutrema halophilum
  Sequence also found in Organisms: Eutrema parvulum
MGLSFAKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVSEARDELHRMLNEDELRDAVLLVFANKQDLPNAMNAAEITDKLGLHSLRQRHWYIQSTCATSGEGLYEGLDWLSNNIAGKA

SEQ ID NO: 24341 - protein, 181 aa, Ricinus communis
MGLSFTKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLNSLRQRHWYIQSTCATSGEGLYEGLEWLSNNIASKA

SEQ ID NO: 24342 - protein, 181 aa, Gossypium hirsutum
  Sequence also found in Organisms: Gossypium raimondii
MGLSFAKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATSGEGLYEGLDWLSNNIANKG

SEQ ID NO: 24343 - protein, 181 aa, Panax ginseng
MGLSFTKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVIEARDELHRMLNEDELRDAVLLVFANKQDLPNAMNAAEITDKLGLHSLRQRHWYIQSTCATSGEGLYEGLDWLSNNIANKA

SEQ ID NO: 24344 - protein, 181 aa, Castanea mollissima
  Sequence also found in Organisms: Carpinus betulus
MGLTFTKLFSKLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELREAVLLVFANKQDLPNAMNAAEITDKLGLHSLRQRHWYIQSTCATSGEGLYEGLDWLSNNIASKA

SEQ ID NO: 24345 - protein, 181 aa, Elaeis guineensis
MGLTFTKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATSGEGLYEGLDWLSNNIANKV

SEQ ID NO: 24346 - protein, 181 aa, Ananas comosus
MGLTFTKLFSRLFAKKEMRILMVGLDAAGKTTILYKLKLGEIVTTIPTIGFNVETVEYKNISFTVWDVGGQDKIRPLWRHYFQNTQGLIFVVDSNDRDRIVEARDELHRMLNEDELRDAVLLVFANKQDLPNAMNAAEITDKLGLHSLRQRHWYIQSTCATSGEGLYEGLDWLSNNIASKG

SEQ ID NO: 24347 - protein, 181 aa, Silene vulgaris
MGLTFTKLFSRLFAKKEMRILMVGLDAAGKTTILYKLKLGEIVTTIPTIGFNVETVEYKNISFTVWDVGGQDKIRPLWRHYFQNTQGLIFVVDSNDRDRAVEARDELHRMLNEDELRDAVLLVFANKQDLPNAMNAAEITDKLGLHSLRQRHWYIQSTCATSGEGLYEGLDWLSNNIANKA

SEQ ID NO: 24348 - protein, 181 aa, Aquilegia formosa
  Sequence also found in Organisms: Thalictrum flavum
MGLTFTKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDRLGLHSLRQRHWYIQSTCATSGEGLYEGLDWLSNNIANKA

SEQ ID NO: 24349 - protein, 181 aa, Chrysanthemum coronarium
  Sequence also found in Organisms: Orobanche aegyptiaca
MGLTFTKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLQSLRQRHWYIQSTCATSGEGLYEGLDWLSNNIANKA

SEQ ID NO: 24350 - protein, 181 aa, Acacia harpophylla
MGLSFTKLFSRLFAKKEMRILMVGLDAAGKTTILYKLKLGEIVTTIPTIGFNVKTVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATSGEGLYEGLDWLSNNIASKG

SEQ ID NO: 24351 - protein, 181 aa, Brassica rapa
MGLSFGKLFSKLFAKKEMRILMVGLDAAGKTTILYKLKLGEIVTTIPTIGFNVETVEYKNISFTVWDVGGQDKIRPLWRHYFQNTQGLISVVDSNDRDRVVEARDELHRMLNEDELRDAVLLVFANKQDLPNAMNAAEITDKLGLHSLRQRHWYIQSTCATSGEGLYEGLDWLSNNIANKA

SEQ ID NO: 24352 - protein, 181 aa, Fagus grandifolia
MGLTFTKLFSRLFAKKEMRILMVGLDAAGKTTILYKLKLGEIVTTIPTIGFNVETVEYKNISFTVWDVGGQDKIRPLWRHYFQNTQGLIFVVDSNDRDRIVEARDELHRMLNEDELRDAVLLVFANKQDLPNAMNAAEITDKLGLNSLRQRHWYIQSTCATSGEGLYEGLDWLSSNIANKA

SEQ ID NO: 24353 - protein, 181 aa, Cannabis sativa
MGLSFGKLFSKLFAKKEMRILMVGLDAAGKTTILYKLKLGEIVTTIPTIGFNVETVEYKNISFTVWDVGGQDKIRPLWRHYFQNTQGLIFVVDSNDRDRAVEARDELHRMLNEDELRDAVLLVFANKQDLPNAMNAAEITDKLGLHSLRQRHWYIQSTCATSGEGLYEGLDWLSNNIANKA

SEQ ID NO: 24354 - protein, 181 aa, Gossypium hirsutum
MGLSFTKLFSRLFAKKEMRILMVGLDAAGKTTILYKLKLGEIVTTIPTIGFNVETVEYKNISFTVWDVGGQDKIRPLWRHYFQNMQGLIFVVDSNDRDRVVEARDELHRMLNEDELRDAVLLVFANKQDLPNAMNAAEITDKLGLHSLRQRHWYIQSTCATSGEGLYEGLDWLSNNIANKA

SEQ ID NO: 24355 - protein, 181 aa, Euonymus alatus
MGLSFGKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEAKDELHRMLNEDELRDAVLLVFANKQDLPNAMNAAEITDKLGLHSLRQRHWYIQSTCATSGEGLYEGLDWLSNNIANKG

SEQ ID NO: 24356 - protein, 181 aa, Adiantum capillus-veneris
MGLTFTKLFQRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATSGEGLYEGLDWLSGNIASKG

SEQ ID NO: 24357 - protein, 181 aa, Gnetum gnemon
MGLTFTKLFQRLFAKKEMRILMVGLDAAGKTTILYKLKLGEIVTTIPTIGFNVETVEYKNISFTVWDVGGQDKIRPLWRHYFQNTQGLIFVVDSNDRDRIVEARDELHRMLNEDELRDAVLLVFANKQDLPNAMNAAEITDKLGLHSLRQRHWYIQSTCATSGEGLYEGLDWLSNNIASKA

SEQ ID NO: 24358 - protein, 181 aa, Zea mays
MGLTFTKLFSRLFSKKEMRILMVGLDAAGKTTILYKLKLGEIVTTIPTIGFNVETVEYKNISFTVWDVGGQDKIRPLWRHYFQNTQGLIFVVDSNDRDRVVEAKDELHRMLNEDELRDAVLLVFANKQDLPNAMNAAEITDKLGLHSLRQRHWYIQSTCATTGEGLYEGLDWLSNNIANKA

SEQ ID NO: 24359 - protein, 181 aa, Vicia sativa
MGLTFTKLFNRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATSGEGLYEGLDWLSNNIANKA

SEQ ID NO: 24360 - protein, 181 aa, Orobanche aegyptiaca
MGLTFTKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITEKLGLHSLRQRHWYIQSTCATSGEGLYEGLDWLSNNIANKA

SEQ ID NO: 24361 - protein, 181 aa, Musa acuminata
MGLTFTKLFSRLFAKKEMRILMVGLDAAGKTTILYKLKLGEIVTTIPTIGFNVETVEYKNISFTVWDVGGQDKIRPLWRHYFQNTQGLIFVVDSNDRDRIVEAKDELHRMLNEDELRDAVLLVFANKQDLPNAMNAAEITDKLGLHSLRQRHWYIQSTCATSGEGLYEGLDWLSNNIASKA

SEQ ID NO: 24362 - protein, 181 aa, Phaseolus vulgaris
MGLSFTKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELREAVLLVFANKQDLPNAMNAAEITDKLGLHSLRQRHWYIQSTCATSGEGLYEGLEWLSNNIASKA

SEQ ID NO: 24363 - protein, 180 aa, Bupleurum chinense
GLSFTKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATSGEGLYEGLDWLSNNIANKA

SEQ ID NO: 24364 - protein, 181 aa, Citrus clementina
  Sequence also found in Organisms: Citrus sinensis
MGLSFTKLFSKLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATSGEGLYEGLDWLSNNIATKA

SEQ ID NO: 24365 - protein, 181 aa, Heritiera littoralis
MGLSFAKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLNSLRQRHWYIQSTCATSGEGLYEGLDWLSNNIANKA

SEQ ID NO: 24366 - protein, 181 aa, Mimulus guttatus
MGLSFSKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATSGEGLYEGLDWLSNNIANKG

SEQ ID NO: 24367 - protein, 181 aa, Phalaenopsis aphrodite
MGLTFTKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVIEARDELHRMLNEDELRDAVLLVFANKQDLPNAMNAAEITDKLGLHSLRQRHWYIQSTCATSGEGLYEGLDWLSSNIANKG

SEQ ID NO: 24368 - protein, 181 aa, Salvia sclarea
MGLSFTKLFSRLFAKKEMRILMVGLDAAGKTTILYKLKLGEIVTTIPTIGFTVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATSGEGLYEGLDWLSNNIANKA

SEQ ID NO: 24369 - protein, 181 aa, Tripterygium wilfordii
MGLSFAKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATSGEGLYEGLDWLSNNIANKS

SEQ ID NO: 24370 - protein, 181 aa, Cleome spinosa
MGLSFAKLFSRLFAKREMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATSGEGLYEGLDWLSNNIANKA

SEQ ID NO: 24371 - protein, 182 aa, Conyza canadensis
MGLTFTKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATSGEGLYEGLDWLLNNIANKAS

SEQ ID NO: 24372 - protein, 182 aa, Lippia dulcis
MGLSFTKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATSGEGLYEGLDWLSNNIANKVG

SEQ ID NO: 24373 - protein, 180 aa, Amaranthus tuberculatus
GLSFTKLFSRLFSKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATSGEGLYEGLDWLSNNIASKG

SEQ ID NO: 24374 - protein, 181 aa, Amsonia hubrichtii
MGLTFTKLFSRLFAKKEMRILMVGLDAAGKTTILYKLKLGEIVTTIPTIGFNVETVEYKNISFTVWDVGGQDKIRPLWRHYFQNTQGLIFVVDSNDRDRIVEARDELHRMLNEDELRDAVLLVFANKQDLPNAMNAAEITDKLGLHSLRQRHWYIQSTCATSGEGLYEGLEWLSNNIANKA

SEQ ID NO: 24375 - protein, 181 aa, Catharanthus roseus
  Sequence also found in Organisms: Rosmarinus officinalis
MGLSFAKLFSRLFAKKEMRILMVGLDAAGKTTILYKLKLGEIVTTIPTIGFNVETVEYKNISFTVWDVGGQDKIRPLWRHYFQNTQGLIFVVDSNDRDRIVEARDELHRMLNEDELRDAVLLVFANKQDLPNAMNAAEITDKLGLHSLRQRHWYIQSTCATSGEGLYEGLDWLSNNISNKA

SEQ ID NO: 24376 - protein, 181 aa, Castanea mollissima
  Sequence also found in Organisms: Quercus alba
MGLSFTKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELREAVLLVFANKQDLPNAMNAAEITDKLGLHSLRQRHWYIQSTCATSGEGLYEGLDWLSNNIANKV

SEQ ID NO: 24377 - protein, 181 aa, Gossypium hirsutum
MGLTFTKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLTEDELRDAVLLVFANKQDLPNAMNAAEITDKLGLNSLRQRHWYIQSTCATSGEGLYEGLDWLSNNIANKA

SEQ ID NO: 24378 - protein, 181 aa, Solanum melongena
MGLSFTKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELREAVLLVFANKQDLPNAMNAAEITDKLGLHSLRQRHWYIQSTCATSGEGLYEGLDWLSNNITNKA

SEQ ID NO: 24379 - protein, 181 aa, Solanum melongena
MGLTFTKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNATEITDKLGLHSLRQRHWYIQSTCATSGEGLYEGLDWLSNNIANKS

SEQ ID NO: 24380 - protein, 181 aa, Euonymus alatus
MGLTFTKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLALNSLRQRHWYIQSTCATSGEGLYEGLDWLSNNIANKA

SEQ ID NO: 24381 - protein, 181 aa, Euonymus alatus
MGLSFTKLFSRLFAKREMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELREAVLLVFANKQDLPNAMNAAEITDKLGLHSLRQRHWYIQSTCATSGEGLYEGLDWLSNNIANKA

SEQ ID NO: 24382 - protein, 181 aa, Euonymus alatus
MGLSFTKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELREAVLLVFANKQDLPNAMNAAEITDKLGLHSLRQRHWYIQSACATSGEGLYEGLDWLSNNIANKA

SEQ ID NO: 24383 - protein, 181 aa, Fraxinus spp
MGLTFTKLLSRLFAKKEMRILMVGLDAAGKTTILYKFKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATSGEGLYEGLDWLSNNIANKA

SEQ ID NO: 24384 - protein, 181 aa, Panax ginseng
MGLSFTKLFSRLFAKREMRILMVGLDAAGKTPILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATSGEGLYEGLDWLSNNIANKA

SEQ ID NO: 24385 - protein, 181 aa, Eragrostis curvula
MGLTFTKLFSRLFSKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANNQDLPNAMNAAEITDKLGLHSLRQRHWYIQSTCATTGERLYEGLDWLSNNIANKA

SEQ ID NO: 24386 - protein, 181 aa, Lupinus angustifolius
MGLSFTKLFSRLFAKKEMRILMVGLDAAGKTTILYKLKLGEIVTTIPTIGFNVETVEYKNISFTVWDVGGQDKIRPLWRHYFQNTQGLIFVVDSNDRDRAVEARDELHRMLNEDELRDAVLLVFANKQDLPNAMNAAEITDKLGLHSLRQRHWYIQSTCATSGEGLYEGLDWLSNNIANKG

SEQ ID NO: 24387 - protein, 181 aa, Marchantia polymorpha
MGLTFTKLFQRLFSKKEMRILMVGLDAAGKTTILYKLKLGEIVTTIPTIGFNVETVEYKNISFTVWDVGGQDKIRPLWRHYFQNTQGLIFVVDSNDRDRIVEARDELHRMLNEDELRDAVLLVFANKQDLPNAMNAAEITDKLGLHSLRQRHWYIQSTCATSGEGLYEGLDWLSSNIANKA

SEQ ID NO: 24388 - protein, 181 aa, Nicotiana benthamiana
MGLTFTKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELGDAVLLVFANKKDLPNAMNAAEITDKLGLHSLRQRHWYIQSTCATSGEGLYEGLDWLSNNIANKA

SEQ ID NO: 24389 - protein, 181 aa, Elaeis guineensis
MGLTFTKLFSRLFAKREMRILMVGLDAAGKTTILYKLKLGEIVTTIPTIGFNVETVEYKNISFTVWDVGGQDKIRPLWRHYFQNTQGLIFVVDSNDRDRIVEARDELHRMLNEDELRDAVLLVFANKQDLPNAMNAAEITDKLGLHSLRQRHWYIQSTCATSGEGLYEGLDWLSNNIANKA

SEQ ID NO: 24390 - protein, 181 aa, Phalaenopsis aphrodite
MGLTFTKLFSRLFAKREMRILMVGLDAAGKTTILYKLKLGEIVTTIPTIGFNVETVEYKNISFTVWDVGGQDKIRPLWRHYFQNTQGLIFVVDSNDRDRVIEARDELHRMLNEDELRDAVLLVFANKQDLPNAMNAAEITDKLGLHSLRQRHWYIQSTCATSGEGLYEGLDWLSSNIANKG

SEQ ID NO: 24391 - protein, 181 aa, Solanum tuberosum
MGLSFTKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELREAVLLVFANKQDLPNAMNAAEITDKLGLHSLRQRHWYIQSTCATSGEGLYEGLDWLSNNISNKA

SEQ ID NO: 24392 - protein, 181 aa, Rosmarinus officinalis
MGLSFTKLFSRLFAKKEMRILMVGLDAAGKTTILYKLKLGEIVTTIPTIGFNVETVEYKNISFTVWDVGGQDKIRPLWRHYFQNTQGLIFVVDSDDRDRVVEARDELHRMLNEDELRDAVLLVFANKQDLPNAMNAAEITDKLGLHSLRQRHWYIQSTCATSGEGLYEGLDWLSNNIANKS

SEQ ID NO: 24393 - protein, 181 aa, Picea glauca
MGLTFTKLFQRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMTAAEITDKLGLHSLRQRHWYIQSTCATSGEGLYEGLDWLSNNIANKA

SEQ ID NO: 24394 - protein, 180 aa, Helianthus annuus
MGLTFTKLFSRLFAKKEMRILMVGLDAAGKTTILYKLKLGEIVTTIPTIGFNVETVEYKNISFTVWDVGGQDKIRPLWRHYFQNTQGLIFVVDSKDRDRVVEARDELHRMLNEDELRDAVLLVFANKQDLPNAMNAAEITDKLGLHSLRQRHWYIQSTCATSGEGLYEGLDWLSNNIANK

SEQ ID NO: 24395 - protein, 181 aa, Tabernaemontana elegans
MGLSFTKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELREAVLLVFANKQDLPNAMNAAEITDKLGLHSLRQRHWYIQSTCATSGEGLYEGLDWLSNNIANQA

SEQ ID NO: 24396 - protein, 181 aa, Utricularia gibba
MGLTFTKLFSRLFAKREMRILMVGLDAAGKTTILYKLKLGEIVTTIPTIGFNVETVEYKNISFTVWDVGGQDKIRPLWRHYFQNTQGLIFVVDSNDRDRVIEARDELHRMLNEDELRDAVLLVFANKQDLPNAMNAAEITDKLGLHSLRQRHWYIQTTCATSGEGLYEGLDWLSNNIASKA

SEQ ID NO: 24397 - protein, 180 aa, Vinca minor
MGLTFTKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELREAVLLVFANKQDLPNAMNAAEITDKLGLHSLRQRHWYIQSTCATSGEGLYEGLDWLSNNIANK

SEQ ID NO: 24398 - protein, 181 aa, Vinca minor
MGLTFTKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELREAVLLVFANKQDLPNAMNAAEITDKLGLHSLRQRHWYIQSTCATSGEGLYEGLDWLSNNIANKS

SEQ ID NO: 24399 - protein, 181 aa, Momordica charantia
MGLTFTKLFGRLFSKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATSGEGLYEGLDWLSNNIVSKA

SEQ ID NO: 24400 - protein, 181 aa, Beta vulgaris
MGLSFTKLFSRLFAKKEMRILMVGLDAAGKTTILYKLKLGEIVTTIPTIGFNVETVEYKNISFTVWDVGGQDKIRPLWRHYFQNTQGLIFVVDSNDRDRAVEARDELHRMLNEDELRDAVLLVFANKQDLPNAMTAAEITDKLGLNSLRQRHWYIQSTCATSGEGLYEGLDWLSNNIASKA

SEQ ID NO: 24401 - protein, 181 aa, Cephalotaxus harringtonia
  Sequence also found in Organisms: Taxus baccata
MGLTFTKLFQRMFAKKEMRILMVGLDAAGKTTILYKLKLGEIVTTIPTIGFNVETVEYKNISFTVWDVGGQDKIRPLWRHYFQNTQGLIFVVDSNDRDRIVEARDELHRMLNEDELRDAVLLVFANKQDLPNAMNAAEITDKLGLHSLRQRHWYIQSTCATSGEGLYEGLDWLSNNIASKA

SEQ ID NO: 24402 - protein, 181 aa, Cucurbita pepo
MGLTFTKLFSSLFSKKEMRILMVGLDAAGKTTILYKLKLGEIVTTIPTIGFNVETVEYKNISFTVWDVGGQDKIRPLWRHYFQNTQGLIFVVDSNDRDRAVEARDELHRMLNEDELRDAVLLVFANKQDLPNAMNAAEITDKLGLHSLRQRHWYIQSTCATSGEGLYEGLDWLSNNIASKA

SEQ ID NO: 24403 - protein, 181 aa, Cyclamen graecum
  Sequence also found in Organisms: Ananas comosus
MGLTFTKLFSRLFAKREMRILMVGLDAAGKTTILYKLKLGEIVTTIPTIGFNVETVEYKNISFTVWDVGGQDKIRPLWRHYFQNTQGLIFVVDSNDKDRVVEARDELHRMLNEDELRDAVLLVFANKQDLPNAMNAAEITDKLGLHSLRQRHWYIQSTCATSGEGLYEGLDWLSNNIANKA

SEQ ID NO: 24404 - protein, 181 aa, Cedrus atlantica
  Sequence also found in Organisms: Distylium racemosum, Podocarpus macrophillus
MGLTFTKLFQRLFAKKEMRILMVGLDAAGKTTILYKLKLGEIVTTIPTIGFNVETVEYKNISFTVWDVGGQDKIRPLWRHYFQNTQGLIFVVDSNDRDRIVEARDELHRMLNEDELRDAVLLVFANKQDLPNAMNAAEITDKLGLHSLRQRHWYIQSTCATSGEGLYEGLDWLSNNIANKA

SEQ ID NO: 24405 - protein, 181 aa, Sequoia sempervirens
MGLTFTKLFQRMFAKREMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATSGEGLYEGLDWLSNNIASKA

SEQ ID NO: 24406 - protein, 181 aa, Amsonia hubrichtii
MGLSFTKLFSRLFAKKEMRILMVGLDAAGKTTILYKLKLGEIVTTIPTIGFNVETVEYKNISFTVWDVGGQDKIRPLWRHYFQNTQGLIFVVDSNDRDRIVEARDELHRMLNEDELREAVLLVFANKQDLPNAMNAAEITDKLGLHSLRQRHWYIQSTCATSGEGLYEGLDWLSNNIANKA

SEQ ID NO: 24407 - protein, 181 aa, Cucurbita pepo
MGLTFTKLFGRLFSKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATSGEGLYEGLDWLSNNIASKG

SEQ ID NO: 24408 - protein, 181 aa, Mimulus guttatus
MGLSFTKLFSRLFAKREMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATSGEGLYEGLDWLSNNIANKG

SEQ ID NO: 24409 - protein, 181 aa, Selaginella moellendorffii
MGLTFTKLFQRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATSGEGLYEGLDWLSNNIANKG

SEQ ID NO: 24410 - protein, 181 aa, Rhizophora mangle
MGLSFTKLFSRLFAKKEMRILMVGLDAAGKTTILYKLKLGEIVTTIPTIGFNVETVEYKNISFTVWDVGGQDKIRPLWRHYFQNTQGLIFVIDSNDRDRVVEARDELHRMLNEDELRDAVLLVFANKQDLPNAMNAAEITDKLGLHSLRQRHWYIQSTCATSGEGLYEGLDWLSNNIANKV

SEQ ID NO: 24411 - protein, 181 aa, Amorphophallus konjac
MGLSFTKLFSRLFAKKEMRILMVGLDAAGKTTILYKLKLGEIVSTIPTIGFNVETVEYKNISFTVWDVGGQDKIRPLWRHYFQNTQGLIFVIDSNDRDRIVEARDELHRMLNEDELRDAVLLVFANKQDLPNAMNAAEITDKLGLHSLRQRHWYIQSTCATSGEGLYEGLDWLSNNIASKA

SEQ ID NO: 24412 - protein, 181 aa, Brassica juncea
MGLSFAKLFSKLFAKKEMRILMVGLDAAGKTTIPYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATSGEGLYEGLDWLSNNIAGKA

SEQ ID NO: 24413 - protein, 181 aa, Pennisetum glaucum
  Sequence also found in Organisms: Cenchrus ciliaris
MGLTFTKLFSRLFSKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLIFANKQDLPNAMNAADITDKLGLHSLRQRHWYIQSTCATTGEGLYEGLDWLSNNIANKA

SEQ ID NO: 24414 - protein, 181 aa, Orobanche aegyptiaca
MGLSFTKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLQSLRQRHWYIQSTCATSGEGLYEGLDWLSNNIANKS

SEQ ID NO: 24415 - protein, 181 aa, Papaver somniferum
MGLSFTKLSSRLFAKREMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATSGEGLYEGLDWLSNNIANKA

SEQ ID NO: 24416 - protein, 181 aa, Silene vulgaris
MGLSFTKLFSRLFAKKEMRILMVGLDAAGKTTILYKLKLGEIVTTIPTIGFNVETVEYKNISFTVWDVGGQDKIRPLWRHYFQNTQGLIFVVDSNDRDRAVEARDELHRMLNEDELRDAVLLVFANKQDLPNAMTAAEITDKLGLHSLRQRHWYIQSTCATSGEGLYEGLDWLSNNIASKS

SEQ ID NO: 24417 - protein, 181 aa, Eutrema parvulum
MGGSFAKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLFVFANKQDLPNAMNAAEITDKLGLHSLRQRHWYIQSTCATSGEGLYEGLDWLSNNIAGKA

SEQ ID NO: 24418 - protein, 181 aa, Zostera marina
MGLSFAKLFSRIFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLQSLRQRHWYIQSTCATSGEGLYEGLDWLSNNIANKA

SEQ ID NO: 24419 - protein, 181 aa, Fagus grandifolia
MGLTFTKLFSKLFAKKEMRILMVGLDAAGKTTILYKLKLGEIVTTIPTIGFNVETVEYKNISFTVWDVGGQDKIRPLWRHYFQNTQGLIFVVDSNDRDRIVEARDELHRMLNEDELREAVLLVFANKQDLPNAMNAAEITDKLGLHSLRQRHWYIQSTCATSGEGLYEGLDWLSNNIASKA

SEQ ID NO: 24420 - protein, 181 aa, Cichorium intybus
MGLSFTKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEAKDELHRMLNEDELRDAVLLVFANKQDLPNAMNAAEITDKLGLQSLRQRHWYIQSTCATSGEGLYEGLDWLSNNIANKA

SEQ ID NO: 24421 - protein, 181 aa, Actinidia deliciosa
MGLSFTKLLSRMFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLNSLRQRHWYIQSTCATSGEGLYEGLDWLSNNIASKA

SEQ ID NO: 24422 - protein, 181 aa, Picea glauca
MGLTFTKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVAEARDELHRMLNEDELRDAVLLVFANKQDLPNAMTAAEITDKLGLHSLRQRHWYIQSTCATSGEGLYEGLDWLSNNIANKA

SEQ ID NO: 24423 - protein, 181 aa, Juglans hindsii x Juglans regia
MGLTFAKLFSKLFAKREMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELREAVLLVFANKQDLPNAMNAAEITDKLGLHSLRQRHWYIQSTCATSGEGLYEGLDWLSNNIASKA

SEQ ID NO: 24424 - protein, 181 aa, Vinca minor
MGLSFTKLFSRLFAKREMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATSGEGLYEGLDWLSNNIANKS

SEQ ID NO: 24425 - protein, 181 aa, Amorphophallus konjac
MGLSFTKLFSRLFAKKEMRILMVGLDAAGKTTILYKLKLGEIVTTIPTIGFNVETVEYKNISFTVWDVGGQDKIRPLWRHYFQNTQGLIFVVDSNDRDRIVEARDELHRILNEDELRDAVLLVFANKQDLPNAMNAAEITDKLGLHSLRQRHWYIQSTCATSGEGLYEGLDWLSNNIASKV

SEQ ID NO: 24426 - protein, 181 aa, Brassica rapa
MGVSFGKLFSKLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWDIQSTCATSGEGLYEGLDWLSNNIANKA

SEQ ID NO: 24427 - protein, 180 aa, Fagopyrum esculentum
GLSFGKLFSRLFSKREMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATSGEGLYEGLDWLSNNIASKG

SEQ ID NO: 24428 - protein, 181 aa, Vitis vinifera
MGLTFTKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDSVLLVFANKQDLPNAMNAAEITDKLGLHSLRQRHWYIQSTCATSGEGLYEGLEWLSNNIATKA

SEQ ID NO: 24429 - protein, 181 aa, Quercus alba
MGLTFTKLFSKLFAKREMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELREAVLLVFANKQDLPNAMNAAEITDKLGLHSLRQRHWYIQSTCATSGEGLYEGLDWLSNNIASKA

SEQ ID NO: 24430 - protein, 181 aa, Tripterygium wilfordii
MGLSFTKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVIEARDELHRMLNEDELREAVLLVFANKQDLPNAMNAAEITDKLGLHSLRQRHWYIQSACATSGEGLYEGLDWLSNNIASKA

SEQ ID NO: 24431 - protein, 181 aa, Amaranthus tuberculatus
MGLTFTKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELREAVLLVFANKQDLPNAMNAAEITDKLGLHSLRQRHWYIQSTCATSGEGLYEGLDWLSNNIANRV

SEQ ID NO: 24432 - protein, 181 aa, Brassica napus
MGLSFGKLFSKLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLFLSNKQDLPNAMNAAEITDKLGLHSLRQRHWYIQSTCATSGEGLYEGLDWLSNNIANKA

SEQ ID NO: 24433 - protein, 183 aa, Centaurea maculosa
MGLSFGKLFKRLFTKKEVRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATSGEGLYEGLDWLSSNIASKGKH

SEQ ID NO: 24434 - protein, 181 aa, Ceratodon purpureus
  Sequence also found in Organisms: Physcomitrella patens
MGLTFTKLFQKLFSKREMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATSGEGLYEGLDWLSSNIANKA

SEQ ID NO: 24435 - protein, 181 aa, Cycas rumphii
  Sequence also found in Organisms: Zamia vazquezii
MGLTFTKLFQRMFAKKEMRILMVGLDAAGKTTILYKLKLGEIVTTIPTIGFNVETVEYKNISFTVWDVGGQDKIRPLWRHYFQNTQGLIFVVDSNDRDRIVEARDELHRMLNEDELRDAILLVFANKQDLPNAMNAAEITDKLGLHSLRQRHWYIQSTCATSGEGLYEGLDWLSNNIASKA

SEQ ID NO: 24436 - protein, 181 aa, Cycas rumphii
MGLTLSKVFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEAKDELHRMLNEDELRDAVLLVFANKQDLPNAMNAAEITDKLGLHSLRQRHWYIQSTCATSGEGLYEGLDWLSNNIANKA

SEQ ID NO: 24437 - protein, 181 aa, Euonymus alatus
MGLSFTKLFSRLFAKREMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELREAVLLVFANKQDLPNAMNAAEITDKLGLHSLRQRHWYIQSACATSGEGLYEGLDWLSNNIANKA

SEQ ID NO: 24438 - protein, 181 aa, Gossypium raimondii
MGLSFTKLFSWLFSKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSPRQRHWYIQSTCATSGEGLYEGLDWLSNNIANKA

SEQ ID NO: 24439 - protein, 180 aa, Nuphar advena
MGLTFTKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLQSLRQRHWYIQSTCATSGDGLYEGLDWLSNNIANK

SEQ ID NO: 24440 - protein, 181 aa, Elaeis guineensis
MGLSFTKLFSRLFAKKEMRILMVGLDAAGKTTILYKLKLGEIVTTIPTIGFNVETVEYKNISFTVWDVGGQDKIRPLWRHYFQNTQGLIFVIDSNDRDRIVEARDELHRMLNEDELRDAVLLVFANKQDLPNAMNAAEITDKLGLHSLRQRHWYIQSTCATSGEGLYEGLEWLSNNIANKA

SEQ ID NO: 24441 - protein, 181 aa, Pinus taeda
MGLTFTKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITNKLGMHSVRQRHWYIQSTCATSGEGLYEGLDWLSNNIANKA

SEQ ID NO: 24442 - protein, 181 aa, Rosmarinus officinalis
MGLSFTKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDDLRDAVLLVFSNKQDLPNAMNAAEITDKLGLHSLRQRHWYIQSTCATSGEGLYEGLDWLSNNIANKS

SEQ ID NO: 24443 - protein, 177 aa, Liriodendron tulipifera
  Sequence also found in Organisms: Triphysaria pusilla
MGLSFTKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATSGEGLYEGLDWLSNNI

SEQ ID NO: 24444 - protein, 181 aa, Triphysaria pusilla
MGLSFTKLFSRLFAKREMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELREAVLLVFANKQDLPNAMNAAEITDKLGLHSLRQRHWYIQSTCATSGEGLYEGLDWLSNNIANKS

SEQ ID NO: 24445 - protein, 178 aa, Arnica chamissonis
  Sequence also found in Organisms: Utricularia gibba
TFTKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATSGEGLYEGLDWLSNNIANKA

SEQ ID NO: 24446 - protein, 181 aa, Valeriana officinalis
MGLTFTKLFSKLFAKREMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATSGEGLYEGLEWLSNNIATKA

SEQ ID NO: 24447 - protein, 177 aa, Primula obconica
FTKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATSGEGLYEGLDWLSNNIANKA

SEQ ID NO: 24448 - protein, 181 aa, Pteridium aquilinum
MGLSFTKLFQRLFAKREMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATSGEGLYEGLDWLSGSIASKG

SEQ ID NO: 24449 - protein, 181 aa, Sciadopitys verticillata
MGLSFTKLFQRMFAKKEMRILMVGLDAAGKTTILYKLKLGEIVTTIPTIGFNVETVEYKNISFTVWDVGGQDKIRPLWRHYFQNTQGLIFVVDSNDRDRIVEARDELHRMLNEDELRDAVLLVFANKQDLPNAMNAAEITDKLGLHSLRQRHWYIQSTCATSGEGLYEGLDWLSNNIVSKA

SEQ ID NO: 24450 - protein, 181 aa, Tabernaemontana elegans
MGLSFTKLFSRLFAKKEMRILMVGLDAAGKTTILYKLKLGEIVTTIPTIGFNVETVEYKNISFTVWDVGGQDKIRPLWRHYFQNTQGLIFVVDSNDRDRIVEARDELHRMLNEDELRDAVLLVFANKQDLPNAMNAAEITDKLGLHSLRQRHWYIQSTCATSGEGLYEGLDWLSNNIANRT

SEQ ID NO: 24451 - protein, 179 aa, Brassica napus
LSFAKLFSKLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATSGEGLYEGLDWLSNNIAGKA

SEQ ID NO: 24452 - protein, 181 aa, Physcomitrella patens
MGLTFTKLFTKLFSKREMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATSGEGLYEGLDWLSSNIANKA

SEQ ID NO: 24453 - protein, 181 aa, Chenopodium quinoa
MGLTFTKLFSGLFSKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLHQRHWYIQSTCATSGEGLYEGLDWLSNNIASKV

SEQ ID NO: 24454 - protein, 181 aa, Populus trichocarpa
MGLSFTKLLGRLFSKKEMRILMVGLDAAGKTTILYKLKLGEIVTTIPTIGFNVETVEYKNISFTVWDVGGQDKIRPLWRHYFQNTQGLIFVVDSNDRDRVGEARDELHRMLNEDELRDAVLLVFANKQDLPNAMNAAEITDKLGLHSLRQRHWYIQSTCATSGEGLYEGLDWLSNNIASKA

SEQ ID NO: 24455 - protein, 181 aa, Musa acuminata
MGLTFTRLFSRLFAKKEMRILMVGLDAAGKTTILYKLKLGEIVTTIPTIGFNVETVEYKNISFTVWDVGGQDKIRPLWRHYFQNTQGLIFVVDSNDRDRIIEARDELHRMLNEDELRDAVLLVFANKQDLPNAMNAAEITDKLGLHSLRQRHWYIQSTCATSGEGLYEGLDWLSNNIVSKA

SEQ ID NO: 24456 - protein, 181 aa, Distylium racemosum
MGLTFTKLFNRLFAKKEMRILMVGLDAAGKTTILYKLKLGEIVTTIPTIGFNVETVEYKNISFTVWDVGGQDKIRPLWRHYFQNTQGLIFVVDSNDRDRIVEARDELHRMLNEDELRDAVLLVFANKQDLPNAMNAAEITDKLGLHSLRQRHWYIQSTCATSGEGLYEGLEWLSNNIANKA

SEQ ID NO: 24457 - protein, 181 aa, Orobanche aegyptiaca
MGLSFTKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAADITDKLGLQSLRQRHWYIQSTCATSGEGLYEGLDWLSNNIANKS

SEQ ID NO: 24458 - protein, 181 aa, Lippia dulcis
MGLTFTKLLSRLFAKKEMRILMVGLDAAGKTTILYKLKLGEIVTTITTIGFNVETVEYKNISFTVWDVGGQDKIRPLWRHYFQNTQGHIFVVDSNDRDRVVEARDELHRMLNEDELRDAVLLVFANKQDLPNAMNAAEITDKLGLHSLRQRHWYIQSTCATSGEGLYEGLDWLSNNIANKA

SEQ ID NO: 24459 - protein, 181 aa, Sciadopitys verticillata
MGLTFTKLFQRLFAKKEMRILMVGLDAAGKTTILYKLKLGEIVTTIPTIGFNVETVEYKNISFTVWDVGGQDKIRPLWRHYFQNTQGLIFVVDSNDRDRIVEARDELHRMLNEDELREAVLLVFANKQDLPNAMNAAEITDKLGLHSLRQRHWYIQSTCATSGEGLYEGLDWLSNNIANKA

SEQ ID NO: 24460 - protein, 183 aa, Cirsium arvense
VGLSFTKLFKRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATSGEGLYEGLDWLSSNIASKTKH

SEQ ID NO: 24461 - protein, 181 aa, Nuphar advena
MGLSFTKLFSRLFAKKEMRILMVGLDAAGKTTILYKLKLGEIVTTIPTIGFNVETVEYKNISFTVWDVGGQDKIRPLWRHYFQNTQGLIFVVDSNDRDRIIEARDELHRMLNEDELRDAVLLVFANKQDLPNAMNAAEITDKLGLHSLRQRHWYIQSTCATSGEGLYEGLDWLSNNIANKS

SEQ ID NO: 24462 - protein, 181 aa, Orobanche aegyptiaca
MGLSFTKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNSAEITDKLGLQSLRQRRWYIQSTCATSGEGLYEGLDWLSNNIANKA

SEQ ID NO: 24463 - protein, 180 aa, Secale cereale
MGLTFTKLFSRLFAKKEMRILMVGLDAAGKTTILYKLKLGEIVTTIPTIGFNVETVEYKNISFTVWDVGGQDKIRPLWRHYFQNTQGLIFVVDSNDRERVVEARDELHRMLNEDELRDAVLLVFANKQDLPNAMNAAEITDKLGLHSLRQRHWYIQSTCATSGEGLYEGLDWLSNNIATG

SEQ ID NO: 24464 - protein, 181 aa, Triphysaria pusilla
MGGSFTKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATSGEGLYEGLDWLSNNISNKS

SEQ ID NO: 24465 - protein, 183 aa, Lotus japonicus
MGLSFTKLFSRLFAKKEMRILMVGLDAAGKTTILYKLKLGEIVTTIPTIGFNVETVEYKNISFTVWDVGGQDKIRPLWRHYFQNTQGLIFVVDSNDRDRAVEARDELHRMLNEDELRDAVLLVFANKQDLPNAMNAAEITDKLGLHSLRQRHWYIQSTCATSGEGLYEGLDWLSNNIANKVSE

SEQ ID NO: 24466 - protein, 180 aa, Cocos nucifera
MGLSFTKLFSRLFAKKEMRILMVGLDAAGKTTILYKLKLGEIVTTIPTIGFNVETVEYKNISFTVWDVGGQDKIRPLWRHYFQNTQGLIFVVDSNDRDRIVEARDELHRMLNEDELRDAVLLVFANKQDLPNAMNAAEITDKLGLHSLRQRHWYIQSTCATSGEGLYEGLEGLSNNIANK

SEQ ID NO: 24467 - protein, 181 aa, Zingiber officinale
MGLTFTKLFSRLFAKKEMRILMVGLDAAGKTTILYKLKLGEIVTTIPTIGFNVETVEYKNISFTVWDVGGQDKIRPLWRHYFQNTQGLIFVVDSNDRDRIAEARDELHRMLNEDELRDAVLLVFANKQDLPNAMNAAEITDKLGLHSLRQRHWYIQSACATSGEGLYEGLDWLSNNIVNKA

SEQ ID NO: 24468 - protein, 181 aa, Curcuma longa
  Sequence also found in Organisms: Zingiber officinale
MGLTFAKLFSRLFAKKEMRILMVGLDAAGKTTILYKLKLGEIVTTIPTIGFNVETVEYKNISFTVWDVGGQDKIRPLWRHYFQNTQGLIFVVDSNDRDRIAEARDELHRMLNEDELRDAVLLVFANKQDLPNAMNAAEITDKLGLHSLRQRHWYIQSACATSGEGLYEGLDWLSNNIVNKA

SEQ ID NO: 24469 - protein, 179 aa, Actinidia deliciosa
MGLSFTKLFSRLFAKKEMRILMVGLDAAGKTTILYKLKLGEIVTTIPTIGFNVETVEYKNISFTVWDVGGQDKIRPLWRHYFQNTQGLIFVIDSNDRDRVVEARDELHRMLNEDELREAVLLVFANKQDLPNAMNAAEITDKLGLHSLRQRHWYIQSTCATSGEGLYEGLDWLSNNIAN

SEQ ID NO: 24470 - protein, 181 aa, Physcomitrella patens
MGLTFTKLFTRLFSKQEMRILMVGLDAAGKTTILYKLKLGEIVTTIPTIGFNVETVEYKNISFTVWDVGGQDKIRPLWRHYFQNTQGLIFVVDSNDRDRVVEARDELLRMLNEDELRDAVLLVFANKQDLPNAMNAAEITDKLGLHSLRQRHWYIQSTCATSGEGLYEGLDWLSSNIANKS

SEQ ID NO: 24471 - protein, 181 aa, Populus trichocarpa
MGLSFTKLLGRLFSKKEMRILMVGLDAAGKTTILYKLKLGEIVTTIPTIGFNVETVEYKNISFTVWDVGGQDKIRPLWRHYFQNTQGLIFVVDSNDRDRVGEARDELHRMLNEDELRDAVLLVFANKQDLPNAMNAAEITDKLGLHSLRQRHWYIQSTCATSGEGLYEGLDWLSNNISSKA

SEQ ID NO: 24472 - protein, 181 aa, Pteridium aquilinum
MGLTFTKLFQRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWFIQSTCATSGEGLYEGLDWLSASIAKKD

SEQ ID NO: 24473 - protein, 181 aa, Abies balsamea
MGLTFTKLFQRMFAKREMRILMVGLDAAGKTTILYKLKLGEIVTTIPTIGFNVETVEYKNISFTVWDVGGQDKIRPLWRHYFQNTQGLIFVVDSNDRDRVAEARDELHRMLNEDELRDAVLLVFANKQDLPNAMTAAEITDKLGLHSLRQRHWYIQSTCATSGEGLYEGLDWLSNNIASKA

SEQ ID NO: 24474 - protein, 181 aa, Musa acuminata
MGLTFTRLFSRLFSKKEMRILMVGLDAAGKTTILYKLKLGEIVTTIPTIGFNVETVEYKNISFTVWDVGGQDKIRPLWRHYFQNTQGLIFVVDSNDRDRIIEARDELHRMLNEDELRDAVLLVFANKQDLPNAMNAAEITDKLGLHSLRQRHWYIQSTCATSGEGLYEGLDWLSNNIVSKA

SEQ ID NO: 24475 - protein, 181 aa, Distylium racemosum
MGLTFTKLFQRMFAKREMRILMVGLDAAGKTTILYKLKLGEIVTTIPTIGFNVETVEYKNISFTVWDVGGQDKIRPLWRHYFQNTQGLIFVVDSNDRDRIVEARDELHRMLSEDELRDAVLLVFANKQDLPNAMNAAEITDKLGLHSLRQRHWYIQSTCATSGEGLYEGLDWLSNNIASKA

SEQ ID NO: 24476 - protein, 181 aa, Euonymus alatus
MGLSFTKLFSRLFAKREMRILMVGLDAAGKTTILYKLKLGEIVTTIPTIGFNVETVEYKNISFTVWDVGGQDKIRPLWRHYFQNTQGLIFVVDSNDRDRVIEARDELHRMLNEDELREAVLLVFANKQDLPNAMNAAEITDKLGLHSLRQRHWYIQSACATSGEGLYEGLEWLSNNIASKA

SEQ ID NO: 24477 - protein, 181 aa, Physcomitrella patens
MGLTFTKLFTKLFSKREMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATSGEGLYEGLDWLSSNIANKS

SEQ ID NO: 24478 - protein, 181 aa, Podocarpus macrophillus
MGLTFTKLFQRMFAKREMRILMVGLDAAGKTTILYKLKLGEIVTTIPTIGFNVETVEYKNISFTVWDVGGQDKIRPLWRHYFQNTQGLIFVVDSNDRDRILEARDELHRMLNEDELRDAVLLVFANKQDLPNAMNAAEITDKLGLHSLRQRHWYIQSTCATSGEGLYEGLDWLSNNIASKA

SEQ ID NO: 24479 - protein, 178 aa, Triphysaria pusilla
SFTKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATSGEGLYEGLDWLSNNIANKG

SEQ ID NO: 24480 - protein, 184 aa, Zea mays
MGLTFTKLFRRLFAKKEMRILMVGLDAAGKTTILYKLKLGEIVTTIPTIGFNVETVEYKNISFTVWDVGGQDKIRPLWRHYFQNTQGLIFVVDSNDRERVVEARDELHRMLNEDELRDAVLLVFANKQDLPNAMNAAEITDKLGLHSLRQRHWYIQSTCATSGEGLYEGLDWLSNNIANKARSI

SEQ ID NO: 24481 - protein, 176 aa, Epimedium sagittatum
MGLTFTKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATSGEGLYEGLDWLSKQ

SEQ ID NO: 24482 - protein, 175 aa, Glycyrrhiza uralensis
MGLSFTKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATSGEGLYEGLDWLSN

SEQ ID NO: 24483 - protein, 181 aa, Physcomitrella patens
MGLTFTKLFSKLFSKREMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPDAMNAAEITDKLGLHSLRQRHWYIQSTCATSGEGLYEGLDWLSSNITNKS

SEQ ID NO: 24484 - protein, 182 aa, Fragaria vesca
MGLSFTKLLSRLFAKKEMRILMVGLDAAGKTTILYKLKLGEIVTTIPTIGFNVETVEYKNISFTVWDVGGQDKIRPLWRHYFQNTQGLIFVVDSNDRDRAVEARDEVHRMLNEDELRDAVLLVFANKQDLPNAMNADEITDKLGLHSLRQRHWYIQSTCATSGEGLYEGLDWLSNNIANKAC

SEQ ID NO: 24485 - protein, 181 aa, Triphysaria pusilla
MGLSFTKLFSRLFAKKEMRILMVGLDAAGKTTILYKLKLGEIVTTIPTIGFNVETVEYKNISFTVWDVGGQDKIRPLWRHYFHNTQGLIFVVDSNDRDRVVEARDELHMMLNGDELRDAVLLVFANQQDLPNAMNAAEITDKLGLHSLRQRHWYIQSTCATSGEGLYEGLDWLSNNIANKG

SEQ ID NO: 24486 - protein, 181 aa, Triphysaria pusilla
MGLSFTKLFSRLFAKREIHILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELREAVLLVFANKQDLPNAMNAAEITDKLGLHSLRQRHWYIQSTCATSGEGLYEGLDWLSNNIANKS

SEQ ID NO: 24487 - protein, 179 aa, Vicia sativa
GLTFTKLFSRLFAKKEMRILMVGLDAAGKTTILYKLKLGEIVTTIPTIGFNVETVEYKNISFTVWDVGGQDKIRPLWRHYFQNTQGVIFVVDSNDRDRVVEARDELHRMLSEDELRDAVLLVFANKQDLPNAMNAADITDKLGLHSLRQRHWYIQSTCATSGEGLYEGLEWLSNNIASK

SEQ ID NO: 24488 - protein, 171 aa, Echinochloa colona
RLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATTGEGLYEGLDWLSSNIASKA

SEQ ID NO: 24489 - protein, 174 aa, Lippia dulcis
LFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATSGEGLYEGLDWLSNNIANKA

SEQ ID NO: 24490 - protein, 181 aa, Cedrus atlantica
  Sequence also found in Organisms: Pseudotsuga menziesii
MGLSFTKLFQRMFAKREMRILMVGLDAAGKTTILYKLKLGEIVTTIPTIGFNVETVEYKNISFTVWDVGGQDKIRPLWRHYFQNTQGLIFVVDSNDRDRVAEARDELHRMLNEDELRDAVLLVFANKQDLPNAMTAAEITDKLGLHSLRQRHWYIQSTCATSGEGLYEGLDWLSNNIANKA

SEQ ID NO: 24491 - protein, 181 aa, Pinus pinaster
MGLTFTKLFHRMFAKREMRILMVGLDAAGKTTILYKLKLGEIVTTIPTIGFNVETVEYKNISFTVWDVGGQDKIRPLWRHYFQNTQGLIFVVDSNDRDRVAEARDELHRMLNEDELRDAVLLVFANKQDLPNAMTAAEITDKLGLHSLRQRHWYIQSTCATSGEGLYEGLDWLSNNIANKA

SEQ ID NO: 24492 - protein, 181 aa, Picea glauca
MGLTFTKLFQRMFAKREMRILMVGLDAAGKTTILYKLKLGEIVTTIPTIGFNVETVEYKNISFTVWDVGGQDKIRPLWRHYFQNTQGLIFVVDSNDRDRVAEARDELHRMLNEDELRDAVLLVFANKQDLPNAMTAAEITDKLGLHSLRQRHWYIQSTCATSGEGLYEGLDWLSNNIANKA

SEQ ID NO: 24493 - protein, 181 aa, Pinus taeda
MGLTFTKLFHRMFAKREMRILMVGLDAAGKTTILYKLKLGEIVTTIPTIGFNVETVEYKNISFTVWDVGGQDKIRPLWRHYFQNTQGLIFVVDSNDRDRVAEARDELHRMLNEDELRDAVLLVFANKQDLPNAMAAAEITDKLGLHSLRQRHWYIQSTCATSGEGLYEGLDWLSNNIANKA

SEQ ID NO: 24494 - protein, 181 aa, Curcuma longa
MGLTFTRLFSRLFAKKEMRILMVGLDAAGKTTILYKLKLGEVVTTIPTIGFNVETVEYKNISFTVWDVGGQDKIRPLWRHYFQNTQGLIFVVDSNDRDRVLEARDELHRMLNEDELRDALLLVFANKQDLPNAMNAAEITEKLGLHSLRQRHWYIQSACATSGEGLYEGLDWLSSNMASKA

SEQ ID NO: 24495 - protein, 180 aa, Actinidia deliciosa
MGLTFTKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELREAVLLVFANKQDLPNAMNAAEITDKLGLHSLRQRHWYIQSTCATSGEGLYEGLDWLSTTSLTS

SEQ ID NO: 24496 - protein, 182 aa, Prunus persica
MGLSFTKLFSRLFAKKEMRILMVGLDASGKTTILYKLKLGEIVTTIPTIGFNVETVEYKNISFTVWDVGGQDKIRPLWRHYFQNTQGLIFVIDSNDRDRVVEARDEMHRMLNEDELREAVLLVFANKQDLPNAMNAAEITDKLNLHSLRQRHWYIQSTCATSGEGLYEGLDWLSNNITSKAC

SEQ ID NO: 24497 - protein, 184 aa, Solanum lycopersicum
MGLSFTKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELREAVLLVFANKQDLPNAMNAAEITDKLGLHSLRQRHWYIQSTCATSGEGLYEGLDWLSNNISNKVCVY

SEQ ID NO: 24498 - protein, 184 aa, Cucumis sativus
MGLTFTKLFGRLFSKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATSGEGLYEGLDWLSNNIVSKVNTP

SEQ ID NO: 24499 - protein, 183 aa, Salvia sclarea
TRPWLSLTKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATSGEGLYEGLDWLSNNIANKS

SEQ ID NO: 24500 - protein, 181 aa, Musa acuminata
MGLTFTRLFSRLFAKKEMRILMVGLDAAGKTTILYKLKLGEIVTTIPTIGFNVETVEYKNISFTVWDVGGQDKIRPLWRHYFQNTQGLIFVVDSNDRDRIIEARDELHRMLNEDELRDAVLLVFANKQDLPNAMNAAEITDKLGLHSLRHRHWYIQSACATSGEGLYEGLDWLSNNIITKA

SEQ ID NO: 24501 - protein, 175 aa, Bupleurum chinense
MGLSFTKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATSGEGLYEGLDWLYK

SEQ ID NO: 24502 - protein, 181 aa, Festuca arundinacea
  Sequence also found in Organisms: Lolium multiflorum
MGLSFSSLFGALFAKKEMRILMVGLDAAGKTTILYKLKLGEIVTTIPTIGFNVETVEYKNISFTVWDVGGQDKIRPLWRHYFQNTQGLIFVVDSNDRDRIAEARDELHRMLNEDELRNAVLLVFANKQDLPNAMNAAEITDKLGLHSLRQRHWYIQSACATSGEGLYEGLDWLSSNIASKS

SEQ ID NO: 24503 - protein, 173 aa, Fraxinus spp
FSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATSGEGLYEGLDWLSNNIANKA

SEQ ID NO: 24504 - protein, 179 aa, Actinidia deliciosa
MGLTFTKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATSGEALYEGLDWLSNTLLA

SEQ ID NO: 24505 - protein, 181 aa, Phalaenopsis aphrodite
MGLLFTKLFSRLFAKKEMRILMVGLDAAGKTTILYKLKLGEIVTTIPTIGFNVETVEYKNISFTVWDVGGQDKIRPLWKYYFQNTQGLIFVVDSNDRERVIEARDELHRMLSEDELRDAVLLVFANKQDLPNAMNAAEITDKLGLHSLRQRHWYIQSACATSGEGLYEGLDWLSSNIASRG

SEQ ID NO: 24506 - protein, 181 aa, Pseudoroegneria spicata
  Sequence also found in Organisms: Secale cereale, Triticum aestivum
MGLSFGTLFGALFAKKEMRILMVGLDAAGKTTILYKLKLGEIVTTIPTIGFNVETVEYKNISFTVWDVGGQDKIRPLWRHYFQNTQGLIFVVDSNDRDRIAEARDELHRMLNEDELRNAVLLVFANKQDLPNAMNAAEITDKLGLHSLRQRHWYIQSACATSGEGLYEGLDWLSNNIASKS

SEQ ID NO: 24507 - protein, 181 aa, Picea glauca
MSLTFTKLFQRMFAKREMRILMVGLDAAGKTTILYKLKLGEIATTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHRYIQSTCATSGEGLYEGLDWLSNNIANKA

SEQ ID NO: 24508 - protein, 187 aa, Lupinus angustifolius
MGLSFGKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELREAVLLVFANKQDLPNAMNAAEITDKLGLHSLRQRHWYIQSTCATSGEGLYEGLDWLSNNISSKVSYIFLV

SEQ ID NO: 24509 - protein, 181 aa, Brachypodium distachyon
MGLSFGTLFGALFAKKEMRILMVGLDAAGKTTILYKLKLGEIVTTIPTIGFNVETVEYKNISFTVWDVGGQDKIRPLWRHYFQNTQGLIFVVDSNDRERITEARDELHRMLNEDELRNAVLLVFANKQDLPNAMNAAEITDKLGLHSLRQRHWYIQSACATSGEGLYEGLDWLSNNIASKS

SEQ ID NO: 24510 - protein, 178 aa, Conyza canadensis
FTKLFSRLFAKKEMRILMVGLDAAGKTTILYKLKLGEIVTTIPTIGFNVETVEYKNISFTVWDVGGQDKIRPLWRFYFQNTQGLIFVVDSNDRDRVVEARDELHRLLNEDELRDAVLLVFANKQDLPNAMNAAEITDKLGLHSLRQRHWYIQSTCATSGEGLYEGLDWLFNNIANKAS

SEQ ID NO: 24511 - protein, 172 aa, Flaveria ramosissima
MGLTFTKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATSGEGLYEGLDW

SEQ ID NO: 24512 - protein, 181 aa, Avena sativa
MGLSFSSLFGALFAKKEMRILMVGLDAAGKTTILYKLKLGEIVTTIPTIGFNVETVEYKNISFTVWDVGGQDKIRPLWRHYFQNTQGLIFVVDSNDRDRIAEARDELHRMLNEDELRNAVLLVFANKQDLPNAMNAAEITDKLGLHSLRQRHWYIQSACATSGEGLYEGLDWLSSNIATKS

SEQ ID NO: 24513 - protein, 181 aa, Avena sativa
MGLSFSSLFGTLFAKKEMRILMVGLDAAGKTTILYKLKLGEIVTTIPTIGFNVETVEYKNISFTVWDVGGQDKIRPLWRHYFQNTQGLIFVVDSNDRDRIAEARDELHRMLNEDELRNAVLLVFANKQDLPNAMNAAEITDKLGLHSLRQRHWYIQSACATSGEGLYEGLDWLSSNIATKS

SEQ ID NO: 24514 - protein, 181 aa, Ostreococcus lucimarinus
MGITFAKLFQRLFSKKEMRILMVGLDAAGKTTILYKLKLGEIVTTIPTIGFNVETVEYKNISFTVWDVGGQDKIRPLWRHYFQNTQGLIFVVDSNDRDRVSEARDELHRMLNEDELRDAVLLVFANKQDLPNAMSAAEITDKLGLHSLRQRHWFIQSTCATSGEGLYEGLDWLSSNISQRA

SEQ ID NO: 24515 - protein, 182 aa, Prunus mume
MGLSFTKLFSRLFAKKEMRILMVGLDASGKTTILYKLKLGEIVTTIPTIGFNVETLEYKNISFTVWDVGGQDKIRPLWRHYFQNTQGLIFVIDSNDRDRVVEARDEMHRMLNEDELREAVLLVFANKQDLPNAMNAAEITDKLSLHSLRQRHWYIQSTCATSGEGLYEGLDWLSNNITSKAC

SEQ ID NO: 24516 - protein, 174 aa, Triphysaria pusilla
MGLSFTKLFSRLFAKREMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELREAVLLVFANKQDLPNAMNAAEITDKLGLHSLRQRHWYIQSTCATSGEGLYEGLDWLS

SEQ ID NO: 24517 - protein, 180 aa, Triphysaria pusilla
MGGSFTKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDGLHRMLNEDELRGMLLVFANKQDLPNAMNAAEITDKLGLHSLRQRHWYIQSTCATSGEGLYEGLDWLSNNISNKG

SEQ ID NO: 24518 - protein, 183 aa, Guizotia abyssinica
MGLTFTKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATSGEGLYEGLDWLSNTLQTRHEA

SEQ ID NO: 24519 - protein, 173 aa, Primula obconica
FSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLNSLRQRHWYIQSTCATSGEGLYEGLDWLSNNIANKA

SEQ ID NO: 24520 - protein, 181 aa, Secale cereale
MGRHVHQAVQRLFAKKEMRILMVGLDAAGKTTILYKLKLGEIVTTIPTIGFNVETVEYKNISFTVWDVGGQDKIRPLWRHYFQNTQGLIFVVDSNDRERVVEARDELHRMLNEDELRDAVLLVFANKQDLPNAMNAAEITDKLGLHSLRQRHWYIQSTCATSGEGLYEGLDWLSNNIANKA

SEQ ID NO: 24521 - protein, 188 aa, Arabidopsis thaliana
MGLNFTKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATSGEGLYEGLDWLSNNIATKVNNLNIPF

SEQ ID NO: 24522 - protein, 188 aa, Nicotiana benthamiana
MGLTFTKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATSGEGLYEGLDWLSNNIANKVRVRFLIE

SEQ ID NO: 24523 - protein, 186 aa, Citrullus lanatus
MGLTFTKLFGRLFSKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATSGEGLYEGLDWLSNNIVSKVNAPSI

SEQ ID NO: 24524 - protein, 180 aa, Marchantia polymorpha
MGLTFTKLFQRFFAKKEMRILMVGLDAAGKTTILYKLKLGEIVTTIPTIGFNVETVEYKNISFTVWDVGGQDKIRPLWKHYFQNTQGLIFVVDSNDRDRVTEARDELHRMVNEDELRDAVLLVFANKQDLPNAMNAAEVTDKLGLHSLRQRHWYIQSTCATSGEGMYEGLDWLSSNIANS

SEQ ID NO: 24525 - protein, 189 aa, Nicotiana benthamiana
MGLSFTKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLLFANKQDLPNAMNAAEITDKLGLHSLRQRHWYIQSTCATSGEGLYEGLDWLSNNIASKVRRDYHTGI

SEQ ID NO: 24526 - protein, 186 aa, Cajanus cajan
MGLSFGKVFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDRLGLNSLRQRHWYIQSTCATSGEGLYEGLDWLSNNISSNKVSLKK

SEQ ID NO: 24527 - protein, 184 aa, Glycine max
MGLSFGKLFSKLCAKKEMRILMVGLDAAGKTTILYKLKLGEIVTTIPTIGFNVETVEYKNISFTVWDVGGQDKIRPLWRHYFQNTQGLIFVVDSNDRDRVGEAKDELHRMLNEDELRDAVLLVFANKQDLPNAMNAAEITDRLGLNSLRQRHWYIQSTCATSGEGLYEGLDWLSNNISGKASFK

SEQ ID NO: 24528 - protein, 171 aa, Echinochloa colona
RLFAKKEMRILMVGLDAAGKTTILYKLKLGEIVTTIPTIGFNVETVEYKNISFTVWDVGGQDKIRPLWRHYFQNTQGLIFVVDSNDRERVVEARDELHRMLNEDELRDAVLLVFANKQDLPNAMNAAEITDKLGLHSLRQRHWYIQSTCATSGEGLYEGLDWLSNNIANKA

SEQ ID NO: 24529 - protein, 169 aa, Brassica juncea
MGLSFGKLFSKLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATSGEGLYEG

SEQ ID NO: 24530 - protein, 169 aa, Brassica juncea
MGLSFAKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATSGEGLYEG

SEQ ID NO: 24531 - protein, 181 aa, Mesostigma viride
MGLTFSKLFQKLFSKKEMRILMVGLDAAGKTTILYKLKLGEIVTTIPTIGFNVETVEYKNISFTVWDVGGQDKIRPLWRHYFQNTQGLIFVVDSNDRDRIGEARDELHRMLNEDELRDALLLVFANKQDLPNAMNAAEITDKLGLHALRQRHWFIQSTCATSGEGLYEGLDWLSTNISNKQ

SEQ ID NO: 24532 - protein, 170 aa, Leymus cinereus x Leymus triticoides
LFAKKEMRILMVGLDAAGKTTILYKLKLGEIVTTIPTIGFNVETVEYKNISFTVWDVGGQDKIRPLWRHYFQNTQGLIFVVDSNDRERVVEARDELHRMLNEDELRDAVLLVFANKQDLPNAMNAAEITDKLGLHSLRQRHWYIQSTCATSGEGLYEGLDWLSNNIANKA

SEQ ID NO: 24533 - protein, 186 aa, Carthamus tinctorius
MGLTFTKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATSGEGLYEGLDWLLTTSLPRHKMVPD

SEQ ID NO: 24534 - protein, 170 aa, Secale cereale
MGLTFTKLFSRLFAKKEMRILMVGLDAAGKTTILYKLKLGEIVTTIPTIGFNVETVEYKNISFTVWDVGGQDKIRPLWRHYFQNTQGLIFVVDSNDRERVVEARDELHRMLNEDELRDAVLLVFANKQDLPNAMNAAEITDKLGLHSLRQRHWYIQSTCATSGEGLYEGR

SEQ ID NO: 24535 - protein, 181 aa, Brassica oleracea
MGLGFAKLVSSLFAKKEMRLLMVGLDAAGKTTILYKLKLGEIVTTIPTIGFNVETVEYRNISFTVWDVGGQDKLRPLWKYYFQNTQGLIFVVDSNDRDRVVEARDELHRMLNEDELRDAVLLVFANKQDLPNAMNAAEITDKLGLHSLRQRHWYIQSTSATSGQGLYEGLEWLSNNIGGKA

SEQ ID NO: 24536 - protein, 181 aa, Chlamydomonas reinhardtii
MGLMVSKALSRLFGKKEMRILMVGLDAAGKTTILYKLKLGEIVTTIPTIGFNVETVEYKNISFTVWDVGGQDKIRPLWRHYFQNTQGLIFVVDSNDRDRIGEAKDELHRMLNEDELRDAVLLVFANKQDLPNAMNAAEITEKLGLHGLRQRHWYIQSTCATSGEGLYEGLDWLSQNIQNKS

SEQ ID NO: 24537 - protein, 175 aa, Panax ginseng
MGLSFTKLFSRLFAKREMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATSGEGLYEVAFKQHC

SEQ ID NO: 24538 - protein, 193 aa, Nicotiana benthamiana
MGLSFTKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLLFANKQDLPNAMNAAEITDKLGLHSLRQRHWYIQSTCATSGEGLYEGLDWLSNNIASKVREIITQEFIDHF

SEQ ID NO: 24539 - protein, 171 aa, Adiantum capillus-veneris
MGLTFTKLFQRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATSGEGLYGGFG

SEQ ID NO: 24540 - protein, 188 aa, Cynara scolymus
MGLSFTKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSPCATSGEGLYEGLDWLSTISLTRHKQGWAVW

SEQ ID NO: 24541 - protein, 167 aa, Heritiera littoralis
MGLTFTKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATSGEGLL

SEQ ID NO: 24542 - protein, 166 aa, Triphysaria pusilla
MGLSFTKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATSGEGL

SEQ ID NO: 24543 - protein, 196 aa, Nicotiana tabacum
MGLSFGKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATSGEGLYEGLDWLSNNIANKGLNARSMIFAAMFLSI

SEQ ID NO: 24544 - protein, 167 aa, Flaveria ramosissima
MGLTFTKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATSGEGRL

SEQ ID NO: 24545 - protein, 181 aa, Gnetum gnemon
MGLSFTKLFQRMFAKKEMRILMVGLDAAGKTTILYKLKLGEIVTTIPTIGFNVETVEYKNISFTVWDVGGQDKIRPLWRHYFQNTQGLIYVVDSNDIERIPEARDELHRMLSEDELRDAVLLVFANKQDLPNAMSAAELTDKLGLHSLRQRRWYIQSACATSGEGLYEGLDWLSNNISNKT

SEQ ID NO: 24546 - protein, 181 aa, Petroselinum crispum
MGQSFTKLFSSLFAKREMRILMVGLDAAGKTTILYKLKLGEVVTTIPTIGFNVETVEYKNISFTVWDVGGQDKIRPLWRFYFQNTQGIIFVVDSNDRERMMEARDELHRMLNEDELRNAVLLVFANKQDLPNAMNAAEMTDKLGLHSLRQRNWYIQSTCATSGEGLYEGLEWLSNNIANKV

SEQ ID NO: 24547 - protein, 181 aa, Volvox carteri
MGLIISKALSRLFGKKEMRILMVGLDAAGKTTILYKLKLGEIVTTIPTIGFNVETVEYKNISFTVWDVGGQDKIRPLWRHYFQNTQGLIFVIDSNDRERVGEAKDELHRMLNEDELRDAVLLVFANKQDLPNAMNAAEITEKLGLHGLRHKCWYIQSTCATSGEGLYEGLDWLSQNIAAKS

SEQ ID NO: 24548 - protein, 169 aa, Festuca arundinacea
LRQKEMRILMVGLDAAGKTTILYKLKLGEIVTTIPTIGFNVETVEYKNISFTVWDVGGQDKIRPLWRHYFQNTQGLIFVVDSNDRERVVEARDELHRMLNEDELRDAVLLVFANKQDLPNAMNAAEITDKLGLHSLRQRHWYIQSTCATSGEGLYEGLDWLSNNIANKA

SEQ ID NO: 24549 - protein, 181 aa, Echinochloa colona
DGAHVHEAVQPTLRQEEMRILMVGLDAAGKTTILYKLKLGEIVTTIPTIGFNVETVEYKNISFTVWDVGGQDKIRPLWRHYFQNTQGLIFVVDSNDRERVVEARDELHRMLNEDELRDAVLLVFANKQDLPNAMNAAEITDKLGLHSLRQRHWYIQSTCATSGEGLYEGLDWLSNNIANKA

SEQ ID NO: 24550 - protein, 165 aa, Marchantia polymorpha
EMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRGALLLVFANKQDLPNAMNAAEITDKLGLHSLRQRHWYIQSTCATSGEGLYEGLDWLSSNIASKA

SEQ ID NO: 24551 - protein, 178 aa, Fagus grandifolia
MGLTFTKLFSKLFAKKEMRILMVGLDAAGKTTILYKLKLGEIVTTIPTIGFNVETVEYKNISFTVWDVGGQDKIRPLWRHYFQNTQGLIFVVDSNDRDRIVEARDELHRMLNEDELREAVLLVFANKQDLPNAMNAAEITDKLGLHSLRQRHWYIQSTCATSGEGLYGGVGLAFQQHC

SEQ ID NO: 24552 - protein, 178 aa, Panax ginseng
MGLTFTKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATVRGSSLWRVGLAFQQHC

SEQ ID NO: 24553 - protein, 181 aa, Castanea mollissima
  Sequence also found in Organisms: Quercus alba
MGLAISRLVKMLFAKKEMRILMVGLDAAGKTTILYKLKLGEIVTTIPTIGFNVETVEYKNVSFTVWDVGGQDKIRPLWRHYFQNTQGLIFVVDSNDRERVSEARDELHRMLSEDELRDATLLVFANKQDLPNAMSVSEITDKLGLHSLRQRRWYIQAACATNGQGLYEGLDWLSSNISSKA

SEQ ID NO: 24554 - protein, 175 aa, Conyza canadensis
FTKLFSQLFAKKEMRILMVGLDAAGKTTILYKLKLGEIVTTIPTIGFNVENVEYKNISFTVWDIGGQDKIRPLWRFYFQNTQGIIFVVDSNDRDRIIEARDELHKLLNEDELRNAVLLVFANKQDLPNAMNAAEITDKLGLHSLRQRHWYIQSTCATSGEGLYEGLDWLSNNIAN

SEQ ID NO: 24555 - protein, 183 aa, Panax ginseng
MGLAFSKLFDRLWGKKEMRILMVGLDAAGKTTILYKLKLGEIVTTIPTIGFNVETVEYKNIQFTVWDVGGQDKIRPLWRHYFQNTQGIIFVVDSNDRDRVVEAREELQRMLNEDELRDALLLVFANKQDLPNAMNAAEITDKLGLHSLRNRGWYIQSTCATSGDGLYEGLEWLSSSLRKAGHQ

SEQ ID NO: 24556 - protein, 200 aa, Hordeum vulgare
MGLTFTKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATTGEGLYEGLDWLSSNIANKVCLDFPCQRTAKHPLLHVQN

SEQ ID NO: 24557 - protein, 177 aa, Flaveria ramosissima
MGLTFTKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCANLVGRALLKVWIGFPTT

SEQ ID NO: 24558 - protein, 179 aa, Carthamus tinctorius
MGLTFTKLFSRLFAKKEMRILMVGLDAAGKTTILYKLKLGEIETTIPTIGFNVETDEYKNINFTEWDVGRHDKIPPLWRHYFQNTQGLIFVVESNDTDRVVDATDELHRMLNEDELTDAVLLVFANKRDLPNAMNAAEITDNLGLHSLRQRHWYIQSTCATSGEGLYEGLDWLSNNIAN

SEQ ID NO: 24559 - protein, 199 aa, Malus domestica
MGLTFTKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATSGEGLYEGLEWLSNNIASKASMRELRPMSLVSCLGDCG

SEQ ID NO: 24560 - protein, 199 aa, Eutrema parvulum
MGLSFAKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATTGEGLYEGLDWLSNNIANKVSLPINIPYYIFSSSKRAL

SEQ ID NO: 24561 - protein, 188 aa, Picea glauca
MGLTFTKLFQRMFAKREMRILMVGLDAAGKTTILYKLKLGEIVTTIPTIGFNVETVEYKNISFTVWDVGGQDKIRPLWRHYFQNTQGLIFVVDSNDRDRVAEARDELHRMLNEDELRDAVLLVFANKQDLPNAMTAAEITDKLGLHSLRQRHWYIQSTCATSGEGLYEGLDWLSKQHCKQGLRMMLGH

SEQ ID NO: 24562 - protein, 197 aa, Lotus japonicus
MGLSFTKLFSRLFAKKEMRILMVGLDAAGKTTILYKLKLGEIVTTIPTIGFNVETVEYKNISFTVWDVGGQDKIRPLWRHYFQNTQGLIFVVDSNDRDRAVEARDELHRMLNEDELRDAVLLVFANKQDLPNAMNAAEITDKLGLHSLRQRHWYIQSTCATSGEGLYEGLDWLSNNIANKHRELLVKVQEVEFTFTM

SEQ ID NO: 24563 - protein, 183 aa, Festuca arundinacea
MGLTFSKLFDRLWGKKEMRILMVGLDAAGKTTILYKLKLGEIVTTIPTIGFNVETVEYKNIQFTVWDVGGQDKIRPLWRHYFQNTQGIIFVVDSNDRDRVVEAREELQRMLNEDELRDALLLVFANKQDLPNAMNAAEITDKLGLHSLRQRAWYIQSTCATSGDGLYEGLEWLSNSLRKAGHQ

SEQ ID NO: 24564 - protein, 183 aa, Secale cereale
  Sequence also found in Organisms: Triticum aestivum
MGLAFSKLFDRLWGKKEMRILMVGLDAAGKTTILYKLKLGEIVTTIPTIGFNVETVEYKNIQFTVWDVGGQDKIRPLWRHYFQNTQGIIFVVDSNDRDRIVEAREELQRMLNEDELRDAILLVFANKQDLPNAMNAAEITDKLGLHSLRQRAWYIQSTCATSGDGLYEGLEWLANTLRKAGHQ

SEQ ID NO: 24565 - protein, 183 aa, Picea glauca
MGLTFSKLFDRLWGKKEMRILMVGLDAAGKTTILYKLKLGEIVTTIPTIGFNVETVEYKNIQFTVWDVGGQDKIRPLWRHYFQNTQGIIFVVDSNDRDRVVEAREELQRMLNEDELRDALLLVFANKQDLPNAMNAAEITDKLGLHSLRQRAWYIQSTCATSGDGLYEGLEWLSNSLRKAGHN

SEQ ID NO: 24566 - protein, 181 aa, Chrysanthemum coronarium
MGLTFTKLFSALFAKREMRILMVGLDAAGKTTILYKLKIGEIVTTIPTIGFNVETVEYKNISFTVWDIGGQDKLRPLWRFYFQNTEGIIFAIDSNDRDRVLEARDELHKMLNEDELRDAVLLVLANKQDLPNAMNAAEITEKLGLHSLRKRPWYIQSTCATSGEGLYEGLEWLSKNIANKA

SEQ ID NO: 24567 - protein, 181 aa, Chrysanthemum coronarium
MGLTFTKLFSALFAKREMRILMVGLDAAGKTTILYKLKIGEIVTTIPTIGFNVESVEYKNISFTVWDIGGQDKLRPLWRFYFQNTEGIIFAVDSNDRDRVLEARDELHKILNEDELRDAVLLVLANKQDLPNAMNAAELTDKLGLHSLRKRPWYIQSTCATSGEGLYEGLDWLSKNIANKA

SEQ ID NO: 24568 - protein, 181 aa, Coffea canephora
MGLAISRFAKMLFAKKEMRILMVGLDAAGKTTILYKLKLGEIVTTIPTIGFNVETVEYKNASFTVWDVGGQDKIRPLWRHYFQNTQGLIFVVDSNDKERISEARDELHRMLNEEELRDAILLVFANKQDLPNAMRVSEITDKLGLHSLRQRRWYIQSACATSGQGLYEGLDWLSSNISSKA

SEQ ID NO: 24569 - protein, 181 aa, Gossypium hirsutum
MGTAISRLVRMLFAKKEMRILMVGLDAAGKTTILYKLKLGEIVTTIPTIGFNVETVEYKNVSFTVWDVGGQDKIRPLWRHYFQNTQGLIFVVDSNDRERVSEARDELHRMLSEDELRDATLLVFANKQDLPNAMTVSEITDKLGLHSLRQRRWYIQATCASSGQGLYEGLDWLSSNISNKA

SEQ ID NO: 24570 - protein, 181 aa, Eucalyptus grandis
MGLAISRFVKMLFAKKEMRILMVGLDAAGKTTILYKLKLGEIVTTIPTIGFNVETVEYKNVSFTVWDVGGQDKIRPLWRHYFQNTQGLIFVVDSNDRERVSEARDELHRMLSEDELRDATLLVFANKQDLPNAMSVSEITDKLGLHSLRQRRWYIQAACATNGQGLYEGLDWLSSNITTKA

SEQ ID NO: 24571 - protein, 181 aa, Festuca arundinacea
MGNMFAKLFQGLFGKKEMRILMVGLDAAGKTTILYKLKLGEIVTTIPTIGFNVETVEYKNISFTVWDVGGQDKIRPLWRHYFQNTQGLIFVVDSNDRERVGEAREELMRMLAEDELRDALLLVFANKQDLPNAMNAAEITDKLGLHSLRQRNWYIQSTCATSGDGLYEGLDWLSNQLKNQK

SEQ ID NO: 24572 - protein, 181 aa, Gossypium raimondii
MGMAISRLVRMLFAKKEMRILMVGLDAAGKTTILYKLKLGEIVTTIPTIGFNVETVEYKNVSFTVWDVGGQDKIRPLWRHYFQNTQGLIFVVDSNDRERVSEARDELHRMLSEDELRDATLLVFANKQDLPNAMTVSEITDKLGLHSLRQRRWYIQATCASSGQGLYEGLDWLSSNISNKA

SEQ ID NO: 24573 - protein, 181 aa, Heritiera littoralis
MGMAISRLVRMLFAKKEMRILMVGLDAAGKTTIFYKLKLGEIVTTIPTIGFNVETVEYKNVSFTVWDVGGQDKIRPLWRHYFQNTQGLIFVVDSNDRERVSEARDELHRMLSEDELRDATLLIFANKQDLPNAMTVSEITDKLGLHSLRQRRWYIQATCATSGQGLYEGLDWLSSNISSKA

SEQ ID NO: 24574 - protein, 161 aa, Nicotiana tabacum
MGLSFTKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCAT

SEQ ID NO: 24575 - protein, 183 aa, Ananas comosus
MGLTFSKLFDKLWGKKEMRILMVGLDAAGKTTILYKLKLGEIVTTIPTIGFNVETVEYKNIQFTVWDVGGQDKIRPLWRHYFQNTQGIIFVVDSNDRDRVVEAREELQRMLNEDELRDALLLVFANKQDLPNAMNAAEITDKLGLHSLRQRAWYIQSTCATSGDGLYEGLEWLSNSLRKAGHN

SEQ ID NO: 24576 - protein, 183 aa, Triticum aestivum
MGLTFSKLFDKLWGKKEMRILMVGLDAAGKTTILYKLKLGEIVTTIPTIGFNVETVEYKNIQFTVWDVGGQDKIRPLWRHYFQNTQGIIFVVDSNDRDRVVEAREELQRMLNEDELRDALLLVFANKQDLPNAMNAAEITDKLGLHSLRQRAWYIQSTCATSGDGLYEGLEWLSNSLRKAGHQ

SEQ ID NO: 24577 - protein, 182 aa, Panax ginseng
MGMAISRFVKMLFAKKEMRILMVGLDAAGKTTILYKLKLGEIVTTIPTIGFNVETVEYKNVSFTVWDVGGQDKIRPLWRHYFQNTQGLIFVVDSNDRERITEARDELHRMLNEDELRGATVLVFANKQDLPNAMNVSEITDKLGLHSLRQRRWYIQSTCATSGQGLYEGLDWLSSNIPTKAT

SEQ ID NO: 24578 - protein, 181 aa, Avena sativa
MGLSISKLLQGLFGKKEMRILMVGLDAAGKTTILYKLKLGEIVTTIPTIGFNVETVEYKNISFTVWDVGGQDKIRPLWRHYFQNTQGIIFVVDSNDRERISEAREELQRMLNEDELRDALLLVFANKQDLPNAMNAAEITDKLGLHSLRQRHWYIQATCATSGDGLYEGLEWLSTNLKRKV

SEQ ID NO: 24579 - protein, 181 aa, Populus trichocarpa
MGMAISRLVKLLFARKEMRILMVGLDAAGKTTILYKLKLGEIVTTIPTIGFNVETVEYKNVSFTVWDVGGQDKIRPLWRHYFQNTQGLIFVVDSNDRERVTEARDELHRMLSEDELRDATLLIFANKQDLPNAMSVSEITDKLGLHSLRQRRWYIQAACATSGQGLYEGLDWLSSNISSKA

SEQ ID NO: 24580 - protein, 160 aa, Sesamum indicum
MGLSFGKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDNLGLHSLRQRHWYIQSTCA

SEQ ID NO: 24581 - protein, 183 aa, Ananas comosus
MGLTFSKLFDRLWGKKEMRILMVGLDAAGKTTILYKLKLGEIVTTIPTIGFNVETVEYKNIQFTVWDVGGQDKIRPLWRHYFQNTQGIIFVVDSNDRDRIVEAREELQRMLNEDELRDAILLVFANKQDLPNAMNAAEITDKLGLHSLRQRAWYIQSTCATSGDGLYEGLEWLATTLRKAGHQ

SEQ ID NO: 24582 - protein, 200 aa, Cannabis sativa
MGLSFGKLFSKLFAKKEMRILMVGLDAAGKTTILYKLKLGEIVTTIPTIGFNVETVEYKNISFTVWDVGGQDKARSHFYYIFIHRFIRPLWRHYFQNTQGLIFVVDSNDRDRAVEARDELHRMLNEDELRDAVLLVFANKQDLPNAMNAAEITDKLGLHSLRQRHWYIQSTCATSGEGLYEGLDWLSNNIANKVATLASA

SEQ ID NO: 24583 - protein, 182 aa, Vitis vinifera
MGLVISRLLKMLFAKREMRILMVGLDAAGKTTILYKLKLGEIVTTIPTIGFNVETVEYKNVSFTVWDVGGQDKIRPLWRHYFQNTQGLIFVVDSNDRERILEAKDELHRMLSEDELRDATLLVFANKQDLPNAMSVSEITDKMGLHSLRQRRWYIQSTCATSGQGLYEGLDWLSSNISSKAR

SEQ ID NO: 24584 - protein, 181 aa, Ambrosia trifida
MGMAISRLVKMLFAKKEMRILMVGLDAAGKTTILYKLKLGEIVTTIPTIGFNVETVEYKDVSFTVWDVGGQDKIRPLWRHYFQNTQGLIFVIDSNDRDRITEARDELHRMINEDALRDATILVFANKQDLPNAMKAAEITDKLGLHSLRNRRWYIQSTCATSGEGLYEGLDWLSNNISTKG

SEQ ID NO: 24585 - protein, 181 aa, Malus domestica
MGMAISRLVKILFARKEMRILMVGLDAAGKTTILYKLKLGEVVTTIPTIGFNVETVEYKNVSFTVWDVGGQDKIRPLWRHYFQNTQGLIFVLDSNDRDRVLEARDELHRMLSEDELRDATLLVFANKQDLPNAMNVSEITDKLGLHSLRQRRWYIQAASATSGQGLYEGLDWLSSNISNKA

SEQ ID NO: 24586 - protein, 163 aa, Musa acuminata
MGLTFTKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRLRHWYIQSTCARGA

SEQ ID NO: 24587 - protein, 181 aa, Theobroma cacao
MGVTISRLVRMLFAKKEMRILMVGLDAAGKTTILYKLKLGEIVTTIPTIGFNVETVDYKNVSFTVWDVGGQDKIRPLWRHYFQNTQGLIFVVDSNDRERISEARDELHRMLSEDELRDATLLVFANKQDLPNAMTVSEITDKLGLHSLRQRRWYMQATCATSGQGLYEGLDWLSSNISSKA

SEQ ID NO: 24588 - protein, 181 aa, Ricinus communis
MGMAISRLIKLLFAKKEMRILMVGLDAAGKTTILYKLKLGEIVTTIPTIGFNVETVEYKNVSFTVWDVGGQDKIRPLWRHYFQNTQGLIFVVDSNDRERISEARDELQRMLSEDELRDATLLVFANKQDLPNAMTVSEVTDKLGLHSLRQRRWYIQATCATSGQGLYEGLDWLSSNISSKG

SEQ ID NO: 24589 - protein, 181 aa, Vitis vinifera
MGLVISRLLKMLFAKREMRILMVGLDAAGKTTILYKLKLGEIVTTIPTIGFNVETVEYKNVSFTVWDVGGQHKIRPLWRHYFQNTQGLIFVVDSNDRERILEAKDELHRMLSEDELRDATLLVFANKQDLPNAMSVSEITDKMGLHSLRQRRWYIQSTCATSGQGLYEGLDWLSSNISSKA

SEQ ID NO: 24590 - protein, 183 aa, Echinacea purpurea
MGMAFSKVFDRLWGKKEMRILMVGLDAAGKTTILYKLKLGEIVTTIPTIGFNVETVEYKNIQFTVWDVGGQDKIRPLWRHYFQNTQGIIFVVDSNDRDRITEAREELQRMLNEDELRDAILLVFANKQDLPNAMNAAEITDKLGLHSLRQRAWYIQSTCATSGDGLYEGLEWLSNSLRKAGHN

SEQ ID NO: 24591 - protein, 183 aa, Rosmarinus officinalis
MGMAFSKVFDRLWGKKEMRILMVGLDAAGKTTILYKLKLGEIVTTIPTIGFNVETVEYKNIQFTVWDVGGQDKIRPLWRHYFQNTQGIIFVVDSNDRDRITEAREELQRMLNEDELRDAILLVFANKQDLPNAMNAAEITDKLGLHSLRQRAWYIQSTCATSGDGLYEGLEWLANTLRKAGHQ

SEQ ID NO: 24592 - protein, 182 aa, Prunus persica
MGMAISRMVKMLFARKEMRILMVGLDAAGKTTILYKLKLGEVVTTIPTIGFNVETVEYKNVSFTVWDVGGQDKIRPLWRHYFQNTQGLIFVVDSNDRDRVSEARDELHRMLSEDELREATLLVFANKQDLPNAMSVSEITDKLGLHSLRQRRWYIQAACATSGQGLYEGLDWLSSNISSKAR

SEQ ID NO: 24593 - protein, 183 aa, Saccharum officinarum
MGLSFSKLLQELFGKKEMRILMVGLDAAGKTTILYKLKLGEIVTTIPTIGFNVETVEYKNISFTVWDVGGQDKIRPLWRHYFQNTQGIIFVVDSNDRERVVEAREELQRMLNEDELRDALLLVFANKQDLPNAMNAAEITDKLGLHSLRQRSWYIQAACATSGDGLYEGLEWLSNNLKKRGTK

SEQ ID NO: 24594 - protein, 181 aa, Acacia harpophylla
MGLAISRLFRLFYSKKEMRILMVGLDAAGKTTILYKLKLGEIVTTIPTIGFNVETVEYKNVSFTVWDVGGQDKIRPLWRHYFQNTQGLIFVVDSNDRERIAEARDELHRMLSEDELRGATLLVFANKQDLPNAMSVSEITDKLGLHSLRQRRWYIQATCATSGQGLYEGLDWLSSNISNRA

SEQ ID NO: 24595 - protein, 181 aa, Catharanthus roseus
MGLAISRFVKMFFTKKEMRILMVGLDAAGKTTILYKLKLGEIVTTIPTIGFNVETVEYKNVSFTVWDVGGQDKIRPLWRHYFQNTQGLIFVVDSNDRERISEARDELHRMLNEEELREATLLVFANKQDLPNAMTVSEMTDKLGLHSLRQRRWYIQSTCATSGQGLYEGLDWLSTNISSKA

SEQ ID NO: 24596 - protein, 181 aa, Centaurea maculosa
MGMAISRLIKMLFAKKEMRILMVGLDAAGKTTILYKLKLGEIVTTIPTIGFNVETVEYKDVSFTVWDVGGQDKIRPLWRHYFQNTQGLIFVVDSNDRDRITEARDELHRMLNEDALREATILVFANKQDLPNAMKVSELTDKLGLHSLRHRRWYIQSTCATSGEGLYEGLDWLSSNISTKG

SEQ ID NO: 24597 - protein, 181 aa, Cichorium intybus
MGMAISRLVKMLFAKKEMRILMVGLDAAGKTTILYKLKLGEIVTTIPTIGFNVETVEYKDVSFTVWDVGGQDKIRPLWRHYFQNTQGLIFVVDSNDRDRITEARDELHRMLNEDALREATILVFANKQDLPNAMRVSELTDKLGLHSLRHRRWYIQSTCATSGEGLYEGLDWLSSNISTKG

SEQ ID NO: 24598 - protein, 181 aa, Carica papaya
MGVAISRLVRIFFAKKEMRILMVGLDAAGKTTILYKLKLGEIVTTIPTIGFNVETVEYKNVSFTVWDVGGQDKIRPLWRHYFYNTQGLIFVVDSNDRERILEAKDELHRMLGEDELRDATLLVFANKQDLPNAMTVSEITDKLGLHSLRQRRWYIQATCASSGQGLYEGLDWLSSNISSKA

SEQ ID NO: 24599 - protein, 181 aa, Rosmarinus officinalis
MGLAISRFMKMFFSRKEMRILMVGLDAAGKTTILYKLKLGEIVTTIPTIGFNVETVEYKNVSFTVWDVGGQDKIRPLWRHYFQNTQGLIFVVDSNDRERISEARDELHRMLNEDELREATLLVFANKQDLPNAMVVSEMTDKLGLHSLRQRSWYIQSACATSGQGLYEGLDWLSSNISSKA

SEQ ID NO: 24600 - protein, 181 aa, Tabernaemontana elegans
MGLAISRFVKMFFSKKEMRILMVGLDAAGKTTILYKLKLGEIITTIPTIGFNVETVEYKNVSFTVWDVGGQDKIRPLWRHYFQNTQGLIFVVDSNDRERISEARDELHRMLNEEELRDSTLLVFANKQDLPNAMSVSEMTDKLGLHSLRQRRWYIQSTCATSGQGLYEGLDWLSSNISSKA

SEQ ID NO: 24601 - protein, 181 aa, Tragopogon dubius
MGMAISRLVRMLFAKKEMRILMVGLDAAGKTTILYKLKLGEIVTTIPTIGFNVETVEYKDVSFTVWDVGGQDKIRPLWRHYFQNTQGLIFVVDSNDRDRITEARDELHRMLNEDALREATILVFANKQDLPNAMRVSELTDKLGLHSLRHRRWYIQSTCATSGEGLYEGLDWLSSNISTKG

SEQ ID NO: 24602 - protein, 181 aa, Citrullus lanatus
MGVAISRLVRMLFAKKEMRILMVGLDAAGKTTILYKLKLGEIVTTIPTIGFNVETVEYKNVSFTVWDVGGQDKIRPLWRHYFQNTQGLIFVVDSNDKDRISEARDELHRMLSEHELVDATVLVFANKQDLPNAMTVAEITDKLGLHSLRHRRWYIQATCATSGQGLYEGLDWLSSNISNKA

SEQ ID NO: 24603 - protein, 182 aa, Trifolium pratense
MGLTVSRLMRLFYAKKEMRILMVGLDAAGKTTILYKLKLGEIVTTIPTIGFNVETVEYKNVSFTVWDVGGQDKIRPLWRHYFQNTQGLIFVVDSNDRERILEARDELHRMLSEDELRDATLLVFANKQDLPNALSVSEITDKLGLHSLRQRRWYIQSTCATSGQGLYEGLDWLSSNISNKIR

SEQ ID NO: 24604 - protein, 182 aa, Lupinus angustifolius
MGLTISRLFRLLYSKKEMRILMVGLDAAGKTTILYKLKLGEIVTTIPTIGFNVETVEYKNISFTVWDVGGQDKIRPLWRHYFQNTQGLIYVVDSNDRERISEARDELHRMLSEDELREATLLVFANKQDLPNALSVAEITDKLGLNSFRQRRWYIQATCATSGQGLYEGLDWLSSNISSKAK

SEQ ID NO: 24605 - protein, 182 aa, Ananas comosus
MGMSFSKLFANFFGKKEMRILMVGLDAAGKTTILYKLKLGEIVTTIPTIGFNVETVEYKNIQFTVWDVGGQDKIRPLWRHYFQNTQGIIFVVDSNDRDRVVEAREELQRMLNEDELRDAILLVFANKQDLPNAMAAAEITDKLGLTSLRARTWYIQSTCATSGDGLFEGLEWLSANLKKQAP

SEQ ID NO: 24606 - protein, 182 aa, Prunus mume
MGMAISRMVKMLFARKEMRILMVGLDAAGKTTILYKLKLGEVVTTIPTIGFNVETVEYKNVSFTVWDVGGQDKIRPLWRHYFQNTQGLIFVVDSNDRDRVSEARDELHRMLSEDELREATLLVFANKQDLPNSMSVSEITDKLGLHSLRQRRWYIQAACATSGQGLYEGLDWLSSNISSKAR

SEQ ID NO: 24607 - protein, 182 aa, Triticum aestivum
MGNMFANLFKGLFGKKEMRILMVGLDAAGKTTILYKLKLGEIVTTIPTIGFNVETVEYKNISFTVWDVGGQDKIRPLWRHYFQNTQGLIFVVDSNDRERIGEAREELMRMLAEDELRDAVLLIFANKQDLPNAMNAAEITDKLGLHSLRNRNWYIQATCATSGDGLYEGLDWLSNQLKSANR

SEQ ID NO: 24608 - protein, 159 aa, Artemisia annua
MGLSFGKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGSQSLRRRHWYIQSTC

SEQ ID NO: 24609 - protein, 188 aa, Manihot esculenta
MGLAISRLLKLLFAKKEMRILMVGLDAAGKTTILYKLKLGEIVTTIPTIGFNVETVEYKNVSFTVWDVGGQDKIRPLWRHYFQNTQGLIFVVDSNDKERISEARDELHRMLNEDELRDATLLVFANKQDLPNAMTVSEITDKLGLHSLRQRRWYIQSTCATSGQGLYEGLDWLSSNISSKVSSLTHIL

SEQ ID NO: 24610 - protein, 181 aa, Centaurea maculosa
  Sequence also found in Organisms: Cirsium arvense
MGMAISRLIKMLFAKKEMRILMVGLDAAGKTTILYKLKLGEIVTTIPTIGFNVETVEYKDVSFTVWDVGGQDKIRPLWRHYFQNTQGLIFVVDSNDRDRITEARDELHRMLNEDALREATILVFANKQDLPNAMKVSELTDKLGLHSLRHRRWYIQSTCATSGEGLYEGLDWLSNNISTKG

SEQ ID NO: 24611 - protein, 180 aa, Chrysanthemum coronarium
MGMAISRMVRMLFAKKEMRILMVGLDAAGKTTILYKLKLGEIVTTIPTIGFNVETVEYKDVSFTVWDVGGQDKIRPLWRHYFQNTQGLIYVIDSNDRDRITEARDELHRMLNEDALREATILVFANKQDLPNAMRVSEITDKLGLHSLRNRRWYIQSTCATSGEGLYEGLDWLSSNISSK

SEQ ID NO: 24612 - protein, 181 aa, Cynara scolymus
MGMAISRLIKMLFAKKEMRILMVGLDAAGKTTILYKLKLGEIVTTIPTIGFNVETVEYKDVSFTVWDVGGQDKIRPLWRHYFQNTQGLIFVVDSNDRDRITEARDELHRMLNEDALREATILVFANKQDLPNAMKVSELTDKLGLHSLRHRRWYIQSTCATSGEGLYEGLDWLSTNISTKG

SEQ ID NO: 24613 - protein, 157 aa, Lolium multiflorum
MGLTFTKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQS

SEQ ID NO: 24614 - protein, 181 aa, Cucumis melo
MGVAISRLVRMLFAKKEMRILMVGLDAAGKTTILYKLKLGEIVTTIPTIGFNVETVEYKNVSFTVWDVGGQDKIRPLWRHYFQNTQGLIFVVDSNDKERISEARDELHRMLSEHELVDATVLVFANKQDLPNAMTVAEITDKLGLHSLRNRRWYIQATCATSGQGLYEGLDWLSSNISTKA

SEQ ID NO: 24615 - protein, 181 aa, Momordica charantia
MGVAISRLVRMLFAKKEMRILMVGLDAAGKTTILYKLKLGEIVTTIPTIGFNVETVEYKNVSFTVWDVGGQDKIRPLWRHYFQNTQGLIFVVDSNDKERISEARDELHRMLSEHELVDATVLVFANKQDLPNAMTVAEITDKLGLHSLRNRRWYIQATCATSGQGLYEGLDWLSSNISNKA

SEQ ID NO: 24616 - protein, 179 aa, Lippia dulcis
SAVSRFVKMLFAKREMRILMVGLDAAGKTTILYKLKLGEIVTTIPTIGFNVETVEYKNVSFTVWDVGGQDKIRPLWRHYFQNTQGLIFVVDSNDRERIAEARDELHRMLSEDELRDATLLVFANKQDLPNAMSVPEITDKLALHSLRQRRWYIQSTCATSGLGLYEGLDWLSSNISSKV

SEQ ID NO: 24617 - protein, 181 aa, Papaver somniferum
MGMAISRLVRMLFAKREMRILMVGLDAAGKTTILYKLKLGEIVTTIPTIGFNVETVEYKNVSFTVWDVGGQDKIRPLWRHYFQNTQGLIFVIDSNDRERIVEARDEIHRMLSEEELRDATLLVFANKQDLPNAMSVAEITDKLGLHSLRLRRWYIQSACATSGEGLYEGLDWLSNNISTKT

SEQ ID NO: 24618 - protein, 179 aa, Triticum aestivum
MGLTFTKLFSRLFAKKEMRILMVGLDAAGKTTILYKLKLGEIVTTIPTIGFNVETVEYKNISFTVGCGAKTRSGPVEALLPEYAGLNFVVDSNDRERVVEARDELHRMLNEDELRDAVLLVFANKQDLPNAMNAAEITDKLGLHSLRQRHWYIQSTCATSGEGLYEGLDWLSNNIANKA

SEQ ID NO: 24619 - protein, 185 aa, Aquilegia formosa
MGLAISRLVRMLFAKREMRILMVGLDAAGKTTILYKLKLGEIVTTIPTIGFNVETVEYKNVSFTVWDVGGQDKIRPLWRHYFQNTQGLIFVVDSNDRDRVSEARDELHRMLSEDELREATLLIFANKQDLPNAMSVSEITDKLGLHSLRQRRWYIQSACATAGQGLYEGLDWLSNNISNKASVYI

SEQ ID NO: 24620 - protein, 205 aa, Chrysanthemum coronarium
TLLVSDLKITFLSIFRLPAIIQQRWGLSFGKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLQSLRQRHWYIQSTCATSGEGLYEGLDWLSNNIANKA

SEQ ID NO: 24621 - protein, 180 aa, Solanum phureja
MGLCFTKLIICLFAKKEMRILMVGLDDAGKTTILYKLKLGEIVTAIRTSGFNVETVEYKNIIFTVWDVGGQDRIRPLWRHYFQNTQGLIFVVDSNDRDRVGEARDELHRMLYEDELREAVLLVFANKQDLPNAMNAAEITDKLGLHSLHSLQQRHWHIQSTCATSGEGLYEGLDWLSNKA

SEQ ID NO: 24622 - protein, 190 aa, Zostera marina
MGVAFTKLLNCIFAKTEMRILMVGLDAAGKTTILYKLKLGEVVTTIPTIGFNVETVEYKNISFTVWDVGGQDKIRPLWRHYFQNTQGLIFVVDSSDRDRVGEARDELHRMINEDELRDAVLLVFANKQDLPNAMKADEITEKLGLDSLRQRHWYIQSTCATNGEGLYEGLDWLSSNISGKSSNLRSSNNG

SEQ ID NO: 24623 - protein, 180 aa, Secale cereale
MGLTFTKLFSRLFAKKEMRILMVGLDAAGKTTILYKLKLGEIVTTIPTIGFNVETVEYKNISFTVWMWGPRQDQAPVEALLPEYARAHFVVDSNDRERVVEARDELHRMLNEDELRDAVLLVFANKQDLPNAMNAAEITDKLGLHSLRQRHWYIQSTCATSGEGLYEGLDWLSNNIANKA

SEQ ID NO: 24624 - protein, 182 aa, Cicer arietinum
MGLTVSRLMRLFYAKKEMRILMVGLDAAGKTTILYKLKLGEIVTTIPTIGFNVETVEYKNVSFTVWDVGGQDKIRPLWRHYFQNTQGLIFVVDSNDRERILEARDELHRMLSEDELRYASLLVFANKQDLPNALSVAEITDKLGLHSLRQCRWYIQSTCATSGQGLYEGLDWLSSNISIKTR

SEQ ID NO: 24625 - protein, 182 aa, Lupinus angustifolius
MGLSISKLLSELFGRREMRILMVGLDAAGKTTILYKLKLGEIVTTIPTIGFNVETVEYKNISFTVWDVGGQDKIRPLWRHYFQNTQGIIFVVDSNDRERVSEAREELQRMLNEDELRDALLLVFANKQDLPNAMNASEITDKLGLQSLRQRAWYIQSTCATSGDGLYEGLEWLSNNLRKRQS

SEQ ID NO: 24626 - protein, 182 aa, Medicago truncatula
MGLTVSRIMRLFYAKKEMRILMVGLDAAGKTTILYKLKLGEIVTTIPTIGFNVETVEYKNVSFTVWDVGGQDKIRPLWRHYFQNTQGLIFVVDSNDRERILEARDELHRMLSEDELRDATLLVFANKQDLPNALSVSEITDKLGLHSLRQRRWYIQSTCATSGQGLYEGLDWLSSNISNKIR

SEQ ID NO: 24627 - protein, 182 aa, Rosmarinus officinalis
MGNMFANLFKGLFGKKEMRILMVGLDAAGKTTILYKLKLGEIVTTIPTIGFNVETVEYKNISFTVWDVGGQDKIRPLWRHYFQNTQGLIFVVDSNDRERIGEAREELMRMLAEDELRDAVLLIFANKQDLPNAMNAAEITDKLGLHSLRNRNWYIQATCATSGDGLYEGLDWLSNQLKNANR

SEQ ID NO: 24628 - protein, 181 aa, Amaranthus tuberculatus
MGVMVSRLVRMLFAKKEMRILMVGLDAAGKTTILYKLKLGEVVTTIPTIGFNVETVEYKNVSFTVWDVGGQDKIRPLWRHYFQNTQGLIFVVDTNDRDRINEARDELHRMLSEDELSDATLLVFANKQDLPNAMPVAEVTDKLGLHSLRRRRWYIQAACATSGEGLYEGLDWLSSNIFNKV

SEQ ID NO: 24629 - protein, 202 aa, Cleome gynandra
FKGPFQGTRSRSLWFFFGSLKWDFHSGRLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATSGEGLYEGLDWLSNNIANKA

SEQ ID NO: 24630 - protein, 181 aa, Lactuca sativa
MGMAISRYVRMLFAKKEMRILMVGLDAAGKTTILYKLKLGEIVTTIPTIGFNVETVEYKDVSFTVWDVGGQDKIRPLWRHYFQNTQGLIFVVDSNDRDRVTEARDELHRMLNEDALREATILVFANKQDLPNAMRVSELTEKLGLHSLRHRRWYMQSTCATSGEGLYEGLDWLSSNISTKG

SEQ ID NO: 24631 - protein, 181 aa, Sesamum indicum
MGLAFSRMLKALFAKREMRILMVGLDAAGKTTILYKLKLGEIITTIPTIGFNVETVEYKNVSFTVWDVGGQDKIRPLWRHYFQNTQGLIFVVDSNDRERITEARDELHRMLNEEDLRDATVLVFANKQDLPNAMTVPEVTDKLGLHSLRLRRWYIQSTCATSGQGLYEGLDWLSSNISTKV

SEQ ID NO: 24632 - protein, 181 aa, Silene vulgaris
MGSVFAKLFKGLIGKKEMRILMVGLDAAGKTTILYKLKLGEIVTTIPTIGFNVETVEYKNINFTVWDVGGQDKIRPLWRHYFQNTQGLIFVVDSNDRDRIGEANEELQKMLREDELRDATLLVFANKQDLPNAMSVSEITDKLGLHSLGSRKWYIQATCATTGDGLYEGLDWLSSALSSKA

SEQ ID NO: 24633 - protein, 181 aa, Fragaria vesca
MGMAISRMLKMLFARKEMRILMVGLDAAGKTTILYKLKLGEVVTTIPTIGFNVETVEYKNVSFTVWDVGGQDKIRPLWRHYFQNTQGLIFVVDSNDKDRVSEARDELHRMLSEDELSNATLLVFANKQDLPNAMSVSEITDKLGLHSLRQRRWYIQAACATSGQGLYEGLDWLSSNISSKT

SEQ ID NO: 24634 - protein, 181 aa, Volvox carteri
MGMAFSRVFERLFGKKEMRILMVGLDAAGKTTILYKLKLGEVVTTIPTIGFNVETVEYKNISFTVWDVGGQDKIRPLWRHYYQNTQGLIFVVDSNDRDRVDAARDELHRMLNEDELRDSVLLVFANKQDLPNAMSAAEMTDKLGLHGLRHRQWFIQACCATTGDGLYEGLDWLSATLQKQK

SEQ ID NO: 24635 - protein, 200 aa, Actinidia deliciosa
MGLSFTKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVIEARDELHRMLNEDELRDAVLLVFANKQDLPNAMNAAEITDKLGLHSLRQRHWYIQSTCATSGEGLYEGLDWLSKTSLARLRRWHDGSNTSGPECLNRET

SEQ ID NO: 24636 - protein, 181 aa, Fagus grandifolia
MGVAFSRVFERLFGKKEMRILMVGLDAAGKTTILYKLKLGEVVTTIPTIGFNVETVEYKNISFTVWDVGGQDKIRPLWRHYYQNTQGLIFVVDSNDRDRVDAARDELHRMLNEDELRDSVLLAFANKQDLPNAVSAAEMTDKLGLHGLRHRQWFIQACCATTGDGLYEGLDWLSATLQKAK

SEQ ID NO: 24637 - protein, 181 aa, Cannabis sativa
MGLSISRFMRMFFAKKEMRILMVGLDAAGKTTILYKLKLGEVVTTIPTIGFNVETVEYKNVSFTVWDVGGQDKIRPLWRHYFQNTQGLIFVVDSNDRERISEAKDELHRMLNEDELRYATLLVFANKQDLPNAMSVSEITDKLGLHSMRQRRWYIQAACATAGQGLYEGLDWLSSNISTKA

SEQ ID NO: 24638 - protein, 181 aa, Cirsium arvense
MGMAISRLIKMLFAKKEMRILMVGLDAAGKTTILYKLKLGEIVTTIPTIGFNVENVEYKDVSFTVWDVGGQDKIRPLWRHYFQNTQGLIFVVDSNDRDRITESRDELHRMLNEDALREAIVLVFANKQDLPNAMKVSELTDKLGLHSLRHRRWYIQSTCATSGEGLYEGLDWLSNNISTKG

SEQ ID NO: 24639 - protein, 181 aa, Cleome spinosa
MGMAISRMLRSLFAKKEMRILMVGLDAAGKTTILYKLKLGEIVTTIPTIGFNVETVEYKNVSFTVWDVGGQDKIRPLWRHYFQNTQGLIYVVDSNDRERIHEARDELHRMLSEEELREATVLVFANKQDLPNAMTVSEITDKLGLHSLRLRRWYIQATCATSGQGLYEGLDWLSSNITSKT

SEQ ID NO: 24640 - protein, 181 aa, Cucurbita pepo
MGMAISRLVRMLFAKKEMRILMVGLDASGKTTILYKLKLGEIVTTIPTIGFNVETVEYKNVSFTVWDVGGQDKIRPLWRHYFQNTHGLIFVVDSNDKDRISEARDELHRMLSEHELVDATVLVFANKQDLPNAMTVAEITDKLGLHSLRHRRWYIQATCATSGQGLYEGLDWLSSNISNKV

SEQ ID NO: 24641 - protein, 181 aa, Guizotia abyssinica
MGMAISRLVKMLFAKKEMRILMVGLDAAGKTTVLYKLKLGEIVTTIPTIGFNVETVDYKDVSFTVWDVGGQDKIRPLWRHYFQNTQGLIYVIDSNDRDRITEARDELHRMLNEDALREATILVFANKQDLPNAMKISEITDKLGLHSLRNRRWYIQSTCATSGEGLYEGLDWLSSNISTKV

SEQ ID NO: 24642 - protein, 181 aa, Cajanus cajan
MGLSVSRLVRLFYAKKEIRILMVGLDAAGKTTILYKLKLGEIVTTIPTIGFNVETVEYRNASFTVWDVGGQDKIRPLWRHYFQNTQGLIFVVDSNDRERILEARDELHRMLSEDELRDATILVFANKQDLPNALSVAEITDKLGLHSLRLRRWYIQPTCATSGQGLYEGLDWLSSNISNKA

SEQ ID NO: 24643 - protein, 164 aa, Pseudotsuga menziesii
KLFDKLWGKKEMRILMVGLDAAGKTTILYKLKLGEIVTTIPTIGFNVETVEYKNISFTVWDVGGQDKIRPLWRHYFQNTQGIIFVVDSNDRDRVVEAREELQRMLNEDELRDALLLVFANKQDLPNAMNAAEITDKLGLHSLRQRAWYIQSTCATSGDGLYEGL

SEQ ID NO: 24644 - protein, 180 aa, Carthamus tinctorius
MGMAISRLIKMLFVKKEMRILMVGLDAAGKTTILYKLKLGEIVTTIPTIGFNVGTVEYKDVSFTVWDVGGQDKIRPLWRHYFQNTQGLIFVVDSNDRDRITEARDELHRMLNEDALREATILVFANKQDLPNAMKVSELTDKLGLHSLRHRRWYIQSTCATSGEGLYEGLDWLSNNISTK

SEQ ID NO: 24645 - protein, 153 aa, Panicum virgatum
MGLAFGKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHW

SEQ ID NO: 24646 - protein, 181 aa, Valeriana officinalis
MGMAISRMVKAMFAKKEMRILMVGLDAAGKTTILYKLKLGEIVSTIPTIGFNVETVEYKNVSFTVWDVGGQDKIRPLWRHYFQNTQGLIYVVDSNDRDRISEARDELHRMLNEDALRDSTLLIFANKQDLPNSMSVSEITDKLSLHSLRQRRWYIQSTCATAGQGLYEGLDWLSSNISTKA

SEQ ID NO: 24647 - protein, 182 aa, Cocos nucifera
MGLAISRLVKMLFAKREMRILMVGLDAAGKTTILYKLKLGEVITTIPTIGFNVETVEYKNVSFTVWDVGGQDKIRPLWRHYFQNTQGLIFVVDSNDRERILEARNELHRMLGEDELQGATLLVFANKQDLPNAMTVSEITDKLGLHALRQRRWYIQSACATTGDGLYEGLDWLSSNISNKTR

SEQ ID NO: 24648 - protein, 180 aa, Chrysanthemum coronarium
MGMAISRMVRMLFAKKEMRILMVGLDAAGKTTILYKLKLGEIVTTIPTIGFNVETVEYKDVSLTVWDVGGQDKIRPLWRHYFQNTQGLIYVIDSNDRDRIIEARDELHRMLNEDALREATILIFANKQDLPNAMRVSEITDKLGLHSLRNRRWYIQSTCATSGEGLYEGLDWLSSNISTK

SEQ ID NO: 24649 - protein, 153 aa, Cucumis sativus
MGLTFGKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHW

SEQ ID NO: 24650 - protein, 180 aa, Panax ginseng
MGLSFTKLFSRLFAKTEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRQLGIFQDANIRRPRVRGRRSIRTVRSSDR

SEQ ID NO: 24651 - protein, 160 aa, Raphanus sativus
MGVSFGKLFSRLFAKKEMRILVTTIPTIGFNVETVEYKNISFTVWDVGGQDKIRPLWRHYFQNTQGLIFVVDSNDRDRVVEARDELHRMLNEDELRDAVLLVFANKQDFPNAMNAAEITDKLGLHSFRQRHWYIQSTCATSGEGLYEGLDWLSNNIANKG

SEQ ID NO: 24652 - protein, 154 aa, Sesamum indicum
MGLTFTKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWY

SEQ ID NO: 24653 - protein, 180 aa, Silene vulgaris
MGAMLSKLVKMMFAKKEMRILMVGLDAAGKTTILYKLKLGEVVTTIPTIGFNVETVEYKNVSFTVWDVGGQDKIRPLWRFYFQNTQGLIFVIDSNDRDRVIEARDELHKMLSEDELKDATVLVFANKQDLPNAMTVAEITDKLGLNSLRHRRWYIQSACAPSGEGLYEGLDWLSSSISKV

SEQ ID NO: 24654 - protein, 181 aa, Spinacia oleracea
MGATLSRLIKMMFAKKEMRILMVGLDAAGKTTILYKLKLGEVVTTIPTIGFNVETVDYKNVGFTVWDVGGQDKIRPLWRYYYQNTQGLIFTVDSNDRERIAEARDELHRMLNEDELRDATLLVFANKQDLPNAMTVAEITDKLGLHSLRQRRWYIQAACATSGEGLYEGLDWLSSNISIKP

SEQ ID NO: 24655 - protein, 202 aa, Arachis hypogaea
MGLNSFVKVSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATSGEGLYEGLDWLSNRGSTCATSGEGLYEGLDWLSNNIANKA

SEQ ID NO: 24656 - protein, 182 aa, Glycine max
MGLTVSRLLRLFYARKEMRILMVGLDAAGKTTILYKLKLGEIVTTIPTIGFNVETVEYKNVSFTVWDVGGQDKIRPLWRHYFQNTQGLIFVVDSNDRERILEARDELHRMLSEDELRDATVLVFANKQDLPNALSVAEITDKLGLHSLRLRRWYIQPTCATSGQGLYEGLDWLSSHITNKTR

SEQ ID NO: 24657 - protein, 153 aa, Chrysanthemum coronarium
  Sequence also found in Organisms: Glycyrrhiza uralensis
MGLSFTKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHW

SEQ ID NO: 24658 - protein, 180 aa, Citrus clementina
  Sequence also found in Organisms: Citrus sinensis
MGMVISRLKMLFARKEMRILMVGLDAAGKTTILYKLKLGEIVTTIPTIGFNVETVEYKNVSFTVWDVGGQDKIRPLWRHYFQNTHGLIFVVDSNDRERIGEAKDELHRMLSEDELREAVLLVFANKQDLPNAMSVSEVTDKLGLHSLRQRRWYIQAACATSGQGLYEGLDWLSSNVSAKG

SEQ ID NO: 24659 - protein, 181 aa, Flaveria ramosissima
MGMAISRLVKMLFAKKEMRILMVGLDAAGKTTILYKLKLGEIVTTIPTIGFNVETLEYKDVSFTVWDVGGQDKIRPLWRHYFQNTQGLIFVIDSNDRERIIEARDELHRMLDEDALREATILVFANKQDLPNAMKVSEITDKLGLHSLRNRRWYVQSTCATSGDGLYEGLDWLSSNISTKG

SEQ ID NO: 24660 - protein, 153 aa, Lactuca sativa
  Sequence also found in Organisms: Triticum aestivum
MGLTFTKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHW

SEQ ID NO: 24661 - protein, 154 aa, Lolium multiflorum
MGLTFTKLFSRLFAKKEMRILMVGLDAVGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWY

SEQ ID NO: 24662 - protein, 165 aa, Quercus alba
MGLTFSKLFDRLWGKKEMRILMVGLDAAGKTTILYKLKLGEIVTTIPTIGFNVETVEYKNIQFTVWDVGGQDKIRPLWRHYFQNTQGIIFVVDSNDRDRIVEAREELQRMLNEDELRDAILLVFANKQDLPNAMNAAEITDKLGLHSLRQRAWYIQSTCATSGDG

SEQ ID NO: 24663 - protein, 181 aa, Helianthus annuus
MGMAISRLVKMLFAKKEMRILMVGLDAAGKTTILYKLKLGEIVTTIPTIGFNVETVEYKDVSFTVWDVGGQDKIRPLWRHYFQNTQGLIFVIDSNDRERITEARDELHRMIHEDALREATILVFANKQDLPNAMKVSEITDRLGLHSLRNRRWYIQSTCATSGEGLYEGLDWLSTNISAKG

SEQ ID NO: 24664 - protein, 189 aa, Solanum phureja
MGMSISKFVKMLFAKKEMRILMVGLDAAGKTTILYKLKLGEIVTTIPTIGFNVETVEYKNSSFTVWDVGGQDKIRPLWRHYFQNTQGLIFVVDSNDRDRISEARDELHRMLNEEELRGATILVFANKQDLPNAMNVADITDKLGLHSLRQRRWYIQSACATSGQGLYEGLDWLSHNITGKARTLWPFHL

SEQ ID NO: 24665 - protein, 188 aa, Amborella trichopoda
MGMAISRMVRMLFAKREMRILMVGLDAAGKTTILYKLKLGEIVTTIPTIGFNVETVEYKNVSFTVWDVGGQDKIRPLWRHYFQNTQGLIFVVDSNDRERISEAKDELHRMLSEDELRDATLLVFANKQDLPNAMRVSEITDKLGLHSLRQRRWYIQSTCATSGEGLYEGLDWLSQNITNKGMTFGIVR

SEQ ID NO: 24666 - protein, 182 aa, Phaseolus vulgaris
MGLTVSRLMRLFYARKEMRILMVGLDAAGKTTILYKLKLGEIVTTIPTIGFNVETVEYKNVSFTVWDVGGQDKIRPLWRHYFQNTQGLIFVVDSNDRERILESRDELHRMLSEDELRDATVLVFANKQDLPNALSVAEITDKLGLHSLRLRRWYIQPTCATSGQGLYEGLDWLSSHISNKTR

SEQ ID NO: 24667 - protein, 163 aa, Castanea mollissima
MGLTFSKLFDKLWGKKEMRILMVGLDAAGKTTILYKLKLGEIVTTIPTIGFNVETVEYKNIQFTVWDVGGQDKIRPLWRHYFQNTQGIIFVVDSNDRDRVVEAREELQRMLNEDELRDAILLVFANKQDLPNAMNAAEITDKLGLHSLRQRAWYIQSTCATSG

SEQ ID NO: 24668 - protein, 180 aa, Flaveria ramosissima
GMAISRLVKMLFAKKEMRILMVGLDAAGKTTILYKLKLGEIVTTIPTIGFNVETLEYKDVSFTVWDVGGQDKIRPLWRHYFQNTQGLIFVIDSNDRERIIEARDELHRMLDEDALRDATILVFANKQDLPNAMKVSEITDKLGLHSLRNRRWYVQRTCATSGEGLYEGLDWLSINISPKG

SEQ ID NO: 24669 - protein, 179 aa, Chenopodium quinoa
MGVALSRLVKMMFAKKEMRILMVGLDAAGKTTILYKLKLGEVVTTIPTIGFNVETVEYKNVGFTVWDVGGQDKIRPLWRYYYQNTQGLIYVVDSNDRERIAEARDELHRMLNEDELRDASLLVFANKQDLPNAMPVAEITDKLGLHSLRQRRWFIQAACATSGEGLYEGLEWLTSNITT

SEQ ID NO: 24670 - protein, 211 aa, Pteridium aquilinum
ECAGLFISSSRSSFLGSLSIPSVTSTSRKKDGLSFAKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATSGEGLYEGLDWLSNNIANKA

SEQ ID NO: 24671 - protein, 159 aa, Acacia harpophylla
MGLTFTKLFSRLFAKKEMRILMVGLDAAGKTTILYKLKLGEIVTTIPTIGFNVETVEYKNISFTVWDVGGQDKIRPLWRHHFQNTQGLIFVVDSNDRDRVVEARDELHRMLNEDELRDAVLLVFANKQDLPNAMNAAEITDKLGLHSLRQRHWLDHINF

SEQ ID NO: 24672 - protein, 188 aa, Cucumis sativus
MGVAISRLVRMLFAKKEMRILMVGLDAAGKTTILYKLKLGEIVTTIPTIGFNVETVEYKNVSFTVWDVGGQDKIRPLWRHYFQNTQGLIFVVDSNDKERISEARDELHRMLSEHELVDATVLVFANKQDLPNAMTVAEITDKLGLHSLRNRRWYIQATCATSGQGLYEGLDWLSSNISTKASSRAHNA

SEQ ID NO: 24673 - protein, 188 aa, Plantago ovata
MGLAISRVVKQMFAKREMRILMVGLDAAGKTTILYKLKLGEIVTTIPTIGFNVETVEYKNVSFTVWDVGGQDKIRPLWRHYFQNTQGLIFVVDSNDKERILEARDELHRMLSEDELRKAVLLVLANKQDLPNAMSVSEVTDKLGLHTLRQRNWYIQSTCATSGQGLYEGLDWLSSNITSKAKIHNYDP

SEQ ID NO: 24674 - protein, 153 aa, Picea glauca
MGLTSTKLFQRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHW

SEQ ID NO: 24675 - protein, 159 aa, Secale cereale
MGLTFTKLFSRLFAKKEMRILMVGLDAAGKTTILYKLKLGEIVTTIPTIGFNVETVEYKNISFTVWDVGGQDKIRPLWRHYFQNTQGLIFVVDSNDRERVVEARDELHRMLNEDELRDAVLLVFANKQDLPNAMNAAEITDKLGLDNYPRRQRHWYIQL

SEQ ID NO: 24676 - protein, 202 aa, Flaveria ramosissima
MGLTFTKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATSGEGLYEVWTGSPTTLLTRHEVMIDCKRLENPRRSLAFRLV

SEQ ID NO: 24677 - protein, 153 aa, Conyza canadensis
MGLSFTKLFSRLFAKREMRILMVGLDAAGKTTILYKLKLGEIVTTIPTIGFKVETVEYKNISFTVRDVGGQDKIRPLWRHYFQNTQGLIFVVDSNDRDRVVEARDELHRMLNEDELRDAVLLVFANKQDLPNAMNAAEITDKLGLHSLRQRHW

SEQ ID NO: 24678 - protein, 180 aa, Secale cereale
MGLTFTKLFSRLFAKKEMRILMVGLDAAGKTTILYKLKLGEIVTTIPTIGFNVETVEYKNISFTVWDVGGQDKIRPLWRHYFQNTQGLIFVVDSNDRERVVEARDELHRMLNEDELRDAVLLVFANKQDLPNAMNAAEITDKLGLHSLRQRHWYIRALARHLEKDCTRDLTGSPTTLQQG

SEQ ID NO: 24679 - protein, 200 aa, Arachis hypogaea
MGLTFTKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATSGEGLMKVWTGFRTTLPIRLNAFGESCGSVILDAGVNII

SEQ ID NO: 24680 - protein, 216 aa, Oryza sativa
MGLTFTKLFSRLFSKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATTGEGLYEGLDWLSSNIANKYLSRSHLSIDCRPDWMTRIPHYIAVAFSGERRRWSF

SEQ ID NO: 24681 - protein, 153 aa, Phaseolus vulgaris
MGLSFGKIFSRLCAKKEMRILMVGLDAAGKTTILYKLKLGEIVTTIPTIGFNVETVEYKNISFTVWDVGGQDKIRPLWRHYFQNTQGLIFVVDSNDRDRVVEAKDELHRMLNEDELRDAVLLVFANKQDLPNAMNAAEITDRLGLNSLRQRHW

SEQ ID NO: 24682 - protein, 197 aa, Helianthus annuus
MGLTFAKLFSRLLLLLLLLNLVSGEKEMRVLMLGLDAAGKTTILYKLKFGEIVTTIPTIGFNVETVEYKNTSFTVWDVGGQDTIRPLWRHYFKNTQGLIFVVDSNDRDRVVKARDVLHRLLNEDELRDAALLVFANKQDLPNAMNASEITDKLGLHSLRQRHWYIQGTCATSGEGLYEGLDWLSNDIANKAWFLENI

SEQ ID NO: 24683 - protein, 216 aa, Eutrema parvulum
MGLSFAKLFSRLFAKKEMRILMVGLDAAGKTTILYKLKLGEIVTTIPTIGFNVETVEYKNISFTVWDVGGQDKIRPLWRHYFQNTQGLIFVIDSNDRDRVVEARDELHRMLNEDELRDAVLLVFANKQDLPNAMNAAEITDKLGLHSLRQRHWYIQSTCATTGEGLYEGLDWLSNNIANKVRLLISIGLFGLGYEHYVTLLIDLHYNLRLRLSWCF

SEQ ID NO: 24684 - protein, 202 aa, Mimulus guttatus
MGLSFTKLFSRLFAKREMRILMVGLDAAGKTTILYKLKLGEIVTTIPTIGFNVETVEFKNINFTVWDIGGQDKIRPLWRYYFQNTQGLIFVVDSIDRDRIVEARDELHKMLNEDQLRDAVLLVFANKQDLPNAMNAAEITDKLGLHSIGKRHWYIQSTCATSGEGLYEGLDWLSNNIANKLMLIIILMCFAHFCRRKSFSRK

SEQ ID NO: 24685 - protein, 195 aa, Solanum tuberosum
MGMSISKFVKMLFAKKEMRILMVGLDAAGKTTILYKLKLGEIVTTIPTIGFNVETVEYKNSSFTVWDVGGQDKIRPLWRHYFQNTQGLIFVVDSNDRDRISEARDELHRMLNEEELRGATILVFANKQDLPNAMNVADITDKLGLHSLRQRRWYIQSACATSGQGLYEGLDWLSHNITGKGINSKQHPAQENPLL

SEQ ID NO: 24686 - protein, 548 aa, Triticum aestivum
MAAAAAATAAPPATPSSRPLRMPPAPSTVHPQLRCHAGPSPSLLALRHRAARAAPARALLDKVTPFNFGEEEDDGGDDHPREECGVFGVVGDPEASSLCYLGLQKLQHRGEEGAGICAAGDDGKLKSVTGLGLVSDVFRDPAHLGSLPGQAAIGHVRYSTSGGQAQLCNVQPFLAGYRFGQLAVAHNGNLVNYLPLRHKLEAQGSIFNNSSDTEVILHLIATSLSRPLLARICDACERLQGAYSLLFLTADKLFAVRDPFGFRPLVMGRRPNGAVVFASETCALDLIDAVYEREVEPGEVIVVDRRDMSVSSACLVPHRPRKSCVFEHIYFALPNSIVFGHAVHERRTAYGRALAEESPAPTADVVIPVPDSGFYAALGFAQASGLEFQQGLIRSHYTGRSFIQPTQAIRDLAVKLKLAPVRGVITGKSVVVVDDSIVRGTTSSKIVRLLRDAGAREVHMRISSPPVVGRCHYGIDTPDEKELISNRLDVEGVREMIGCDSLGFLTLDKLHSIYGDEADELCDACFSRNYPVPMPDKVPAMASADDED

SEQ ID NO: 24687 - protein, 551 aa, Hordeum vulgare
MAAAATATAVPPATASSNLLFTPPAPSPVHGQLRCHAGPSPSLLALRHRAARAVPARALFDKVTPFNFGDGDRPIEEDDGDDHPREECGVFGVVGDPEASSLCYLGLQKLQHRGEEGAGICAAGDDGKLKSVTGLGLVSDVFRDPAHLKSLPGQAAIGHVRYSTSGGNAQLCNVQPFLAGYRFGQLAVAHNGNLVNYMPLRNKLEAQGSIFNNSSDTEVILHLIATSLSRPLLARICDACERLQGAYSLLFLTADKLFAVRDPFGFRPLVMGRRPNGAVVFASETCALDLIDAVYEREVEPGEVIVVDRRDMSVSSACLVPHRPRKSCVFEHIYFALPNSIVFGHAVHERRTAYGRALAEESPAPTADVVIPVPDSGFYAALGFAQASGLEFQQGLIRSHYTGRSFIQPTQAIRDLAVKLKLAPVRGVITGKSVVVVDDSIVRGTTSSKIVRLLRDAGAREVHMRISSPPVVGRCHYGIDTPDENELISNRLDIEGVRKMIGCDSLGFLTLDKLHSIYGDEADELCDACFSRKYPVDPPEKVPAMASADED

SEQ ID NO: 24688 - protein, 336 aa, Gossypium raimondii
MAPPELVQPSDKTNVFAKQVTLRNRAYVTFLAGNGDYVKGVVGLAKGLRKVKSAYPLVVAVLPDVPEEHRRILENQGCIVREIEPVYPPENQTQFAMAYYVINYSKLRIWEFVEYSKMIYLDGDIQVYDNIDHLFDLPDGHFYAVMDCFCEKTWSHTPQYRIGYCQQCPDKVKWPAEMGNPPSLYFNAGMFVFEPSLVTYESLLKTLKITQPTPFAEQDFLNMFFKDIYKPIPLIYNLVLAMLWRHPENVELEKVKVVHYCAAGSKPWRYTGKEANMQREDIKMLVQKWWDIYNDESLDYRTSAAEGGTETVNLQPFLVALSEVGAVHFVAAPSAA

SEQ ID NO: 24689 - protein, 336 aa, Theobroma cacao
MAPELVQAAAKPTAFAKPVTLPKRAYVTFLAGNGDYVKGVVGLAKGLRKVKSAYPLVVAVLPDVPEEHRRVLENQGCIVREIEPVYPPENQTQFAMAYYVINYSKLRIWEFVEYSRMIYLDGDIQVFDNIDHLFDLPDGHFYAVMDCFCEKTWSHTPQYKIGYCQQCPDKVKWPAEMGQPPSLYFNAGMFVFEPSLFTYKNLLETLKITPPTPFAEQDLLNMFFRDIYKPIPLVYNLVLAMLWRHPENVELDKVKVVHYCAAGSKPWRYTGKEENMQREDIKMLVQKWWDIYNDESLGYKKPTVAEGAAEPVNPQPFVAALSEAGAVQYVTAPSAA

SEQ ID NO: 24690 - protein, 337 aa, Gossypium hirsutum
MAPELVQAGVKPTVLAKPVTLPKRAYVTFLAGDGDYVKGVVGLAKGLRKVKSAYPLVVAVLPDVPEEHRRILENQGCIVREIEPVYPPENQTQFAMAYYVINYSKLRIWKFVEYSKMIYLDGDIQVYENIDHLFDLPDGQFYAVMDCFCEKTWSHTPQFKIGYCQQCPDKVKWPAEMGQPPALYFNAGMFVFEPSLTTYENLLATLKSTPPTPFAEQDFLNMYFKDIYKPIPLVYNLVLAMLWRHPDNVELDKVKVVHYCAAGSKPWRYTGKEENMQREDVKMLVQKWWDIYNDESLDYEKPTIGEGQAAEPVNMQPFLVALSEAGKVQYVTAPSAA

SEQ ID NO: 24691 - protein, 337 aa, Gossypium raimondii
MAPELVQAGVKPTVLAKPVTLPKRAYVTFLAGDGDYVKGVVGLAKGLRQVKSAYPLVVAVLPDVPEEHRRILENQGCIVREIEPVYPPENQTQFAMAYYVINYSKLRIWKFVEYSKMIYLDGDIQVYENIDHLFDLPDGQFYAVMDCFCEKTWSHTPQFKIGYCQQCPDKVKWPAEMGQPPALYFNAGMFVFEPSLTTYENLLATLKSTPPTPFAEQDFLNMYFKDIYKPIPLVYNLVLAMLWRHPDNVELDKVKVVHYCAAGSKPWRYTGKEENMQREDVKMLVQKWWDIYNDESLDYEKPTIGEGQAAESVNMQPFLVALSEAGAVQYVTAPSAA

SEQ ID NO: 24692 - protein, 336 aa, Populus trichocarpa
MAPELIQAALKPAGFTKPASSPSRAYVTFLAGNGDYVKGVVGLAKGLRKVKTAYPLIVAVLPDVPEEHRRILESQGCIVREIEPVYPPENQTQFAMAYYVINYSKLRIWEFVEYSKMIYLDGDIQVYDNIDHLFDLPDGHFYAVKDCFCEKTWSHTPQYKIGYCQQCPDKVKWPAEMGQPPSLYFNAGMFVFEPSISTYHDLLKTLKVTPPTPFAEQDFLNMYFKDIYKPIPLVYNLVLAMLWRHPENVELDKVKVVHYCAAGSKPWRYTGKEENMQREDIKMLVEKWWGIYNDESLDYMKFVADGIDAELVNLQSFIAALSEAGAVQYVTAPSAA

SEQ ID NO: 24693 - protein, 337 aa, Populus trichocarpa
MAPELVRSALKPAGFTKLASLPSRAYVTFLAGDGDYVKGVVGLAKGLRKVKTAYPLIVAVLPDVPEEHRQILESQGCIVREIEPVYPPENQTQFAMAYYVINYSKLRIWEFVEYSKMIYLDGDIQVYDNIDHLFDLPDGRFYAVMDCFCEKTWSHTPQYKIGYCQQCPDKVNWPAEMGQPPSPYFNAGMCVFEPSIATYHDLLKTLKVTPPTPFAEQDFLNMYFKDIYTPIPLVYNLVLAMLWRHPENVELDRVKVVHYCAAGSKPWRYTGKEENMQREDIKMLVKKWWDIYSDESLDSKKLVADCTTDAEPVNLQPFIAALSEAGAVQYVTAPSAA

SEQ ID NO: 24694 - protein, 335 aa, Manihot esculenta
MAPELLQSAMKPVGFTKPATLPSRAYVTFLAGNGDYIKGVVGLAKGLRKVKTAYPLVVAVLPDVPEEHRRILESQGCLVREIEPVYPPENQTQFAMAYYVINYSKLRIWEFVEYSKMIYLDGDIQVFENIDHLFDLPDGYLYAVMDCFCEKTWSHTAQYKIGYCQQCPDRVKWPAEMGQPPSLYFNAGMFVFEPSVSTYHDLLKTVKITPPTSFAEQDFLNMYFKDIYKPIPLVYNLVLAMLWRHPENVELDEVKVVHYCAAGSKPWRYTGKEENMQREDIKMLVKKWWDIYNDESLDYKKPAGDGDAEPVKLQPFIAALSEAGALQYVTAPSAA

SEQ ID NO: 24695 - protein, 342 aa, Vitis vinifera
MAPEIISASGKPSRFLKPASLPNRAYVAFLAGNGDYVKGVVGLAKGLRKVKSAYPLVVAVLPDVPVEHRRELESQGCIVREIEPVYPPENQTQFAMAYYVINYSKLRIWEFVEYSKMIYLDGDIQVYDNIDHLFELPDGHFYAVMDCFCEKTWSHTPQYKIGYCQQCPEKVQWPAELGQPPSLYFNAGMFVFEPSLSTYEDLLETLRITPATPFAEQDFLNMYFRDVYKPIPLVYNLVLAMLWRHPENVELDKVKVVHYCAAGSKPWRYTGKEDNMQREDIKMLVNKWWEIYNDKSLDYKKTRMMANDYSSVLPGEQVNLEPFIAALSEVGHVEFVRAPSAA

SEQ ID NO: 24696 - protein, 336 aa, Euonymus alatus
MAPELTMKQTEFTKPPVTLPSRAYVTFLAGNADYVKGVVGLAKGLRKAKSVYPLVVACLPDVPEEHREILQSQGCIVRVIEPVYPPENQTQFAMAYYVINYSKLRIWEFVEYSKMIYLDGDIQVFENIDHLFDLPEGYFYAVMDCFCEKTWSHTPQYNIGYCQQCPDKVKWPAEMGNPPSLYFNAGMFVYEPSLSTYEDLLTTVKTVPPTSFAEQDFLNMYFRDIYKPIPLVYNLVLAMLWRHPENVELEKVKVVHYCAAGSKPWRYTGKEENMQREDIKMLVQKWSDIYDDESLDYKEPAVVADGEPEPVNVQPFIAAALSEAGAVQYVTAPSAA

SEQ ID NO: 24697 - protein, 337 aa, Citrus clementina
  Sequence also found in Organisms: Citrus sinensis
MAPPELVQTAVKPAGLGAKPASLPGRAYVTFLAGNGDYVKGVVGLAKGLRKVKTAYPLVVAVLPDVPEEHRNILESQGCIVREIEPVYPPDNQTQYAMAYYVINYSKLRIWEFVEYSKMIYLDGDIQVFENIDHLFDLPDGYFYAVMDCFCEKTWSKTPQYKIGYCQQCPDRVRWPAEMGEPPALYFNAGMFVFEPSISTYHDLLETVKVTPPTTFAEQDFLNMYFKHIYKPIPLVYNLVLAMLWRHPENVELDKVKVVHYCAAGSKPWRFTGEEENMQREDVKMLVKKWWDIYNDESLDYKKPSADGNAGSVNLQPFIDALSDAAAVQFVTAPSAA

SEQ ID NO: 24698 - protein, 340 aa, Lippia dulcis
MAPELVAAAGKPADMAKPAVLPRRAYVTFLAGSGDYVKGVVGLAKGLRKVKTAYPLVVAVLPDVPAEHRRILEDQGCIVREIEPVYPPENQTQFAMAYYVINYSKLRIWEFVEYSKMIYLDGDIQVYDNIDHLFDLEDGYFYAVMDCFCEKTWSHTPQYKISYCQQCPEKVKWPAEMGPPPALYFNAGMFVFEPSLSTYENLLKTLRITPPTPFAEQDFLNMFFKDIYKPIPNVYNLVLAMLWRHPENVDLEKVKVVHYCAAGSKPWRYTGKEENMQREDIKKLVKKWWDIYDDESLNYKKPTVQNEVAVEAGALQPLIVAAMTEGNAPPMQYVAAPSAA

SEQ ID NO: 24699 - protein, 339 aa, Trigonella foenum-graecum
MAPELVPTSTKSVTGFTKPVTIPKRAYVTFLAGNADYVKGVIGLAKGLRKVKTAYPLVVAVLPDVPEEHREMLEAQGCIVREIEPVYPPENQTQFAMAYYVINYSKLRIWEFVEYSKMIYLDGDIQVYENIDHLFDLPDGHFYAVMDCFCEKTWSHTPQYKIGYCQQCPEKVQWPKKMGQPPSLYFNAGMFLFEPSIETYHDLLKTLKVTPPTPFAEQDFLNMYFKDIYKPIPLVYNLVLAMLWRHPENVELHKVKVVHYCAAGSKPWRYTGKEENMQREDIKMLVKKWWDIYNDSSLDYNKILSGSSEVQTNGVEIEPFVQALSEVGRVQYVTAPSAA

SEQ ID NO: 24700 - protein, 336 aa, Fagus grandifolia
MAPELAPAALKQASYNNKPVTKASRAYVTFLAGNGDYVKGVVGLAKGLRKVETAYPLVVAVLPDVPQEHRRILESQGCIVREIEPVYPPENQTQFAMAYYVINYSKLRIWEFVEYGKVIYLDGDIQVFENIDHLFDLPDGHFYAVMDCFCEKTWSHTLQYKIGYCQQCPDRVKWPVEMGQPPSLYFNAGMCVFEPSLYTYQDLLKTVKITTPTSFAEQDFLNIYFRDIYKPIPLVYNLVLAMLWRHPENVELDKVKVAHYCAAGSKPWRYTGKEENMQREDIKMLVKKWWDIYNDESLDYKKPVEAANGEAVKMQPFLAALSEVDAVQYVTAPSAA

SEQ ID NO: 24701 - protein, 338 aa, Brassica rapa
MAPELTQTTTAKSAVTITKPSPRVHGGRAYVTFLAGNGDYVKGVVGLAKGLRKVKSAYPLVVAVLPDVPEEHRRILVEQGCIVREIEPVYPPENQTQFAMAYYVINYSKLRIWKFVEYSKMIYLDGDIQVYENIDHLFDLPDRYFYAVMDCFCEKTWSHTPQYKIGYCQQCPERVQWPKAELGEPPALYFNAGMFVFEPGLDTYEDLLRTLKVTPPTPFAEQDFLNMYFKKIYKPIPLVYNLVLAMLWRHPENVELDKVKVVHYCAAGSKPWRYTGKEANMEREDIKMLVNKWWDIYKDGSLDYKKSEAESDLVNLKPFINALTEAGRVKYVTAPSAA

SEQ ID NO: 24702 - protein, 344 aa, Arabidopsis lyrata
MAPGLTPTADAESTVMITKPLLPSVQDSDRAYVTFLAGNGDYVKGVVGLAKGLRKVKSAYPLVVAILPDVPEEHRRILMEQGCIVREIEPVYPPENQTQFAMAYYVINYSKLRIWKFVEYSKMIYLDGDIQVYENIDHLFDLPDGYFYAVMDCFCEKTWSHTPQYKIGYCQQCRDKVQWPKAELGEPPALYFNAGMFLFEPNLETYEDLLRTLKITPPTPFAEQDFLNMYFKKIYKPIPLVYNLVLAMLWRHPENVELGKVKVVHYCAAGSKPWRYTGKEANMDREDIKMLVKKWWDIYNDESLDYKKPVAVVGTEADPVNLKPFITALTEAGRVNYVTAPSAA

SEQ ID NO: 24703 - protein, 340 aa, Vitis vinifera
MAPEIISASGKPSRFLKPASLPDRAYVAFLAGNGDYVKGVVGLAKGLRKVKSAYPLVVAVLPDVPVEHRRELESQGCIVREIVPVYKNQTQFAMAYYVINYSKIRIWEFVEYSKMIYLDGDIQVYDNIDHLFELPDGHFYAVMDCFCEKTWSHTPQYKIGYCQQCPEKVQWPAELGQPPSLYFNAGMFVFEPSLSTYEDLLETLRITPATPFAEQDFLNMYFRDVYKPIPLVYNLVLAMLWRHPENVELDKVKVVHYCAAGSKPWRYTGKEDNMQREDIKMLVNKWWEIYNDKSLDYKKTRMMANDYSSVLPGEQVNLEPFIAALSEVGHVEFVRAPSAA

SEQ ID NO: 24704 - protein, 334 aa, Pisum sativum
MAPEIVQTSTKPVTGFTKLKRAYVTFLAGNGDYVKGVIGLAKGLRKVKTAYPLVVAVLPDVPEEHREMLESQGCIVREIQPVYPPENQTQFAMAYYVINYSKLRIWEFVEYSKMIYLDGDIQVYENIDHLFDLPDGYFYAVMDCFCEKTWSHTPQYKIGYCQQCPEKVQWPKEMGEPPSLYFNAGMFLFEPSVETYDDLLKTCQVTAPTPFAEQDFLNMYFKDIYRPIPLVYNLVLAMLWRHPENVELRKVKVVHYCAAGSKPWRYTGKEENMQREDIKMLVQKWLDIYSDSSLDYKKNLSGNCETQRNDVEEPFVQALSEVGRVRYVTAPSAA

SEQ ID NO: 24705 - protein, 335 aa, Glycine max
MAPELVPTVAFTKPATLPRRAYVTFLAGNGDYVKGVVGLAKGLRKVKTAYPLVVAVLPDVPEDHRKILESQGCIVREIEPVYPPENQTQFAMAYYVINYSKLRIWEFVEYTKMIYLDGDIQVYENIDHLFDLPGGYFYAVMDCFCEKTWSHTPQYKVGYCQQCPEKVQWPTELGQPPSLYFNAGMFVFEPSIATYHDLLKTVQVTTPTSFAEQDFLNMYFKDIYKPIPLNYNLVLAMLWRHPENVKLDQVKVVHYCAAGSKPWRYTGKEENMQREDIKMLVKKWWDIYNDASLDYKPLMSASEAPAPDGVDNIEPFVQALSEVGHVQYVTAPSAA

SEQ ID NO: 24706 - protein, 338 aa, Brassica oleracea
MAPELTQTTTEKSAVTITKPSPPVHGGRAYVTFLAGNGDYVKGVVGLAKGLRKVKSAYPLVVAILPDVPEEHRRILVEQGCIVREIEPVYPPENQTQFAMAYYVINYSKLRIWKFVEYSKMIYLDGDIQVYENIDHLFDLPDRYFYAVMDCFCEKTWSHTPQYKIGYCQQCPERVQWPKAELGEPPALYFNAGMFVFEPGLDTYEDLLRTLKVTPPTPFAEQDFLNMYFKKIYKPIPLVYNLVLAMLWRHPENVELDKVKVVHYCAAGSKPWRYTGKEANMEREDIKMLVNKWWDIYKDGSLDYKKSEAESDLVNLKPFINALTEAGRVKYVTAPSAA

SEQ ID NO: 24707 - protein, 342 aa, Brassica oleracea
MAPELIQTNTAKSAVTITKPSPPVHSDRAYVTFLAGNGDYVKGVVGLAKGLRKVKSAYPLVVAILPDVPEEHRRILVEQGCIVREIEPVYPPENQTQFAMAYYVINYSKLRIWKFVEYSKMIYLDGDIQVYENIDHLFDLPDGYFYAVMDCFCEKTWSHTPQYKIGYCQQCPEKVQWPKEELGEPPSLYFNAGMFVFEPGLDTYEDLLRTLKITPPTPFAEQDFLNMYFEKIYKPIPLVYNLVLAMLWRHPENVELDKVKVVHYCAAGSKPWRYTGKEANMEREDIKMLVNKWWDIYNDDSLDYKKSVGDLVEESDVVNLKPFISALTEAGPVKYVTAPSAA

SEQ ID NO: 24708 - protein, 339 aa, Medicago truncatula
MAPELVPTAAKSVTGFTKPVTIPKRAYVTFLAGNGDYVKGVIGLAKGLRKVMTAYPLVVAVLPDVPEEHREMLEAQGCIVREIEPVNPPENQTQFAMAYYVINYSKLRIWEFVEYSKMIYLDGDIQVYENIDHLFDLPDGHFYAVMDCFCERTWSHTPQYKIGYCQQCPEKVHWPKEMGQPPSLYFNAGMFLFEPSIDTYHDLLKTLKVTPPTPFAEQDFLNMYFKDIYKPIPFVYNLVLAMLWRHPENVELHKVKVVHYCAAGSKPWRYTGKEENMQREDIRMLVKKWWDIYNDSSLDYNKNLSGSGEVQTNGFEIEPFVQALSEVGRVQYVTAPSAA

SEQ ID NO: 24709 - protein, 342 aa, Brassica rapa
MAPELTQTTTVKSAVTITKPSPPVHGDRAYVTFLAGNGDYVKGVVGLAKGLRKVKSAYPLVVAILPDVPEEHRRVLVEQGCIVREIEPVYPPENQTQFAMAYYVINYSKLRIWKFVEYSKMIYLDGDIQVYENIDHLFDLPDGYFYAVMDCFCEKTWSHTPQYKIGYCQQCPEKVQWPKEELGEPPSLYFNAGMFVFEPGLDTYEDLLRTLKITPPTPFAEQDFLNMYFEKIYKPIPLVYNLVLAMLWRHPENVELDKVKVVHYCAAGSKPWRYTGKEANMEREDIKMLVNKWWDIYNDDSLDYKKSVGDLVEESDVVNLKPFISALTEAGPVKYVTAPSAA

SEQ ID NO: 24710 - protein, 338 aa, Brassica napus
MAPELTQTTTEKSAVTITKPSSPVHGGRAYVTFLAGNGDYVKGVVGLAKGLRKVKSAYPLVVAILPDVPEEHRRILVEQGCIVREIEPVYPPENQTQFAIAYYVINYSKLRIWKFVEYSKMIYLDGDIQVYENIDHLFDLPDGYFYAVMDCFCEKTWNHTPQYKIGYCQQCPEKVQWAKAELGEPPALYFNAGMFVFEPGLDTYEDLLRTLKVTPPTPFAEQDFLNMYFKKIYRPIPLVYNLVLAMLWRHPENVELDKVKVVHYCAAGSKPWRYTGKEANMEREDIKMLVNKWWDIYKDGSLDYKKPEAESDLVNLKPFINALTEAGRVKYVTAPSAA

SEQ ID NO: 24711 - protein, 221 aa, Oryza sativa
MAAGGGGGYRAEDDYDYLFKTVLIGDSGVGKSNLLSRFTKNEFCLESKSTIGVEFATRSIQVDGKVVKAQIWDTAGQERYRAITSAYYRGAVGALLVYDVTRRATFDNVARWLKELRDHTDPSIVVMLVGNKSDLRHLVAVSTEDGKEYAEAESLYFMETSALDATNVENAFAEVLTQIYQTVSKKTVEASDDGSNAPIKGEKINVKDDVSALKRIGCCSN

SEQ ID NO: 24712 - protein, 221 aa, Hordeum vulgare
  Sequence also found in Organisms: Pseudoroegneria spicata
MAGSGGGAYRAEDDYDYLFKAVIIGDSGVGKSNLLSRFTKNEFCLESKSTIGVEFATRSLQVDGKVVKAQIWDTAGQERYRAITSAYYRGAVGALLVYDVTRRATFDNVARWLKELRDHTDPSIVVMLVGNKSDLRHLVAVSTEDGQEYAEAESLYFMETSALDATNVDNAFSEVLTQIYRIASRKTVDAGDDGSSAPSKGENINVKDDVSSLKRAGCCSS

SEQ ID NO: 24713 - protein, 219 aa, Avena sativa
MAGSGAYRAEDDYDYLFKAVIIGDSGVGKSNLLSRFTKNEFCLESKSTIGVEFATRSLQVDGKVVKAQIWDTAGQERYRAITSAYYRGAVGALLVYDVTRRVTFDNVARWLKELRDHTDPSIVVMLVGNKSDLRHLVAVSTEDGQEYAESESLYFMETSALDATNVDSAFAEVLTQIYQIASRKTVDAGEDGSSAPSKGEKINVKDDVSALKRAGCCST

SEQ ID NO: 24714 - protein, 221 aa, Secale cereale
MAGSGGGAYRAEDDYDYLFKAVIIGDSGVGKSNLLSRFTKNEFCLESKSTIGVEFATRSLQVDGKVVKAQIWDTAGQERYRAITSAYYRGAVGALLVYDVTRRATFDNVARWLKELRDHTDPSIVVMLVGNKSDLRHLVAVSTEDGQEYAEAESLYFMETSALDATNVDNAFSEVLTQIYRIASRKMVDAGDDGSSAPSKGENINVKDDVSSLKRAGCCSS

SEQ ID NO: 24715 - protein, 219 aa, Avena sativa
MAGSGAYRAEDDYDYLFKAVIIGDSGVGKSNLLSRFTKNEFCLESKSTIGVEFATRSLQVDGKVVKAQIWDTAGQERYRAITSAYYRGAVGALLVYDVTRRVTFDNVARWLKELRDHTDPSIVVMLVGNKSDLRHLVAVSTEDGQEYAESESLYFMETSALDATNVDSAFAEVLTQIYQIASRKNVDAGEDGSSAPSKGEKINVKDDVSALKRAGCCST

SEQ ID NO: 24716 - protein, 219 aa, Festuca arundinacea
MAGSGAYRAEDDYDYLFKAVIIGDSGVGKSNLLSRFTKNEFCLESKSTIGVEFATRSLQVDGKVVKAQIWDTAGQERYRAITSAYYRGAVGALLVYDVTRRVTFDNVARWLKELRDHTDPSIVVMLVGNKSDLRHLVAVSTEDGQEYAEAEKLYFMETSALDATNVDNAFAEVLTQIYQIASRKTVDAGDDGSSPPSKGEKINVKDDVSALKRAGCCST

SEQ ID NO: 24717 - protein, 217 aa, Amorphophallus konjac
MAAYRAEDDYDYLFKVVLIGDSGVGKSNLLSRFTRNEFNLESKSTIGVEFATRSLNVDGKIIKAQIWDTAGQERYRAITSAYYRGAVGALLVYDVTRRTTFENVERWLKELRDHTDPNIVVMLIGNKSDLRHLVAVSTDDGKVFSERESLYFMETSALEATNVEAAFAEVLTQIYRIVSKKAVETGDESSSSVPSKGEKINVKDDVSAMKRVGCCSN

SEQ ID NO: 24718 - protein, 217 aa, Elaeis guineensis
MAGYRAEDDYDYLFKVVLIGDSGVGKSNLLSRFTRNEFSLESKSTIGVEFATRSLNVDGKVIKAQIWDTAGQERYRAITSAYYRGAVGALLVYDVTRHATFENAERWLRELRDHTDPNIVVMLVGNKSDLRHLVAVSSEDGKAFAERESLYFMETSALEATNVEDAFAEVLTQIYRIVSKKAVEAADDSASAVPSKGEKINVKDDVSALKRVGCCSS

SEQ ID NO: 24719 - protein, 217 aa, Avena sativa
MAAGYRAEDDYDYLFKVVLIGDSGVGKSNLLSRFTRNEFSLESKSTIGVEFATRSLQVDGKVVKAQIWDTAGQERYRAITSAYYRGAVGALLVYDVTRHATYENAERWLKELRDHTDPNIVVMLVGNKSDLRHLVAVQTDEAKAFAERESLYFMETSALESTNVEDAFSEVLTQIYRIVSKRSVEAGEDSASGPGKGEKINMKDDVSAVKKGGCCSS

SEQ ID NO: 24720 - protein, 217 aa, Festuca arundinacea
MAAGYRAEDDYDYLFKVVLIGDSGVGKSNLLSRFTRNEFSLESKSTIGVEFATRSLQVDGKVVKAQIWDTAGQERYRAITSAYYRGAVGALLVYDVTRHATYENAERWLKELRDHTDPNIVVMLVGNKSDLRHLVAVQTDEAKGFAERESLYFMETSALESTNVEDAFSEVLTQIYRIVSKRSVEAGEDSGSGPGKGEKINMKDDVSAVKKGGCCSS

SEQ ID NO: 24721 - protein, 217 aa, Avena sativa
MAAGYRAEDDYDYLFKVVLIGDSGVGKSNLLSRFTRNEFSLESKSTIGVEFATRSIQVDDKVVKAQIWDTAGQERYRAITSAYYRGAVGALLVYDVTRHATFENAERWLKELRDHTDPNIVVMLVGNKSDLRHLVAVQTDEAKAFAERESLYFMETSALESTNVEDAFSEVLTQIYRIVSKRSVEAGEDSASGPGKGEKINMKDDVSAVKKGGCCSS

SEQ ID NO: 24722 - protein, 217 aa, Pseudoroegneria spicata
MAAGYRAEDDYDYLFKVVLIGDSGVGKSNLLSRFTRNEFSLESKSTIGVEFATRSLQVDGKVVKAQIWDTAGQERYRAITSAYYRGAVGALLVYDVTRHATFENAERWLKELRDHTDPNIVVMLVGNKSDLRHLVAVPTDEGKAFAERESLYFMETSALESTNVEDAFAEVLKQIYCIVSKRAVEAGEDSASGPGKGEKINMKDDVSAVKKGGCCSS

SEQ ID NO: 24723 - protein, 215 aa, Pennisetum glaucum
MAAGYRAEDDYDYLFKVVLIGDSGVGKSNLLSRFTRNEFSLESKSTIGVEFATRSLQVDGKVVKAQIWDTAGQERYRAITSAYYRGAVGALLVYDVTRHSTFENVERWLKELRDHTDPNIVVMLVGNKSDLRHLVAVQTDEGKAFAERESLYFMETSALESTNVENAFAEVLTQIYRIVSKRAVEAGEDAVSGPGKGEKINIKDDVSAVKKGGCC

SEQ ID NO: 24724 - protein, 217 aa, Prunus mume
MAGYRADDDYDYLFKVVLIGDSGVGKSNLLSRFTKNEFNLESKSTIGVEFATRTLNVDGKVIKAQIWDTAGQERYRAITSAYYRGAVGALLVYDVTRHATFENVDRWLKELRNHTDSNIVVMLVGNKSDLRHLVAVSTEDGKSYAEKESLYFMETSALEAKNVENSFAEVLTQIYHIVSKKAVEGVENGTASVPAKGEKINIKDDVSALKRVGCCSS

SEQ ID NO: 24725 - protein, 217 aa, Brachypodium distachyon
MASGYRAEDDYDYLFKVVLIGDSGVGKSNLLSRFTRNEFSLESKSTIGVEFATRSLQVDGKVVKAQIWDTAGQERYRAITSAYYRGAVGALLVYDVTRHATFENAERWLKELRDHTDPNIVVMLVGNKSDLRHLVAVQTDEGKAFAERESLYFMETSALESTNVEDAFAEVLTQIYRIVSKRAVEAGEDSASGPGKGEKINMKDDVSAVKKGGCCSS

SEQ ID NO: 24726 - protein, 215 aa, Cirsium arvense
  Sequence also found in Organisms: Carthamus tinctorius
MSAYRAEDDYDYLFKVVLIGDSGVGKSNLLSRFTRNEFSLESKSTIGVEFATRSLNVDSKVIKAQIWDTAGQERYRAITSAYYRGAVGALLVYDVTRHATFENVERWLKELRDHTDPNIVVMLIGNKSDLRHLVAVSTEDGKSFAERESLYFMETSALDATNVESAFAEVLTQIYRIVSKKAMDAAEDSAVPSKGEKIDVGKEVSAMKSVGCCSS

SEQ ID NO: 24727 - protein, 215 aa, Setaria italica
MAAGYRAEDDYDYLFKVVLIGDSGVGKSNLLSRFTRNEFSLESKSTIGVEFATRSLQVDGKVVKAQIWDTAGQERYRAITSAYYRGAVGALLVYDVTRHSTFENVERWLKELRDHTDPNIVVMLVGNKSDLRHLVAVQTDEGKAFAERESLYFMETSALESTNVENAFAEVLTQIYRIVSKRAVEGGEDAVSGPGKGEKINIKDDVSAVKKGGCC

SEQ ID NO: 24728 - protein, 217 aa, Leymus cinereus x Leymus triticoides
MAAGYRAEDDYDYLFKVVLIGDSGVGKSNLLSRFTRNEFSLESKSTIGVEFATRSLQVDGKVVKAQIWDTAGHERYRAITSAYYRGAVGALLVYDVTRHATFENADRWLKDLRDHTDPNIVVMLVGNKSDLRHLVAVPTDEGKAFAERESLYFMETSALESTNVEDAFAEVLKQIYRIVSKRVVEAGEDSASGPGKGEKINMKDDVSAVKKGGCCSS

SEQ ID NO: 24729 - protein, 217 aa, Zea mays
MAAGYRAEDDYDYLFKVVLIGDSGVGKSNLLSRFTRNEFSLESKSTIGVEFATRSLQVDGKVVKAQIWDTAGQERYRAITSAYYRGAVGALLVYDVTRHSTFENVERWLKELRDHTDPNIVVMLVGNKSDLRHLVAVQTDEGKAFAERESLYFMETSALESTNVENAFAEVLAQIYRIVDKRAVEAGEDAASGPGRGEKINIKDDVSAVKKGGCCSS

SEQ ID NO: 24730 - protein, 218 aa, Rosmarinus officinalis
MAGYRAEDDYDYLFKVVLIGDSGVGKSNLLSRFTRNEFSLESKSTIGVEFATRSLNVDGKVIKAQIWDTAGQERYRAITSAYYRGAVGALLVYDVTRHSTFENVERWLRELRDHTDPNIVVMLVGNKSDLRHLVAVSTEDGKSFAERESLYFMETSALEATNVDNAFAEVLTQIYRIVSKKAMEAGENGNSSTVPSKGEKIDVGKDVSAIKKGGCCST

SEQ ID NO: 24731 - protein, 218 aa, Vinca minor
MGGYRAEDDYDYLFKVVLIGDSGVGKSNLLSRFTRNEFSLESKSTIGVEFATRSLNVDGKVIKAQIWDTAGQERYRAITSAYYRGAVGALLVYDVTRHSTFENVERWLRELRDHTDPNIVVMLVGNKSDLRHLVAVSTEDSKSFAERESLYFMETSALEATNVDNAFAEVLTQIHRIVSKKAMEAGENGSSSTVPSKGEKIDVGKDVSAIKKGGCCST

SEQ ID NO: 24732 - protein, 217 aa, Lupinus angustifolius
MAGYRAEDDYDYLFKVVLIGDSGVGKSNLLSRFTKNEFNLESKSTIGVEFATRTLNVDSKVIKAQIWDTAGQERYRAITSAYYRGAVGALLVYDVTRHATFENVDRWLKELRNHTDANIVVMLVGNKSDLRHLVAVSTEDGKSYAEKESLYFMETSALESTNVENSFAEVLTQIYHIVSKKAVEAAENGNASVPAKGEKIDIKNDVSALKRVGCCSS

SEQ ID NO: 24733 - protein, 217 aa, Lupinus angustifolius
MAGYRAEDDYDYLFKVVLIGDSGVGKSNLLSRFTKNEFNLESKSTIGVEFATRTLTVDSKVIKAQIWDTAGQERYRAITSAYYRGAVGALLVYDVTRHATFENVDRWLKELRNHTDANIVVMLVGNKSDLRHLVAVSTEDGKSYAEKESLYFMETSALESTNVENSFAEVLTQIYHIVSKKAVEAAENGNASVPAKGEKIDIKNDVSALKRVGCCSS

SEQ ID NO: 24734 - protein, 217 aa, Prunus persica
MAGYRADDDYDYLFKVVLIGDSGVGKSNLLSRFTKNEFNLESKSTIGVEFATRTLNVDGKVIKAQIWDTAGQERYRAITSAYYRGAVGALLVYDVTRHATFENVDRWLKELRNHTDSNIVVMLVGNKSDLRHLVAVSTEDGKSYAEKESLYFMETSALEAKNVENSFAEVLTQIYHIVSKKAVEGGENGTASVPATGEKINIKDDVSALKRVGCCSS

SEQ ID NO: 24735 - protein, 217 aa, Allium cepa
MAAYKAEDDYDYLFKVVLIGDSGVGKSNLLSRFTRNEFSLESKSTIGVEFATRSLNVDGKVIKAQIWDTAGQERYRAITSAYYRGSVGALLVYDVTRHATFENVERWLKELRDHTDPNIVVMLIGNKSDLRHLIAVSTEDGKSFAERESLYFMETSALESVNVDNAFSEVLTQIYRIVSRKAVDTGDDSASAVPSKGEKINVTDDVSALKKGGCCSN

SEQ ID NO: 24736 - protein, 218 aa, Catharanthus roseus
MSGYRAEDDYDYLFKVVLIGDSGVGKSNLLSRFTRNEFSLESKSTIGVEFATRSLNVDSKVIKAQIWDTAGQERYRAITSAYYRGAVGALLVYDVTRHSTFENVERWLRELRDHTDPNIVVMLVGNKSDLRHLVAVSTEDGKSFAERESLYFMETSALEATNVDNAFAEVLTQIYRVVSKKAMETGENGNSSTVPSKGEKIDVGKDVSAMKKGGCCST

SEQ ID NO: 24737 - protein, 217 aa, Musa acuminata
MAAYRAEDDYDYLFKVVLIGDSGVGKSNLLSRFTRNEFSLESKSTIGVEFATRSLTVDGKVVKAQIWDTAGQERYRAITSAYYRGAIGALLVYDVTRHATFENVERWLKELRGHTDPNIVVMLIGNKSDLRHLVAVPTEDGEAYAERESLYFMETSALEATNVENAFAEVLTQIYRIVSKKAVEAGDDATSTVPSKGERINVKDDVSALKRVGCCSS

SEQ ID NO: 24738 - protein, 215 aa, Cynara scolymus
MSAYRAADDYDYLFKVVLIGDSGVGKSNLLSRFTRNEFSLESKSTIGVEFATRSLNVDSKVIKAQIWDTAGQERYRAITSAYYRGAVGALLVFDVTRHATFENVERWLKELRDHTDPNIVVMLIGNKSDLRHLVAVSTDDGKSFAERESLYFMETSALDATNVESAFAEVLTQIYRIVTKKAMDAAEDLNVPTKGEKIDVGKEVSAMKSVGCCSS

SEQ ID NO: 24739 - protein, 216 aa, Lupinus angustifolius
MAGYRAEDDYDYLFKVVLIGDSGVGKSNLLSRFTKNEFNLESKSTIGVEFATRTLNVDSKVIKAQIWDTAGQERYRAITSAYYRGAVGALLVYDVTRHATFENVDRWLKELRNHTDANIVVMLVGNKSDLRHLVAVSTEDGKSYAEKESLYFMETSALESTNVENAFADVLTQIYHIVSKKAVQAENGTASAPAKGEKIDIKNDVSAMKRVGCCSS

SEQ ID NO: 24740 - protein, 217 aa, Pisum sativum
  Sequence also found in Organisms: Vicia sativa
MAGYRADDDYDYLFKVVLIGDSGVGKSNLLSRFTKNEFNLESKSTIGVEFATRTLNVDSKVIKAQIWDTAGQERYRAITSAYYRGAVGALLVYDVTRHATFENVDRWLKELRNHTDSNIVVMLVGNKADLRHLVAVSTEDGKSYAEKESLYFMETSALEATNVENAFAEVLTQIYHIVSKKTVEGAENGNASVPAKGEKIDLKNDVSALKRVGCCSS

SEQ ID NO: 24741 - protein, 218 aa, Tabernaemontana elegans
MTGYRAEDDYDYLFKVVLIGDSGVGKSNLLSRFTRNEFSLESKSTIGVEFATRSLNVDGKVIKAQIWDTAGQERYRAITSAYYRGAVGALLVYDVTRHSTFENVERWLRELRDHTDPNIVVMLVGNKSDLRHLVAVTTEDGKSFAERESLYFMETSALEATNVDSAFAEVLTQIYRIVSKKSMETGENGNSSTVPSKGEKIDIGKDVSDIKKGGCCST

SEQ ID NO: 24742 - protein, 217 aa, Malus domestica
MAGYKADDDYDYLFKVVLIGDSGVGKSNLLSRFTKNEFNLESKSTIGVEFATRTLTVDGKVIKAQIWDTAGQERYRAITSAYYRGAVGALLVYDVTRHATFENVDRWLKELRNHTDSNIVVMLVGNKSDLRHLVAVSTEDGKSYAEKESLYFMETSALEAKNVENSFAEVLTQIYHVVSKKAVEGGENGTSSVPAQGEKINIKDDVSALKRVGCCSS

SEQ ID NO: 24743 - protein, 215 aa, Musa acuminata
MAAYRAEDDYDYLFKLVLIGDSGVGKSNLLSRFTKNEFNLESKSTIGVEFATRSISVDGKVLKAQIWDTAGQERYRAITSAYYRGAVGALLVYDVTRRATFENVSRWLRELRDHTDPNIVVMLIGNKSDLRHLVAVPTEDGKAYAERESLYFMETSALDATNVENAFAEVLTQIYRIVSKRAVEAGDDATSSIPGRGERINVKDDASKKLGCCST

SEQ ID NO: 24744 - protein, 217 aa, Phaseolus vulgaris
MAGYRADDDYDYLFKVVLIGDSGVGKSNLLSRFTKNEFNLESKSTIGVEFATRTLNVDSKVIKAQIWDTAGQERYRAITSAYYRGAVGALLVYDVTRHATFENVDRWLKELRNHTDANIVVMLVGNKSDLRHLVAVTTEDGKSYAEKESLYFMETSALEATNVENAFAEVLTQIYRIVSKKAVEGVENGTASVPAKGEKIDLKNDVSALKRVGCCSS

SEQ ID NO: 24745 - protein, 217 aa, Cicer arietinum
MAGYRADDDYDYLFKVVLIGDSGVGKSNLLSRFTKNEFNLESKSTIGVEFATRTLNVDSKVIKAQIWDTAGQERYRAITSAYYRGAVGALLVYDVTRHATFENVDRWLKELRNHTDSNIVVMLVGNKSDLRHLVAVSTEDGKSYAEKESLYFMETSALEASNVENAFAEVLTQIYRIVSKKAVEGAENGNASVPAKGEKIDLKNDVSALKRVGCCSS

SEQ ID NO: 24746 - protein, 217 aa, Trifolium pratense
MAGYRADDDYDYLFKVVLIGDSGVGKSNLLSRFTKNEFNLESKSTIGVEFATRTLNVDSKVIKAQIWDTAGQERYRAITSAYYRGAVGALLVYDVTRHATFENVDRWLKELRNHTDSNIVVMLVGNKADLRHLVAVSTEDGKSYAEKESLYFMETSALEATNVENAFAEVLTQIYHIVSKKAVEGVENGNASVPAKGEKIDLKNDVSALKRVGCCSS

SEQ ID NO: 24747 - protein, 217 aa, Vigna unguiculata
MAGYRADDDYDYLFKVVLIGDSGVGKSNLLSRFTKNEFNLESKSTIGVEFATRTLNVDSKVIKAQIWDTAGQERYRAITSAYYRGAVGALLVYDVTRHATFENVDRWLKELRNHTDANIVVMLVGNKSDLRHLVAVTTEDGKSYAEKESLYFMETSALEATNVENAFAEVLTQIYRIVSKKAVEGAENGTASVPAKGEKIDLKNDVSALKRVGCCSS

SEQ ID NO: 24748 - protein, 217 aa, Trigonella foenum-graecum
MAGYRADDDYDYLFKVVLIGDSGVGKSNLLSRFTKNEFNLESKSTIGVEFATRTLNVDSKVIKAQIWDTAGQERYRAITSAYYRGAVGALLVYDVTRHATFENVDRWLKELRNHTDSNIVVMLVGNKADLRHLVAVSTEDGKSYAEKESLYFMETSALEATNVENAFAEVLTQIYHIVSKKAVEGAENGNASVPAKGEKIDLKNDVSALKRVGCCSS

SEQ ID NO: 24749 - protein, 399 aa, Citrus sinensis
MALQAAALVPSAFSVPKEGKTSASFKDSSLFGVSFSEHAKADFSSSALRCKREFSQRNGVVRAQTMATASPAVDVSSPQGKKTLRKGSVIITGASSGLGLATAKALAETGKWHIIMACRDFLKAERAAKSAGMAKENYTIMHLDLASLDSVRQFVDTFRRSGRPLDVLVCNAAVYLPTAKEPTFTAEGFELSVGTNHLGHFLLSRLLLDDLKQSDYPSKRLIIVGSITGNTNTLAGNVPPKANLGDLRGFAGGLNGLNSSSMIDGGDFDGAKAYKDSKVCNMLTMQEFHRRFHEETGIAFASLYPGCIATTGLFREHIPLFRLLFPPFQKYITKGYVSEDEAGKRLAQVVSDPSLTKSGVYWSWNKDSASFENQLSQEASDVEKARKVWEISEKLVGLA

SEQ ID NO: 24750 - protein, 399 aa, Citrus clementina
MALQAAALVPSAFSVPKEGKTSASFKDSSLFGVSFSEHAKADFSSSALRCKREFSQRNGVVRAQTMATASPAVDVSSPQGKKTLRKGSVIITGASSGLGLATAKALAETGKWHIIMACRDFLKAERAAKSAGMAKENYTIMHLDLASLDSVRQFVDTFRRSGRPLDVLVCNAAVYLPTAKEPTFTAEGFELSVGTNHLGHFLLSRLLLDDLKQSDYPSKRLIIVGSITGNTNTLAGNVPPKANLGDLRGFAGGLNGLNSSSMIDGGDFDGAKAYKDSKVCNMLTMQEFHRLFHEETGIAFASLYPGCIATTGLFREHIPLFRLLFPPFQKYITKGYVSEDEAGKRLAQVVSDPSLTKSGVYWSWNKDSASFENQLSQEASDVEKARKVWEISEKLVGLA

SEQ ID NO: 24751 - protein, 397 aa, Ipomoea nil
MALQAAALLPALSIPKEGKTSATLKDSSLFGVSLLDHSKPDFSSSALKIKGARKVSNGVVKAETMVATPGVTGAQVSGKKTLRKGTVVVTGASSGLGLATAKALAETGKWHVIMACRDFLKAERAAKSVGMRKEDFTIMHLDLASLDSVRQFVDNFRRSGRPLDVLVCNAAVYLPTAKEPTFTAEGFELSVGTNHLGHFLLSRLLLDDLKQSDYPSKRLIIVGSITGNTNTLAGNVPPKAHLGDMRGLAGGLSGHHSSAMIDGGAFDGAKAYKDSKVCNMLTMQEFHRRFHEDTGITFASLYPGCIATTGLFREHIPLFRLLFPPFQRFITKGFVSEDEAGKRLAQVVSDPSLTKSGVYWSWNKDSASFENQLSQEASDADKARKVWDLSEKLVGLA

SEQ ID NO: 24752 - protein, 391 aa, Rosmarinus officinalis
MALQAAALLPSTFSISKEGKTSASLKDSSLFGISLSDPLKCEFSSSPLKIKRGVRAQAVLTTPGVTRATAEGKKTLRKGNVIVTGASSGLGLATAKALAETGKWHIIMACRDFLKAERAAKSVGMSKENYTIMHLDLASLDSVRQFADNFKRSGRPLDVLVCNAAVYLPTATEPTFTAEGFELSVGTNHLGHFLLSRLLLDDMKQSDYPSKRLIIVGSITGNTNTLAGNVPPKANLGDLRGLAGGLNGLNSSAMIDGGDFDGAKAYKDSKVCNMLSMQEFHRRYHEDTGITFASLYPGCIATTGLFREHIPLFRLLFPPFQKYITKGFVSEEEAGKRLAQVVSDPSLTKSGVYWSWNKDSASFENQLSQEASDVEKARKVWELSEKLVGLA

SEQ ID NO: 24753 - protein, 397 aa, Epimedium sagittatum
MALQASSILPSALSIHKEGKLNASLKDNSFLGVSLNDHLKSEFGTSCLRSKKEINQRIISIRATAVTSPGVNQATSQGKKTLRQGVCIVTGASSGLGLTTAKSLAESGKWHVIMACRDFLKAERAAKSVGMSKGTYTIMHLDLSSLDSVRQFADNFKRSGRPLDVLVCNAAIYQPTAKEPSFTADGFELSVGTNHLGHFLLSRLLIDDLKQSDYPSKRLIIVGSITGNTNTLAGNVPPKANLGDLRGMAGGLNGLNSSAMIDGGEFDGAKAYKDSKVCNMLTMQEFHRRYHEETGITFASLYPGCIATTGLFREHIPLFRLLFPPFQKYITKGYVSEEEAGKRLAQVVSDPSLTKSGVYWSWNQNSASFENQLSEEASDAEKARKVWEESEKLVGLA

SEQ ID NO: 24754 - protein, 397 aa, Actinidia deliciosa
MALHAAAILPSAFSILKEGKSKDSTFLGISLSDHVKSDSIYTSLRIKRESKQRKFIVGPIRAQAVVEAPEVAQATPAGKKTLRQGSVVVTGASSGLGLATATALAETGKWHVIMACRDFLKAERAAKSAGMAKENYTIMHLDLASLDSVRQFVDNFRRSGRPLDVLVCNAAVYLPTAKEPTFTAEGFELSVGTNHLGHFLLSRLLLDDLKQSDYPSKRLIIVGSITGNTNTLAGNVPPKANLGDLRGLAGGLNGLNTSSMIDGGEFDGAKAYKDSKVCNMLTMQEFHRRYHEETGITFASLYPGCIATTGLFREHIPLFRLLFPPFQKYITKGFVSEEESGKRLAQVVSDPSLTKSGVYWSWNKDSASFENQLSQEASDAEKARKVWEVSEKLVGLA

SEQ ID NO: 24755 - protein, 399 aa, Gossypium hirsutum
  Sequence also found in Organisms: Gossypium raimondii
MALQAAALVPSTFSVPKEGKSGASFKDSSLFGVSLSDHIKADFTSSALRCKREFNHRIGAVRAQTTATATPAITRSTVDGKKTLRKGSVIITGASSGLGLATAKALAETGKWHVIMACRDFLKAERAAKSAGMSKENYTIMHLDLASLDSVRQFVDSYKRSGRPLDVLVCNAAVYQPTAKEPTFTAEGFELSVGTNHLGHFLLSRLLLDDLKQSDYPSKRLIIVGSITGNTNTLAGNVPPKANLGDLRGLAGGLNGLNSSAMIDGGDFDGAKAYKDSKVCNMLTMQEFHRRFHEETGITFASLYPGCIATTGLFREHIPLFRLLFPPFQKYITKGFVSEEEAGKRLAQVVSDPSLTKSGVYWSWNKDSASFENQLSQEASDQDKARKIWELSEKLVGLA

SEQ ID NO: 24756 - protein, 391 aa, Amsonia hubrichtii
MALQAAALLPSTFSISKESKISASLRDTSLFGISLSDHLKCEFSSSSLKIKKGVRAQTVVTTPAVTRATGEGKKTLRKGTVIVTGASSGLGLATAKALAETGKWHIIMACRDFLKTERAAKSVGMAKESYTIMHLDLASLDSVRQFVDNFKRSGRPLDVLVCNAAVYLPTAKEPTFTAEGFELSVGTNHLGHFLLSRLLLDDMTQSDYPSKRLIIVGSITGNTNTLAGNVPPKANLGDLRGLAGGLNGLNSSAMVDGGNFDGAKAYKDSKVCNMLTMQEFHRRYHEDTGITFASLYPGCIATTGLFREHIPLFRFLFPPFQKYITKGFVSEEDAGKRLAQVVSDPSLTKSGVYWSWNKDSASFENQLSQEASDVEKARKVWEVSEKLVGLA

SEQ ID NO: 24757 - protein, 395 aa, Panax ginseng
MALQAASLLPSAFSINKEGKISASLKDTSLFGVSFFDNHKTDFTSSSSLKTKRHAGVVRAQAVVTTPSVNRATTDTKKTLRKGSVIVTGASSGLGLAAAKALAETGKWHVIMACRDFLKAERAAKSAGIAKENYTIMHLDLASLDSVRQFVDNFRRSGRALDVLVCNAAVYFPTAREPTFTAEGFELSVGTNHLGHFLLSRLLLDDLNKSDYPSKRLIIVGSITGNTNTLAGNVPPKANLGDMRGLAGGLNGLNSSAMIDGGDFDGAKAYKDSKICNMLTMQEFHRRYHEDTGITFASLYPGCIATTGLFREHIPLFRTLFPPFQKYITKGFVSEAESGKRLAQVVSEPSLTKSGVYWSWNKDSASFENQLSEEASDVEKARKVWEASEKLVGLA

SEQ ID NO: 24758 - protein, 388 aa, Catharanthus roseus
AAALLPSTFSLSKEGRTSVSLKDSSLFGISFSDPLKGEFSSSAFKIKKSSIRGQAVITTPGVTRATSEGKKTLRKGSVIITGASSGLGLATAKALAETGKWHIIMACRDFLKAERAAKSVGMSKENYTIMHLDLSSLDSVRQFVDNFKRSGRPLDVLVCNAAVYLPTAKEPTFTAEGFELSVGTNHLGHFLLSRLLLDDMKQSDYPSKRLIIVGSITGNTNTLAGNVPPKANLGDLRGLAGGLNGLNSSAMVDGGEFDGAKAYKDSKVCNMLTMQEFHRRYHEDTGITFASLYPGCIATTGLFREHIPLFRLLFPPFQKYITKGFVSEEDAGKRLAQVVSDPSLTKSGVYWSWNKDSASFENQLSQEASDVEKARKVWEVSEKLVGLA

SEQ ID NO: 24759 - protein, 399 aa, Medicago truncatula
MALQATSCLPASFSITKEGKIGASLKDSTFFGVSLSDSLKGDFSSSALRCKRELRQKVGAVRAETAATATPAVTKSSPDGKKTLRKGSVVITGASSGLGLATAKALAETGKWHVIMACRDFLKASRAAKSAGMAKENYTIMHLDLSSLDSVRQFVDNFRRSEMPLDVLVNNAAIYLPTAKEPTFTAEGFELSVGTNHLGHFLLSRLLLEDLGKSDYPSKRLIIVGSITGNTNTLAGNVPPKANLGDLRGLAGGLNGLNSSAMIDGGDFDGAKAYKDSKVCNMLTMQEFHRRYHEETGITFASLYPGCIATTGLFREHIPLFRTLFPPFQKYITKGYVSEDEAGKRLAQVVSDPSLTKSGVYWSWNKASASFENQLSQEASDVEKARKVWEVSEKLVGLA

SEQ ID NO: 24760 - protein, 398 aa, Eucalyptus grandis
MALQAAALVPSAFTIPKEGKSSASFKDSSLFGVSFSEHVKADFNSSALRCKREYNQRNGAVRAQTTASAPSVTRASPEGKKTLRKGSVIVTGASSGLGLATAKALAETGKWHVIMACRDFLKAERAAKSAGITKENYTIMHLDLASLDSVRQFVDNFRRSGQPLDVLVCNAAVYLPTAKEPTFTAEGFELSVGTNHLGHFLLSRLLLEDLNKSDYPSRRHIIVGSITGNTNTLAGNVPPKANLGDLRGLAGGLNGLNSSAMIDGGDFDGAKAYKDSKVCNMLTMQEFHRRYHEDTGITFASLYPGCIATTGLFREHIPLFRLLFPPFQKYITKGFVSEEEAGKRLAQVVSEPSLTKSGVYWSWNKDSASFENQLSQEASDVEKARKVWDVSEKLVGLA

SEQ ID NO: 24761 - protein, 395 aa, Plantago ovata
MALQSAALIPSSFFNHKEVSLKDSSLFGVSLSDHVKSDFTSSCLKSKREFSSRKLCTVRAQAVTAAPTYTPASVQGKKTLRKGTVIVTGASSGLGLATAKSLAESGKWHVIMACRDFLKAEKAAKSVGMDKENYTIMHLDLASLESVRQFVDSFKRSGRPLDVLVCNAAVYQPTAREPSFTADGFELSVGTNHLGHFLLSRLLLDDMKQSDYPSKRLIIVGSITGNTNTLAGNVPPKANLGDMRGLQGGLSAVNSSAMIDGGDFDGAKAYKDSKVCNMLTMQEFHRRYHEDTGITFASLYPGCIATTGLFREHIPLFRLLFPPFQRFITKGFVSEEEAGKRLAQVVSDPSLTKSGVYWSWNKDSASFENQLSQEASDVEKARKVWEVSEKLVGLA

SEQ ID NO: 24762 - protein, 399 aa, Populus trichocarpa
MALQAASLVSSAFVVPKEGKSSASLKESSLLGVSLSDHVKADFSSSTLKWKREFNQRVRTVRAQSMATATPAVNRASSDGKKTLRQGCCIVTGASSGLGLAAAKALAETGKWHVIMACRDFLKAERAAKSAGIAKENCTIMHLDLASLDSVRQFVDTFRRSGRALDVLVCNAAVYLPTAKEPTFTAEGFELSVGTNHLGHFLLSRLLLEDMKKSDYPSKRLIIVGSITGNTNTLAGNVPPKANLGDLRGLAGGLNGLNSSAMIDGGEFDGAKAYKDSKVCNMLTMQEFHRRFHEETGITFASLYPGCIATTGLFREHIPLFRLLFPPFQKYITKGFVSEEDAGKRLAQVVSDPSLTKSGVYWSWNKDSASFENQLSQEASDAEKARKVWEVSEKLVGLA

SEQ ID NO: 24763 - protein, 400 aa, Manihot esculenta
MALQAASLVSSGFVVPKEAKSNASFKDSSLFGVSLSDHLKADFSSSALSSQREPNQRVGAVVRAQTMATASPAVNRSAGEGKKTLRKGSVVVTGASSGLGLATAKALAETGKWHVIMACRDFLKAERAAKSAGISKENYTIMHLDLASLESVRQFVDNFRQSGRPLDVLVCNAAVYQPTAKEPTFTAEGFELSVGTNHLGHFLLSRLLLDDLKKSDYPSKRLIIVGSITGNTNTLAGNVPPKANLGDMRGLAGGLNGLNSSSMIDGGDFDGAKAYKDSKVCNMLTMQEFDRRFHEETGITFASLYPGCIATTGLFREHIPLFRLLFPPFQKYITKGFVSEDEAGKRLAQVVSDPSLTKSGVYWSWNKDSASFENQLSQEASDADKARKIWEISEKLVGLA

SEQ ID NO: 24764 - protein, 399 aa, Arachis hypogaea
MALQAASLVPASFSIPKEGKGSVSLRDSTLFGLSLSDSFKADFSSSALRCKREFQQSIGVVRAETAATATPAVSKSAPEGKKTLRKGNVVVTGASSGLGLATAKALAETGKWHVIMACRDFLKAARAAKSAGMSKENYSIMHLDLASLDSVRQFVDNLRRSEMPLDVLVCNAAVYLPTAKEPRFTAEGFELSVGTNHLGHFLLARLLMDDLTKSDYPSKRLIIVGSITGNTNTLAGNVPPKANLGDLRGLAGGLNGLNSSAMIDGGDFDGAKAYKDSKVCNMLTMQEFHRRYHEETGITFASLYPGCIATTGLFREHIPLFRTLFPPFQKYITKGYVSEDEAGKRLAQVVSDPSLTKSGVYWSWNKASASFENQLSQEASDVEKARKVWEISEKLVGLA

SEQ ID NO: 24765 - protein, 399 aa, Theobroma cacao
MALQAAALVPAAFSVPKEGKSSASFKDSSLFGVSLSDLVKADFSSSALRCKREFNQRTGAVRAQTTATATPAISRSAMDGKKTLRKGSVIITGASSGLGLATAKALAETGKWHVIMACRDFLKAERAAKSAGMSKENYTIMHLDLASLDSVRQFVDSYKRSGRPLDVLVCNAAVYQPTAKEPSFTAEGFELSVGTNHLGHFLLSRLLLDDLTQSDYPLKRLIIVGSITGNTNTLAGNVPPKANLGDLRGLAGGLNGLNSATMIDGGDFDGAKAYKDSKVCNMLTMQEFHRRFHEETGITFASLYPGCIATTGLFREHIPLFRLLFPPFQKYITKGFVSEEEAGKRLAQVVSDPSLTKSGVYWSWNKDSASFENQLSPEASDQEKARKIWEQSEKLVGLA

SEQ ID NO: 24766 - protein, 396 aa, Ricinus communis
MASSLVSSTFVVLKEGKSSASFKDSSLFGVSLSDHLKADHSSSAFRFKREPNQRVGAVRAQTMATASPAVNRAAPEGKKTLRKGSVIVTGASSGLGLATAKALAETGKWHIIMACRDFLKTERAAKSAGISKENYTIMHLDLASLDSVRQFVDNFKRSGRPLDVLVCNAAVYLPTAKEPTFTAEGFELSVGTNHLGHFLLSRLLLEDLQKSDYPSKRLIIVGSITGNTNTLAGNVPPKANLGDMRGLAGGLNGLNSSAMIDGGNFDGAKAYKDSKVCNMLIMQEFHRRFHEETGITFASLYPGCIATTGLFREHIPLFRTLFPPFQKYITKGYVSEDEAGKRLAQVVSDPSLTKSGVYWSWNKDSASFENQLSQEASDADKARKVWEISEKLVGLA

SEQ ID NO: 24767 - protein, 399 aa, Cicer arietinum
MALQAASLLPASFSIPKEGKGGVSLKDSTLFGLSLSESLKGDFSSSALRCKRELRQKVGAVRAETAATATPAVNKSSQDGKKTLRKGNVVITGASSGLGLATAKALAETGKWHVIMACRDFLKAARAAKSAGMAKENYTIMHLDLSSLDSVHQFVDNFRRSGMPLDVLVNNAAVYLPTAKEPRFTAEGFELSVGTNHLGHFLLSRLLLEDLQKSDYPSKRLIIVGSITGNTNTLAGNVPPKANLGDLRGLAGGLNGLNSSSMIDGGDFDGAKAYKDSKVCNMLTMQEFHRRYHEETGITFASLYPGCIATTGLFREHIPLFRTLFPPFQKYITKGYVSEEESGKRLAQVVSDPSLTKSGVYWSWNKASASFENQLSQEASDVEKARKVWEVSEKLVGLA

SEQ ID NO: 24768 - protein, 400 aa, Platanus occidentalis
MALQAASLLPSAFSAHKEGKSNAAKDTGFFGVPLAEHLKSDFNLPVLRTKREFSQKKLSVGAIRAQTAVTTPAINRAAPEGKKTLRKGSVVITGASSGLGLATAKALAETGKWHVIMACRDFLKAERAAKSAGMAKENYTVMHLDLASLDSVRQFVDNFRRSERPLDVLVCNAAVYLPTAKEPTFTAEGFELSVGTNHLGHFLLSRLLLDDLKQSDYPSKRLIIVGSITGNTNTLAGNVPPKANLGDLRGLAGGLNGLNISTMIDGGDFDGAKAYKDSKVCNMLTMQEFHRRFHEETGITFASLYPGCIATTGLFREHIPLFRLLFPPFQKYITKGFVSEEESGKRLAQVVSDPSLTKSGVYWSWNKDSASFENQLSQEASDAEKARKVWEVSEKLVGLA

SEQ ID NO: 24769 - protein, 400 aa, Utricularia gibba
MALQAAALFPSATSIHKEGKCVASLKSSSMFGVSLSDYVVKKDVLISSANKTKTGSRNLPVIKAEAVATSPTFTTAPVQGKKTLRKGTVIVTGASSGLGLATAKSLAESGKWHVIMACRDFLKAEKAAKSVGMSKENYTIIHLDLASLESVRQFVDNFRRSGRPLDVLVCNAAVYQPTAREPSFTADGFELSVGTNHLGHFLLSRLLLDDLKNSDYPSKRLIIVGSITGNTNTLAGNVPPKAGLGDLRGLQGGLNGINVSAMIDGGDFDGAKAYKDSKVCNMLTMQEFHRRFHDDTGITFASLYPGCIATTGLFREHIPLFRLLFPPFQKFITKGFVSEEESGKRLAQVVSDPSLTKSGVYWSWNKDSASFENQLSKEASDVDKAKKLWEVSEKLVGLSE

SEQ ID NO: 24770 - protein, 395 aa, Tragopogon dubius
MALQATSFTVQNLVKTTASFKDSTLFGASLSDHLKVDSSSSASRNHKEFTRRKVFRTLAVATTPQAPAVNRAAPEGKKTLRKGSVIITGASSGLGLATAKALAETGKWHVIMACRDFLKAERAAKSAGMSKENYTVMHLDLASLDSVRQFVDNFKRSGRPLDVLVCNAAVYQPTAKEPTFTADGIELSVGTNHLGHFLLSRLLLDDMKQSDYPSKRLIIVGSITGNTNTLAGNVPPKANLGDMRGLAGGLNGLNSSTMIDGGEFDGAKAYKDSKVCNMLTMQEFHRRYHEETGITFASLYPGCIATTGLFREHIPLFRLLFPPFQKFITKGYVSEEESGKRLAQVVSDPSLTKSGVYWSWNKDSASFENQLSEEASDVSKARKVWEISEKLVGLA

SEQ ID NO: 24771 - protein, 398 aa, Fagus grandifolia
MALHAASLLPSAFSIPKEGKSSASSKDSSLFGVSFSDHLKVDFNSSGLRCKREFNQRVGMVTAQTVTTTPSVITSAPDVKKTLRKGSVVVTGASSGLGLATAKALAETGKWHVIMACRDFLKTERAAKSAGIAKENYTIMHLDLASLDSVRQFVDNFKRSGRPLDVLVCNAAVYLPTAKEPTFTAEGFELSVGTNHLGHFLLSRLLLDDLQKSDYPSRRLIIVGSITGNTNTLAGNVPPKANLGDMRGLARGLNGLNSSAMIDGGDFDGAKAYKDSKVCNMLTMQEFHRRYHEDTGIAFASLYPGCIATTGLFREHIPLFRLLFPPFQKYITKGYVSEEESGKRLAQVVSDPSLTKSGVYWSWNKNSASFENQLSQEASDVEKAKKVWEISEKLVGLA

SEQ ID NO: 24772 - protein, 397 aa, Trifolium pratense
MALQAASLLPASFSIPKEGKIGVKDSTLFGVSLSESLKGDFSSSALRCKRELRQKAGVVRAETAATATPSVTKSSPDGKKTLRKGNVVITGASSGLGLATAKALAETGKWHVIMACRDFLKAARAAKSAGMAKESYTIMHLDLSSLDSVRQFVDNFRRSEMPLDVLVNNAAVYLPTAKEPTFTADGFELSVGTNHLGHFLLSRLLLEDIGKSDYPSKRLIIVGSITGNTNTLAGNVPPKANLGDLRGLAGGLNGLNSSSMIDGGDFDGAKAYKDSKVCNMLTMQEFHRRYHEETGITFASLYPGCIATTGLFREHIPLFRTLFPPFQKYITKGYVSEDEAGKRLAQVVSDPSLTKSGVYWSWNKASASFENQLSQEASDVEKARKVWEVSEKLVGLA

SEQ ID NO: 24773 - protein, 399 aa, Trifolium pratense
MALQAASLLPASFSIPKEGKIGASLKDSTLFGVSLSESLKGDFSSSALRCKRDLRQRVGAVRAETAATATPSVTKSSPDGKKTLRKGNVVITGASSGLGLATAKALAETGKWHVIMACRDFLKAARAAKSAGMAKENYTIMHLDLSSLDSVRQFVDNFRRAEMPLDVLVNNAAVYLPTAKEPTFTADGFELSVGTNHLGHFLLSRLLLEDMGKSDYPSKRLIIVGSITGNTNTLAGNVPPKANLGDLRGLSGGLNGLNSSAMIDGGDFDGAKAYKDSKVCNMLTMQEFHRRYHEETGITFASLYPGCIATTGLFREHIPLFRTLFPPFQKYITKGYVSEDEAGKRLAQVVSDPSLTKSGVYWSWNKASASFENQLSQEASDVEKARKVWEVSEKLVGLA

SEQ ID NO: 24774 - protein, 396 aa, Vitis vinifera
MAMQAAALVPSAFSIPKEGKGSASFKESGLFGVSLSDHVKADFSSSALRNKRKPSVGAIRAQTAATTPAITRATPEGKKTLRKGTVVITGASSGLGLATTKALAETGKWHIIMACRDFLKAERAARSAGLSKENYTVMHLDLASLDSVRQFVDNFKRSERPLDVLVCNAAVYLPTAKEPTFTADGFELSVGTNHLGHFLLARLLLDDLKQSDYPSKRLIIVGSITGNTNTLAGNVPPKANLGDLRGMAGGLNGLNSSAMIDGGAFDGAKAYKDSKVCNMLTMQEFHRRYHEDTGITFASLYPGCIATTGLFREHIPLFRLLFPPFQKFITKGYVSEEESGKRLAQVVSEPSLTKSGVYWSWNKNSASFENQLSQEASDADKARKVWELSEKLVGLA

SEQ ID NO: 24775 - protein, 396 aa, Cichorium intybus
MALQATTTFSIHNLVKTNASFKDSSLFGVSLSDHRQVDFSSAASTTRSKEFRRKVLRTQAVATTTQAPAVNRAAPEGKKTLRKGSVIITGASSGLGLATAKALAETGKWHVIMACRDFLKAERAAKSVGMTKENYTVMHLDLASLDSVRQFVNNFKQSGRPLDVLVCNAAVYQPTAKEPSFTADGIELSVGTNHLGHFLLSRLLLDDMKQSDYPSKRLIIVGSITGNTNTLAGNVPPKANLGDMRGLAGGLNGLNSSTMIDGGEFDGAKAYKDSKICNMLTMQEFHRRFHEETGITFASLYPGCIATTGLFREHIPLFRLLFPPFQKYITKGFVSEEESGKRLAQVVSDPSLTKSGVYWSWNKDSASFENQLSEEASDVSKARKVWEISEKLVGLA

SEQ ID NO: 24776 - protein, 401 aa, Carica papaya
MALQAAAAALVPSAFSIPKEGKSSASFKDSSLFGVSVSENLKSDVRPSALISNRKFSQRTSSVRAQTAATTTPGISKSALEGKKTLRKGSVIITGASSGLGLATAKALAETGKWHVIMACRDFLKAQRAAKSAGMTKENYTVMHLDLASLDSVRQFVQNFRQSGRPLDVLVCNAAVYLPTAKDPTFTAEGFELSVGTNHLGHFLLSRLLLDDLKQSDYPSKRLIIVGSITGNTNTLAGNVPPKANLGDLRGLAGGLNGLNSSAMIDGGHFDGAKAYKDSKVCNMLTMQEFHRRYHEETGITFTSLYPGCIATTGLFREHIPLFRLLFPPFQKYITKGFVSEEESGKRLAQVVSDPSLTKSGVYWSWNKDSASFENQLSQEASDADKARKVWELSEKLVGLA

SEQ ID NO: 24777 - protein, 400 aa, Panax ginseng
MALHAAALLPSAFSINKEVKTIASFKNTSLFQVSFSDILKIDLGSTSLRTKRDGNQRWNAGVVRAQTAVTTPSINRAATDGKKTLRKGSVIITGASSGLGLAAAKSLAETGKWHVIMACRDFLKAERAAKSAGISKENYTIMHLDLASLDSVRQFVDNFRQSARPLDVLVCNAAVYFPTAKEPTYSAEGFELSVGTNHLGHFLLSRLLLDDLNKSDYPSKRLIIVGSITGNTNTLAGNVPPKANLGDMRGLAGGLNGLNSSAMIDGGEFDGAKAYKDSKVCNMLTMQEFHRRYHEDTGITFASLYPGCIATTGLFREHIPLFRTLFPPFQKYITKGYVSEEESGRRLAQIVSEPSLTKSGVYWSWNKNSASFENQLSEEASDVEKARKVWEVSEKLVGLA

SEQ ID NO: 24778 - protein, 399 aa, Trifolium pratense
MALQAASLLPASFSIPKEGKIGASLKDSTLFGVSLSESLKGDFSSSALRCKRDLRQKVGAVRAETAATATPSVTKSSPDGKKTLRKGNVVITGASSGLGLATAKALAETGKWHVIMACRDFLKAARAAKSAGMAKENYTIMHLDLSSLDSVRQFVDNFRRAEMPLDVLVNNAAVYLPTAKEPTFTADGFELSVGTNHLGHFLLSRLLLEDMGKSDYPSKRLIIVGSITGNTNTLAGNVPPKANLGDLRGLSGGLNGLNSSSMIDGGDFDGAKAYKDSKVCNMLTMQEFHRRYHEETGITFASLYPGCIATTGLFREHIPLFRTLFPPFQKYITKGYVSEDEAGKRLAQVVSDPSLTKSGVYWSWNKASASFENQLSQEASDVEKARKVWEVSEKLVGLA

SEQ ID NO: 24779 - protein, 399 aa, Carpinus betulus
MALQAASLVSSAFAIPKEGKSSASSKDSSLFGVSFSDHLKADFSSSGLRCKREFNHRVGAVRAQTAATTTPAVNRAAPEGKKTLRKGSVVITGASSGLGLATAKALAETGKWDVIMACRDFLKAERAAKSAGIAKENYTIMHLDLASLDSVRQFVDNFRRSGRPLDVLVCNAAVYLPTAKEPTFTAEGFELSVGTNHLGHFLLSRLLLEDLQKSDYPLRRHIIVGSITGNTNTLAGNVPPKANLGDMRGLAGGLNGLNSSAMIDGGAFDGAKAYKDSKVCNMLTMQEFHRRYHEDTGITFASLYPGCIATTGLFREHIPLFRILFPPFQKYITKGYVSEEESGKRLAQVVSDPSLTKSGVYWSWNKDSASFENQLSQEASDTDKARKVWEVSEKLVGLA

SEQ ID NO: 24780 - protein, 399 aa, Tropaeolum majus
MALQAASLVSSAFSIPKEGKSCSSFKDSCVFGVSLSDLHKSDFSASALRCKREFTQRAGVVRAQTVATTAPANNKATVDGKKTLRKGSVVVTGASSGLGLATAKALAETGKWHVIMACRDFLKAERAAKSAGMSKENYTVIHLDLSSLESVRQFVDNFRRTERPLDVLVCNAAVYLPTAKEPTYTADGFELSVGTNHLGHFLLARLLLEDLKQSDYPSKRLIIVGSITGNTNTLAGNVPPKANLGDLRGLAGGLNGLNSSAMIDGGEFDGAKAYKDSKVCNMLTMQEFHRRYHEETGVTFASLYPGCIATTGLFREHIPLFRLLFPPFQKYITKGYVSEEESGKRLAQVVSDPSLTKSGVYWSWNKASASFENQLSQEASDVEKAKKVWELSEKLVGLA

SEQ ID NO: 24781 - protein, 400 aa, Pisum sativum
MALQTASMLPASFSIPKEGKIGASLKDSTLFGVSSLSDSLKGDFTSSALRCKRELRQKVGAVRAETAAPATPAVNKSSSEGKKTLRKGNVVITGASSGLGLATAKALAESGKWHVIMACRDYLKAARAAKSAGLAKENYTIMHLDLASLDSVRQFVDNFRRSEMPLDVLINNAAVYFPTAKEPSFTADGFEISVGTNHLGHFLLSRLLLEDLKKSDYPSKRLIIVGSITGNTNTLAGNVPPKANLGDLRGLAGGLTGLNSSAMIDGGDFDGAKAYKDSKVCNMLTMQEFHRRYHEETGITFASLYPGCIATTGLFREHIPLFRTLFPPFQKYITKGYVSEEESGKRLAQVVSDPSLTKSGVYWSWNNASASFENQLSQEASDAEKARKVWEVSEKLVGLA

SEQ ID NO: 24782 - protein, 399 aa, Cajanus cajan
MALQAASLVPASFSLPKEGKNGVSLKDSALFGLSLSEPIKADFSSSALRCKRDLQQKIGAVRAETVATTTPAVTKSTPEGKKTLRKGSVVITGASSGLGLATAKALAETGKWHIIMACRDFLKASRAAKSAGMAKENYTIMHLDLASLDSVRQFVDNFRRSDMPLDVLVCNAAVYLPTAKEPTFTAEGFELSVGTNHLGHFLLARLLLEDLNKSDYPSKRLIIVGSITGNTNTLAGNVPPKANLGDLRGLQGGLNGLNSSAMIDGGDFDGAKAYKDSKVCNMLTMQEFHRRFHEETGITFASLYPGCIATTGLFREHIPLFRTLFPPFQKYITKGFVSEDEAGKRLAQVVSDPSLTKSGVYWSWNKTSASFENQLSQEASDAEKARKVWEISEKLVGLA

SEQ ID NO: 24783 - protein, 401 aa, Aquilegia formosa
MALQAYSVLPSAISIHKEGKLSMSLKDTAFLGISINDHLNSEFSFPGLKSKIELSQRNKSVGAIRAQTAATTPAVNQATPQGKKTLRKGSVIITGASSGLGLATAKSLAESGKWHVIMACRDFLKAERAAKSAGMSKENYTIMHLDLSSLDSVRQFVDNFKRSERPLDVLVCNAAVYQPTAKEPSYTAEGFELSVGTNHLGHFLLARLLLDDLKQSDYPSKRLIIVGSITGNTNTLAGNVPPKANLGDLRGLAGGLSGLNSSAMIDGGDFDGAKAYKDSKVCNMLTMQEFHRRYHEETGITFASLYPGCIATTGLFREHIPLFRLLFPPFQKYITKGYVSEEESGKRLAQVVSDPSLTKSGVYWSWNKTSASFENQLSEEASDAEKAKKVWEMSEKLVGLA

SEQ ID NO: 24784 - protein, 394 aa, Cirsium arvense
MALQATSFSVHNLPVKTAGSSMDSGLFGASLLDHRKVDFSSSSSRSKMEFTRRKVFKTQAVATTTPAVIWTAPEGKKTLRKGSVIITGASSGLGLATAKALSETGKWHVIMACRDFLKAERAAKSAGMSKENYTVMHLDLSSFDSVRQFVGNFKQSGRPLDVLVCNAAVYQPTAKEPTFTADGIELSVGTNHLGHFLLSRLLLDDLKQSDYPSKRLIIVGSITGNTNTLAGNVPPKANLGDMRGLAGGLNGLNSSAMIDGGDFDGAKAYKDSKVCNMLTMQEFHRRYHEETGITFASLYPGCIATTGLFREHIPLFRLLFPPFQKFITKGYVSEEESGKRLAQVVSDPSLTKSGVYWSWNKDSASFENQLSEEASDVAKARKVWEISEKLVGLA

SEQ ID NO: 24785 - protein, 399 aa, Cucumis melo
MALQAASLVSPALSVPKEGKSSVCLKDSSLFGISFSDHLKSEFSSSTLRCKRELNQQIGAIRAQTTATESPAVNKAAPDGKKTLRKGSVVITGASSGLGLATAKALAETGKWHVIMACRDFLKAERAAKSAGIAKENYTVMHLDLASLDSVRQFVDNFRQSGRPLDVLVCNAAVYLPTAKEPTFTAEGFELSVGTNHLGHFLLSRLLLEDLNKSDYPSKRLIIVGSITGNTNTLAGNVPPKANLGDLRGLAGGLNGLNSSSMIDGGEFDGAKAYKDSKVCNMLTMQEFHRRYHEETGITFASLYPGCIATTGLFREHIPLFRLLFPPFQKFITKGYVSEDEAGKRLAQVVSEPSLTKSGVYWSWNKNSASFENQLSQEASDAEKARKVWDLSEKLVGLA

SEQ ID NO: 24786 - protein, 391 aa, Tabernaemontana elegans
MALQAAALLPSTFSISKEGKTSVSFKDSSLFGISIFDHLKCECSSSSLKIKKGVRAQAVVTTPDVTRATTEGKKTLRKGTVIVTGASSGLGLATAKALAESGKWHIIMACRDFLKTERSAKSVGMTKESYTIMHLDLASLDSVRQFVDNFRRSERPLDVLVCNAAVYLPTAKEPTFTAEGFELSVGTNHLGHFLLSRLLLDDMKQSDYPSKRLIIVGSITGNTNTLAGNVPPKASLGDMRGLAGGLNGLNSSAMIDGGDFDGAKAYKDSKVCNMLTMQEFHRRYHDDTGITFSSLYPGCIATTGLFREHIPLFRLLFPPFQKYITKGFVSEEEAGKRLAQVVSDPSLTKSGVYWSWNKDSASFENQLSQEASDVEKARKVWEISEKLVGLA

SEQ ID NO: 24787 - protein, 402 aa, Amaranthus tuberculatus
MALQATSFLPCALSIPKEGKSNPCLKDSGFFGVSLSDYVKADFSSSALRCKRECNATRSTVGPIRAQASAVATPGVTKSSSEQKKTLRKGSVIVTGASSGLGLAAAKALAETGKWHVIMACRDFLKTERAAKSAGMAKENYTIMHLDLASLDSVRQFVNNFRQSGRPLDVLVCNAAVYLPTAREPTYTAEGFELSVGTNHLGHFLLSRLLLEDLNKSDYPSKRLIIVGSITGNTNTLAGNVPPKANLGDMRGLAGGLNGLNSSAMIDGGDFDGAKAYKDSKVCNMLTMQEFHRRYHEETGITFASLYPGCIATTGLFREHIPLFRLLFPPFQKFITKGFVSEDEAGKRLAQVVSEPSLTKSGVYWSWNKASASFENQLSQEASDPEKAKKVWEISEKLVGLA

SEQ ID NO: 24788 - protein, 389 aa, Chrysanthemum coronarium
MALQATSSFSIHKEACLKESSIFGAPLSTHVKVDFTSSSKSKKEFSQRGALRTQAVATPTPTANRASTDGKKTLRKGTVIITGASSGLGLATAKSLAESGKWHVIMACRDFLKAERAAKSSGMTKENYSVMHLDLSSLDSVRQFVANFKQSGQSLDVLVCNAAVYLPTAKEPTYTADGFELSVGTNHLGHFLLARLLLDDLKQSDYPSKRLIIVGSITGNTNTLAGNVPPKANLGDMRGLAGGLNGLNSSAMIDGGDFDGAKAYKDSKVCNMLMMQEFHRRYHEETGITFASLYPGCIATTGLFREHIPLFRLLFPPFQKYITKGYVSEDESGKRLAQVVSDPSLTKSGVYWSWNNNSASFENQLSEEASDVSKARKVWEVSEKLVGLA

SEQ ID NO: 24789 - protein, 399 aa, Cucumis sativus
MALQAASLVSPALSIPKEGKSSVCLKDSSLFGISFSDHLKSEFSSSTLRCKRELNQQIGAIRAQTTATESPAVNKATPDGKKTLRKGSVVITGASSGLGLATAKALAETGKWHVIMACRDFLKAERAAKSAGITKENYTVMHLDLASLDSVRQFVDNFRQSGRPLDVLVCNAAVYLPTAKEPTFTAEGFELSVGTNHLGHFLLSRLLLEDLNKSDYPSKRLIIVGSITGNTNTLAGNVPPKANLGDLRGLAGGLNGLNSSSMIDGGEFDGAKAYKDSKVCNMLTMQEFHKRYHEETGITFASLYPGCIATTGLFREHIPLFRILFPPFQKFITKGYVSEDEAGKRLAQVVSEPSLTKSGVYWSWNKNSASFENQLSQEASDAEKARKVWELSEKLVGLA

SEQ ID NO: 24790 - protein, 398 aa, Ananas comosus
MALQAAALLPSAFSIRKEGKSGASLKESGLFGISLSDHVNCSSGLRIKKEFNPRKLSVGSVRAEAMATTPTITKATVEGKKTLRKGCVVITGASSGLGLATAKALGDTGKWHIIMACRDFLKAERAAKSAGIAKENYTVMHLDLASLDSVRQFVDNFRRSGRPLDVLVCNAAVYLPTAREPTFTADGFELSVGTNHLGHFLLSRLMLDDLKQSDYPSKRLIIVGSITGNTNTLAGNVPPKANLGDLRGFAGGLNGLNSSSMIDGGDFDGAKAYKDSKVCNMLTMQEFHRRYHEETGITFASLYPGCIATTGLFREHIPLFRTLFPPFQKYITKGYVSEEESGKRLAQVVAEPSLTKSGVYWSWNKASASFENQLSEEASNVEKARKVWELSEKLVGLA

SEQ ID NO: 24791 - protein, 399 aa, Citrullus lanatus
MALQAASLVSPALSVPKEGKSCVCLKDSSFFGISFSDHLKSEFTSSTLRCKIELNQQIGAIRAQTTATTTPAVNKAAPDGKKTLRKGSVVVTGASSGLGLATAKALAETGKWHVIMACRDFLKAERAAKSAGIAKENYTVMHLDLASLDSVRQFVDNFRQSGRPLDVLVCNAAVYLPTAKEPTFTAEGFELSVGTNHLGHFLLSRLLLEDLNKSDYPSRRLIIVGSITGNTNTLAGNVPPKANLGDLRGLAGGLNGLNSSSMIDGGEFDGAKAYKDSKVCNMLTMQEFHRRYHEETGITFASLYPGCIATTGLFREHIPLFRLLFPPFQKYITKGYVSEEEAGKRLAQVVSEPSLTKSGVYWSWNKNSASFENQLSQEASDVEKARKVWELSEKLVGLA

SEQ ID NO: 24792 - protein, 394 aa, Vinca minor
MALQAAAASFLPSTFSISKEGKTGASLKDSILFGISLSDHLKCEFSSSSSLKIKKGVRAEAVLTTPGVTNSASERKKTLRKGTVIITGASSGLGLATAKALAETGKWHIIMACRDFLKTERAAKSVGMSKENYTIMHLDLSSLDSVRQFVDNFKRSERPLDVLVCNAAVYLPTAKEPTFTADGFELSVGTNHLGHFLLSRLLLDDMKQSDYPSKRLIIVGSITGNTNTLAGNVPPKANLGDLRGLAGGLNGLNSSAMVDGAEFDGAKAYKDSKVCNMLTMQEFHRRYNEDTGITFASLYPGCIATTGLFREHIPLFRTLFPPFQRFITKGFVSEEDAGKRLAQVVSDPSLTKSGVYWSWNKDSASFENQLSEEASDIEKARKVWEVSEKLVGLA

SEQ ID NO: 24793 - protein, 399 aa, Gossypium hirsutum
  Sequence also found in Organisms: Gossypium raimondii
MALQTAALVPATFTLPKEGKSSPSFKDSTFFGVSLSEHAKADFSSSALRCKREFNPRNGAVRAETTATATPAISRSAVDGKKTLRKGSVIITGASSGLGLATAKALAETGKWHIIMACRDFLKAERAAKSAGMSKQNYTIMHLDLASLDSVRQFVDRYKRSGRPLDVLVCNAAVYQPTAKEPSFTAEGFELSVGTNHLGHFLLSRLLLDDLKQSDYPSKRLIIVGSITGNTNTLAGNVPPKANLGDLRGLAGGLNGLNSSTMIDGGEFDGAKAYKDSKVCNMLTMQEFHRRFHEESGITFASLYPGCIATTGLFREHIPLFRLLFPPFQKYIIKGFVSEDEAGKRLAQVVSDPSLTKSGVYWSWNQNSASFENQLSPEASDEEKARKIWELSEKLVGLA

SEQ ID NO: 24794 - protein, 389 aa, Chrysanthemum coronarium
MALQATSSFSIHKEACLKESSIFGAPLSTHVKVDFTSSSKSKKEFSQRGALRTQAVATPTPTANRASTDGKKTLRKGTVIITGASSGLGLATAKSLAESGKWHVIMACRDFLKAERAAKSSGMTKENYSVMHLDLSSLDSVRQFVANFKQSGQSLDVLVCNAAVYLPTAKEPTYTADGFELSVGTNHLGHFLLARLLLDDLKQSDYPSKRLIIVGSITGNTNTLAGNVPPKANLGDMRGLAGGLSGLNSSAMIDGGDFDGAKAYKDSKVCNMLMMQEFHRRYHEETGITFASLYPGCIATTGLFREHIPLFRLLFPPFQKYITKGYVSEDESGKRLAQVVSDPSLTKSGVYWSWNNNSASFENQLSEEASDVSKARKVWEVSEKLVGLA

SEQ ID NO: 24795 - protein, 392 aa, Coffea canephora
MALQAAALLPSTFSFSKEGKVGASLKDSSLFGKSLSDQIKSDISSSSLKIKRAVRAEAVITATPAVNRATAEGKKTLRKGTVVITGASSGLGLATAKALAETGKWHIIMACRDFLKAERAAKSVGMTKENYTIMHLDLGSLDSVRQFVDTFRRSGRSLDVLVCNAAVYLPTAKEPTFTAEGFELSVGVNHLGHFLLARSLLDDMNQSDYPSKRLIIVGSITGNTNTLAGNVPPKASLGDLRGLAGGLNGLNTASMIDGGDFDGAKAYKDSKVCNMLTMQEFHRRYHEDTGITFASLYPGCIATTGLFREHIPLFRFLFPPFQKYVTKGFVSEEEAGKRLAQVVSDPSLTKSGVYWSWNKDSASFENQLSQEASDVEKARKVWEISEKLVGLA

SEQ ID NO: 24796 - protein, 399 aa, Cucurbita pepo
MALQPASLVSPALSLPKEGKSTVCLKDSSFFGISVSDHLKSEFSSSALRCKREFNHHVGAIRAQTTATTTPAVNKAAPDGKKTLRKGSVVITGASSGLGLATAKALAETGKWHVIMACRDFLKAERAAKSAGITKENYTVMHLDLASLDSVRQFVDNFRQSGRPLDVLVCNAAVYLPTAKEPTFTAEGFELSVGTNHLGHFLLSRLLLEDLQKSDYPSKRLIIVGSITGNTNTLAGNVPPKANLGDLRGLSGGLTGLNSSAMIDGGEFDGAKAYKDSKVCNMLTMQEFHRRYHEETGITFASLYPGCIATTGLFREHIPLFRWLFPPFQKYITKGYVSEEESGKRLAQVVSDPSLTKSGVYWSWNKNSASFENQLSQEASDGEKARRVWELSEKLVGLA

SEQ ID NO: 24797 - protein, 397 aa, Primula obconica
MALQAAALLPSTFSIPKEGRSGALKDSALFGISLSDHVISSSSLRIKKEFNTRKLSTGAIRAETMVTTPSINTASSEKKKTLRKGSVIITGASSGLGLATAKALADTGKWHIIMACRDFLKAERAAKSAGINKENYTVMHLDLSSLDSVRQFVENFRRSGRPLDVLVCNAAVYFPTATTPTFTAEGFELSVGTNHLGHFLLSRLLLDDLQQSDYPSKRLIIVGSITGNTNTLAGNIPPKANLGDLRGLAGGLNGLNTSAMIDGGDFDGAKAYKDSKVCNMLTMQEFHKRYHEETGITFASLYPGCIATTGLFREHIPLFRTLFPPFQKYITKGYVSEEESGNRLAQVVAEPSLTKSGVYWSWNNASASFENQLSEEASDAEKARKVWDLSEKLVGLA

SEQ ID NO: 24798 - protein, 399 aa, Glycine max
MALQAASLVSASFSIAKEGKSGVSLRDTTMFGVSLSDTLKSDFSSPSSTCKREFQQKFGPLRVQSVATTTPGVTKASPEGKKTLRKGSVIITGASSGLGLATAKALAETGKWHVIMACRDFLKAERAAKSAGIAKENYTIMHLDLASLDSVRQFVDNFRQSGRPLDVLVCNAAVYLPTAREPTYTADGFELSVGTNHLGHFLLSRLLLDDLNKSDYPSKRLIIVGSITGNTNTLAGNVPPKANLGDMRGLAGGLNGLNTSAMIDGGSFDGAKAYKDSKVCNMLTMQEFHRRYHDETGITFASLYPGCIATTGLFREHIPLFRLLFPPFQKYITKGFVSEDESGKRLAQVVSDPSLTKSGVYWSWNAASASFENQLSQEASDADKARKVWEISEKLTGLA

SEQ ID NO: 24799 - protein, 399 aa, Phaseolus vulgaris
MALQAASLVPASFSVPKEGKSCVSLKDSTLFGLSLSEPSKADFSSSALRCKREFQQKIGAVRAETVATASPAVTKSTPEGKKTLRKGSVVITGASSGLGLATAKALAETGKWHIIMACRDYLKAARAAKSAGMAKENYTIMHLDLASLDSVRQFVDNFRRSEMPLDVLVCNAAVYLPTAKEPTFTAEGFELSVGTNHLGHFLLARLLLEDLRKSDYPSKRMIIVGSITGNTNTLAGNVPPKANLGDLRGLQGGLNGLNSSAMIDGGDFDGAKAYKDSKVCNMLTMQEFHRRYHEETGITFSSLYPGCIATTGLFREHIPLFRTLFPPFQKYITKGYVSEDEAGKRLAQVVSDPSLTKSGVYWSWNKTSASFENQLSQEASDVEKARKVWEISEKLLGLA

SEQ ID NO: 24800 - protein, 399 aa, Vitis vinifera
MALQAASLLPSAVSIHKEGKSNASLKETGFFEVSVSDHLKAELSLGLSKNKELKRRKLPVGVIRAQTATTPAISQASPEGKKTLRKGNVIITGASSGLGLATAKALAETEKWHIIMACRNFLKADRAAKSAGIAKENYTVMHLDLASLESVRQFADNFRRSGRPLDVLVCNAAVYLPTAKEPTFTAEGFELSVGTNHLGHFLLSRLLLDDLKQTDYPSKRLIIVGSITGNTNTLAGNVPPKANLGDLRGLAGGLNGINGSPMIDGGEFDGAKAYKDSKVCNMLTMQEFHRRYHEETGITFASLYPGCIATTGLFREHIPLFRLLFPPFQKYITKGYVSEEEAGKRLAQVVTDPSLTKSGVYWSWNKNSASFQNQLSQEASDAEKARKVWEISEKLVGLA

SEQ ID NO: 24801 - protein, 398 aa, Chelidonium majus
MALQAASILPSGLSIHKEGKCKETSFYGVSFSDHLKSDHFNPLVIRNKRESKNQRNFSAGIIRAQTAATSSGVKEATPGKKTLRKGCVIITGASSGLGLATAKSLADTGKWHIIMACRDFLKAERAAKSVGMEKENYTVMHLDLSSLDSVRQFVDNFRRSDRPLDVLVCNAAVYQPTAKEPTFTADGFELSVGTNHLGHFLLARLLLDDLNKSDYPSRRLIIVGSITGNTNTLAGNVPPKANLGDLRGLARGLNGLNSSVMIDGGEFDGAKAYKDSKVCNMLTMQEFHKRYHEETGITFASLYPGCIATTGLFREHIPLFRLLFPPFQKYITKGYVSEEEAGKRLAQVVGEPSLTKSGVYWSWNKTSASFENQLSEEASDAEKARKLWEVSEKLVGLA

SEQ ID NO: 24802 - protein, 394 aa, Humulus lupulus
MALQAASLVPSAFSVPKEGKTSASFKDSSLFGVSLDHFKAEISSCALRCKRTGPVKAQTTATTTPSVAKSSSEGKKTLRKGSVIVTGASSGLGLATAKALAETGKWHVIMACRDFLKTERAAKAAGINKENYSIIHLDLASLDSVRQFVDNFRLSGRPLDVLVCNAAVYQPTAKEPSFTAEGFELSVGTNHLGHFLLARLLLEDLNKSDYPSKRLIIVGSITGNTNTLAGNVPPKANLGDLRGLAGGLNGLNTSSMIDGGSFDGAKAYKDSKVCNMLIMQEFHRRFHEETGITFSSLYPGCIATTGLFREHIPLFKLLFPPFQKYITKGFVSEEDAGKRLAQVVSDPSLTKSGVYWSWNKASASFENQLSEEASDAEKARKVWEISEKLVGLAE

SEQ ID NO: 24803 - protein, 399 aa, Platanus occidentalis
MALQAASLLPSALSIHKEGKNNASLKDTGFYGVSLSDHLKYDFNPVIRTKREFSQKKLSIAVRAEAAVTTPAINQATPEAKKTLRKGSVVITGASSGLGLATAKALAETGKWHIIMACRDFLKAERAAKSVGIAKENYTVMHLDLASLDSVRQFVDNFKRSGRPLDVLVCNAAVYLPTAKEPTYTAEGFELSVGTNHLGHFLLARLLLDDLKQSDYPSKRLIIVGSITGNTNTLAGNVPPKANLGDLRGLVGGLNGLNTSTMIDGGEFDGAKAYKDSKVCNMLTMQEFHRRFHEETSITFASLYPGCIATTGLFREHIPLFRLLFPPFQKYITKGYVSEEEAGKRLAQVVSEPSLTKSGVYWSWNKNSASFENQLSQEASDAEKARKLWEVSEKLVGLA

SEQ ID NO: 24804 - protein, 391 aa, Sesamum indicum
PSAYPIHKEGKSGACLKDSSLFGVSLSDHVKADFTSAALKSKREFGSRKLPAVRVEAVATSPTFTPATVQGKKTLRKGSVIITGASSGLGLATAKALAESGKWHVIMACRDFLKAERAAKSVGMAKENYTIMHLDLASLDSVRQFVDNFKRSGRPLDVLVCNAAVYQPTAREPSYTADGFELSVGTNHLGHFLLSRLLLDDLKQSDYPSKRLIIVGSITGNTNTLAGNVPPKANLGDLRGLQGGLNGLNSSSMIDGADFDGAKAYKDSKVCNMLTMQEFHRRYHEDTGITFASLYPGCIATTGLFREHIPLFRLLFPPFQKFITKGFVSEEEAGKRLAQVVSDPSLTKSGVYWSWNKDSASFENQLSEEASDADKARKVWEISEKLVGLRD

SEQ ID NO: 24805 - protein, 399 aa, Glycine max
MALQAASLVPASFSVLKEGKSGVSLKDSTLFGLSFSEPIKANFSSSALRCKREFEQKLCAVRAETVATASPAVTKSTPEGKKTLRKGSVVITGASSGLGLATAKALAETGKWHVIMACRDYLKAARAAKSAGMAKENYTIMHLDLASLDSVRQFVDNFRRSEMPLDVLVCNAAVYLPTAKEPTFTAEGFELSVGTNHLGHFLLSRLLLEDLEKSDYPSKRLIIVGSITGNTNTLAGNVPPKANLGDLRGLQGGLNGLNSSAMIDGGDFDGAKAYKDSKVCNMLTMQEFHRRFHEETGITFASLYPGCIATTGLFREHIPLFRTLFPPFQKYITKGYVSEDEAGKRLAQVVSDPSLTKSGVYWSWNKASASFENQLSQEASDTEKARKIWEISEKLVGFA

SEQ ID NO: 24806 - protein, 399 aa, Cichorium intybus
MALRAASLLPSAISVHKEGKLNSSLKESSFNGAFVSKNVKSDFSSLVIGTKDLRRKSSFGPIRAQTATVAPSVNDAVPDGKKTLRKGNVIITGASSGLGLATAKALADTEKWHIIMACRNFLKAEKAAKSVGITKENYTVMHLDLSSLDSVRQFVDTFRRSGRPLDALVCNAAIYLPTAKEPTYTAEGFELSVGTNHLGHFLLSRLLLDDLKKSDFPQKRLIIVGSITGNTNTLAGNVPPKANLGDLRGLAGGLNGLNSSAMIDGGEFDGAKAYKDSKVCNMLTMQEFHRRYHEETGVTFSSLYPGCIATTGLFREHIPLFRLLFPPFQKYITKGYVSEEEAGKRLAQVVSDSSLTKSGVYWSWNKNSASFENQLSQEASDEEKARKLWEVSEKLLGLA

SEQ ID NO: 24807 - protein, 399 aa, Cichorium intybus
MALRAASLLPSAISVHKEGKLNSSLKESSFNGAFVSKNVKSDFSSLVIGTKELRRKSSFGPIRAQTATVAPSVNDAVPDGKKTLRKGNVIITGASSGLGLATAKALADTEKWHIIMACRNFLKAEKAAKSVGITKENYTVMHLDLSSLDSVRQFVDTFRRSGRPLDALVCNAAIYLPTAKEPTYTAEGFELSVGTNHLGHFLLSRLLLDDLKKSDFPQKRLIIVGSITGNTNTLAGNVPPKANLGDLRGLAGGLNGLNSSAMIDGGEFDGAKAYKDSKVCNMLTMQEFHRRYHEETGVTFSSLYPGCIATTGLFREHIPLFRLLFPPFQKYITKGYVSEEEAGKRLAQVVNDSSLTKSGVYWSWNKNSASFENQLSQEASDEEKARKLWEVSEKLVGLA

SEQ ID NO: 24808 - protein, 393 aa, Olea europaea
MALQAAAILPSAFAIQKEGKNSASFKDSNLFGISISDHVKADKREFISRKLSVGAIRAEAVATYPVFTPATVQGKKTLRKGTVVITGASSGLGLATAKALAETGKWHVIMACRDFLKAERAAKSVGMSKENYTIMHLDLASFDSARQFVENFKQSGRPLDVLVCNAAVYQPTAREPSFTADGFELSVGTNHLGHFLLSRLLLDDMKQSDYPSKRLIIVGSITGNTNTLAGNVPPKANLGDLRGLQGGLNGLNTSSMIDGGDFDGAKAYKDSKVCNMLTMQEFHRRYHEETGITFASLYPGCIATTGLFREHIPLFRLLFPPFQKFITKGFVSEEEAGNRLAQVVSDPSLTKSGVYWSWNKDSASFENQLSQEASNADKARKVWEISEKLVGLA

SEQ ID NO: 24809 - protein, 389 aa, Chrysanthemum coronarium
MALQATSSFCINKEASLKESSIFGAPLSTHVKVGFTSSSKTKKEFSQRGALRTQAVATPTPTANRASTDGKKTLRKGTVIITGASSGLGLATAKSLAESGKWHVIMACRDFLKAERAAKSSGMAKENYTVMHLDLSSFDSVRQFVGNFKQSGQSLDVLVCNAAVYLPTAKEPTYTADGFELSVGTNHLGHFLLARLLLDDLKKSDYPSKRLIIVGSITGNTNTLAGNVPPKANLGDMRGLAGGLNGLNSSAMIDGGDFDGAKAYKDSKVCNMLMMQEFHRRYHEETGITFASLYPGCIATTGLFREHIPLFRLLFPPFQKYITKGYVSEDESGKRLAQVVSDPSLTKSGVYWSWNNNSASFENQLSEEASDVSKARKVWEISEKLVGLA

SEQ ID NO: 24810 - protein, 393 aa, Mimulus guttatus
MALHAAALLPSAFSTHKEGKSSASLKDSCFFGVSLISDHVKADKREFSSRKSPVLRVQAVATAPTATPAASQGKKTIRKGTVIITGASSGLGLATAKALSESGKWHVVMACRDFLKAEKAAKSAGMAKESYTIMHLDLSSLDSVRQFVDNFKRSGRPLDVLVCNAAIYQPTAKEPSFTADGFELSVGTNHLGHFLLSRLLPDDMKESDYPSKRLIIVGSITGNTNTLAGNVPPKANLGDLRGLQGGLTGLNTSSMIDGGDFDGAKAYKDSKVCNMLTMQEFHRRYHEDTGITFASLYPGCIATTGLFREHIPLFRLLFPPFQKFITKGFVSEEESGKRLAQVVSDPSLTKSGVYWSWNKDSASFVNQLSEEASDAAKARKVWEVSEKLVGLSE

SEQ ID NO: 24811 - protein, 395 aa, Cajanus cajan
MALQAASLVSASFNIAKEGKSGVPLRDTTMFGLSMSDTLTSPSLTCKREFQQKFGPVRVQSVATTTPGVTKSAPEGKKTLRKGSVVITGASSGLGLATAKALAETGKWHVIMACRDFLKAERAAKSAGIAKENYTIMHLDLASLDSVRQFVDNFRRSGRPLDVLVCNAAVYLPTASEPTYTAEGFELSVGTNHLGHFLLSRLLLEDLNKSDYPSKRLIIVGSITGNTNTLAGNVPPKANLGDLRGLAGGLNGLNTSAMIDGGSFDGAKAYKDSKVCNMLTMQEFHRRYHEETGITFASLYPGCIATTGLFREHIPLFRLLFPPFQKYITKGFVSEDESGKRLAQVVSDPSLTKSGVYWSWNKASASFENQLSQEASDVDKARKVWEISEKLVGLA

SEQ ID NO: 24812 - protein, 399 aa, Populus trichocarpa
MALQAASLVSSAFVFPKEGKSNAYFKDSSLFGVSLSEHVKADFSSCALKCKREFNQGVGAVRAQTMVAATPALDRASSESKKTLGQGTCIVTGASSGLGLATAKALAETGKWHIIMACRNFLKAERAAKSAGIAKENYTIMHLDLASLDSVRQFVDTFRRSGRPLDVLVCNAAVYLPTAKEPAFTAEGFELSVGTNHLGHFLLSRLLLEDMKKSDYPSKRLIIVGSITGNTNTLAGNVPPKANLGDLRGLSGGLNGLNRSAMIDGGVFDGAKAYKDSKVCNMLTMQEFHRRLHEETGIAFASLYPGCIATTGLFREHIPLFRLLFPPFQKYITKGFVSEHEAGKRLAQVVSDPSLTKSGAYWSWNKHSASFQNQLSQEASDAEKARKVWEISEKLVGLA

SEQ ID NO: 24813 - protein, 393 aa, Triphysaria pusilla
MALQAAALLPSAFSIHKEGKCSAALKDSALFGLSLSDYVKADFTSSALITKQRQFRPQAVATSPNSTPATSQAKKTLRKGTVIITGASSGLGLATAKALSDSGKWHIIMACRDFLKAEKAAKSVGMAKDNYTVMHLDLSSLESVRQFVDNFKQAGRALDVLVCNAAVYQPTAKEPSFTADGFELSVGTNHLGHFLLSRLLLDDMKESDFPSKRLIIVGSITGNTNTLAGNIPPKANLGDLRGLQAGLNGPSSSPMIDGGDFDGAKAYKDSKVCNMLTMQEFHRRYHEETGITFASLYPGCIATTGLFREHIPLFRLLFPPFQKFITKGYVSEEEAGKRLAQVVSDPSLTKSGVYWSWNKNSASFVNQLSEEASDADKAKKVWEVSEKLCGLKD

SEQ ID NO: 24814 - protein, 395 aa, Lupinus angustifolius
MALQAASLIPTSFSVLKEGKSCVKDSSLFGLSLSDTLRADFTSSALRCKFQQKIGAVRAETAATASPAVNKSASEGKKTLRKGTVVITGASSGLGLATAKALAETGKWHVIMACRDFLKTARAAKSAGIAKENYTILHLDLSSLDSVRQFVDSFRRLELPLDVLVCNAAVYLPTAKEPRFTAEGFEISVGTNHLGHFLLARLLLDDLNKSDYPSRRLIIVGSITGNTNTLAGNVPPKANLGDLRGLAGGLNGLNSSVMIDGGDFDGAKAYKDSKVCNMLTMQEFHRRYHEETGITFASLYPGCIATTGLFREHIPLFRTLFPPFQKYITKGYVSEDEAGKRLAQVVSEPSLTKSGVYWSWNKTSASFENQLSEEASNAEKARKVWEVSEKLVGLV

SEQ ID NO: 24815 - protein, 393 aa, Papaver somniferum
MALQATSILPSSLSIHKEGKSNLSGKDFYGVSFAEFSPLVIRNKRELKSQRLSVGQIRAQTAATTPGVNQSTQGKKTLRKGNVIITGASSGLGLATAKALADTGKWHVIMACRDFLKAQRAAKSAGIDKENFTVMHLDLSSLDSVRQFVDNFKRSGKPLDVLVCNAAVYQPTAKEPSFTADGFELSVGTNHLGHFLLARLLLDDLKNSDYPSKRLIIVGSITGNTNTLAGNVPPKANLGDLRGMAGGLSGTNSSVMIDGGEFDGAKAYKDSKVCNMLTMQEFHRRYHEETGITFASLYPGCIATTGLFREHIPLFRLLFPPFQKYITKGYVSEEESGKRLAQVVGEPSLTKSGVYWSWNKTSASFENQLSEEASDVEKARKLWEVSEKLVGLA

SEQ ID NO: 24816 - protein, 395 aa, Lippia dulcis
MALQAAALPPSAFSIHKEGKASASLRESSTFLGVSFSDHVKSSSIKREFNSKKFPAIRVEAVATTPTFTPATVQGKKTLQKGTVIITGASSGLGLAAAKALAETGKWHVIMACRDFLKAEKAAKSAGMAKESYTIMHLDLASLDSVRQFVDSFKRSGQPLDVLVCNAAVYQPTAREPSFTAEGFELSVGTNHLGHFLLSRLLLDDMTKSDYPSKRLIIVGSITGNTNTLAGNVPPKANLGDLRGLQGGLNGVNISSMIDGGHFDGAKAYKDSKVCNMLTMQEFHRRYHEDTGITFASLYPGCIAETGLFREHIPLFRLLFPPFQKFITKGYVSQEEAGKRLAQVVSDPSLTKSGVYWSWNKDSSSFENKLSVEASDVEKARKVWEVSEKLVGLAD

SEQ ID NO: 24817 - protein, 396 aa, Cirsium arvense
MALQATSSSFSIHKEGKTGASLKDSSLFGASLSSHLKLDLKSSVSRNRKEFSQRGALKIQATSTITTPSVNQASTDGKKTLRKGTVVITGASSGLGLATAKALAETGKWHVIMACRDFLKAERAAKSIGMVKENYTVMHLDLASFDSVRQFVANFKQSGYPLDVLVCNAAVYFPTAKEPTFTADGFELSVGTNHLGHFLLARLLIDDLKQSDYPSKRLVIVGSITGNTNTLAGNVPPKANLGDMRGLAGGLNGLNSSAMIDGGDFDGAKAYKDSKVCNMLMMQEFHRRFHEETGITFASLYPGCIATTGLFREHIPLFRLLFPPFQQYITKGFVSEEESGKRLAQVVSDPSLTKSGVYWSWNNNSASFENQLSEEASDVAKARKVWEISEKLVGLA

SEQ ID NO: 24818 - protein, 399 aa, Vigna unguiculata
MALQAASLVPASFSVPKEGKSGVSLKDSTLFGLSLSEPVKADFSSSALRCKRESLRKIGAVRAETVATASPAVTKSAPEGKKTLRKGSVVITGASSGLGLATAKALAETGKWHIIMACRDYLKAARAAKSAGIAKENYTIMHLDLASLDSVRQFVDNFRRSEMPLDVLVCNAAVYLPTAKEPTYTAEGFELSVGTNHLGHFLLARLLLEDLQKSDYPSKRMIIVGSITGNTNTLAGNVPPKANLGDLRGLQGGLSGLNSSAMIDGGDFDGAKAYKDSKVCNMLTMQEFHRRYHEETGITFSSLYPGCIATTGLFREHIPLFRTLFPPFQKYITKGYVSEEEAGKRLAQVVSDPSLTKSGVYWSWNKTSASFENQLSQEASDAEKARRVWDISEKLVGLA

SEQ ID NO: 24819 - protein, 392 aa, Euphorbia peplus
VSSAFGLPKDGKASSTSFKDSTLFGVSFTDHLKSDFTSSDFRSKRQPNQRVGAVRAQTAATASPTVIRSTPEGKKTLRKGSVIVTGASSGLGLAAAKALAETGKWHVIMACRDFLKTERAAKSAGISKENYTIMHLDLASLDSVRQFVDNFRQSGRPLDVLVCNAAVYLPTAKEPTFTAEGFELSVGTNHLGHFLLSRLLLDDLNKSDYPSKRMIIVGSITGNTNTLAGNVPPKANLGDMRGLAGGLNGLNSSAMIDGGNFDGAKAYKDSKVCNMLTMQEYHRRFHEETGITFASLYPGCIATTGLFREHIPLFRTLFPPFQKYITKGFVSEDDAGKRLAQVVSDPSLTKSGVYWSWNKDSASFENQMSQEASDADKARKIWEVSEKLVGLA

SEQ ID NO: 24820 - protein, 394 aa, Ambrosia trifida
MALQATSFSVHSLVKTTGTLKDSTLLGVSLSDHRKVDFSSFASKSKMEFKRTKLFKTQAVVTTSTPPVTRAAPEGKKTLRKGTVIITGASSGLGLATAKALAETEKWHVIMACRDFLKAERAAKSAGISKENYTVMHLDLASLDSVRQFVANFKQSGRPLDVLVCNAAVYQPTAKEPTFTADGIELSVGTNHLGHFLLSRLLLDDMKKSDYPSKRLIIVGSITGNTNTLAGNVPPKASLGDMRGLAGGLNGLNSSTMIDGGKFDGAKAYKDSKICNMLTMQEFHRRYHEETGITFASLYPGCIATTGLFREHIPLFRLLFPPFQKFITKGYVSEEESGKRLAQVVSDPSLTKSGVYWSWNKGSASFENQLSDEASDVSKAKKVWEISEKLVGLA

SEQ ID NO: 24821 - protein, 403 aa, Eutrema parvulum
MSLQAASLVSSALSVRKDGKSNASSSFKESSFFGVSLSDQIKTEFVSSSLRCKREQNLRTKGAIIRAQAIATSTPSVTRSSLDRKKTLRKGNVVVTGASSGLGLATAKALAETGKWHVIMACRDFLKAERAAKSAGMSKDSYTVMHLDLASLDSVRQFVDNFRRAEMPLDVLVCNAAIYQPTANQPTFTAEGFELSVGTNHLGHFLLSRLLIDDLKNSDYPSKRLIIVGSITGNTNTLAGNVPPKANLGDLRGLAGGLNGLNSSAMIDGGDFNGAKAYKDSKVCNMLTMQEFHRRFHEETGITFASLYPGCIATTGLFREHIPLFRSLFPPFQKYITKGYVSEIEAGKRLAQVVNDPSLTKSGVYWSWNKTSASFENQLSQEASNVEKARRVWEVSEKLVGLA

SEQ ID NO: 24822 - protein, 401 aa, Lippia dulcis
MALQAAAFLPSSFSIHKEGKSGASLKDSGFFGVPLFGHVKSDFISSALKIKRESCLRSFPGAIRAQTAATAPTFTPSTVQGKKILRKGSVIITGASSGLGLATAKALAASGKWHVIMACRDFLKAEKAAKSAGMDKENYTIMHLDLASFESIRQFVDNFRRSTMPLDVLVCNAAVYQPTAKEPSFTAEGIELSVGTNHLGHFLLSRLLLDDMKQSDCPSKRLIIVGSITGNTNTLAGNVPPKANLGDLRGLQGGLNGPNTSSMIDGGDFDGAKAYKDSKVCNMLTMQEFHRRYHEDTGITFASLYPGCIATTGLFREHIPLFRLLFPPFQKFITKGYVSEEDAGKRLAQVVSDPSLTKSGVYWSWNKDSASFENQLSEEASDVEKARKVWEISEKLVGLSD

SEQ ID NO: 24823 - protein, 216 aa, Festuca arundinacea
MSKLQSDSLREAVTAITNGSREKNRKFVETIELQIGLKNYDPQKDKRFSGSVKLPHIPRPKMRVCMLGDAQHVEEAGKMSLDYMDVESLKKMNKNKKLVKKLAKKYHAFLASEAIIKQIPRLLGPGLNKAGKFPTLVSHQESLEAKVNETKATVKFQLKKVLCMGVAVGHLGMDEKQIFQNVQMSVNFLVSLLKKNWQNVRCLYLKSTMGKRQRLF

SEQ ID NO: 24824 - protein, 216 aa, Oryza sativa
MSKLQSDALREAISQIANDSREKQRKFVETIELQIGLKNYDPQKDKRFSGSVKLPHIPRPKMKVCMLGDAQHVEEAEKMGLDYMDVEALKKMNKNKKLVKKLAKKYHAFLASEAIIKQIPRLLGPGLNKAGKFPTLVTHQESLESKVNETKATVKFQLKKVLCMGVAVGNCAMEEKQIFQNVQMSVNFLVSLLKKNWQNVRCLYLKSTMGKVYRVF

SEQ ID NO: 24825 - protein, 216 aa, Echinochloa colona
MSKLQSEALREAIASITNDSREKQRKFVETIELQIGLKNYDPQKDKRFSGSVKLPHIPRPKMKVCMLGDAQHVEEAERIGLDSMDVEALKKMNKNKKLVKKLAKKYHAFLASEAIIKQIPRLLGPGLNKAGKFPTLVSHQESLDSKVNETKATVKFQLKKVLCMGVAVGNCGMEEKQIFQNVQMSVNFLVSLLKKNWQNVRCLYLKSTMGKVYRVF

SEQ ID NO: 24826 - protein, 216 aa, Echinochloa colona
MSKLQSEALREAIASITNDSREKQRKFVETIELQIGLKNYDPQKDKRFSGSVKLPHIPRPKMKVCMLGDAQHVEEAERICLDSMDVEALKKMNKNKKLVKKLAKKYHAFLASEAIIKQIPRLLGPGLNKAGKFPTLVSHQESLDSKVNETKATVKFQLKKVLCMGVAVGNCGMEEKQIFQNVQMSVNFLVSLLKKNWQNVRCLYLKSTMGKVYRVF

SEQ ID NO: 24827 - protein, 206 aa, Lolium multiflorum
MSKLQSDSLREAITAITNGSREKNRKFVETIELQIGLKNYDPQKDKRFSGSVKLPHIPRPKMRVCMLGDAQHVEEAGKMSLDYMDVESLKKMNKNKKLVKKLAKKYHAFLASEAIIKQIPRLLGPGLNKAGKFPTLVSHQESLEGKVNETKATVKFQLKKVLCMGVAVGHLGMDEKQIFQNVQMSVNFLVSLLKKNWQNVRCLYLK

SEQ ID NO: 24828 - protein, 216 aa, Cocos nucifera
MSKLQSDVLREAISQIANDSREKKRNFTETIELQIGLKNYDPQKDKRFSGSVKLPHIPRPKMKVCMLGDAQHVEEAEKIGLDYMDVEALKKMNKNKKLVKKLAKKYHAFLASEAIIKQIPRLLGPGLNKAGKFPTLVTHQESLESKVNETKAMVKFQLKKVLCMGVAVGNCAMEEKQIFQNVQLSVNFLVSLLKKNWQNVRCLYLKSTMGKPYRVF

SEQ ID NO: 24829 - protein, 216 aa, Cyclamen graecum
MSKLQSEALREAITQIRNDSIEKPRKFTETIELQIGLKNYDPQKDKRFSGSVKLPHIPRPKMKVCMLGDAQHVEEAEKLGLEYMDVEGLKKLNKNKKLVKKLAKKYHAFLASEAVIKQIPRLLGPGLNKAGKFPTLVSHQESLESKVNETKATVKFQLKKVLCMGVAVGNCVMEEKQIFQNVQMSVNFLVSLLKKNWQNVRCLYLKSTMGKPVRVF

SEQ ID NO: 24830 - protein, 216 aa, Mimulus guttatus
MSKLQSEALREAITQISADCKEKNRKFTETIELQIGLKNYDPQKDKRFSGSVKLPHIPRPKMKICMLGDAQHVEEATKIGLESMDVEALKKLNKNKKLVKKLAKKYHAFLASEAVIKQIPRLLGPGLNKAGKFPTLVSHQESLEAKVNETKATVKFQLKKVLCMGVAVGNLSMEEKQIFQNVQMSVNFLVSLLKKNWQNVRCLYLKSTMGKPQRVF

SEQ ID NO: 24831 - protein, 216 aa, Daucus carota
MSKLQSDAVREAITQITNDAKEKGRKFTETIELQIGLKNYDPQKDKRFSGSVKLPHIPRPKMKVCMLGDAQHVGEAEKIGLESMDVESLKKLNKNKKLVKKLAKKYHAFLASEAVIKQIPRLLGPGLNKAGKFPTLVSHQESLESKVNETKATVKFQLKKVLCMGVAVGNCSMEDKQLFQNVQMSVNFLVSLLKKNWQNVRCLYLKSTMGKPVRIF

SEQ ID NO: 24832 - protein, 216 aa, Cocos nucifera
MSKLQSDVLREAISQIANDSREKKRNFTETIELQIGLKNYDPQKDKRFSGSVKLPHIPRPKMKVCMLGDAQHVEEAEKIGLDYMDVEALKKMNKNKKLVKKLAKKYHAFLASEAIIKQIPRLLGPGLNKAGKFPTLVTHQESLEAKVNETKAMVKFQLKKVLCMGVAVGNCSMEEKQIFQNVQLSVNFLVSLLKKNWQNVRCLYLKSTMGKPYRVF

SEQ ID NO: 24833 - protein, 216 aa, Cocos nucifera
MSKLQSDVLREAISQLTNDSREKKRNFTETIELQIGLKNYDPQKDKRFSGSVKLPHIPRPKMKVCMLGDAQHVEEAEKIGLDYMDVEALKKMNKNKKLVKKLAKKYHAFLASEAIIKQIPRLLGPGLNKAGKFPTLVTHQESLEAKVNETKAMVKFQLKKVLCMGVAVGNCSMEEKQIFQNVQLSVNFLVSLLKKNWQNVRCLYLKSTMGKPYRVF

SEQ ID NO: 24834 - protein, 216 aa, Echinochloa colona
MSKLQSEVLKDAISQIVGDAKEKNRKFTETVELQIGLKNYDPQKDKRFSGSVKLPHIPRPKMKVCMLGDAQHVEEAEKMGLDCMDVEALKKMNKNKKLVKKLAKKYHAFLASEAIIKQIPRLLGPGLNKAGKFPTLVSHQESLESKVNETKATVKFQLKKVLCMGVAVGNLSMEEKQIQQNIQMSVNFLVSLLKKNWQNVRCLYIKSTMGKPYRVF

SEQ ID NO: 24835 - protein, 216 aa, Lupinus angustifolius
MSKLSSDAVREAISGIVTDSKEKNRKFVETIELQIGLKNYDPQKDKRFSGSVKLPHIPRPKMKICMLGDAQHVEEAEKIGLDYMDVEALKKLNKNKKLVKKLAKKYHAFLASEAIIKQIPRLLGPGLNKAGKFPTLVSHQESLESKVNETKAMVKFQLKKVLCMGVAVGNVSMEEKQIFQNVQLSVNFLVSLLKKNWQNVRCLYLKSTMGKSYRVF

SEQ ID NO: 24836 - protein, 216 aa, Lupinus angustifolius
MSKLSSDAVREAISGIVADSKEKNRKFVETIELQIGLKNYDPQKDKRFSGSVKLPHIPRPKMKICMLGDAQHVEEAEKIGLDYMDVEALKKLNKNKKLVKKLAKKYHAFLASEAIIKQIPRLLGPGLNKAGKFPTLVSHQESLESKVNETKAMVKFQLKKVLCMGVAVGNVSMEEKQIFQNVQLSVNFLVSLLKKNWQNVRCLYLKSTMGKSYRVF

SEQ ID NO: 24837 - protein, 216 aa, Amaranthus tuberculatus
MSKLQSDALREAISGIKNDATEKGRKFTETIELQIGLKNYDPQKDKRFSGSVKLPHIPRPKMKVCMLGDAQHVEEAERIGLEWMDVEALKKLNKNKKLVKKLAKKYHAFLASEAVIKQIPRLLGPGLNKAGKFPTLVTHQEPLENKVNETKATVKFQLKKVLCMGVAVGNCGMEEKQIFQNVQMSVNFLVSLLKKNWQNVRCLYLKSTMGKPYRIF

SEQ ID NO: 24838 - protein, 216 aa, Panax ginseng
MSKLQSEALREAISQITNESKEKKRNFTETIELQIGLKNYDPQKDKRFSGSVKLPHIPRPKMKVCMLGDAQHVEEAEKIGLEYMDVEGLKKLNKNKKLVKKLAKKYHAFLASEAVIKQIPRLLGPGLNKAGKFPTLVTHQESLESKVNETKATVKFQLKKVLCMGVAVGNLSMEEKQIFQNVQMSVNFLVSLLKKNWQNVRCLYLKSTMGKTVRVF

SEQ ID NO: 24839 - protein, 216 aa, Panax ginseng
MSKLQSEALREAISQITNESKEKKRNFTETIELQIGLKNYDPQKDKRFSGSVKLPHIPRPKMKVCMLGDAQHVEEAEKIGLEYMDVEGLKKLNKNKKLVKKLAKKYHAFLASEAVIKQIPRLLGPGLNKAGKFPTLVTHQESLESKVNETKATVKFQLKKVLCMGVAVGNLSMEEKQIFQNVQMSVNFLVSLLKKNWQNVRCLYLKSTMGKTVRIF

SEQ ID NO: 24840 - protein, 216 aa, Ananas comosus
MSKLQSDVLKEAISQVMGDSREKKRKFTETIELQIGLKNYDPQKDKRFSGSVKLPHIPRPKMKVCMLGDAQHVEEAEKIGLDYMDVEGLKKMNKNKKLVKKLAKKYHAFLASEAIIKQIPRLLGPGLNKAGKFPTLVTHQESLESKVNETKATVKFQLKKVLCMGVAVGNCAMEEKQIQQNVQLSVNFLVSLLKKNWQNVRCLYLKSTMGKPYRVF

SEQ ID NO: 24841 - protein, 216 aa, Musa acuminata
MSKLQSDVLREAISQVVGDSREKKRKFTETVELQIGLKNYDPQKDKRFSGSVKLPHIPRPKMKVCMLGDAQHVEEAEKIGLDYMDVEGLKKMNKNKKLVKKLAKKYHAFLASEAIIKQIPRLLGPGLNKAGKFPTLVTHQESLESKVNETKAMVKFQLKKVLCMGVAVGNCAMEEKQIFQNVQLSVNFLVSLLKKNWQNVRCLYLKSTMGKPYRVF

SEQ ID NO: 24842 - protein, 216 aa, Musa acuminata
MSKLQSDVLREAISQVVGDSREKKRKFTETVELQIGLKNYDPQKDKRFSGSVKLPHIPRPKMKVCMLGDAQHVEEAEKIGLDYMDVESLKKMNKNKKLVKKLAKKHHAFLASEAIIKQIPRLLGPGLNKAGKFPTLVTHQESLESKVNETKAMVKFQLKKVLCMGVAVGNCAMEEKQIFQNVQLSVNFLVSLLKKNWQNVRCLYLKSTMGKPYRVF

SEQ ID NO: 24843 - protein, 216 aa, Olea europaea
MSKLQSEALREAISVIVTDSKEKKRNFTETIELQIGLKNYDPQKDKRFSGSVKLPHIPRPKMKICMLGDAQHVEEAEKIGLESMDVEALKKLNKNKKLVKKLAKKYHAFLASEAVIKQIPRLLGPGLNKAGKFPTLVSHQESLESKVNETKATVKFQLKKVLCMGVAVGNLGMEEKQIFQNVQMSVNFLVSLLKKNWQNVRCLYLKSTMGKPQRIF

SEQ ID NO: 24844 - protein, 216 aa, Rosmarinus officinalis
MSKLQSDALREAISQIKNDAAVKKRNFTETVELQIGLKNYDPQKDKRFSGSVKLPHIPRPKMKVCMLGDAQHVEEAEKIGLEYMDVESLKKLNKNKKLVKKLAKKYHAFLASEAVIKQIPRLLGPGLNKAGKFPTLVTHQESLESKVNETKATVKFQLKKVLCMGVAVGNCAMEEKQIFQNVQMSVNFLVSLLKKNWQNVRCLYLKSTMGKPQRIF

SEQ ID NO: 24845 - protein, 216 aa, Vaccinium corymbosum
MSKLQSDALREAITQIAKDAREKKRNFTESIELQIGLKNYDPQKDKRFSGSVKLPHIPRPRMKVCMLGDAQHVEEAEKIGLEYMDVEGLKKLNKNKKLVKKLAKKYHAFLASEAVIKQIPRLLGPGLNKAGKFPTLVSHQESLESKVNETKATVKFQLKKVLCMGVAVGNCSMEEKQMFQNVQMSVNFLVSLLKKNWQNVRCLYLKSTMGKRVRIF

SEQ ID NO: 24846 - protein, 216 aa, Vaccinium corymbosum
MSKLQSEVLREAITQIGNDVKEKKRNFTETIELQIGLKNYDPQKDKRFSGSVKLPHIPRPKMKVCMLGDAQHVEEAEKIGLEYMDVEGLKKLNKNKKLVKKLAKKYHAFLASEAVIKQIPRLLGPGLNKAGKFPTLVSHQESLESKVNETKATVKFQLKKVLCMGVAVGNCSMEDKQIFQNVQMSVNFLVSLLKKNWQNVRCLYLKSTMGKPIRIF

SEQ ID NO: 24847 - protein, 216 aa, Lupinus angustifolius
MSKLSSDAVREAISGIVTDSKENNRKFVETIELQIGLKNYDPQKDKRFSGSVKLPHIPRPKMKICMLGDAQHVEEAEKIGLDYMDVEALKKLNKNKKLVKKLAKKYHAFLASEAVIKQIPRLLGPGLNKAGKFPTLVSHQESLESKVNETKAMVKFQLKKVLCMGVAVGNVSMEEKQIFQNVQLSVNFLVSLLKKNWQNVRCLYLKSTMGKSYRVF

SEQ ID NO: 24848 - protein, 216 aa, Ananas comosus
MSKLQSDVLKEAISQVMGDSREKKRKFTETIELQIGLKNYDPQKDKRFSGSVKLPHIPRPKMKVCMLGDAQHVEEAEKIGLDYMDVEGLKKMNKNKKLVKKLAKKYHAFLASEAIIKQIPRLLGPGLNKAGKFPTLVTHQESLESKVNETKATVKFQLKKVLCIGVAVGNCAMEEKQIQQNVQLSVNFLVSLLKKNWQNVRCLYLKSTMGKPYRVF

SEQ ID NO: 24849 - protein, 216 aa, Nuphar advena
MSKLQSDALREAITQVVGESRDKKRKFTETIELQIGLKNYDPQKDKRFSGSVKLPHIPRPKMKVCMLGDAQHVEEAEKIGLDYMDVEGLKKMNKNKKLVKKLAKKYHAFLASEAIIKQIPRLLGPGLNKAGKFPTLVSHQESLESKVNETKAMVKFQLKKVLCMGVAVGNCAMEDKQIFQNVQLSVNFLVSLLKKNWQNVRCLYLKSTMGRAIRVF

SEQ ID NO: 24850 - protein, 216 aa, Rosmarinus officinalis
MSKLQSDALREAISQIKNDAAVKKRNFTETIELQIGLKNYDPQKDKRFSGSVRLPHIPRPKMKVCMLGDAQHVEEAEKIGLEYMDVEGLKKLNKNKKLVKKLAKKYHAFLASEAVIKQIPRLLGPGLNKAGKFPTLVTHQESLESKVNETKATVKFQLKKVLCMGVAVGNCAMEEKQIFQNVQMSVNFLVSLLKKNWQNVRCLYLKSTMGKPQRIF

SEQ ID NO: 24851 - protein, 216 aa, Spinacia oleracea
MSKLQSEAVREAITGIANDAKEKNRKFTETIELQIGLKNYDPQKDKRFSGSVKLPHIPRPKMKVCMLGDAQHVEEAERIGLQWMDVEALKKLNKNKKLVKKLAKKYHAFLASEAVIKQIPRLLGPGLNKAGKFPTLVTHQEPLENKVNEIKATVKFQLKKVLCMGVAVGNLSMEEKQIFQNVQMSVNFLVSLLKKNWQNVRCLYLKSSMGKPYRIF

SEQ ID NO: 24852 - protein, 216 aa, Spinacia oleracea
MSKLQSEAVREAISGIANDSKEKNRKFTETIELQIGLKNYDPQKDKRFSGSVKLPHIPRPKMKVCMLGDAQHVEEAERIGLQWMDVEALKKLNKNKKLVKKLAKKYHAFLASEAVIKQIPRLLGPGLNKAGKFPTLVTHQEPLENKVNEIKATVKFQLKKVLCMGVAVGNLSMEEKQIFQNVQMSVNFLVSLLKKNWQNVRCLYLKSTMGKPYRIF

SEQ ID NO: 24853 - protein, 216 aa, Daucus carota
MSKLQSEALREAIAQIVKEAVEKKRNFTETIELQIGLKNYDPQKDKRFSGSVKLPHIPRPKMKVCMLGDAQHVGEAEKIGLESMDVEGLKKLNKNKKLVKKLAKKYHAFLASEAVIKQIPRLLGPGLNKAGKFPTLVSHQESLESKVNETKATVKFQLKKVLCMGVAVGNLSMEEKQIFQNVQMSVNFLVSLLKKNWQNVRCLYLKSTMGKTVRIF

SEQ ID NO: 24854 - protein, 216 aa, Cocos nucifera
MSKLQGDVLREAISQIMNDTSEKKRNFTETIELQIGLKNYDPQKDKRFSGSVKLPHIPRPKMKVCMLGDAQHVEEAEKIGLDYMDVEGLKKMNKNKKLVKKLAKKYHAFLASEAIIKQIPRLLGPGLNKAGKFPTLVTHQESLEAKVNETKAMVKFQLKKVLCMGVAVGNCAMEEKQVFQNVQLSVNFLVSLLKKNWQNVRCLYLKSTMGKPYRVF

SEQ ID NO: 24855 - protein, 216 aa, Cyclamen graecum
MSKLQSEAVREAISQISGEAKDKKRNFVETIELQIGLKNYDPQKDKRFSGSVKLPHIPRPKMKVCMLGDAQHVEEAEKIGLDYMDVEGLKKLNKNKKLVKKLAKKYHAFLASEAVIKQIPRLLGPGLNKAGKFPTLVSHQESLESKVNETKATVKFQLKKVLCMGVAVGNCGMEEKQIFQNVQMSVNFLVSLLKKNWQNVRCLYLKSTMGRPVRVF

SEQ ID NO: 24856 - protein, 216 aa, Cyclamen graecum
  Sequence also found in Organisms: Ananas comosus
MSKLQSDAVREAISQISGEAKDKKRNFVETIELQIGLKNYDPQKDKRFSGSVKLPHIPRPKMKVCMLGDAQHVEEAEKIGLDYMDVEGLKKLNKNKKLVKKLAKKYHAFLASEAVIKQIPRLLGPGLNKAGKFPTLVSHQESLESKVNETKATVKFQLKKVLCMGVAVGNCGMEDKQIFQNVQMSVNFLVSLLKKNWQNVRCLYLKSTMGRPVRVF

SEQ ID NO: 24857 - protein, 216 aa, Echinochloa colona
MSKLQTEVLKDAISQVVSEAKEKNRKFTETIELQIGLKNYDPQKDKRFSGSVKLPHIPRPKMKVCMLGDAQHVEEAEKMGLDCMDVEALKKMNKNKKLVKKLAKKYHAFLASEAIIKQIPRLLGPGLNKAGKFPTLVTHQESLESKVNETKATVKFQLKKVLCMGVAVGNLSMEEKQIQQNIQMSVNFLVSLLKKNWQNVRCLYIKSTMGKPYRVF

SEQ ID NO: 24858 - protein, 216 aa, Lupinus angustifolius
MSKLQSEALREAISQIVTNSKEKNRKFTETIELQIGLKNYDPQKDKRFSGSVKLPHIPRPKMRICMLGDAQHVEEAEKIGLDYMDVEALKKLNKNKKLVKKLAKKYHAFLASEAIIKQIPRLLGPGLNKAGKFPTLVSHQESLESKVNETKAMVKFQLKKVLCMGVAVGNCAMEEKQIFQNVQLSVNFLVSLLKKNWQNVRCLYVKSTMGSAVRVF

SEQ ID NO: 24859 - protein, 216 aa, Olea europaea
MSKLQSEALREAISVITTDVKEKKRNFVETIELQIGLKNYDPQKDKRFSGSVKLPHIPRPKMKICMLGDAQHVEEAEKIGLESMDVEALKKLNKNKKLVKKLAKRYHAFLASEAVIKQIPRLLGPGLNKAGKFPTLVSHQESLESKVNEAKATVKFQLKKVLCMGVAVGNCAMEEKQIFQNVQMSVNFLVSLLKKNWQNVRCLYLKSTMGKPQRIF

SEQ ID NO: 24860 - protein, 216 aa, Petroselinum crispum
MSKLQSEALREAIAQIVKEAGEKKRNFTETIELQIGLKNYDPQKDKRFSGSVKLPHIPRPKMKVCMLGDAQHVGEAEKIGLESMDVEGLKKLNKNKKLVKKLAKKYHAFLASEAVIKQIPRLLGPGLNKAGKFPTLVSHQESLESKVNETKATVKFQLKKVLCMGVAVGNLSMEEKQIFQNVQMSVNFLVSLLKKNWQNVRCLYLKSTMGKTVRIF

SEQ ID NO: 24861 - protein, 216 aa, Sesamum indicum
MSKLQSDALREAISVIAADSKEKKRNFTETVELQIGLKNYDPQKDKRFSGSVKLPHIPRPKMKICMLGDAQHVEEAEKIGLESMDVEALKKLNKNKKLVKKLAKKYHAFLASEAVIKQIPRLLGPGLNKAGKFPTLVTHQESLESKVNETKATVKFQLKKVLCMGVAVGNLDMEEKQIFQNVQMSVNFLVSLLKKNWQNVRCLYLKSTMGKPQRIF

SEQ ID NO: 24862 - protein, 216 aa, Oryza sativa
MSKLQTEALKEAISQVVADCKEKNRKFTETVELQIGLKNYDPQKDKRFSGSVKLSHIPRPKMKVCMLGDAQHVEEAEKIGLDYMDVEALKKMNKNKKLVKKLAKKYHAFLASEAIIKQIPRLLGPGLNKAGKFPTLVTHQESLESKVNETKATVKFQLKKVLCMGVAVGNLSMEEKQIQQNIQMSVNFLVSLLKKNWQNVRCLYIKSTMGKPYRVF

SEQ ID NO: 24863 - protein, 216 aa, Trifolium pratense
MSKLQSDAVREAITSIVGACKEKNRNFVETIELQIGLKNYDPQKDKRFSGSVKLPHIPRPKMKICMLGDAQHVEEAEKIGLESMDVEALKKLNKNKKLVKKLAKKYHAFLASEAVIKQIPRLLGPGLNKAGKFPTLVSHQESLEAKVNETKAMVKFQLKKVLCMGVAVGIVSMDEKQIFQNVQLSVNFLVSLLKKNWQNVRCLYLKSSMGKSYRVF

SEQ ID NO: 24864 - protein, 216 aa, Trifolium pratense
MSKLQSDAVREAITGIMTDSKDKNRKFVETIELQIGLKNYDPQKDKRFSGSVKLPHIPRPKMKICMLGDAQHVEEAEKIGLESMDVEALKKLNKNKKLVKKLAKKYHAFLASEAVIKQIPRLLGPGLNKAGKFPTLVSHQESLEAKVNETKAMVKFQLKKVLCMGVAVGNVSMDEKQIFQNVQLSVNFLVSLLKKNWQNVRCLYLKSSMGKSYRVF

SEQ ID NO: 24865 - protein, 216 aa, Cyclamen graecum
MSKLQSEAVREAISQISGEAKDKKRNFVETIELQIGLKNYDPQKDKRFSGSVKLPHIPRPKMKVCMLGDAQHVEEAEKIGLDYMDVEGLKKLNKNKKLVKKLAKKYHAFLASEAVIKQIPRLLGPGLNKAGKFPTLVSHQESLESKVNETKATVKFQLKKVLCMGVAVGNCGMEDKQIFQNVQMSVNFLVSLLKKNWQNVRCLYLKSTMGRPVRVF

SEQ ID NO: 24866 - protein, 216 aa, Chenopodium quinoa
MSKLQSEAVREAISGIANDAKEKNRKFTETVELQIGLKNYDPQKDKRFSGSVKLPHIPRPKMKVCMLGDAQHVEEAERIGLEWMDVEALKKLNKNKKLVKKLAKKYHAFLASEAVIKQIPRLLGPGLNKAGKFPTLVTHQEPLENKVNEIKATVKFQLKKVLCMGVAVGNLSMEEKQIFQNVQMSVNFLVSLLKKNWQNVRCLYLKSTMGKPYRIF

SEQ ID NO: 24867 - protein, 216 aa, Chenopodium quinoa
MSKLQSEAVREAISGIANDAKEKNRKFTETVELQIGLKNYDPQKDKRFSGSVKLPHIPRPKMKVCMLGDAQHVEEAARIGLEWMDVEALKKLNKNKKLVKKLAKKYHAFLASEAVIKQIPRLLGPGLNKAGKFPTLVTHQEPLENKVNEIKATVKFQLKKVLCMGVAVGNLSMEEKQIFQNVQMSVNFLVSLLKKNWQNVRCLYLKSTMGKPYRIF

SEQ ID NO: 24868 - protein, 216 aa, Vicia sativa
MSKLSSEAVREAITGIMADSKEKNRKFVETIELQIGLKNYDPQKDKRFSGSVKLPHIPRPKMRICMLGDAQHVEEAEKIGLDSMDVEALKKLNKNKKLVKKLAKKHHAFLASEAVIKQIPRLLGPGLNKAGKFPTLVSHQESLEAKVNETKAMVKFQLKKVLCMGVAVGNVSMDEKQIFQNVQLSVNFLVSLLKKNWQNVRCLYLKSSMGKSYRVF

SEQ ID NO: 24869 - protein, 216 aa, Pseudoroegneria spicata
MSKLQSDAVKDAITQIAGEAREKKRKFTETVELQIGLKNYDPQKDKRFSGSVKLPHIPRPKMRVCMLGDAQHVDQAEKMGLDYMYVESLKKMNKNKKLVKKLAKKYHAFLASEAIIKQIPRLLGPGLNKAGKFPTLVSHQESLEAKVNETKATVKFQLKKVLCMGVAVGNLSMDEKQIQQNIQMSVNFLVSLLKKNWQNVRCLYVKSTMGKRVRVF

SEQ ID NO: 24870 - protein, 216 aa, Eutrema parvulum
MSKLQSEALREAITTVKSKSEDKKRNFVETVELQIGLKNYDPQKDKRFSGSVKLPHIPRPKMKICMLGDAQHVEEAEKMGLDYMDVEALKKLNKNKKLVKKLAKKYHAFLASESVIKQIPRLLGPGLNKAGKFPTLVSHQESLESKVNETKATVKFQLKKVLCMGVAVGNLSMEEKQIFQNVQMSVNFLVSLLKKNWQNVRCLYLKSTMGPPQRIF

SEQ ID NO: 24871 - protein, 217 aa, Raphanus sativus
MSKLQSEAVREAISSIITHCKETKPRKFTETIELQIGLKNYDPQKDKRFSGSVKLPHIPRPNMKICMLGDAQHVEEAEKIGLDSMDVEALKKLNKNKKLVKKLAKKFHAFLASESVIKQIPRLLGPGLNKAGKFPTLVSHQESLESKVNETKATVKFQLKKVLCMGVAVGNLGMEEKQIFQNVQMSVNFLVSLLKKNWQNVRCLYLKSTMGPPNRVF

SEQ ID NO: 24872 - protein, 216 aa, Brassica juncea
MSKLQSEALREAITTIKGKSEDKKRNFVETIELQIGLKNYDPQKDKRFSGSVKLPHIPRPKMKVCMLGDAQHVEEAEKMGLDSMDVEALKKLNKNKKLVKKLAKKYHAFLASESVIKQIPRLLGPGLNKAGKFPTLVSHQESLEGKVNETKATVKFQLKKVLCMGVAVGNLSMEEKQLFQNVQMSINFLVSLLKKNWQNVRCLYLKSTMSPPTRVF

SEQ ID NO: 24873 - protein, 216 aa, Trifolium pratense
MSKLQSDAVREAITSIVGACKEKNRNFVETIELQIGLKNYDPQKDKRFSGSVKLPHIPRPKMKICMLGDAQHVEEAEKIGLDSMDVEALKKLNKNKKLVKKLAKKYHSFLASEAVIKQIPRLLGPGLNKAGKFPTLVSHQESLEAKVNETKAMVKFQLKKVLCMGVAVGNVSMDEKQIFQNVQLSVNFLVSLLKKNWQNVRCLYLKSSMGKSHRVF

SEQ ID NO: 24874 - protein, 216 aa, Echinochloa colona
MSKLQTEVLKDAISQVVSEAKEKNRKFTETIELQIGLKNYDPQKDKRFSGSVKLPHIPRPKMKVCMLGDAQHVEEAEKIGLDCMDVEALKKMNKNKKLVKRLAKKYHAFLASEAIIKQIPRLLGPGLNKAGKFPTLVSHQESLESKVNETKATVKFQLKKVLCMGVAVGNLSMEEKQIQQNIQMSVNFLVSLLKKNWQNVRCLYIKSTMGKPNRVF

SEQ ID NO: 24875 - protein, 216 aa, Amaranthus tuberculatus
MSKLQSEAVREAITGIKTDSAEKGRKFTETIELQIGLKNYDPQKDKRFSGSVKLPHIPRPKMKVCMLGDAQHVEEAERIGLEWMDVEALKKLNKNKKLVKKLAKKYHAFLASEAVIKQIPRLLGPGLNKAGKFPTLVTHQEPLENKVNEIKATVKFQLKKVLCMGVAVGNCGMEEKQVFQNVQMSVNFLVSLLKKNWQNVRCLYLKSTMGKPYRIF

SEQ ID NO: 24876 - protein, 221 aa, Nicotiana benthamiana
LILFLYSKLQSDALREAISVIKNDCAEKKRKFTETIELQIGLKNYDPQKDKRFSGSVKLPHIPRPKMKICMLGDAQHVEEAEKIGLEYMDVESLKKLNKNKKLVKKLAKKYHAFLASESVIKQIPRLLGPGLNKAGKFPSLVSHQESLESKVNETKATIKFQLKKVLCMGVAVGNLDMEEKQIFQNVQMSVNFLVSLLKKNWQNVRCLYLKSTMGKPHRVF

SEQ ID NO: 24877 - protein, 221 aa, Nicotiana benthamiana
FNTILYSKLQSDALREAISVIKNDCAEKKRKFTETIELQIGLKNYDPQKDKRFSGSVKLPHIPRPKMKICMLGDAQHVEEAEKIGLEYMDVESLKKLNKNKKLVKKLAKKYHAFLASESVIKQIPRLLGPGLNKAGKFPSLVSHQESLESKVNETKATIKFQLKKVLCMGVAVGNLDMEEKQIFQNVQMSVNFLVSLLKKNWQNVRCLYLKSTMGKPQRIF

SEQ ID NO: 24878 - protein, 217 aa, Brassica juncea
MSKLQSEAVREAISTIITHCKETKPRKFTETIELQIGLKNYDPQKDKRFSGSVKLPHIPRPKMKICMLGDAQHVEEAEKIGLESMDVEALKKLNKNKKLVKKLAKKFHAFLASESVIKQIPRLLGPGLNKAGKFPTLVSHQESLESKVNETKATVKFQLKKVLCMGVAVGNLGMEEKQIFQNVQMSVNFLVSLLKKNWQNVRCLYLKSTMSPPNRVF

SEQ ID NO: 24879 - protein, 216 aa, Trifolium pratense
MSKLQSDAVREAITSIVGACKEKNRNFVETIELQIGLKNYDPQKDKRFSGSVKLPHIPRPKMKICMLGDAQHVEEAEKIGLDSMDVEALKKLNKNKKLVKKLAKKYHSFLASEVVIKQIPRLLGPGLNKAGKFPTLVSHQESLEAKVNETKAMVKFQLKKVLCMGVAVGNVSMDEKQIFQNVQLSVNFLVSLLKKNWQNVRCLYLKSSMGKSHRVF

SEQ ID NO: 24880 - protein, 216 aa, Trifolium pratense
MSKLQSDAVREAITGIMGASKDKGRKFVETIELQIGLKNYDPQKDKRFSGSVKLPHIPRPKMKICMLGDAQHVEEAEKIGLESMDVEALKKLNKNKKLVKKLAKKYHAFLASEAVIKQIPRLLGPGLNKAGKFPTLVSHQESLEAKVNETKAMVKFQLKKVLCMGVAVGNVSMDEKQIFQNVQLSVNFLVSLLKKNWQNVRCLYLKSSMGKSYRVF

SEQ ID NO: 24881 - protein, 216 aa, Trifolium pratense
MSKLQSEAVREAISGIMTDSKDKNRKFVETIELQIGLKNYDPQKDKRFSGSVKLPHIPRPKMKICMLGDAQHVEEAEKIGLESMDVEALKKLNKNKKLVKKLAKKYHAFLASEAVIKQIPRLLGPGLNKAGKFPTLVSHQESLEGKVNETKAMVKFQLKKVLCMGVAVGNVSMDEKQIFQNVQLSVNFLVSLLKKNWQNVRCLYLKSSMGKSYRVF

SEQ ID NO: 24882 - protein, 216 aa, Trifolium pratense
MSKLQSDAVREAITSIVGACKEKNRNFVETIELQIGLKNYDSQKDKRFSGSVKLPHIPRPKMKICMLGDAQHVEEAEKIGLESMDVEALKKLNKNKKLVKKLAKKYQAFLASEAVIKQIPRLLGPGLNKAGKFPTLVSHQESLEGKVNETKAMVKFQLKKVLCMGVAVGNVSMDEKQIFQNVQLSVNFLVSLLKKNWQNVRCLYLKSSMGKSYRVF

SEQ ID NO: 24883 - protein, 216 aa, Echinochloa colona
MSKLQTEVLKDAISQVVSEAKEKNRKFTETIELQIGLKNYDPQKDKRFSGSVKLPHIPRPKMKVCMLGDAQHVEEAEKIGLDCMDVEALKKMNKNKKLVKRLAKKYHAFLASEAIIKQIPRLLGPGLNKAGKFPTLVTHQESLESKVNETKATVKFQLKKVLCMGVAVGNLSMEEKQIQQNIQMSVNFLVSLLKKNWQNVRCLYIKSTMGKPNRVF

SEQ ID NO: 24884 - protein, 216 aa, Festuca arundinacea
MSKLSSDAVKEAIALIVGEAREKKRKFTETVELQIGLKNYDPQKDKRFSGSVKLPHIPRPKMRVCMLGDAQHVDQAEKLGLDSMDVESLKKMNKNKKLVKKLAKKYHAFLASEAIIKQIPRLLGPGLNKAGKFPTLVSHSESLEAKVNETKATVKFQLKKVLCMGVAVGNLSMDEKQIQQNLQMSVNFLVSLLKKNWQNVRCLYVKSTMGKRQRVF

SEQ ID NO: 24885 - protein, 216 aa, Panax ginseng
MSKLQSDAVREAITQIGKEAKENNRKFTETIELQIGLKNYDPQKDKRFSGSVKLPNIPRPKMKVCMLGDAQHVEEAERIGLEYMDVEGLKKLNKNKKLVKKLAKKYHAFLASEAVIKQIPRLLGPGLNKAGKFPTLVTHQESLELKVNETKATVKFQLKKVLCMGVAVGNCSMEDKQIFQNVQMSVNFLVSLLKKNWQNVRCLYLKSTMGKPIRVF

SEQ ID NO: 24886 - protein, 216 aa, Allium cepa
MSKLQSDVLREAITQIKTGATEKKRNFTETIELQIGLKNYDPQKDKRFSGSVKLPHIPRPKMKVCMLGDAQHCEEAEKMDLPFMDVESLKKFNKNKKLVKKMAKKYHVFLASEAIIKQIPRLLGPGLNKAGKFPTLVSHQESLEAKVNETKAMVKFQLKKVLCMGVAVGNCGMDEKQIFQNVQLSVNFLVSLLKKNWQNVRCLYLKSTMGKPVRVF

SEQ ID NO: 24887 - protein, 216 aa, Petroselinum crispum
MSKLQSEAVKETITQITTDSKEKSRKFTETIELQIGLKNYDPQKDKRFSGSVRLPHISRPKMKVCMLGDAQHVGEAEKIGLEYMDVEGLKKLNKNKKLVKKLAKKYHAFLASEAVIKQIPRLLGPGLNKAGKFPTLVSHQESLESKVNETKATVKFQLKKVLCMGVAVGNCSMEEKQIFQNVQMSVNFLVSLLKKNWQNVRCLYLKTTMGKPVRIF

SEQ ID NO: 24888 - protein, 216 aa, Vicia sativa
MSKLQSEAVREAITGIMGDSKDKGRKFVETIELQIGLKNYDPQKDKRFSGSVKLPHIPRPKMKICMLGDAQHVEEAEKIGLESMDVEALKKLNKNKKLVKKLAKKYHAFLASEAVIKQIPRLLGPGLNKAGKFPTLVSHQESLEAKVNETKAMVKFQLKKVLCMGVAVGNVSMDEKQIFQNVQLSVNFLVSLLKKNWQNVRCLYLKSSMGKSYRVF

SEQ ID NO: 24889 - protein, 217 aa, Brassica juncea
MSKLQSEAVREAISAMITHCKETKPRKFTETIELQIGLKNYDPQKDKRFSGSVKLPHIPRPKMKICMLGDAQHVEEAEKIGLESMDVEALKKLNKNKKLVKKLAKKFHAFLASESVIKQIPRLLGPGLNKAGKFPTLVSHQESLESKVNETKATVKFQLKKVLCMGVAVGNLDMEEKQIFQNVQMSVNFLVSLLKKNWQNVRCLYLKSTMGPPNRVF

SEQ ID NO: 24890 - protein, 217 aa, Chrysanthemum coronarium
MSKLSSDALREAITQITTDAKEKKVRNFVETIELQIGLKNYDPQKDKRFSGTVRLPHIPRPKLKVCMLGDAQHVEEAQKIGLEYMDVESLKKLNKNKKLVKKLAKKHQAFLASESVIKQIPRLLGPGLNKAGKFPTLVSHQESLEAKVNETKATVKFQLKKVLCMGVAVGNCSMEEKQIFQNVQMSVNFLVSLLKKNWQNVRCLYLKTTMGKPVRIF

SEQ ID NO: 24891 - protein, 216 aa, Trifolium pratense
MSKLQSEAVREAISGIMTDSKDKNRKFVETIELQIGLKNYDPQKDKRFSGSVKLPHIPRPKMKICMLGDAQHVEEAEKIGLDSMDVEALKKLNKNKKLVKKLAKKYHSFLASEAVIKQIPRLLGPGLNKAGKFPTLVSHQESLEAKVNETKAMVKFQLKKVLCMGVAVGNVSMDEKQIFQNVQLSVNFLVSLLKKNWQNVRCLYLKSSMGKSHRVF

SEQ ID NO: 24892 - protein, 216 aa, Festuca arundinacea
MSKLSTEALKEAITQVVTDAKEKNRKFTETIELQIGLKNYDPQKDKRFSGSVKLPHVPRPKMRVCMLGDAQHVGEAEKIGLDSMDVEALKKMNKNKKLVKRLAKKYHAFLASEAIIKQIPRLLGPGLNKAGKFPTLVSHSESLEAKVNETKATIKFQLKKVLCMGVAVGNLSMEEKQIQQNIQMSVNFLVSLLKKNWQNVRCLYIKSTMGKPARVF

SEQ ID NO: 24893 - protein, 193 aa, Lolium multiflorum
EAITAITNGSREKNRKFVETIELQIGLKNYDPQKDKRFSGSVKLPHIPRPKMRVCMLGDAQHVEEAGKMGLDYMDVESLKKMNKNKKLVKKLAKKYHAFLASEAIIKQIPRLLGPGLNKAGKFPTLVSHQESLEAKVNETKATVKFQLKKVLCMGVAVGHLGMDEKQIFQNVQMSVNFLVSLLKKNWQNVRCL

SEQ ID NO: 24894 - protein, 216 aa, Lolium multiflorum
MSKLSSDAVKEAIALIVGEAREKKRKFTETVELQIGLKNYDPQKDKRFSGSVKLPHIPRPKMRVCMLGDASHVDQAEKLGLDSMDVESLKKMNKNKKLVKKLAKKYHAFLASEAIIKQIPRLLGPGLNKAGKFPTLVSHSESLEAKVNETKATIKFQLKKVLCMGVAVGNLSMEEKQIQQNIQMSVNFLVSLLKKNWQNVRCLYIKSTMGKPARVF

SEQ ID NO: 24895 - protein, 216 aa, Vicia sativa
MSKLQSEAVREAVTGIMGDSKDKGRKFVETIELQIGLKNYDPQKDKRFSGSVKLPHIPRPKMKICMLGDAQHVEEAEKIGLESMDVEALKKLNKNKKLVKKLAKKYHAFLASEAVIKQIPRLLGPGLNKAGKFPTLVSHQESLEAKVNETKAMVKFQLKKVLCMGVAVGNVSMDEKQIFQNVQLSVNFLVSLLKKNWQNVRCLYLKSSMGKSYRVF

SEQ ID NO: 24896 - protein, 217 aa, Brassica juncea
MSKLQSEAVREAISAMITHCKETKPRKFTETIELQIGLKNYDPQKDKRFSGSVKLPHIPRPKMKICMLGDAQHVEEAEKIGLESMDVEALKKLNKNKKLVKKLAKKFHAFLASESVIKQIPRLLGPGLNKAGKFPTLVSHQESLEAKVNETKATVKFQLKKVLCMGVAVGNLGMEEKQIFQNVQMSVNFLVSLLKKNWQNVRCLYLKSTMGPPNRVF

SEQ ID NO: 24897 - protein, 217 aa, Brassica juncea
MSKLQSEAVREAISAMITHCKETKPRKFTETIELQIGLKNYDPQKDKRFSGSVKLPHIPRPKMKICMLGDAQHVEEAEKIGLESMDVEALKKLNKNKKLVKKLAKKFHAFLASESVIKQIPRLLGPGLNKAGKFPTLVSHQESLESKVNETKATVKFQLKKVLCMGVAVGNLGMEEKQIFQNVQMSVNFLVSLLKKNWQNVRCLYLKSTMSPPTRVF

SEQ ID NO: 24898 - protein, 221 aa, Nicotiana benthamiana
NYLNNYSKLQSDALREAITVIKSASNEKKRKFTETIELQIGLKNYDPQKDKRFSGSVKLPHIPRPKMKICMLGDAQHVEEAEKIGLEYMDVESLKKLNKNKKLVKKLAKKYHAFLASEAVIKQIPRLLGPGLNKAGKFPSLVSHQESLESKVNETKATIKFQLKKVLCMGVAVGNMDMEEKQIFQNVQMSVNFLVSLLKKNWQNVRCLYLKSTMGKTQRIF

SEQ ID NO: 24899 - protein, 216 aa, Rosmarinus officinalis
MSKLQSEALREAITVIVSDAKEKKRNFTETVELQIGLKNYDPQKDKRFSGSVRLPHIPRPKMKICMLGDAQHVEEAEKIGLESMDVEALKKLNKNKKLVKKLAKRYHAFLASEAVIKQIPRLLGPGLNKAGKFPTLVTHQESLEAKVNETKATIKFQLKKVLCMGVAVGNLDMEEKQIFQNVQMSVNFLVSLLKKNWQNVRCLFLKSTMGKPQRIF

SEQ ID NO: 24900 - protein, 216 aa, Trifolium pratense
MSKLQSDAVREAITGIMGASKDKERKFVETIELQIGLKNYDPQKDKRFSGSVKLPHIPRPKMKICMLGDAQHVEEAEKIGLESMDVEALKKLNKNKKLVKKLAKRYQAFLASEAVIKQIPRLLGPGLNKAGKFPTLVSHQESLEAKVNETKAMVKFQLKKVLCMGVAVGNVSMDEKQIFQNVQLSVNFLVSLLKKNWQNVRCLYLKSSMGKSYRVF

SEQ ID NO: 24901 - protein, 216 aa, Festuca arundinacea
MSKLSSGAVKEAIALIVGEAREKKRKFTETVELQIGLKNYDPQKDKRFSGSVKLPHIPRPKMRVCMLGDASHVDQAEKLGLDSMDVESLKKMNKNKKLVKKLAKKYHAFLASEAIIKQIPRLLGPGLNKAGKFPTLVSHSESLEAKVNETKATVKFQLKKVLCMGVAVGNLSMDEKQIQQNLQMSVNFLVSLLKKNWQNVRCLYVKSTMGKRQRVF

SEQ ID NO: 24902 - protein, 216 aa, Lolium multiflorum
MSKLSSDAVKEAIALIVGEAREKKRKFTETVELQIGLKNYDPQKDKRFSGSVKLPHIPRPKMRVCMLGDASHVDQAEKLGLDSMDVESLKKMNKNKKLVKRLAKKYHAFLASEAIIKQIPRLLGPGLNKAGKFPTLVSHSESLEAKVNETKATIKFQLKKVLCMGVAVGNLSMEEKQIQQNIQMSVNFLVSLLKKNWQNVRCLYIKSTMGKPARVF

SEQ ID NO: 24903 - protein, 216 aa, Lolium multiflorum
MSKLSSDAVKEAIALIVGEAREKKRKFTETVELQIGLKNYDPQKDKRFSGSVKLPHVPRPKMRVCMLGDASHVDQAEKLGLDSMDVESLKKMNKNKKLVKKLAKKYHAFLASEAIIKQIPRLLGPGLNKAGKFPTLVSHSESLEAKVNETKATVKFQLKKVLCMGVAVGNLSMDEKQIQQNLQMSVNFLVSLLKKNWQNVRCLYVKSTMGKRQRVF

SEQ ID NO: 24904 - protein, 216 aa, Avena sativa
MSKLSTEALKEAITQVVSEAKEKNRKFTETIELQIGLKNYDPQKDKRFSGSVKLPHVPRPKMRVCMLGDAQHVGEAEKIGLDSMDVEALKKMNKNKKLVKRLAKKYHAFLASEAIIKQIPRLLGPGLNKAGKFPTLVSHSESLEAKVNETKATIKFQLKKVLCMGVAVGNLSMEEKQIQQNIQMSVNFLVSLLKKNWQNVRCLYIKSTMGKPARVF

SEQ ID NO: 24905 - protein, 216 aa, Allium cepa
MSKLQSDVLREAITQIKTGATEKKRNFTETIELQIGLKNYDPQKDKRFSGSVKLPHIPRPKMKVCMLGDAQHCEEAEKMNLPFMDVESLKKFNKNKKLVKKMAKKYHVFLASEAVIKQIPRLLGPGLNKAGKFPTLVSHQESLEAKVNETKAMVKFQLKKVLCMGVAVGNCGMDEKQIFQNVQLSVNFLVSLLKKNWQNVRCLYLKSTMGRPVRIF

SEQ ID NO: 24906 - protein, 216 aa, Allium cepa
MSKLQSDVLREAITQIKTGAAEKKRNFTETIELQIGLKNYDPQKDKRFSGSVKLPHIPRPKMKVCMLGDAQHCEEAEKMDLPFMDVESLKKFNKNKKLVKKMAKKYHVFLASEAVIKQIPRLLGPGLNKAGKFPTLVSHQESLEAKVNETKAMVKFQLKKVLCMGVAVGNCGMDEKQIFQNVQLSVNFLVSLLKKNWQNVRCLYLKSTMGRPVRIF

SEQ ID NO: 24907 - protein, 216 aa, Allium cepa
MSKLQSDVLREAITQIKINAEEKKRNFTETIELQIGLKNYDPQKDKRFSGSVKLPHIPRPKMKVCMLGDAQHCEEAEKMDLPFMDVESLKKFNKNKKLVKKMAKKYHVFLASEAVIKQIPRLLGPGLNKAGKFPTLVSHQESLEAKVNETKAMVKFQLKKVLCMGVAVGNCGMDEKQIFQNVQLSVNFLVSLLKKNWQNVRCLYLKSTMGRPVRVF

SEQ ID NO: 24908 - protein, 216 aa, Allium cepa
MSKLQSDVLREAITQIKTNAEEKKRNFTETIELQIGLKNYDPQKDKRFSGSVKLPHIPRPKMKVCMLGDAQHCEEAEKMDLPFMDVESLKKFNKNKKLVKKMAKKYHVFLASEAVIKQIPRLLGPGLNKAGKFPTLVSHQESLEAKVNEVKAMVKFQLKKVLCMGVAVGNCGMDEKQIFQNVQLSVNFLVSLLKKNWQNVRCLYLKSTMGKPVRVF

SEQ ID NO: 24909 - protein, 216 aa, Leymus cinereus x Leymus triticoides
MSKLQTEALKEAITQVVAEAKEKNRKFTETVELQIGLKNYDPQKDNRFSGSVKLPHVPRPKMRVCMLGDAQHVGEADKIGLDSMDVEALKKMNKNKKLVKRLAKKYHAFLASEAIIKQIPRLLGPGLNKAGKFPTLVSHQESLEAKVNETKATIKFQLKKVLCMGVAVGNLSMEEKQIQQNIQMSVNFLVSLLKKNWQNVRCLYIKSTMGKPVRVF

SEQ ID NO: 24910 - protein, 216 aa, Festuca arundinacea
MSKLSSDAVKEAIALIVGEAREKKRKFTETVELQIGLKNYDPQKDKRFSGSVKLPHIPRPKMRVCMLGDAQHVDQAEKLGLDSMDVESLKKMNKNKKLVKKLAKKYHAFLASEAIIKQIPRLLGPGLNKAGKFPTLVSHSESLEAKVNETKATVKFQLKKVLCMGVAVGNLSMDEKQIQQNLQMSVNFLVSLLKKNWQNVRCLYVKSPLGKRQRVF

SEQ ID NO: 24911 - protein, 216 aa, Theobroma cacao
MSKLQSDAVREAISTIVGDSKEKQRKFVETIELQIGLKNYDPQKDKRFSGAVKLPHIPRPKMKICMLGDALHVEEAEKIGLDWMDVEALKKLNKNKKLVKKLAKKYHAFLASEAVIKQIPRLLGPGLNKAGKFPTLVTHQESLESKVNETKAMVKFQLKKVLCMGVAVGNCSMEEKQIFQNVQLSVNFLVSLLKKNWQNVRCLHLKSTMGRPQRIY

SEQ ID NO: 24912 - protein, 212 aa, Brassica juncea
MSKLQSEAVREAISSMITHCKDTKPRKFTETIELQIGLKNYDPQKDKRFSGSVKLPHIPRPKMKICMPGDAQHVEEAEKIGLDSMDVEALKKLNKNKKLVKKLAKKFHAFLASESVIKQIPRLLGPGLNKAGKFPTLVSHQESLESKVNETKATVKFQLKKVLCMGVAVGNLGMEEKQIFQNVQMSVNFLVSLLKKNWQNVRCLYLKSTMGP

SEQ ID NO: 24913 - protein, 223 aa, Nicotiana benthamiana
MSKLQSDALREAITVIKSASNEKKRKFTETIELQIGLKNYDPQKDKRFSGSVKLPHIPRPKMKICMLGDAQHVEEAEKIGLEYMDVESLKKLNKNKKLVKKLAKKYHAFLASEAVIKQIPRLLGPGLNKAGKFPSLVSHQESLESKVNETKATIKFQLKKVLCMGVAVGNMDMEEKQIFQNVQMSVNFLVSLLKKNWQNVRCLYLKSTMGKTQRRLLKEIALQ

SEQ ID NO: 24914 - protein, 216 aa, Conyza canadensis
MSKLSSEALREAITQVTTEAKEKKRNFTETIELQIGLKNYDPQKDKRFSGTVKLPHIPRPKLKVCMLGDAQHVEEAQKIGLEYMDVESLKKLNKNKKLVKKLAKKHQAFLASESVIKQIPRLLGPGLNKAGKFPTLVSHQESLEAKVNETKATVKFQLKKVLCMGVAVGNCSMEEKQIFQNVQMSVNFLVSLLKKNWQNVRCLYLKTTMGKPVRIF

SEQ ID NO: 24915 - protein, 216 aa, Rosmarinus officinalis
MSKLQSEALREAITQIVSDSKEKKRNFTETVELQIGLKNYDPQKDKRFSGSVRLPHIPRPKMKICMLGDAQHVEEAEKIGLESMDVEALKKLNKNKKLVKKLAKRYHAFVASEAVIKQIPRLLGPGLNKAGKFPTLVTHQESLESKVNETKATIKFQLKKVLCMGVAVGNLDMEEKQLFQNIQMSVNFLVSLLKKNWQNVRCLYLKSTMGKPQRIF

SEQ ID NO: 24916 - protein, 216 aa, Arachis hypogaea
MSKLQSDALREAISQLVANANEKKRKFTETVELQIGLKNYDPQKDKRFSGSVKLPHIPRPKMKICMLGDAQHVEEAEKIGLDWMDVEALKKLNKNKKLVKKLAKKYHAFLASEAVIKQIPRLLGPGLNKAGKFPTLVTHQESLESKVNETKAMVKFQLKKVLCMGIAVGNCSMDEKQIFQNVQLSVNFLVSLLKKNWQNVRCLYLKSTMGSAIRVF

SEQ ID NO: 24917 - protein, 216 aa, Prunus mume
MSKLQSDTLREGISTIMAASKEKNRKFTETIELQIGLKNYDPQKDKRFSGSVRLPHIPRPKMKVCMLGDAQHVEEAEKIGLDYMDVEGLKKLNKNKKLVKKLAKKYHAFLASEAVIKQIPRLLGPGLNKAGKFPTLVTHQESLESKVAETKATIKFQLKKVLCMGVAVGNASMEEKQIFQNVQLSVNFLVSLLKKNWQNVKCLNLKTTMGKPYRIY

SEQ ID NO: 24918 - protein, 197 aa, Secale cereale
EAITNIINDCREKNRKFVETIELQIGLKNYDPQKDKRFSGSVKLPHIPRPKMRVCMLGDAQHVEEAGKMGLDCMDVESLKKMNKNKKLVKKLAKKYHAFLASEAIIKQIPRLLGPGLNKAGKFPTLVSHQESLESKVNETKAHGIGESVVVAALDEKQIFQNVQMSVNFLVSLLKKNWQNVRCLYLKSTMGKVYRLF

SEQ ID NO: 24919 - protein, 216 aa, Avena sativa
MSKLSTEALKEATTQVVSEAKEKNRKFTETIELQIGLKNYDPQKDKRFSGSVKLPHVPRPKMRVCMLGDAQHVGEAEKIGLDSMDVEALKKMNKNKKLVKRLAKKYHAFLASEAIIKQIPRLLGPGLNKAGKFPTLVSHSESLEAKVNETKATIKFQLKKVLCMGVAVGNLSMEEKQIQQNIQMSVNFLVSLLKKNWQNVRCLYIKSTMGKPSRVF

SEQ ID NO: 24920 - protein, 217 aa, Chrysanthemum coronarium
MSKLSSDAVREAITQITTDAKEKKVRNFVETIELQIGLKNYDPQKDKRFSGTVRLPNIPRPKLKVCMLGDAQHVEEAQKIGLEYMDVESLKKLNKNKKLVKKLAKKHQAFLASESVIKQIPRLLGPGLNKAGKFPTLVSHQESLEAKVNETKATIKFQLKKVLCMGVAVGNCSMEEKQIFQNVQMSVNFLVSLLKKNWQNVRCLYLKTTMGKPVRIF

SEQ ID NO: 24921 - protein, 216 aa, Rosmarinus officinalis
MSKLQSEALREAITQIVSDCKEKKRNFTETVELQIGLKNYDPQKDKRFSGSVRLPHIPRPKMKICMLGDAQHVDQAEKIGLESMDVEALKKLNKNKKLVKKLAKRYHAFVASEAVIKQIPRLLGPGLNKAGKFPTLVTHQESLESKVNETKATIKFQLKKVLCMGVAVGNLDMEEKQLFQNIQMSVNFLVSLLKKNWQNVRCLYLKSTMGKPQRIF

SEQ ID NO: 24922 - protein, 216 aa, Cynara scolymus
MSKLQSEALREAITQITTDAKEKKRNFTETIELQIGLKNYDPQKDKRFSGTVKLPHIPRPKLKVCMLGDAQHVEEAQKIGLEYMDVEGLKKLNKNKKLVKKLAKKHQAFLASESVIKQIPRLLGPGLNKAGKFPTLVTHQESLEAKVNETKATVKFQLKKVLCMGVAVGNCSMEDKQIFQNVQMSVNFLVSLLKKNWQNVRCLYLKTTMGKPGRIS

SEQ ID NO: 24923 - protein, 215 aa, Brassica juncea
KLQSEAVKEAISTIITHCKETKPRKFTETIELQIGLKNYDPQKDKRFSGSVKLPHIPRPKMKICMLGDAQHVEEAEKIGLESMDVEALKKLNKNKKLVKKLAKKYHAFLASESVIKQIPRLLGPGLNKAGKFPTLVSHQESLEGKVNETKATVKFQLKKVLCMGVAVGNLSMEEKQLFQNVQMSINFLVSLLKKNWQNVRCLYLKSTMGPPQRIF

SEQ ID NO: 24924 - protein, 217 aa, Chrysanthemum coronarium
MSKLSSEAVREAITSITTDAKEKKVRNFTETIELQIGLKNYDPQKDKRFSGTVRLPHIPRPKLKVCMLGDAQHVEEAQKIGLEYMDVESLKKLNKNKKLVKKLAKKHQAFLASESVIKQIPRLLGPGLNKAGKFPTLVSHQESLEAKVNETKATIKFQLKKVLCMGVAVGNCSMEEKQIFQNVQMSVNFLVSLLKKNWQNVRCLYLKTTMGKPVRIF

SEQ ID NO: 24925 - protein, 207 aa, Rosmarinus officinalis
REAISVIKNDSAEKKRKFSETIELQIGLKNYDPQKDKRFSGSVKLPHIPRPKMKVCMLGDAQHVEEAEKIGLEYMDVEGLKKLNKNKKLVKKLAKKYHTFLASEAVIKQIPRLLGPGLNKAGKFPTLVTHQESLESKVNETKATIKFQLKKVLCMGVAVGNCSMEEKQIFQNVQMSVNFLVSLLKKNWQNVRCLYLKSTMGKPVRIF

SEQ ID NO: 24926 - protein, 208 aa, Lupinus angustifolius
MSKLQSEALREAISQIVTNSKEKNRKFTETIELQIGLKNYDPQKDKRFSGSVKLPHIPRPKMKICMLGDAQHVEEAEKIGLDYMDVEALKKLNKNKKLVKKLAKKYHAFLASEAIIKQIPRLLGPGLNKAGKFPTLVSHQESLESKVNETKAMVKFQLKKVLCMGVAVGNLAMEEKQIFQNVQLSVNFLVSLLKKNWQNVSSDLKSLH

SEQ ID NO: 24927 - protein, 218 aa, Brassica juncea
MSKLQSEVLREGITAVKGKADEKKRNFVETVELQIGLKNYDPQKDKRFSGSVKLPHIPRPKMKICMLGDAQHVEEAEKIGLDYMDVEALKKLNKNKKLVKKLAKKYHAFLASESVIKQIPRLLGPGLNKAGKFPTLVSHQESLEGKVNETKATVKFQLKKVLCMGVAVGNLSMEEKQLFQNVQMSVNFLVSLLKKNWQNVRCLYLKSTMGPPNKKEYF

SEQ ID NO: 24928 - protein, 226 aa, Vigna unguiculata
AAKPLSWKKTKSHNESDALREAITGIMGDSKEKNRKFVETIELQIGLKNYDPQKDKRFSGSVKLPHIPRPKMKICMLGDAQHVEEAEKIGLDYMDVEALKKLNKNKKLVKKLAKKYHAFLASEAVIKQIPRLLGPGLNKAGKFPTLVTHQESLESKVNETKAMVKFQLKKVLCMGVAVGNVSMEEKQIFQNVQLSVNFLVSLLKKNWQNVRCLYLKSTMGKSYRVF

SEQ ID NO: 24929 - protein, 217 aa, Chrysanthemum coronarium
MSKLSSEAVREAITSITTDAKEKKVRNFTETIELQIGLKNYDPQKDKRFSGTVRLPNIPRPKLKVCMLGDAQHVEEAQKIGLEYMDVESLKKLNKNKKLVKKLAKKHQAFLASESVIKQIPRLLGPGLNKAGKFPTLVSHQESLEAKVNETKATIKFQLKKVLCMGVAVGNCSMEEKQIFQNVQMSVNFLVSLLKKNWQNVRCLYLKTTMGKPVRIF

SEQ ID NO: 24930 - protein, 203 aa, Cyclamen graecum
TQIRNDSIEKARKFTETIELQIGLKNYDPQKDKRFSGSVKLPHIPRPKMKVCMLGDAQHVEEAEKIGLEYMDVEGLKKLNKNKKLVKKLAKKYHAFLASEAVIKQIPRLLGPGLNKAGKFPTLVSHQESLESKVNETKATVKFQLKKVLCMGVAVGNCSMEEKQIFQNVQMSVNFLVSLLKKNWQNVRCLYLKSTMGRPVRVF

SEQ ID NO: 24931 - protein, 223 aa, Panicum virgatum
DTCPLLFCSKLQTEVLKDAISQVVSEAREKNRKFTETIELQIGLKNYDPQKDKRFSGSVKLPHIPRPKMKVCMLGDAQHVEEAEKIGLDYMDVEALKKMNKNKKLVKKLAKKYHAFLASEAIIKQIPRLLGPGLNKAGKFPTLVTHQESLESKVNETKATVKFQLKKVLCMGVAVGNLSMEEKQIQQNIQMSVNFLVSLLKKNWQNVRCLYIKSTMGKPNRVF

SEQ ID NO: 24932 - protein, 203 aa, Cyclamen graecum
TQIRNDSIEKARKFTETIELQIGLKNYDPQKDKRFSGSVKLPHIPRPKMKVCMLGDAQHVEEAEKIGLEYMDVEGLKKLNKNKKLVKKLAKKYHAFLASEAVIKQIPRLLGPGLNKAGKFPTLVTHQESMESKVNETKATVKFQLKKVLCMGVAVGNCSMEEKQIFQNVQMSVNFLVSLLKKNWQNVRCLYLKSTMGKPVRVF

SEQ ID NO: 24933 - protein, 206 aa, Brassica juncea
MSKLQSEAVKEAISSIITHCKETKPRKFTETIELQIGLKNYDPQKDKRFSGSVKLPHIPRPKMKICMLGDAQHVEEAEKIGLESMDVEALKKLNKNKKLVKKLAKKFHAFLASESVIKQIPRLLGPGLNKAGKFPTLVSHQESLEAKVNETKATVKFQLKKVLCMGVAVGNLGMEEKQIFQNVQMSVNFLVSLLKKNWQNVRCLYL

SEQ ID NO: 24934 - protein, 216 aa, Juglans hindsii x Juglans regia
MSKLHSDAVREAISTLFTGSREKKRNFTETVELQIGLKNYDPQKDKRFSGSVKLPHIPRPKMKVCMLGDAQHVEEADKIGLDYMDVEALKKLNKNKKLVKKLAKKYHAFLASEAVIKQIPRLLGPGLNKAGKFPTLVTHQETIESKVNETKAMVKFQLKKVLCMGVAVGNVAMEEKQVFQNVQMSVNFLVSLLKKNWQNVRSLSLKTTMGRPVRIY

SEQ ID NO: 24935 - protein, 216 aa, Populus trichocarpa
MSKLAGDTIREAVTTIKNGVNDKPRKFVQTIELQIGLKNYDPQKDKRFSGSVKLPHIPRPKMKVCMLGDAQHVEEAESIGLQWMDVEALKKLNKNKKLVKKLSKQYHAFLASESVIKQIPRLLGPGLNKAGKFPTLVTHQESLESKVNEIKATVKFQLKKVLCMGVAVGNCGMEDKQIFQNVQMSVNFLVSLLKKNWQNVKSLHLKSTMGTPVRLY

SEQ ID NO: 24936 - protein, 216 aa, Panax ginseng
SKLQSDALREAHSLRFLMRPRRKSVISLRPLNSRLVLKNYDPQKDKRFSGSVKLPHIPRPKMKVCMLGDAQHVEEAEKIGLEYMDVEGLKKLNKNKKLVKKLAKKYHAFLASEAVIKQIPRLLGPGLNKAGKFPTLVTHQESLESKVNETKATVKFQLKKVLCMGVAVGNLSMEEKQIFQNVQMSVNFLVSLLKKNWQNVRCLYLKSTMGKTVRIF

SEQ ID NO: 24937 - protein, 216 aa, Populus trichocarpa
MSKLSGDTIREAVTTIKTGVNEKPRKFVQTIELQIGLKNYDPQKDKRFSGSVKLPHIPRPKMKVCMLGDAQHVEEATSIGLQWMDVEALKKLNKNKKLVKKLSKQYHAFLASESVIKQIPRLLGPGLNKAGKFPTLVNHQESLESKVNEIKATVKFQLKKVLCMGVAVGNCDMEDKQIFQNVQMSVNFLVSLLKKNWQNVKSLHLKSTMGTPVRLY

SEQ ID NO: 24938 - protein, 216 aa, Zostera marina
MSKLQSDVLREAISTIVAGCREKQRNFQETIELQIGLKNYDPQKDKRFSGSVKLPHIPRPKMKVCMLGDAQHVDASSKIDLPSMSVEDLKKFNKNKKLVKKLSKKYQAFLASESVIKQIPRLLGPGLNKAGKFPTLVSHQESLEGKLNEIKATVKFQLKKVLCMGVAVGNVGMDEKQIFQNVQLSINFLVSLLKKNWQNVKCLHLKSTMGSPVRLF

SEQ ID NO: 24939 - protein, 208 aa, Chrysanthemum coronarium
REAITSITTDAKEKKVRNFTETIELQIGLKNYDPQKDKRFSGTVRLPHIPRPKLKVCMLGDAQHVEEAQKIGLEYMDVESLKKLNKNKKLVKKLAKKHQAFLASESVIKQIPRLLGPGLNKAGKFPTLVSHQESLEAKVNETKATIKFQLKKVLCMGVAVGNCSMEEKQIFQNVQMSVNFLVSLLKKNWQNVRCLYLKTTMGKPVRIF

SEQ ID NO: 24940 - protein, 206 aa, Chrysanthemum coronarium
AITQITTDAKEKKVRNFVETIELQIGLKNYDPQKDKRFSGTVRLPHIPRPKLKVCMLGDAQHVEEAQKIGLEYMDVESLKKLNKNKKLVKKLAKKHQAFLASESVIKQIPRLLGPGLNKAGKFPTLVSHQESLEAKVNETKATVKFQLKKVLCMGVAVGNCSMEEKQIFQNVQMSVNFLVSLLKKNWQNVRCLYLKTTMGKPVRIF

SEQ ID NO: 24941 - protein, 202 aa, Brassica juncea
PIKGKSEDKKRNFVETVELQIGLKNYDPQKDKRFSGSVKLPHIPRPKMKVCMLGDAQHVEEAEKMGLDSMDVEALKKLNKNKKLVKKLAKKYHAFLASESVIKQIPRLLGPGLNKAGKFPTLVSHQESLEGKVNETKATVKFQLKKVLCMGVAVGNLSMEEKQLFQNVQMSVNFLVSLLKKNWQNVRCLYLKSTMGPPQRIF

SEQ ID NO: 24942 - protein, 198 aa, Euphorbia peplus
MSKLQSDALREAITTITTSSKEKKRNFTETIELQIGLKNYDPQKDKRFSGSVKLPHIPRPKMKICMLGDAQHVEEAEAIGLQWMDVEALKKLNKNKKLVKKLAKQYHAFLASESVIKQIPRLLGPGLNKAGKFPTLVTHQESLESKVNETKATVKFQLKKVLCMGVAVGNCAMEEKQIFQNVQMSVNFLVSLLKKNWQ

SEQ ID NO: 24943 - protein, 220 aa, Centaurea maculosa
SEALREAITQITTDAKEKKRNFTETIELQIGLKNYDPQKDKRFSGTVKLPHIPRPKLKVCMLGDAQHVEEAQKIGLEYMDVEGLKKLNKNKKLVKKLAKKHQAFLASESVIKQIPRLLGPGLNKAGKFPTLVTHQESLEAKVNETKATVKFQLKKVLCMGVAVGNCSMEDKQIFQNVQMSVNFLVSLLKKNWQNVRCLYLKTTMGKPSADRFRSSLFVVF

SEQ ID NO: 24944 - protein, 249 aa, Cenchrus ciliaris
MELMCSEMLFQDFVDPIKIPKNSSMQLNVSCFYFSKLQSDVLREAIASVTNDAREKQRKFVETIELQIGLKNYDPQKDKRFSGSVKLPHIPRPKMKVCMLGDAQHVEEAARIGLDSMDVEALKKMNKNKKLVKKLAKKYHAFLASEAIIKQIPRLLGPGLNKAGKFPTLVSHQESLESKVNETKATVKFQLKKVLCMGVAVGNCGMDEKQIFQNVQMSVNFLVSLLKKNWQNVRCLYLKSTMGKVYRLF

SEQ ID NO: 24945 - protein, 235 aa, Nicotiana benthamiana
MSKLQSDALREAITVIKSASNEKKRKFTETIELQIGLKNYDPQKDKRFSGSVKLPHIPRPKMKICMLGDAQHVEEAEKIGLEYMDVESLKKLNKNKKLVKKLAKKYHAFLASEAVIKQIPRLLRPGLNEAGKFRSLVSHQESLESKVNETKATIKFQLKKVLCMGVAVGNMDMEEKQIFQNVQMSVNFLVSLLKKNWQNVRCLYLKSTMGKTQRRLLKEIALQSWRFLRFALYAL

SEQ ID NO: 24946 - protein, 159 aa, Setaria italica
MDVSGAGATGKVKKGAAGRKAGGPRKKSVSRSVKAGLQFPVGRIGRYLKKGRYAQRVGTGAPVYLAAVLEYLAAEVLELAGNAARDNKKTRIIPRHVLLAIRNDEELGKLLAGVTIAHGGVLPNINPVLLPKKVAEKAASGGAKEAKSPKKGAKSPKKA

SEQ ID NO: 24947 - protein, 157 aa, Setaria italica
MDASGATGKVKKGAAGRKAGGPRKKSVSRSVKAGLQFPVGRIGRYLKKGRYAQRVGTGAPVYLAAVLEYLAAEVLELAGNAARDNKKTRIIPRHVLLAIRNDEELGKLLAGVTIAHGGVLPNINPVLLPKKAAEKAASGGAKEAKSPKKAAKSPKKA

SEQ ID NO: 24948 - protein, 148 aa, Cenchrus ciliaris
MDVSGAGATGKVKKGAAGRKAGGPRKKSVTRSVKAGLQFPVGRIGRYLKKGRYAQRVGSGAPVYLAAVLEYLAAEVLELAGNAARDNKKTRIVPRHVLLAIRNDEELGKLLAGVTIAHGGVLPNINPVLLPKKVAEKAAAKEAKSPKK

SEQ ID NO: 24949 - protein, 157 aa, Panicum virgatum
MDASGATGKVKKGAAGRKAGGPRKKSVSRSVKAGLQFPVGRIGRYLKKGRYAQRVGTGAPIYLAAVLEYLAAEVLELAGNAARDNKKTRIIPRHVLLAIRNDEELGKLLAGVTIAHGGVLPNINPVLLPKKVAEKAASGGAKEAKSPKKGAKSPKKA

SEQ ID NO: 24950 - protein, 154 aa, Echinochloa colona
MDATGAGGKAKKGAAGRKAGGPRKKSVSRSVKAGLQFPVGRIGRYLKKGRYAQRVGTGAPVYLAAVLEYLAAEVLELAGNAARDNKKTRIIPRHVLLAIRNDEELGKLLAGVTIAHGGVLPNINPVLLPKKVAEKAASGAKEAKSSKKGAKSPK

SEQ ID NO: 24951 - protein, 154 aa, Cenchrus ciliaris
MDASGATGKVKKGAAGRKTGGPRKKSVTRSVKAGLQFPVGRIGRYLKKGRYAQRVGSGAPVYLAAVLEYLAAEVLELAGNAARDNKKTRIVPRHVLLAIRNDEELGKLLSGVTIAHGGVLPNINQVLLPKKVAEKAAAKEAKSPKKAAKSPKKA

SEQ ID NO: 24952 - protein, 156 aa, Cenchrus ciliaris
MDATGTGAGGKVKKGAAGRKAGGPRKKSVSRSVKAGLQFPVGRIGRYLKKGRYAQRVGSGAPVYLAAVLEYLAAEVLELAGNAARDNKKTRIVPRHVLLAVRNDEELGKLLAGVTIAHGGVLPNINPVLLPKKVAERAAAKEAKSPKKAAKSPKKA

SEQ ID NO: 24953 - protein, 160 aa, Echinochloa colona
MDATGAGGKAKKGAAGRKAGGPRKKSVSRSVKAGLQFPVGRIGRYLKKGRYAQRVGTGAPVYLAAVLEYLAAEVLELAGNAARDNKKTRIIPRHVLLAIRNDEELGKLLAGVTIAHGGVLPNINPVLLPKKTASAAAKEGKEKKSPKKAATKSPKKAAAA

SEQ ID NO: 24954 - protein, 159 aa, Setaria italica
MDATGTGAGGKVKKGAAGRKAGGPRKKSVSRSVKAGLQFPVGRIGRYLKKGRYAQRVGTGAPVYLAAVLEYLAAEVLELAGNAARDNKKTRIIPRHVLLAIRNDEELGRLLAGVTIAHGGVLPNINPVLLPKKTAEKASSGGSKEAKSPKKAAKSPKKA

SEQ ID NO: 24955 - protein, 155 aa, Avena sativa
MDVSSTATGGKAKKGAAGRKAGGPRKKSVTRSVKAGLQFPVGRVGRYLKKGRYAQRVGTGAPVYLAAVLEYLAAELLELAGNAAKDNKKSRIIPRHLLLAVRNDEELGKLLAGVTIAHGGVLPKINPVLLPKKTAEKAAKEPKSPKKTAKSPKKA

SEQ ID NO: 24956 - protein, 155 aa, Avena sativa
MDVSSTAAGAKGKKGAAGRKAGGPRKKSVTRSVKAGLQFPVGRVGRYLKKGRYAQRVGTGAPVYLAAVLEYLAAEVLELAGNAAKDNKKSRIIPRHLLLAVRNDEELGKLLAGVTIAHGGVLPKINPVLLPKKTAEKAAKEPKSPKKTAKSPKKA

SEQ ID NO: 24957 - protein, 150 aa, Cenchrus ciliaris
GATGKVKKGAAGRKAGGPRKKSVTRSVKAGLQFPVGRIGRYLKKGRYAQRVGSGAPVYLAAVLEYLAAEVLELAGNAARDNKKTRIVPRHVLLAVRNDEELGKLLAGVTIAHGGVLPNINPVLLPKKVAEKAAAKEAKSPKKAAKSPKKA

SEQ ID NO: 24958 - protein, 151 aa, Silene vulgaris
MDTAGGKKKGAAGRKAGGPKKKSVTRSIKAGLQFPVGRIGRYLKKGRYAQRVGSGAPVYLAAVLEYLAAEVLELAGNAARDNKKNRIIPRHVLLAIRNDEELGKLLAGVTIAHGGVLPNINPILLPKKTAEKSPKEPKSPSKAAKSPKKAA

SEQ ID NO: 24959 - protein, 155 aa, Avena sativa
MDVPSAATGGKAKKGGAGRKAGGPRKKSVTRSVKAGLQFPVGRIGRYLKKGRYAQRVGTGAPVYLAAVLEYLAAELLELAGNAAKDNKKSRIIPRHLLLAIRNDEELGKLLAGVTIAHGGVLPKIHSVLLPKKAAEKAEKAAKSPKKATKSPKKA

SEQ ID NO: 24960 - protein, 155 aa, Secale cereale
MDVSATGAGAKAKKGAAGRKAGGPRKKSVSRSVKAGLQFPVGRIGRYLKKGRYAQRVGTGAPVYLSAVLEYLAAEVLELAGNAAKDNKKSRIIPRHLLLAVRNDEELGKLLAGVTIAHGGVVPKINPVLLPKRTAEKAPKEGKSPKKAAKSPKKA

SEQ ID NO: 24961 - protein, 155 aa, Triticum aestivum
MDVSATGAGAKAKKGAAGRKAGGPRKKSVSRSVKAGLQFPVGRIGRYLKKGRYAQRVGTGAPVYLAAVLEYLAAEVLELAGNAAKDNKKSRIIPRHLLLAVRNDEELGKLLAGVTIAHGGVVPKINPVLLPKRTAEKVPKEGKSPKKAAKSPKKA

SEQ ID NO: 24962 - protein, 151 aa, Amaranthus tuberculatus
MDTAGGKGKKGAAGRKGGGPKKKPVSRSVKAGLQFPVGRIGRYLKKGRYAQRVGTGAPVYLAAVLEYLAAEVLELAGNAARDNKKNRIIPRHVLLAVRNDDELGKLLAGVTIAHGGVLPNINPVLLPKKTADKAPKEPKSPSKATKSPKKA

SEQ ID NO: 24963 - protein, 152 aa, Musa acuminata
MDAGGGGGKVKRGAAGRKGGGPRKKPVSRSVKAGLQFPVGRIGRYLKKGRYAQRVGTGAPVYLAAVLEYLAAEVLELAGNAARDNKKNRIIPRHVLLAIRNDEELGKLLAGVTIAHGGVLPNINPVLLPKKSNNAAKEPKSPSKATKSPKKA

SEQ ID NO: 24964 - protein, 159 aa, Echinochloa colona
MDSTGTGATGKVKKGAAGRKAGGPRKKSVSRSVKAGLQFPVGRIGRYLKKGRYAQRVGTGAPVYLAAVLEYLAAEVLELAGNAARDNKKSRIIPRHVLLAIRNDEELGRLLAGVTIAHGGVLPNINPVLLPKKTAEKASSGGSKEAKSPKKAAKSPKKA

SEQ ID NO: 24965 - protein, 159 aa, Pennisetum glaucum
MDVSGAGATGKVKKGAAGRKAGGPRKKSVTRSVKAGLQFPVGRIGRYLKKGRYAQRVGSGAPVYLAAVLEYLAAEVLELAGNAARDNKKTRIVPRHVLLAVRNDEELGKLLAGVTIAHGGVLPNINPVLLPKKVAEKVASGGAKEPKSPKKGAKSPKKA

SEQ ID NO: 24966 - protein, 149 aa, Chenopodium quinoa
MDTGGKAKKGAGGRKGGGPKKKPVTRSVRAGLQFPVGRIGRYLKKGRYAQRVGTGAPVYLAAVLEYLAAEVLELAGNAARDNKKNRIIPRHVLLAVRNDDELGKLLAGVTIAHGGVLPNINPVLLPKKTAEKSPKEPKSPKATKSPKKA

SEQ ID NO: 24967 - protein, 147 aa, Echinacea purpurea
MDASGKAKKGAAGRKAGGPRKKSVTRSVKAGLQFPVGRIGRYLKHGRYAKRVGTGAPVYLAAVMEYLAAEVLELAGNAARDNKKTRIIPRHVLLAIRNDDELGKLLAGVTIAHGGVLPNINPVLLPKKTAAKEPKSPAKATKSPKKA

SEQ ID NO: 24968 - protein, 155 aa, Hordeum vulgare
MDASATGAGAKGKKGAAGRKAGGPRKKSVSRSVKAGLQFPVGRIGRYLKKGRYAQRVGTGAPVYLAAVLEYLAAELLELAGNAAKDNKKSRIIPRHLLLAVRNDEELGKLLAGVTIAHGGVMPNINPVLLPKRTAEKAPKEGKSPKKAAKSPKKA

SEQ ID NO: 24969 - protein, 155 aa, Hordeum vulgare
MDVSATGAGAKGKKGAAGRKAGGPRKKSVSRSVKAGLQFPVGRIGRYLKKGRYAQRVGTGAPVYLAAVLEYLAAELLELAGNAAKDNKKSRIIPRHLLLAVRNDEELGKLLAGVTIAHGGVMPKINPVLLPKRTAEKAPKEGKSPKKAAKSPKKA

SEQ ID NO: 24970 - protein, 153 aa, Daucus carota
MESPAAGKVKKGAAGRKAGGPKKKSVTRSVRAGLQFPVGRIGRYLKKGRYAQRVGTGAPVYLAAVLEYLAAEVLELAGNAARDNKKSRIIPRHLLLAIRNDEELGKLLGGVTIAHGGVLPNINPVLLPKKTTEKAGKEPTAKVAGKSPKKAAK

SEQ ID NO: 24971 - protein, 146 aa, Cenchrus ciliaris
KVKKAAAGRKLGGPKKKPVSRSVKAGLQFPVGRIGRYLKKGRYAQRVGTGAPVYLAAVLEYLAAEVLELAGNAARDNKKTRIIPRHVLLAIRNDEELGKLLAGVTIAHGGVLPNINPVLLPKKVAEKAAAKEAKSPKKAAKSPKKA

SEQ ID NO: 24972 - protein, 152 aa, Spinacia oleracea
MDSAAGGKGKKGAAGRKGGGPKKKSVTRSVKAGLQFPVGRIGRFLKKGRYAQRVGSGAPVYLAAVLEYLAAEVLELAGNAARDNKKSRIIPRHVLLAVRNDDELGKLLAGVTIAHGGVLPNINPILLPKKTAEKAPKEAKPSTKAAKSPKKA

SEQ ID NO: 24973 - protein, 159 aa, Cenchrus ciliaris
MDATGTGAAGKVKKGAAGRKAGGPRKKSVSRSVKAGLQFPVGRIGRYLKKGRYAQRVGTGAPVYLAAVLEYLAAEVLELAGNAARDNKKSRIVPRHVLLAIRNDEELGRLLAGVTIAHGGVLPNINPVLLPKKTAEKASSGGSKEAKSPKKAAKSPKKA

SEQ ID NO: 24974 - protein, 149 aa, Humulus lupulus
MDAGGKIKKGAAGRKGGGPKKKPVSRSVKAGLQFPVGRIGRYLKKGRYSQRVGTGAPVYLAAVLEYLAAEVLELAGNAARDNKKNRIIPRHVLLAVRNDEELGKLLAGVTIAHGGVLPNINPILLPKKTEKATKEPKSPSKATKSPKKA

SEQ ID NO: 24975 - protein, 153 aa, Avena sativa
MDVSGTGAAAKGKKGAAGRKAGGPRKKSVTRSVKAGLQFPVGRIGRYLKKGRYAQRVGTGAPVYLAAVLEYLAAELLELAGNAAKDNKKSRIIPRHLLLAVRNDEELGKLLAGVTIAHGGVVPKINPVLLPKKTAEKEAKSPKKAAAKSPKKA

SEQ ID NO: 24976 - protein, 149 aa, Cajanus cajan
MDTGGKIKKGAGGRKGGGPKKKPVTRSVRAGLQFPVGRIGRYLKKGRYAQRVGTGAPVYLAAVLEYLAAEVLELAGNAARDNKKNRIIPRHVLLAVRNDEELGKLLAGVTIAHGGVLPNINPVLLPKKTERAAKEPKSPSKATKSPKKA

SEQ ID NO: 24977 - protein, 149 aa, Cajanus cajan
MDTTGKIKKGAGGRKGGGPKKKPVTRSVRAGLQFPVGRIGRYLKKGRYAQRVGTGAPVYLAAVLEYLAAEVLELAGNAARDNKKNRIIPRHVLLAVRNDEELGKLLAGVTIAHGGVLPNINPVLLPKKTEKAAKEPKSPSKAKKSPKKA

SEQ ID NO: 24978 - protein, 149 aa, Centaurea maculosa
MDASTKVKKGAAGRKAGGPRKKSVTRSVKAGLQFPVGRIGRYLKKGRYAQRVGTGAPVYLAAVLEYLAAEVLELAGNAARDNKKNRIIPRHVLLAIRNDEELGKLLAGVTIAHGGVLPNINPILLPKKTATKEPKSPSKAAKSPKKAAA

SEQ ID NO: 24979 - protein, 155 aa, Avena sativa
MDASTTVAESKAKKGSAGRKAGGPRKKSVTRSSKAGLQFPVGRIGRYLKKGRYAQRVGTGAPVYLAAVLEYLAAELLELAGNAAKDNKKSRIIPRHLLLAIRNDEELGKLLAGVTIAHGGVLPKINPVLLPKKTAEKAAKEPKSPKKTTKSPKKA

SEQ ID NO: 24980 - protein, 151 aa, Silene vulgaris
MDSTGGKKKGAAGRKAGGPKKKSVTRSIKAGLQFPVGRIGRYLKKGRYAQRVGSGAPVYLAAVLEYLAAEVLELAGNAARDNKKNRIIPRHVLLAIRNDEELGKLLAGVTIAHGGVLPNINPILLPKKTAEKSPKEPKSPKAAKSPKKAAA

SEQ ID NO: 24981 - protein, 149 aa, Silene vulgaris
STGGKKKGAAGRKAGGPKKKSVTRSIKAGLQFPVGRIGRYLKKGRYAQRVGSGAPVYLAAVLEYLAAEVLELAGNAARDNKKNRIIPRHVLLAIRNDEELGKLLAGVTIAHGGVLPNINPILLPKKTAEKSPKEPKSPKAAKSPKKAAA

SEQ ID NO: 24982 - protein, 149 aa, Glycine max
MDADGKIKKGAGGRKGGGPKKKPVSRSVKAGLQFPVGRIGRYLKKGRYAQRVGTGAPVYLAAVLEYLAAEVLELAGNAARDNKKNRIIPRHVLLAVRNDEELGKLLAGVTIAHGGVLPNINPVLLPKKSERASKEPKSPSKATKSPKKA

SEQ ID NO: 24983 - protein, 150 aa, Spinacia oleracea
MDSAGKGKKGAGGRKGGGPKKKPVTRSVRAGLQFPVGRIGRFLKKGRYAQRVGTGAPVYLAAVLEYLAAEVLELAGNAARDNKKTRIIPRHVLLAVRNDDELGKLLAGVTIAHGGVLPNINPVLLPKKVAEKSPKEPKSPSKATKSPKKA

SEQ ID NO: 24984 - protein, 151 aa, Amaranthus tuberculatus
MDSTGGKAKKGAAGRKGGGPKKKPVSRSVKAGLQFPVGRIGRYLKKGRYAQRVGTGAPVYLAAVLEYLAAEVLELAGNAARDNKKNRIIPRHVLLAVRNDDELGKLLAGVTIAHGGVLPNINPVLLPKKTAEKTPKEPKSPSKATKSPKKA

SEQ ID NO: 24985 - protein, 150 aa, Daucus carota
METGGKAKKGFGGRKGGGPRKKAVTRSVRAGLQFPVGRIGRYLKKGRYAQRVGTGAPVYLAAVLEYLAAEVLELAGNAARDNKKTRIIPRHVLLAVRNDEELGKLLAGVTFAHGGVLPNINPVLLPKKTAEKAPKEPKSPAKAGKSPKKA

SEQ ID NO: 24986 - protein, 150 aa, Echinacea purpurea
MDASGKAKKGAAGRKAGGPRKKSVTRSVKAGLQFPVGRIGRYLKNGRYAKRVGTGAPVYLAAVLEYLAAEVLELAGNAARDNKKNRINPRHVLLAVRNDDELGKLLAGVTIAHGGVLPNINPVLLPKKSHEKAAKEPKSPSKSTKSPKKA

SEQ ID NO: 24987 - protein, 150 aa, Fagopyrum esculentum
MDASSKVKKGAAGRKAGGPKKKSVSRSVKAGLQFPVGRIGRYLKNGRYAKRVGSGAPVYLAAVLEYLAAEVLELAGNAARDNKKTRIIPRHLLLAVRNDEELGKLLNGVTIAHGGVLPNINPVLLPKKTAEKAPKEPKSPSKAKKSPKKA

SEQ ID NO: 24988 - protein, 150 aa, Fagopyrum esculentum
MDATTKVKKGAAGRKAGGPKKKSVSRSVKAGLQFPVGRIGRYLKNGRYARRVGSGAPVYLAAVLEYLAAEVLELAGNAARDNKKTRIIPRHLLLAVRNDEELGKLLNGVTIAHGGVLPNINPVLLPKKTAEKAPKEPKSPSKAKKSPKKA

SEQ ID NO: 24989 - protein, 150 aa, Fagopyrum esculentum
MDASSKGKKGAAGRKAGGPKKKSVSRSIKAGLQFPVGRIGRYLKNGRYAKRVGSGAPVYLAAVLEYLAAEVLELAGNAARDNKKTRIIPRHLLLAVRNDEELGKLLNGVTIAHGGVLPNINPVLLPKKTAEKAPKEPKSPSKAKKSPKKA

SEQ ID NO: 24990 - protein, 151 aa, Silene vulgaris
MDSTGAKGKKGAGGRKGGGPKKKAVSRSIKAGLQFPVGRIGRYLKKGRYAQRVGSGAPVYMAAVLEYLAAEVLELAGNAARDNKKNRIIPRHVLLAIRNDDELGKLLAGVTIAHGGVLPNINPVLLPKKTAEKSPKEPKSPSKAAKSPKKA

SEQ ID NO: 24991 - protein, 149 aa, Chrysanthemum coronarium
MEGAGKVKKGAAGRKAGGPRKKSVTRSVKAGLQFPVGRIGRYLKKGRYALRVGTGAPVYLAAVLEYLAAEVLELAGNAARDNKKTRIIPRHVLLAIRNDEELGKLLSGVTIAHGGVLPNINPVLLPKKTAAKESTPKSPSKAGKSPKKA

SEQ ID NO: 24992 - protein, 149 aa, Chrysanthemum coronarium
MEGIGKVKKGAAGRKAGGPRKKSVTRSVKAGLQFPVGRIGRYLKKGRYAKRVGTGAPVYLAAVLEYLAAEVLELAGNAARDNKKTRIIPRHVLLAIRNDEELGKLLSGVTIAHGGVLPNINPVLLPKKTAAKESTPKSPSKAAKSPKKA

SEQ ID NO: 24993 - protein, 148 aa, Parthenium argentatum
METTGKAKKGAAGRKAGGPRKKAVTRSVKAGLQFPVGRIGRYLKKGRYAKRVGTGAPVYLAAVLEYLAAEVLELAGNAARDNKKNRIIPRHVLLAIRNDDELGKLLAGVTIAHGGVLPNINPVLLPKKSAAAVKEGKSPKAAKSPKKA

SEQ ID NO: 24994 - protein, 154 aa, Linum usitatissimum
MDAGTTKVKKGAAGRKIGGPKKKPVSRSLKAGLQFPVGRIGRYLKKGRYAQRVGTGAPVYLAAVLEYLAAEVLELAGNAARDNKKNRIIPRHVLLAIRNDEELGKLLAGVTIAHGGVLPNINPVLLPKKSEKAAPKEPAEKKASAKATKSPKKA

SEQ ID NO: 24995 - protein, 153 aa, Silene vulgaris
MDSTGAKGKKGAGGRKGGGPKKKAVSRSVKAGLQFPVGRLGRYLKKGRYAQRVGSGAPVYMAAVLEYLAAEVLELAGNAARDNKKNRIIPRHVLLAIRNDDELGKLLAGVTIAHGGVLPNINPVLLPKKTAEKAPKEPKSPSKTKAAKSPKKA

SEQ ID NO: 24996 - protein, 149 aa, Flaveria ramosissima
MEATGKTKKGAGGRKAGGPRKKAVTRSVRAGLQFPVGRIGRFLKKGRYAQRVGTGAPVYLAAVLEYLAAEVLELAGNAARDNKKNRIIPRHVLLAIRNDEELGKLLAGVTIAHGGVLPNINPVLLPKKTAAAKEPKSPSKATKSPKKAN

SEQ ID NO: 24997 - protein, 153 aa, Petroselinum crispum
MESPAAGKVKKGAAGRKAGGPKKKSVTRSVKAGLQFPVGRIGRFLKKGRYAQRVGSGAPVYLAAVLEYLAAEVLELAGNAARDNKKTRIIPRHLLLAIRNDEELGKLLGGVTIAHGGVLPNINPVLLPKKTVEKAAKEPAAKVAGKSPRKAAK

SEQ ID NO: 24998 - protein, 150 aa, Sarracenia psittacina
MDAAGKVKKGAAGRRGGGPKKKPVSRSVKAGLQFPVGRIGRYLKKGRYSQRVGTGAPVYLAAVLEYLAAEVLELAGNAARDNKKNRIIPRHLLLAVRNDEELGKLLAGVTIAHGGVLPNINPVLLPKKGEKAASKEPKSPSKATKSPKKA

SEQ ID NO: 24999 - protein, 149 aa, Tropaeolum majus
MDAGGKAKKGAGGRKAGGPKKKAVTRSIKAGLQFPVGRIGRYLKKGRYSQRVGSGAPVYLAAVLEYLAAEVLELAGNAARDNKKNRIIPRHLLLAVRNDEELGKLLAGVTIAHGGVLPNINPVLLPKKSEKAGAKEAKSPKTTKSPKKA

SEQ ID NO: 25000 - protein, 150 aa, Cichorium intybus
MEAGTKVKKGAAGRKAGGPKKKPVSRSVKAGLQFPVGRIGRYIKKGRYAKRVGTGAPVYLAAVLEYLAAEVLELAGNAARDNKKTRIIPRHVLLAVRNDEELGKLLAGVTIAHGGVLPNINPILLPKKSLEKATKEPKSPAKSAKSPKKA

SEQ ID NO: 25001 - protein, 150 aa, Euphorbia peplus
MDAGGKLKKGAGGRKGGGPKKKPVSRSVKAGLQFPVGRIGRFLKKGRYAQRVGSGAPVYLAAVLEYLAAEVLELAGNAARDNKKNRIIPRHVLLAIRNDEELGKLLAGVTIAHGGVLPNINPILLPKKSEKIAAKEPKSPSKATKSPKKA

SEQ ID NO: 25002 - protein, 149 aa, Petroselinum crispum
METAGKAKKGFGGRKGGPRKKSVTRSVKAGLQFPVGRIGRYLKKGRYAQRVGTGAPVYLAAVLEYLAAEVLELAGNAARDNKKTRIIPRHLLLAVRNDEELGKLLAGVTFAHGGVLPNINPVLLPKKTAEKAAKEPKSPSKAGKSPKKA

SEQ ID NO: 25003 - protein, 149 aa, Scabiosa columbaria
MEASGKGKKGAGGRKGGGPRKKSVTRSVKAGLQFPVGRIGRYLKKGRYAKRVGTGAPVYLAAVLEYLAAEVLELAGNAARDNKKTRIIPRHVLLAIRNDEELGKLLAGVTIAHGGVLPNINPILLPKKSEKAASEPKSPKASKSPKKAA

SEQ ID NO: 25004 - protein, 149 aa, Chrysanthemum coronarium
MEGAGKVKKGAAGRKAGGPRKKSVTRSVKAGLQFPVGRIGRYLKKGRYALRVGTGAPVYLAAVLEYLAAEVLELAGNAARDNKKTRIIPRHVLLAIRNDEELGKLLSGVTIAHGGVLPNINPVLLPKRTAAKESTPKSPSKAGKSPKKA

SEQ ID NO: 25005 - protein, 149 aa, Phalaenopsis aphrodite
MDATSKIKKGAGGRKGGGPKKKPVSRSVRAGLQFPVGRIGRYLKKGRYAHRVGTGAPVYLAAVLEYLAAEVLELAGNAARDNKKNRIIPRHVLLAIRNDDELGKLLGGVTIAHGGVLPNINPVLLPKKTAAKEPKEPSKAAKSPKKAAA

SEQ ID NO: 25006 - protein, 149 aa, Scabiosa columbaria
MDAGGKSKKGAGGRKGAGPRKKSVSRSVKAGLQFPVGRIGRFLKKGRYAQRVGSGAPIYLAAVLEYLAAEVLELAGNAARDNKKSRIIPRHVLLAVRNDEELGKLLAGVTIAHGGVLPNINPVLLPKKTERAEKEAKSPSKATKSPKKA

SEQ ID NO: 25007 - protein, 148 aa, Cirsium arvense
MEGTAKAKKGAGGRKGGGPRKKSVTRSVKAGLQFPVGRIGRYLKKGRYAQRVGTGAPVYLAAVLEYLAAEVLELAGNAARDNKKNRIIPRHVLLAIRNDEELGKLLAGVTIAHGGVLPNINPILLPKKTATKEPKSPSKAAKSPKKAA

SEQ ID NO: 25008 - protein, 157 aa, Avena sativa
MDVSGTGAGAKGKKGAAGRKAGGPRKKSVTRSVKAGLQFPVGRIGRYLKKGRYAQRVGTGAPVYLAAVLEYLAAEVLELAGNAAKDNKKSRIIPRHVLLAVRNDEELGKLLSGVTIAHGGVIPKINPVLLPKKTAEKEAKEPKSPKKTAKSPKKTKA

SEQ ID NO: 25009 - protein, 148 aa, Valeriana officinalis
METGGKQKKGAAGRKAGGPKKKSVSRSTKAGLQFPVGRIGRYLKKGRYAQRVGSGAPVYLAAVLEYLAAEVLELAGNAARDNKKSRIIPRHLLLAVRNDEELGKLLAGVTIAHGGVLPNINPVLLPKKTAAKEPSATPTKAAKSPKKA

SEQ ID NO: 25010 - protein, 150 aa, Cichorium intybus
MEGTGKAKKGAAGRKGGPRKKAVSRSVKAGLQFPVGRIGRYLKKGRYAKRVGTGAPVYLAAVLEYLAAEVLELAGNAARDNKKTRIIPRHLLLAIRNDEELGKLLAGVTIAHGGVLPNINPILLPKKTAAAKEPKSPSKAAKSPKKAVKA

SEQ ID NO: 25011 - protein, 152 aa, Daucus carota
METGGKVKKGAAGRKFGGGGPRKKSVTRSVKAGLQFPVGRIGRYLKKGRYAQRVGTGAPVYLAAVLEYLAAEVLELAGNAARDNKKTRIIPRHVLLAVRNDEELGKLLAGVTIAHGGVLPNINPVLLPKKSEKAAAAKEPTKATKSPKKAAA

SEQ ID NO: 25012 - protein, 154 aa, Linum usitatissimum
MDAGTTKVKKGAAGRKIGGPKKKPVSRSLKAGLQFPVGRIGRYLKKGRYAQRVGTGAPVYLAAVLEYLAAEVLELAGNAARDNKKNRIIPRHVLLAIRNDEELGKLLAGVTIAHGGVLPNINPVLLPKKSEKAAAKEPAEKKASAKATKSPKKA

SEQ ID NO: 25013 - protein, 153 aa, Curcuma longa
METSGAGGGKVKKGAAGRRTGGPKKKAVSRSVKAGLQFPVGRIGRFLKKGRYSQRVGSGAPVYLAAVLEYLAAEVLELAGNAARDNKKNRIIPRHVLLAIRNDEELGKLLAGVTIAHGGVLPNINPVLLPKKTAAAKEPKSPSKATKSPKKTA

SEQ ID NO: 25014 - protein, 152 aa, Echinochloa colona
MDAGAAKVKKAAAGRKLGGGPKKKPVSRSVKAGLQFPVGRIGRYLKKGRYAQRVGTGAPVYLAAVLEYLAAEVLELAGNAARDNKKNRIIPRHVLLAIRNDEELGRLLAGVTIAHGGVLPNINPVLLPKKAAEKAEKAPKSPKKAAAKSPKK

SEQ ID NO: 25015 - protein, 152 aa, Lupinus angustifolius
MDTATGKLKKGAGGRKGGGPRKKSVTRSVKAGLQFPVGRIGRYLKKGRYAQRVGTGAPVYLAAVLEYLAAEVLELAGNAARDNKKNRIIPRHLLLAVRNDEELGKLLAGVTIAHGGVLPNINPVLLPKKNEKVASAKEPKSPSKATKSPKKA

SEQ ID NO: 25016 - protein, 152 aa, Aquilegia formosa
MEATGGKTKKGAAGRKAGGPKKKSVSRSVKAGLQFPVGRLGRYLKKGRYAQRVGSGAPVYLAAVLEYLAAEVLELAGNAARDNKKNRIIPRHVLLAIRNDEELGKLLSGVTIAHGGVLPNINPVLLPKKSEKVANKEPKSPSKTATKSPKKA

SEQ ID NO: 25017 - protein, 150 aa, Panax ginseng
METGGKLKKGAAGRKGGGPKKKPVSRSVKAGLQFPVGRIGRYLKKGRYAQRVGTGAPVYLAAVLEYLAAEVLELAGNAARDNKKNRIIPRHLLLAVRNDEELGKLLAGVTIAHGGVLPNINPVLLPKKSEKAAKEPTKSPSKATKSPKKA

SEQ ID NO: 25018 - protein, 151 aa, Nicotiana benthamiana
MDTSGKAKKGAAGRRGGGPKKKPVTRSVRAGLQFPVGRIGRYLKKGRYAQRVGTGAPVYLAAVLEYLAAEVLELAGNAARDNKKNRIIPRHVLLAVRNDEELGKLLAGVTIAHGGVLPNINPILLPKKTGGDKAGKEPKSPSKTTKSPKKA

SEQ ID NO: 25019 - protein, 151 aa, Tabernaemontana elegans
MESAGGKLKKGAAGRKGGGPKKKPVSRSTRAGLQFPVGRIGRYLKKGRYSERVGTGAPVYMAAVLEYLAAEVLELAGNAARDNKKNRIIPRHVLLAVRNDEELGKLLAGVTIAHGGVLPNINPVLLPKKNEKAAKEPTKSPAKATKSPKKA

SEQ ID NO: 25020 - protein, 151 aa, Vinca minor
MEGAGGKVKKGAAGRRGGGPKKKPVTRSTRAGLQFPVGRIGRYLKKGRYSQRVGTGAPVYLAAVLEYLAAEVLELAGNAARDNKKNRIIPRHVLLAVRNDEELGKLLAGVTIAHGGVLPNINPVLLPKKNEKAGKEPAKSPAKATKSPKKA

SEQ ID NO: 25021 - protein, 149 aa, Phaseolus vulgaris
MDTTGKIKKGAGGRKGGGPKKKAVSRSVKAGLQFPVGRIGRFLKKGRYAQRVGAGAPVYLAAVLEYLAAEVLELAGNAARDNKKNRIIPRHVLLAVRNDEELGKLLSGVTIAHGGVLPNINPVLLPKKSEKAAKEPKSPSKATKSPKKA

SEQ ID NO: 25022 - protein, 150 aa, Cichorium intybus
METSGKVKKGAAGRKAGGPKKKPVTKSVKAGLQFPVGRIGRYIKKGRYAKRVGTGAPVYLAAVLEYLAAEVLELAGNAARDNKKTRIIPRHVLLAVRNDEELGKLLAGVTIAHGGVLPNINPILLPKKSLEKATKEPKSPAKSAKSPKKA

SEQ ID NO: 25023 - protein, 151 aa, Linum usitatissimum
MDAGSTKVKKGAAGRKIGGPKKKPVSRSVKAGLQFPVGRIGRYLKKGRYAKRVGTGAPVYLAAVLEYLAAEVLELAGNAARDNKKNRIIPRHVLLAIRNDEELGKLLAGVTIAHGGVLPNINPVLLPKKSAAKEPAEKKSPAKATKSPKKA

SEQ ID NO: 25024 - protein, 149 aa, Acacia harpophylla
MDAGGKLKKGAGGRRGGGPKKKPVSRSVKAGLQFPVGRIGRYLKKGRYSQRVGTGAPVYLAAVLEYLAAEVLELAGNAARDNKKNRIIPRHVLLAVRNDEELGKLLAGVTIAHGGVLPNINPVLLPKKAERATTESKSPSKATKSPKKA

SEQ ID NO: 25025 - protein, 149 aa, Amorphophallus konjac
MDASGKVKKGAAGRKGGGPKKKPVSRSVKAGLQFPVGRIGRYLKKGRYAQRLGTGAPVYLAAVLEYLAAEVLELAGNAARDNKKNRIIPRHVLLAIRNDEELGKLLTGVTIAHGGVLPNINPVLLPRRGEKAAKEPVSPSKATKSPKRA

SEQ ID NO: 25026 - protein, 150 aa, Fagus grandifolia
MDTGGKVKRGAAGRKGGGPKKKPVSRSVKAGLQFPVGRIGRYLKKGRYSQRVGTGAPVYLAAVLEYLAAEVLELAGNAARDNKKNRIIPRHVLLAVRNDEELGKLLAGVTIAHGGVLPNINPVLLPKKTEKAAAKEPKSPARATKSPKKA

SEQ ID NO: 25027 - protein, 149 aa, Cicer arietinum
MEASTKTKKGAGGRKGGGPRKKSVTRSIRAGLQFPVGRIGRYLKKGRYAQRVGTGAPVYLAAVLEYLAAEVLELAGNAARDNKKNRIIPRHVLLAVRNDEELGKLLAGVTIAHGGVLPNINPILLPKKTEKAAKELPSPSKAKKSPKKA

SEQ ID NO: 25028 - protein, 150 aa, Cichorium intybus
MEAGTKVKKGAAGRKAGGPKKKPVSRSVKAGLQFPVGRLGRYLKKGQYAKRVGTGAPVYLAAVLEYLAAEVLELAGNAARDNKKTRIIPRHVLLAVRNDEELGKLLSGVTIAHGGVLPNINPVLLPKKALDKATKEPKSPSKATKSPKKA

SEQ ID NO: 25029 - protein, 150 aa, Trifolium pratense
MDTSPKSKKGAGGRKGGGPRKKSVTRSTRAGLQFPVGRIGRYLKKGRYAQRIGTGAPVYLAAVLEYLAAEVLELAGNAARDNKKNRIIPRHVLLAVRNDEELGKLLAGVTIAHGGVLPNINPILLPKKSERTAAKEPKSPSKAGKSPKKA

SEQ ID NO: 25030 - protein, 149 aa, Epimedium sagittatum
METSGKAKKGAAGRKMGGPKKKSVPRSVKAGLQFPVGRIGRYLKKGRYAKRVGSGAPVYLAAVLEYLAAEVLELAGNAAKDNKKSRIIPRHVLLAIRNDEELGKLLGGVTIAHGGVLPNINPVLLPKKTEKSSQEPKSPKKAAKSPKKA

SEQ ID NO: 25031 - protein, 149 aa, Eucalyptus grandis
METGGKLKKGAGGRKGGGPKKKPVSRSVKAGLQFPVGRIGRYLKKGRYSQRVGTGAPVYLAAVLEYLAAEVLELAGNAARDNKKNRIIPRHVLLAVRNDEELGKLLAGVTIAHGGVLPNINPVLLPKKTEKATKEPKSPSKATKSPKKA

SEQ ID NO: 25032 - protein, 150 aa, Fagopyrum esculentum
MDTTTKVKKGVAGRKAGGPKKKSVTRSVKAGLQFPVGRIGRYLKNGRYARRVGSGAPVYLAAVLEYLAAEVLELAGNAARDNKKTRIIPRHLLLAVRNDEELGKLLSGVTIAHGGVLPNINPVLLPKKTAEKAPKEPKSPSKAAKSPKKA

SEQ ID NO: 25033 - protein, 150 aa, Fagopyrum esculentum
MDASSKGKKGAAGRKAGGPKKKSVSRSIKAGLQFPVGRIGRYLKNGRYARRVGSGAPVYLGAVLEYLAAEVLELAGNAARDNKKTRIIPRHLLLAVRNDEELGKLLNGVTIAHGGVLPNINPVLLPKKTAEKAPKETKSPSKAKKSPKKA

SEQ ID NO: 25034 - protein, 150 aa, Lactuca sativa
MDAGTKVKKGAAGRKAGGPKKKPVSRSVKAGLQFPVGRLGRFLKKGQYAKRVGSGAPVYLAAVLEYLAAEVLELAGNAARDNKKTRIIPRHVLLAVRNDEELGKLLSGVTIAHGGVLPNINPVLLPKKALDKATKEPKSPSKATKSPKKA

SEQ ID NO: 25035 - protein, 151 aa, Arachis hypogaea
MDSPAVKGKKGAAGRRGGGPKKKSVSKSVKAGLQFPVGRIGRYLKKGRYAQRVGSGAPVYLAAVLEYLAAEVLELAGNAARDNKKNRIIPRHVLLAVRNDEELGKLLAGVTIAHGGVLPNINPVLLPKKSQTAAAKEPKSPSKGTKSPKKA

SEQ ID NO: 25036 - protein, 149 aa, Cajanus cajan
MDTAGKIKKGAGGRKGGGPKKKPVTRSVKAGLQFPVGRIGRYLKKGRYAQRVGTGAPVYLAAVLEYLAAEVLELAGNAARDNKKNRIIPRHVLLAVRNDEELGKLLAGVTIAHGGVLPNINPVLLPKKTQAAAKEPKSPSKATKSPKKA

SEQ ID NO: 25037 - protein, 152 aa, Chenopodium quinoa
MDSTTGGKAKKGAAGRKGGGPKKKSVTRSVKAGLQFPVGRIGRYLKKGRYAQRVGSGAPVYLAAVLEYLAAEVLELAGNAARDNKKNRIIPRHVLLAVRNDDELGKLLSGVTIAHGGVLPNINPVLLPKKTGDKAAKDVKPSPKGVKSPKKA

SEQ ID NO: 25038 - protein, 149 aa, Scabiosa columbaria
METGGKGKKGAGGRKGGGPRKKSVTRSVKAGLQFPVGRIGRYLKKGRYSQRVGTGAPVYLAAVLEYLAAEVLELAGNAARDNKKTRIIPRHVLLAVRNDEELGKLLAGVTIAHGGVLPNINPILLPKKAERAASEPKSPKATKSPKKAA

SEQ ID NO: 25039 - protein, 156 aa, Lupinus angustifolius
MDTGAGKSKKGAAGRKGGGPRKKAVTRSIRAGLQFPVGRIGRYLKKGRYAQRVGTGAPVYLAAVLEYLAAEVLELAGNAARDNKKNRIIPRHVLLAVRNDEELGKLLAGVTIAHGGVLPNINPVLLPKKTGASSSASSAKEPKSPSKAAKSPKKAA

SEQ ID NO: 25040 - protein, 149 aa, Ambrosia trifida
METTGKAKKGAAGRKAGGPRKKAVTRSVKAGLQFPVGRIGRYLKHGRYAKRVGTGAPVYLAAVLEYLAAEVLELAGNAARDNKKNRIIPRHVLLAIRNDDELGKLLSGVTIAHGGVLPNINPVLLPKKSAAASKEAKSPAKAAKSPKKA

SEQ ID NO: 25041 - protein, 149 aa, Chrysanthemum coronarium
MEGIGKVKKGAAGRKAGGPRKKSVTRSVKAGLQFPVGRIGRYLKKGRYAKRVGTGAPVYLAAVLEYLAAEVLELAGNAARDNKKNRIIPRHVLLAIRNDEELGKLLSGVTIAHGGVLPNINPVLLPKKTAAKESTPKSPSKAGKSPKKA

SEQ ID NO: 25042 - protein, 149 aa, Chrysanthemum coronarium
MEETGKVKKGAAGRKAGGPRKKSVTRSVKAGLQFPVGRMGRYLKKGRYALRVGTGAPVYLAAVLEYLAAEVLELAGNAARDNKKTRIIPRHVLLAIRNDEELGKLLSGVTIAHGGVLPNINPVLLPKKTAAKESTPKSPSKAGKSPKKA

SEQ ID NO: 25043 - protein, 149 aa, Cyamopsis tetragonoloba
MDTGAKVKKGAGGRKGGGPKKKPVTRSVRAGLQFPVGRIGRYLKKGRYAQRVGTGAPVYLAAVLEYLAAEVLELAGNAARDNKKNRIIPRHVLLAVRNDEELGKLLAGVTIAHGGVLPNINPVLLPKKTNQATKEPKSPSKATKSPKKA

SEQ ID NO: 25044 - protein, 149 aa, Phalaenopsis aphrodite
MDATSKIKKGAGGRKGGGPKKKPVSRSVRAGLQFPVGRIGRYLKKGRYAHRVGTGAPVYLAAVLEYLAAEVLELAGNAARDNKKNRIIPRHVLLAIRNDDELGKLLGGVTIAHGGVLPNINPVLLPKKTAAKEPKESSKAAKSPKKAAA

SEQ ID NO: 25045 - protein, 149 aa, Scabiosa columbaria
MDTGGKSKKGAAGRKLGGPKKKPVSRSVKSGLQFPVGRIGRYLKKGRYAQRVGTGAPVYLAAVLEYLAAEVLELAGNAARDNKKNRIIPRHVLLAIRNDEELGKLLSGVTIAHGGVLPNINPILLPKKTAAKEPKSPSKATKSPKKAAA

SEQ ID NO: 25046 - protein, 147 aa, Ambrosia trifida
MESTGKAKKGAGGRKGGPRKKAVTRSVKAGLQFPVGRIGRYLKKGRYAKRVGTGAPVYLAAVLEYLAAEVLELAGNAARDNKKNRIIPRHVLLAIRNDEELGKLLAGVTIAHGGVLPNINPVLLPKKTAAKEPKSPSKAAKSPKKAK

SEQ ID NO: 25047 - protein, 147 aa, Triphysaria pusilla
MDASAKVKKGAGGRKAGGPKKKPVSRSVKAGLQFPVGRIGRYLKKGRYSERVGSGAPVYMAAVLEYLAAEVLELAGNAARDNKKNRIIPRHVLLAVRNDEELGKLLAGVTIAHGGVIPNINPVLLPKKAAEKASKSPAKATKSPKKA

SEQ ID NO: 25048 - protein, 161 aa, Cynodon dactylon
MDSTGTGAGGKVKKGAAGRKAGGPRKKGVSRSVKAGLQFPVGRIGRYLKNGRYARRVGSGAPVYLAAVLEYLAAEVLELAGNAARDNKKTRIVPRHVLLAIRNDEELGKLLSGVTIAHGGVLPNINPVLLPKKTAEKASTGGSKEAKSPKKAAAKKSPKKA

SEQ ID NO: 25049 - protein, 148 aa, Medicago truncatula
MDASTKTTKKGAGGRKGGGPRKKSVTRSIRAGLQFPVGRIGRYLKKGRYAQRVGTGAPVYLAAVLEYLAAEVLELAGNAARDNKKNRIIPRHVLLAVRNDEELGKLLNGVTIAHGGVLPNINPILLPKKTEKAVSKEPKKAGKSPKKA

SEQ ID NO: 25050 - protein, 155 aa, Triticum aestivum
MDVSGTGAGAKGKKGAAGRKAGGPRKKSVTRSVKAGLQFPVGRIGRYLKKGRYAQRVGTGAPVYLAAVLEYLAAELLELAGNAAKDNKKSRIIPRHLLLAVRNDEELGKLLAGVTIAHGGVIPKINPVLLPKRTAEKEGKEPKKTTKSPKKATKA

SEQ ID NO: 25051 - protein, 155 aa, Triticum aestivum
MDASATVATGKGKKGVAGRKAGGPRKKSVSRSVKAGLQFPVSRIGRFLKKGRYAQRVGSGAPVYLAAVLEYLAAELLELAGNAAKDNKKSRIIPRHLLLAIRNDEELGKLLAGITIAHGGVIPNINPVLLPKKTAEKSTKEPKSPKKTAKSPKKA

SEQ ID NO: 25052 - protein, 150 aa, Cicer arietinum
MEASTKTKKGAGGRKGGGPRKKSVTRSIRAGLQFPVGRIGRYLKKGRYAQRVGTGAPVYLAAVLEYLAAEVLELAGNAARDNKKNRIIPRHVLLAVRNDEELGKLLSGVTIAHGGVLPNINPILLPKKTEKAAKEPKSPSKAVKSPKKAA

SEQ ID NO: 25053 - protein, 151 aa, Chrysanthemum coronarium
MEGTGKIKKGAAGRKAGGPRKKSVTRSVKAGLQFPVGRIGRYLKKGRYAKRVGTGAPVYLAAVLEYLAAEVLELAGNAARDNKKTRIIPRHVLLAIRNDEELGKLLSGVTIAHGGVLPNINPVLLPKKTAAKEATPKSPSKVGKSPKKAAA

SEQ ID NO: 25054 - protein, 151 aa, Chrysanthemum coronarium
MEGTGKIKKGAAGRKAGGPRKKSVTRSVKAGLQFPVGRIGRYLKKGRYALRVGTGAPVYLAAVLEYLAAEVLELAGNAARDNKKTRIIPRHVLLAIRNDEELGKLLSGVTIAHGGVLPNINPVLLPKKTAAKESTPKSPSKAGKSPKKAAA

SEQ ID NO: 25055 - protein, 151 aa, Trifolium pratense
MDASTKTKKGAGGRKGGGPRKKSVTRSTRAGLQFPVGRIGRYLKKGRYAQRVGTGAPVYLAAVLEYLAAEVLELAGNAARDNKKNRIIPRHVLLAVRNDEELGKLLAGVTIAHGGVLPNINPILLPKKTDRSTTASKEPKSPKAKKSPKKA

SEQ ID NO: 25056 - protein, 143 aa, Pennisetum glaucum
KGAAGRKTGGPRKKSVTRSVKAGLQFPVGRIGRYLKKGRYAQRVGSGAPVYLAAVLEYLAAEVLELAGNAARDNKKTRIVPRHVLLAIRNDEELGKLLSGVTIAHGGVLPNINPVLLPKKVAEKAAAKEAKSPKKAAKSPKKA

SEQ ID NO: 25057 - protein, 151 aa, Petroselinum crispum
METGGKVKKGAAGRKFGGGGPRKKSVTRSVKAGLQFPVGRIGRYLKKGRYAQRVGTGAPVYLAAVLEYLAAEVLELAGNAARDNKKNRIIPRHVLLAVRNDEELGKLLAGVTIAHGGVLPNINPVLLPKKSEKAAAKEPTKATKSPKKAAA

SEQ ID NO: 25058 - protein, 144 aa, Silene vulgaris
KKGAAGRKAGGPKKKSVTRSIKAGLQFPVGRIGRYLKKGRYAQRVGSGAPVYLAAVLEYLAAEVLELAGNAARDNKKNRIIPRHVLLAIRNDEELGKLLAGVTIAHGGVLPNINPILLPKKTAEKSPKEPKSPSKAAKSPKKAA

SEQ ID NO: 25059 - protein, 149 aa, Theobroma cacao
MDTGGKVKKGAGGRKGGGPKKKPVSRSVKAGLQFPVGRIGRYLKKGRYSQRVGTGAPVYMAAVLEYLAAEVLELAGNAARDNKKNRIIPRHVLLAVRNDEELGKLLAGVTIAHGGVLPNINPVLLPKKTDKATKEPKSPSKATKSLKKA

SEQ ID NO: 25060 - protein, 149 aa, Acacia harpophylla
MDSTVKVKKGAGGRKGGGPKKKPVSRSVKAGLQFPVGRIGRYLKKGRYSQRVGTGAPVYMAAVLEYLAAEVLELAGNAARDNKKNRIIPRHVLLAVRNDEELGKLLAGVTIAHGGVLPNINPVLLPKKTEKATKEPKSPSKATKSPKKA

SEQ ID NO: 25061 - protein, 151 aa, Amaranthus tuberculatus
MDSTGGKSKKGAAGRKGGGPKKKPVSRSVKAGLQFPVGRIGRYLKKGRYAQRVGTGAPVYLAAVLEYLAAEVLELAGNAARDNKKNRIIPRHVLLAVRNDDELGKLLAGVTIAHGGVLPNINPVLLPKKTTEKSPKEPKSPSKGTKSPKKA

SEQ ID NO: 25062 - protein, 150 aa, Arnica chamissonis
METGGKLKKGAAGRKAGGPKKKPVTRSVKAGLQFPVGRIGRYLKVGRYAKRVGTGAPVYLAAVLEYLAAEVLELAGNAARDNKKTRIIPRHVLLAIRNDDELGKLLSGVTIAHGGVLPNINPVLLPKRVHDKAAKEPKSPSKSTKSPKKA

SEQ ID NO: 25063 - protein, 150 aa, Vaccinium corymbosum
METGGKAKKGAAGRRGGGPKKKPVSRSVKAGLQFPVGRIGRYLKKGRYAQRVGTGAPVYLAAVLEYLAAEVLELAGNAARDNKKNRIVPRHLLLAIRNDEELGKLLAGVTIAHGGVLPNINPILLPKKSEKAAAKEPKSPSKATKSPKKA

SEQ ID NO: 25064 - protein, 143 aa, Chrysanthemum coronarium
KKGAAGRKAGGPRKKSVTRSVKAGLQFPVGRIGRYLKKGRYAKRVGTGAPVYLAAVLEYLAAEVLELAGNAARDNKKTRIIPRHVLLAIRNDEELGKLLSGVTIAHGGVLPNINPVLLPKKTVAKEPTPKSPSKAAKSPKKAA

SEQ ID NO: 25065 - protein, 150 aa, Chrysanthemum coronarium
MEGTGKIKKGAAGRKAGGPRKKSVTRSVKAGLQFPVGRIGRYLKKGRYAKRVGTGAPVYLAAVLEYLAAEVLELAGNAARDNKKTRIIPRHVLLAIRNDEELGKLLSGVTIAHGGVLPNINPVLLPKKTAAKEPTPKSPSKVGKSPKKAA

SEQ ID NO: 25066 - protein, 150 aa, Chrysanthemum coronarium
MEGTGKVKKGAAGRKAGGPRKKSVTRSVKAGLQFPVGRIGRYLKKGRYAKRVGTGAPVYLAAVLEYLAAEVLELAGNAARDNKKTRIIPRHVLLAIRNDEELGKLLSGVTIAHGGVLPNINPVLLPKKTAAKEPTPKSPSKVGKSPKKAA

SEQ ID NO: 25067 - protein, 150 aa, Chrysanthemum coronarium
MEGTGKIKKGAAGRKAGGPRKKSVTRSVKAGLQFPVGRIGRYLKKGRYAKRVGTGAPVYLAAVLEYLAAEVLELAGNAARDNKKNRIIPRHVLLAIRNDEELGKLLSGVTIAHGGVLPNINPVLLPKKTAAKESATPKSPSKAGKSPKKA

SEQ ID NO: 25068 - protein, 150 aa, Cichorium intybus
MEAGTKVKKGAAGRKAGGPKKKPVSRSVKAGLQFPVGRLGRYLKKGQYAKRVGTGAPVYLAAVLEYLAAEVLELAGNAARDNKKSRIIPRHVLLAVRNDEELGKLLSGVTIAHGGVLPNINPVLLPKKALDKATKEPKSPSKATKSPKKA

SEQ ID NO: 25069 - protein, 149 aa, Eucalyptus grandis
MESLGKPKKGAGGRKGGGPKKKPVSRSVKAGLQFPVGRIGRYLKKGRYSQRVGTGAPVYLAAVLEYLAAEVLELAGNAARDNKKNRIIPRHVLLAVRNDEELGKLLAGVTIAHGGVLPNINPVLLPKKTEKATKEPKSPSKATKSPKKA

SEQ ID NO: 25070 - protein, 149 aa, Platanus occidentalis
MEATGKVKKGAGGRKGGGPKKKPVSRSVKAGLQFPVGRIGRYLKKGRYSQRVGTGAPVYMAAVLEYLAAEVLELAGNAARDNKKNRIIPRHVLLAVRNDEELGKLLSGVTIAHGGVLPNINPVLLPKKSEKAAKEPKSPSKAIKSPKKA

SEQ ID NO: 25071 - protein, 149 aa, Platanus occidentalis
METTGKVKKGAGGRKGGGPKKKPVSRSVKAGLQFPVGRIGRYLKKGRYSQRVGTGAPVYLAAVLEYLAAEVLELAGNAARDNKKNRIIPRHVLLAVRNDEELGKLLSGVTIAHGGVLPNINPVLLPKKSDKAAKEPKSPSKAVKSPKKA

SEQ ID NO: 25072 - protein, 150 aa, Triphysaria pusilla
METGGKVKKGAAGRKAGGPKKKSVTRSVKAGLQFPVGRIGRFLKKGRYAQRVGSGAPVYLAAVLEYLAAEVLELAGNAARDNKKSRIIPRHLLLAVRNDEELGKLLAGVTIAHGGVIPNINPVLLPKKSDKVAEKAPKSPSKATKSPKKA

SEQ ID NO: 25073 - protein, 149 aa, Tripterygium wilfordii
MDAGGKAKKGAGGRKGGGPKSKPVSRSVKAGLQFPVGRIGRYLKKGRYSQRVGSGAPVYLAAVLEYLAAEVLELAGNAARDNKKNRIIPRHLLLAVRNDEELGKLLSGVTIAHGGVLPNINPVLLPKKTDKASKEPKSPSKATKSPKKA

SEQ ID NO: 25074 - protein, 148 aa, Ambrosia trifida
MDGAGKAKKGAGGRKGGPRKKAVTRSVKAGLQFPVGRIGRYLKKGRYAKRVGTGAPVYLAAVLEYLAAEVLELAGNAARDNKKNRIIPRHVLLAIRNDEELGKLLAGVTIAHGGVLPNINPILLPKKTAAKEPKSPAKATKSPKKAAA

SEQ ID NO: 25075 - protein, 144 aa, Chrysanthemum coronarium
KVKKGAAGRKAGGPRKKSVTRSVKAGLQFPVGRIGRYLKKGRYALRVGTGAPVYLAAVLEYLAAEVLELAGNAARDNKKTRIIPRHVLLAIRNDEELGKLLSGVTIAHGGVLPNINPVLLPKKTAAKESTPKSPSKAGKSPKKA

SEQ ID NO: 25076 - protein, 149 aa, Chrysanthemum coronarium
MEETGKVKKGAAGRKAGGPRKKSVTRSVKAGLQFPVGRIGRYMKKGRYALRVGTGAPVYLAAVLEYLAAEVLELAGNAARDNKKTRIIPRHVLLAIRNDEELGKLLSGVTIAHGGVLPNINPVLLPKKTAAKESTPKSPSKAGKSPKKA

SEQ ID NO: 25077 - protein, 149 aa, Cyamopsis tetragonoloba
MDTGAKVKKGASGRKGGGPKKKPVTRSARAGLQFPVGRIGRYLKKGRYSQRVGTGAPVYLAAVLEYLAAEVLELAGNAARDNKKNRIIPRHVLLAVRNDEELGKLLAGVTIAHGGVLPNINPVLLPKKTNQATKEPKSPSKATKSPKKA

SEQ ID NO: 25078 - protein, 147 aa, Echinacea purpurea
GGAKAKKGAGGRKGGGPKKKPVSRSVKAGLQFPVGRLGRYLKKGRYAQRVGTGAPVYLAAVLEYLAAEVLELAGNAARDNKKNRIIPRHVLLAVRNDEELGKLLAGVTIAHGGVLPNINPVLLPKKSATKEPTKSPSKATKSPKKAA

SEQ ID NO: 25079 - protein, 150 aa, Arachis hypogaea
MDSPAGKTKKGAAGRRGGGPKRKPVSRSVKAGLQFPVGRIGRYLKKGRYSQRVGTGAPVYLAAVLEYLAAEVLELAGNAARDNKKNRIIPRHVLLAVRNDEELGKLLAGVTIAHGGVLPNINPVLLPKKSQTATKEPKSPSKGTKSPKKA

SEQ ID NO: 25080 - protein, 149 aa, Phalaenopsis aphrodite
MDSGGKVKKGAGGRKGGGPKKKAVSRSVRAGLQFPVGRIGRYLKNGRYARRVGTGAPVYLAAVLEYLAAEVLELAGNAARDNKKNRIIPRHVLLAIRNDDELGKLLGKVTIAHGGVLPNINPVLLPKKALEKEPKETVKKAKKSPKKAA

SEQ ID NO: 25081 - protein, 148 aa, Cichorium intybus
MEGAGKTKKGAGGRKGGGPRKKAVARSVKAGLQFPVGRIGRYLKKGRYAQRVGSGAPVYLAAVLEYLAAEVLELAGNAARDNKKTRIIPRHLLLAIRNDEELGKLLGGVTIAHGGVLPNINPVLLPKKTAAKEPSTPSKAAKSPKKAK

SEQ ID NO: 25082 - protein, 153 aa, Cucurbita pepo
MDSSAKLKKGAGGRKGGGPKKKPVSRSVKAGLQFPVGRIGRYLKNGRYARRVGTGAPVYLAAVLEYLAAEVLELAGNAARDNKKNRIIPRHVLLAIRNDEELGKLLAGVTIAHGGVLPNINPVLLPKKSEKAATKEPKSPSKASKATKSPKKA

SEQ ID NO: 25083 - protein, 148 aa, Capsicum annuum
MESTGKAKKGAAGRSRGGPKKKPVSRSIKAGLQFPVGRIGRFLKKGRYAHRVGSGAPVYLAAVLEYLAAEVLELAGNAARDNKKTRIIPRHLLLAVRNDEELGKLLAGVTIAHGGVLPNINPVLLPKKTGAEKAPKSPSKATKSPKKA

SEQ ID NO: 25084 - protein, 152 aa, Daucus carota
MEGGGKLKKGAAGRKGDGPRKKSVTRSVKAGLQFPVGRIGRYLKKGRYAKRVGTGAPVYLAAVLEYLAAEVLELAGNAARDNKKSRIIPRHLLLAIRNDEELGKLLAGVTIAHGGVLPNINPVLLPKKSEKAAAAKEPTKSPSKAAKSPKKA

SEQ ID NO: 25085 - protein, 152 aa, Euphorbia peplus
MDAGTKVKKGAAGRKGGGPKKKPVSRSVKAGLQFPVGRIGRFLKKGRYAQRVGSGAPVYMAAVLEYLAAEVLELAGNAARDNKKNRIIPRHVLLAVRNDEELGKLLAGVTIAHGGVLPNINPVLLPKKSEKAAATTKEPKSPAKATKSPKKT

SEQ ID NO: 25086 - protein, 153 aa, Lippia dulcis
MDASGKPKKGAGGRKGGGPKKKPVSRSVKAGLQFPVGRIGRYLKKGRYAQRVGTGAPVYMAAVLEYLAAEVLELAGNAARDNKKNRIIPRHVLLAVRNDEELGKLLAGVTIAHGGVLPNINPVLLPKKSEKSAAAEKKPAKSPTKATKSPKKA

SEQ ID NO: 25087 - protein, 156 aa, Secale cereale
MEASGAAAKGKKGAAGRKAGGPRKKSVTRSVKAGLQFPVGRIGRYLKKGRYAQRVGTGAPVYLAAVLEYLAAELLELAGNAAKDNKKSRIIPRHLLLAVRNDEELGKLLAGVTIAHGGVIPKINPVLLPKKTAEKSPKEPKSPKKAAKSPKKAAKA

SEQ ID NO: 25088 - protein, 153 aa, Vinca minor
METGGKVKKGAAGRKAGGPKKKSVTRSTRAGLQFPVGRIGRYLKKGRYSQRVGTGAPVYMAAVLEYLAAEVLELAGNAARDNKKNRIIPRHVLLAIRNDEELGKLLAGVTIAHGGVLPNINPILLPKKTDKAGATKEPKSSAKAAKSPKKAAA

SEQ ID NO: 25089 - protein, 144 aa, Amsonia hubrichtii
MESGGGKLKKGAAGRKGGGPKKKPVSRSSRAGLQFPVGRIGRFLKKGRYSERLGTGAPVYMAAVLEYLAAEVLELAGNAARDNKKNRIIPRHVLLAVRNDEELGKLLAGVTIAHGGVLPNINPVLLPKKNEKAAKETTKSPKKA

SEQ ID NO: 25090 - protein, 140 aa, Cirsium arvense
MDATGKVKKGAAGRKAGGPRKKSVTRSVKAGLQFPVGRIGRYLKKGRYAQRVGTGAPVYLAAVLEYLAAEVLELAGNAARDNKKNRIIPRHVLLAIRNDEELGKLLAGVTIAHGGVLPNINPILLPKKTATKEPKSPSKA

SEQ ID NO: 25091 - protein, 147 aa, Cocos nucifera
METGGKIKKGAGGRRGGGPKKKPVSRSVKAGLQFPVGRIGRYLKKGRYSQRVGTGAPVYLAAVLEYLAAEVLELAGNAARDNKKNRIIPRHVLLAVRNDEELGKLLAGVTIAHGGVLPNINPVLLPKKTASKEPKSPSKATKSPKKA

SEQ ID NO: 25092 - protein, 147 aa, Flaveria ramosissima
MEATGKAKKGAGGRKAGGPRKKAVTRSVKAGLQFPVGRIGRYLKHGRYAKRVGTGAPVYLAAVLEYLAAEVLELAGNAARDNKKNRIIPRHVLLAIRNDDELGKLLSGVTIAHGGVLPNINPVLLPKKTAAKEPKSPSKATKSPKKA

SEQ ID NO: 25093 - protein, 147 aa, Guizotia abyssinica
METTGKAKKGAAGRKAGGPRKKAVTRSVKAGLQFPVGRIGRYLKNGRYAKRVGTGAPVYLAAVLEYLAAEILELAGNAARDNKKNRIIPRHVLLAIRNDDELGKLLSGVTIAHGGVLPNINPVLLPKSAAAKEAKSPAKATKSPKKA

SEQ ID NO: 25094 - protein, 147 aa, Primula obconica
MESVGKAKKGAGGRKGGGPKKKSVTRSSKAGLQFPVGRIGRYLKKGRYSKRVGSGAPVYLAAVLEYLAAEVLELAGNAARDNKKNRIVPRHVLLAIRNDEELGKLLAGVTIAHGGVLPNINPILLPKKTKEPAAKSPSKATKSPKKA

SEQ ID NO: 25095 - protein, 155 aa, Secale cereale
MDASATVAAGKGKKGVAGRKAGGPRKKSVSRSVKAGLQFPVSRIGHYLKKGRYAQRVGTGAPVYLAAVLEYLGAELLELAGNAAKDNKKSRIIPRHLLLAVRNDEELGKLLAGVTIAHGGVVPKINPVLLPKKTAEKATKEPKSPKKTPKSPKKA

SEQ ID NO: 25096 - protein, 155 aa, Secale cereale
  Sequence also found in Organisms: Triticum aestivum
MDASATVATGKGKKGAAGRKAGGPRKKSVSRSVKAGLQFPVSRIGRFLKKGRYAQRVGSGAPVYLAAVLEYLAAELLELAGNAAKDNKKSRIIPRHLLLAVRNDQELGRLLAGVTIAHGGVIPNINPVLLPKKTAEKSPKEPKSPKKTAKSPKKA

SEQ ID NO: 25097 - protein, 155 aa, Secale cereale
MDASATVAAGKGKKGAAGRKAGGPRKKSVSRSVKAGLQFPVSRIGRFLKKGRYAQRVGSGAPVYLAAVLEYLAAELLELAGNAAKDNKKSRIIPRHLLLAVRNDQELGRLLAGVTIAHGGVIPNINPVLLPKKTAEKSPKEPKSPKKTAKSPKKA

SEQ ID NO: 25098 - protein, 145 aa, Silene vulgaris
KKGAAGRKAGGPKKKSVTRSIKAGLQFPVGRIGRYLKKGRYAQRVGSGAPVYLAAVLEYLAAEVLELAGNAARDNKKNRIIPRHVLLAIRNDEELGKLLAGVTIAHGGVLPNINPILLPKKTAEKSPKEPKSPSKAAKSPKKAAA

SEQ ID NO: 25099 - protein, 150 aa, Trigonella foenum-graecum
MDASTKTKKGAGGRKGGPRKKAVTRSTRAGLQFPVGRIGRYLKKGRYAQRVGTGAPVYLAAVLEYLAAEVLELAGNAARDNKKNRIIPRHLLLAVRNDEELGKLLAGVTIAHGGVLPNINPVLLPKKNEKAATATASKSPAKATKSPKKA

SEQ ID NO: 25100 - protein, 150 aa, Amsonia hubrichtii
MDTGGKVKKGAAGRKGGGPKKKPVSRSNRAGLQFPVGRIGRYLKKGRYSERVGSGAPVYMAAVLEYLAAEVLELAGNAARDNKKNRIIPRHVLLAIRNDEELGKLLAGVTIAHGGVLPNINPILLPKKTDKPVKEPKSPSKATKSPKKAA

SEQ ID NO: 25101 - protein, 150 aa, Vaccinium corymbosum
METGGKVKKGAGGRGRGTGPKKPPVTRSVRAGLQFPVGRIGRYLKKGRYAQRVGTGAPVYLAAVLEYLAAEVLELAGNAARDNKKNRIIPRHVLLAIRNDEELGKLLAGVTIAHGGVLPNINPVLLPKKSDKAMKEPKSPSKATKSPKKA

SEQ ID NO: 25102 - protein, 151 aa, Chrysanthemum coronarium
MEGTGKVKKGAAGRKAGGPRKKSVTRSVKAGLQFPVGRIGRYLKKGRYAKRVGTGAPVYLAAVLEYLAAEVLELAGNAARDNKKNRIIPRHVLLAIRNDEELGKLLSGVTIAHGGVLPNINPVLLPKKTAAKEATPKSPSKVGKSPKKAAA

SEQ ID NO: 25103 - protein, 150 aa, Panax ginseng
MDNTGKGKKGAGGRKGGGPRKKSVTRSVKAGLQFPVGRIGRYLKKGRYAQRLGTGAPVYLAAVLEYLAAEVLELAGNAARDNKKNRIIPRHLLLAVRNDEELGKLLGGVTIAHGGVLPNINPVLLPKKTDKATKEPKSPSKAATKSPKKA

SEQ ID NO: 25104 - protein, 150 aa, Sarracenia psittacina
MDATAKVKKGAGGRKGGGPRKKAVTRSVKAGLQFPVGRIGRYLKKGRYSQRVGTGAPVYLAAVLEYLAAEVLELAGNAARDNKKTRIIPRHLLLAVRNDEELGKLLAGVTIAHGGVLPNINPVLLPKKTDKATKEPKSPSKATKSPKKAA

SEQ ID NO: 25105 - protein, 159 aa, Triticum aestivum
MDVSGTGAGAKGKKGAAGRKAGGPRKKSVTRSVKAGLQFPVGRIGRYLKKGRYAQRVGTGAPVYLAAVLEYLAAELLELAGNAAKDNKKSRIIPRHLLLAVRNDEELGKLLAGVTIAHGGVIPKINPVLLPKRTAEKEGKEPKSPKKAAKSPKKADKKA

SEQ ID NO: 25106 - protein, 150 aa, Rosmarinus officinalis
METGGKLKKGAGGRKGGGPKKKPVSRSVKAGLQFPVGRIGRYLKKGRYSQRVGTGAPVYLAAVLEYLAAEVLELAGNAARDNKKNRIIPRHVLLAVRNDEELGKLLAGVTIAHGGVLPNINPVLLPKKSEKVAEKSQKSPSKGTKSPKKA

SEQ ID NO: 25107 - protein, 149 aa, Phaseolus vulgaris
METGGKIKKGAGGRKGGGPKKKPVTRSVRAGLQFPVGRVGRYLKKGRYAKRVGTGAPVYLAAVLEYLAAEVLELAGNAARDNKKNRIIPRHVLLAVRNDEELGKLLSGVTIAHGGVLPNINPILLPKKTDKAVKEPKSPSKATKSPKKA

SEQ ID NO: 25108 - protein, 150 aa, Chrysanthemum coronarium
MEGTGKIKKGAAGRKAGGPRKKSVTRSFKAGLQFPVGRIGRYLKKGRYAKRVGTGAPVYLAAVLEYLAAEVLELAGNAARDNKKNRIIPRHVLLAIRNDEELGKLLSGVTIAHGGVLPNINPVLLPKKTAAKEPTPKSPSKVGKSPKKAA

SEQ ID NO: 25109 - protein, 145 aa, Trifolium pratense
MAEKGAGGRKGGGPRKKSVTRSTRAGLQFPVGRIGRYLKKGRYAQRVGTGAPVYLAAVLEYLAAEVLELAGNAARDNKKNRIIPRHVLLAVRNDEELGKLLAGVTIAHGGVLPNINPVLLPKKNERTAAKEPKSPSKAGKSPKKA

SEQ ID NO: 25110 - protein, 150 aa, Echinacea purpurea
METGGKSKKGAAGRKAGGPKKKSVTRSVKAGLQFPVGRIGRYLKVGRYAKRVGTGAPVYLAAVLEYLAAEVLELAGNAARDNKKNRITPRHVLLAVRNDDELGKLLSGVTIAHGGVLPNINPVLLPKKAHDKAAKEPKSPSKATKSPKKA

SEQ ID NO: 25111 - protein, 149 aa, Euonymus alatus
MDTGGKAKKGAGGRKGGGPKSKPVTRSVKAGLQFPVGRIGRYLKKGRYSQRVGSGAPVYLAAVLEYLAAEVLELAGNAARDNKKNRIIPRHVLLAVRNDEELGKLLSGVTIAHGGVLPNINPVLLPKKTDKASKEPKSPSKATKSPKKA

SEQ ID NO: 25112 - protein, 149 aa, Euonymus alatus
MDTGGKVKKGAGGRKGGGPKSKPVSRSVKAGLQFPVGRIGRYLKKGRYSQRVGSGAPVYLAAVLEYLAAEVLELAGNAARDNKKNRIIPRHVLLAVRNDEELGKLLSGVTIAHGGVLPNINPVLLPKKTDKASKEPKSPSKATKSPKKA

SEQ ID NO: 25113 - protein, 148 aa, Euphorbia peplus
MESANVKKGAGGRKGGGPKKKPVTRSARAGLQFPVGRIGRYLKKGRYAQRVGTGAPVYLAAVLEYLAAEVLELAGNAARDNKKNRIIPRHVLLAIRNDEELGKLLAGVTIAHGGVLPNINPILLPKKTEKATKEPKSPTKATKSPKKA

SEQ ID NO: 25114 - protein, 150 aa, Fagopyrum esculentum
MDGASKSKKGAAGRRGGGPRKKSVSRSIKAGLQFPVGRIGRYLKKGRYAQRVGSGAPIYVAAVLEYLAAEVLELAGNAARDNKKTRIIPRHILLAVRNDEELGKLLSGVTIAHGGVLPNINPILLPKKVAEKAPKEGKSPSKASKSPKKA

SEQ ID NO: 25115 - protein, 150 aa, Lactuca sativa
METSGKVKKGAAGRKAGGPKKKSVSKSVKAGLQFPVGRIGRHIKNGRYAKRVGSGAPIYLAAVLEYLAAEVLELAGNAARDNKKKRIIPRHVLLAVRNDEELGKLLAGVTIAHGGVLPNINPVLLPKKSLETATKEPKSPAKAAKSPKKA

SEQ ID NO: 25116 - protein, 150 aa, Lippia dulcis
METGGKMKKGAGGRKGGGPKKKPVSRSVKAGLQFPVGRIGRYLKKGRYSQRVGTGAPVYMAAVLEYLAAEVLELAGNAARDNKKNRIIPRHVLLAVRNDEELGKLLAGVTIAHGGVLPNINPVLLPKKSEKASEKAAKSPAKATKSPKKA

SEQ ID NO: 25117 - protein, 149 aa, Platanus occidentalis
MEATGKVKKGAGGRKGGGPKKKPVSRSVKAGLQFPVGRIGRYLKKGRYSQRVGTGAPVYMAAVLEYLAAEVLELAGNAARDNKKNRIIPRHVLLAVRNDEELGKLLSGVTIAHGGVLPNINPVLLPKKSEKAAKEPKSPSKAIKSPKKT

SEQ ID NO: 25118 - protein, 150 aa, Helianthus annuus
MEAGGKLKKGAAGRKAGGPKKKPVTRSVKAGLQFPVGRIGRYLKVGRYAKRVGTGAPVYLAAVLEYLAAEVLELAGNAARDNKKNRINPRHVLLAVRNDDELGKLLAGVTIAHGGVLPNINPVLLPKKSHDKAAKEPKSPAKPTKSPKKA

SEQ ID NO: 25119 - protein, 155 aa, Trigonella foenum-graecum
MDASTKAKKGAGGRKGGGPRKKSVTRSIRAGLQFPVGRIGRYLKKGRYAQRVGTGAPVYLAAVLEYLAAEVLELAGNAARDNKKNRIIPRHLLLAVRNDEELGKLLAGVTIAHGGVLPNINPVLLPKKTERAAAAAASKEPKSPKAKAGKSPKKA

SEQ ID NO: 25120 - protein, 150 aa, Triphysaria pusilla
MEATPKAKKGAAGRKAGGPKKKSVTRSVKAGLQFPVGRIGRFLKKGRYAQRVGSGAPVYLAAVLEYLAAEVLELAGNAARDNKKSRIIPRHLLLAVRNDEELGKLLAGVTIAHGGVIPNINPVLLPKKSDKVAEKAPKSPSKATKSPRKA

SEQ ID NO: 25121 - protein, 150 aa, Triphysaria pusilla
MEATPKAKKGAAGRKAGGPKKKSVSRSVKAGLQFPVGRIGRFLKKGRYSQRVGSGAPVYMAAVLEYLAAEVLELAGNAARDNKKSRIIPRHLLLAVRNDEELGKLLAGVTIAHGGVIPNINPVLLPKKSDKVAEKAPKSPSKAAKSPRKA

SEQ ID NO: 25122 - protein, 150 aa, Triphysaria pusilla
MEATPKAKKGAAGRKAGGPKKKSVSRSVKAGLQFPVGRIGRFLKKGRYSQRVGPGAPVYMAAVLEYLAAEVLELAGNAARDNKKSRIIPRHLLLAVRNDEELGKLLAGVTIAHGGVIPNINPVLLPKKSDKVAEKAPKSPSKAAKSPRKA

SEQ ID NO: 25123 - protein, 150 aa, Triphysaria pusilla
METGGKVKKGAAGRKAGGPKKKSVTRSVKAGLQFPVGRIGRFLKKGRYAQRVGSGAPVYLAAVLEYLAAEVLELAGNAARDNKKSRIIPRHLLLAVRNDEELGKLLAGVTIAHGGVIPNINPVLLPKKSDKVAEKAPKSPSKATKSPRKA

SEQ ID NO: 25124 - protein, 149 aa, Tripterygium wilfordii
MDAGGKVKKGAGGRKGGGPKSKPVSRSVKAGLQFPVGRIGRYLKKGRYSERVGSGAPVYLAAVLEYLAAEVLELAGNAARDNKKNRIIPRHVLLAVRNDEELGKLLSGVTIAHGGVLPNINPVLLPKKSDKASKEPKSPSKATKSPKKA

SEQ ID NO: 25125 - protein, 153 aa, Euphorbia peplus
MDTGAKLKKGAGERKGGGPKKKPVSRSVKAGLQFPVGRIGRFLKKGRYAQRVGSGAPVYLAAVLEYLAAEVLELAGNAARDNKKNRIIPRHVLLAVRNDEELGKLLAGVTIAHGGVLPNINPVLLPKKAEKAAAAATKEPKSPAKATKSPKKA

SEQ ID NO: 25126 - protein, 150 aa, Pennisetum glaucum
GKVKKGAAGRKAGGPRKKSVTRSVKAGLQFPVGRIGRYLKKGRYAQRVGSGAPVYLAAVLEYLAAEVLELAGNAARDNKKTRIVPRHVLLAFRNDEELGKLLAGVTIAHGGVLPNINPVLLPKKAAEKVASGGAKEPKSPKKGAKSPKKA

SEQ ID NO: 25127 - protein, 148 aa, Centaurea maculosa
MEGTGKAKKGAGGRKGGGPRKKAVTRSIRAGLQFPVGRIGRYLKNGRYAKRVGTGAPVYLAAVLEYLAAEVLELAGNAARDNKKNRIIPRHVLLAIRNDDELGKLLAGVTIAHGGVLPNINPILLPKKTAAKEPKSPSKATKSPKKAD

SEQ ID NO: 25128 - protein, 148 aa, Musa acuminata
MEATGKGRKGAGGRRGGGPKKKPVSRSVKAGLQFPVGRIGRYLKQGRYAQRVGTGAPVYLAAVLEYLAAEVLELAGNAARDNKKNRIIPRHVLLAIRNDEELGKLLAGVTIAHGGVLPNINPVLLPKKTANKEPKSPAKPASKSPKKA

SEQ ID NO: 25129 - protein, 152 aa, Chrysanthemum coronarium
METGGKKKGAAGRKGPGGGPRKKSVTRSVKAGLQFPVGRIGRYLKKGRYAKRVGTGAPVYLAAVLEYLAAEVLELAGNAARDNKKTRIIPRHVLLAIRNDEELGKLLSGVTIAHGGVLPNINPVLLPKKSATKESTPKSPAKAAKSPKKAAA

SEQ ID NO: 25130 - protein, 153 aa, Cucumis melo
MDSGGKAKKGFAGRRGGAGPKKKPVSRSVKAGLQFPVGRIGRYLKNGRYSQRVGTGAPVYLAAVLEYLAAEVLELAGNAARDNKKNRIIPRHVLLAVRNDEELGKLLAGVTIAHGGVLPNINPVLLPKKSERAGTAAKEPKSPSKGTKSPKKA

SEQ ID NO: 25131 - protein, 145 aa, Tropaeolum majus
MDTAGKAKKGAGGRKGGGPKKKAVTKSVRAGLQFPVGRIGRYLKKGRYAARVGTGAPVYLAAVLEYLAAEVLELAGNAARDNKKSRIIPRHLLLAVRNDEELGKLLSGVTIAHGGVLPNINPILLPKKTDKAEPKPKAGKSPKKA

SEQ ID NO: 25132 - protein, 154 aa, Papaver somniferum
METPGGKAKKGFAGRRGGGPKKKAVTRSVKAGLQFPVGRIGRYLKKGRYAQRVGSGAPVYLAAVLEYLAAEVLELAGNAARDNKKTRIIPRHVLLAVRNDEELGKLLSGVTIAHGGVLPNINPILLPKKTAEKAATGGSKEPKSPKAGKSPKKA

SEQ ID NO: 25133 - protein, 153 aa, Sesamum indicum
MDAAGKVKKGAGGRKGGGPKKKPVSRSVRAGLQFPVGRIGRYLKKGRYAQRVGTGAPVYMAAVLEYLAAEVLELAGNAARDNKKNRIIPRHVLLAVRNDEELGKLLQGVTIAHGGVLPNINPVLLPKKTGGDKATKEPKSPSKAGKSPKAAAS

SEQ ID NO: 25134 - protein, 153 aa, Vinca minor
METGGKVKKGAAGRKGGGPKKKPVSRSSRAGLQFPVGRIGRYLKKGRYSQRVGTGAPVYMAAVLEYLAAEVLELAGNAARDNKKNRIIPRHVLLAIRNDEELGKLLSGVTIAHGGVLPNINPILLPKKTDKAGATKEPKSPAKAAKSPKKAAA

SEQ ID NO: 25135 - protein, 156 aa, Triticum aestivum
MDASATGAGAKAKKGAAGRKAGGPRKKSVTRSVKAGLQFPVGRIGRYLKNGRYAKRVGTGAPVYLAAVLEYLAAELLELAGNAAKDNKKSRIVPRHLLLAVRNDQELGRLLAGVTIAHGGVLPNINPVLLPKKTAEKEPKSPKKAAKSPKKADKKA

SEQ ID NO: 25136 - protein, 156 aa, Triticum aestivum
MDASATGAGAKAKKGAAGRKAGGPRKKSVARSVKAGLQFPVGRIGRYLKNGRYAKRVGTGAPVYLAAVLEYLAAELLELAGNAAKDNKKSRIVPRHLLLAVRNDQELGRLLAGVTIAHGGVLPNINPVLLPKKTAEKEPKSPKKAAKSPKKADKKA

SEQ ID NO: 25137 - protein, 140 aa, Helianthus annuus
MESKKGAGGRKAGGPKKKPVSRSVKAGLQFPVGRLGRYLKKGRYAQRVGTGAPVYLAAVLEYLAAEVLELAGNAARDNKKNRIIPRHVLLAVRNDEELGKLLAGVTIAHGGVLPNINPVLLPKKAAAKEAAKVTKSPKKA

SEQ ID NO: 25138 - protein, 160 aa, Festuca arundinacea
MDVSGTGAGVKGKKGASGRKAGGPRKKSVTRSVKAGLQFPVGRIGRYLKKGRYAQRVGTGAPVYLAAVLEYLAAEVLELAGNAAKDNKKSRIIPRHLLLAVRNDEELGKLLAGVTIPHGGVLPKINPVLLPKKTAEKAAKEPKSLKEAAKSPKTRIGWIN

SEQ ID NO: 25139 - protein, 160 aa, Avena sativa
VSSTATGGKAKKGAAGRKAGGPRKKSVTRSVKAGLQFPVGRVGRYLKKGRYAQRVGTGAPVYLAAVLEYLAAEVLELAGNAAKDNKKSRIIPRHLLLAVRNDEELGKLLAGVTIAHGGVLPKINPVLLPKKTAEKAAKEPKSPKKTAKSPKKTAKSPKKA

SEQ ID NO: 25140 - protein, 155 aa, Secale cereale
MDASATVATGKGKKGAAGRKAGGPRKKSVSRSVKAGLQFPVSRIGRFLKKGRYAQRVGSGAPVYLAAVLEYLAAELLELAGNAAKDNKKSRIIPRHLLLAVRNDQELGRLLAGVTIAHGGVIPNINPVLLPKKTAEKSPKEPKSPKRTAKSPKKA

SEQ ID NO: 25141 - protein, 155 aa, Triticum aestivum
MDASATVAAGKAKKGAAGRKAGGPRKKSVARSVKAGLQFPVGRIGRFLKKGRYAQRVGSGAPVYLAAVLEYLAAELLELAGNAAKDNKKSRIIPRHLLLAVRNDQELGRLLAGVTIAHGGVIPNINPVLLPKKTAEKSPKEPKSPKKTAKSPKKA

SEQ ID NO: 25142 - protein, 159 aa, Hordeum vulgare
MDASGTVAKGKKGAAGRKAGGPRKKSVSRSVKAGLQFPVGRIGRYLKKGRYAQRVGTGAPVYLAAVLEYLAAELLELAGNAAKDNKKSRIIPRHLLLAVRNDEELGKLLAGVTIAHGGVVPNINTVLLPKRTAEKEGKAPKSPKKAPKSPKKAATPKKA

SEQ ID NO: 25143 - protein, 145 aa, Chrysanthemum coronarium
IKKGAAGRKAGGPRKKSVTRSVKAGLQFPVGRIGRYLKKGRYAKRVGTGAPVYLAAVLEYLAAEVLELAGNAARDNKKTRIIPRHVLLAIRNDEELGKLLSGVTIAHGGVLPNINPVLLPKKTAAKESTPKSPSKAAKSPKKAAA

SEQ ID NO: 25144 - protein, 149 aa, Euphorbia peplus
MDSTTVKKGAAGRKGGGPKKKSVTRSVRAGLQFPVGRIGRYLKKGRYAKRVGSGAAVYLAAVLEYLAAEVLELAGNAARDNKKNRIIPRHLLLAVRNDEELGKLLAGVTIAHGGVLPNINPVLLPKKNEKASQEPKSPAKKAAKSPKKA

SEQ ID NO: 25145 - protein, 150 aa, Fraxinus spp
MDTGGKLKKGAGGRRGGGPKKKPVSRSVKAGLQFPVGRIGRYLKKGRYSQRVGTGAPVYMAAVLEYLAAEVLELAGNAARDNKKNRIIPRHVLLAVRNDEELGKLLAGVTIAYGGVLPNINPVLLPKKSEKAGKEPAKSPTKATKSPKKA

SEQ ID NO: 25146 - protein, 151 aa, Nicotiana benthamiana
MDTAGKAKKGAGGRKAGGQSKKPVSRSVKAGLQFPVGRIGRYLKKGRYAQRVGSGAPVYLAAVLEYLAAEVLELAGNAARDNKKNRIIPRHVLLAVRNDEELGKLLAGVTIAHGGVLPNINPILLPKKTGGAEKEPKSPAKATKSPRKAAA

SEQ ID NO: 25147 - protein, 150 aa, Plantago ovata
METDGKVKKGAGGRKGGGPKKKSVSRSVKAGLQFPVGRIGRYLKKGRYAQRVGSGAPVYMAAVLEYLAAEVLELAGNAARDNKKTRIIPRHVLLAVRNDEELGKLLAGVTIAHGGVLPNINPVLLPKKNEKAEKETATKSPAKATKSPKK

SEQ ID NO: 25148 - protein, 150 aa, Sarracenia psittacina
METVGKSRKGAAGRKGGGPKKKPVSRSVKAGLQFPVGRIGRYLKKGRYSQRIGTGAPVYLAAVLEYLAAEVLELAGNAARDNKKNRIIPRHVLLAVRNDEELGKLLAGVTIAHGGVLPNINPVLLPKKSEKAATKEPKSPSRATKSPKKA

SEQ ID NO: 25149 - protein, 150 aa, Tabernaemontana elegans
MESGGKVKKGAAGRKGGGPKKKPVSRSTRAGLQFPVGRIGRYLKKGRYSERVGTGAPVYMAAVLEYLAAEVLELAGNAARDNKKNRIIPRHVLLAIRNDEELGKLLAGVTIAHGGVLPNINPILLPKKTDKPTKEPKSPSKATKSPKKAA

SEQ ID NO: 25150 - protein, 151 aa, Vinca minor
MEGAGGKLKKGAAGRRGGGPKKKPVTRSTRAGLQFPVGRIGRYLKKGRYSQRVGTGAPVYMAAVLEYLAAEVLELAGNAARDNKKNRIIPRHVLLAVRNDEELGKLLAGVTIAHGGVLPNINPVLLPKKNEKATKEPAKSPAKATKSPRKT

SEQ ID NO: 25151 - protein, 153 aa, Hordeum vulgare
MDASTAGAVSKAKKYVVGRKLGGGPRKKAVARSVKAGLQFPVSRIARFLKKGRYAQRVGMGAPVYLASVLEYLAAELLELAGNAAKDNKKSRIIPRHLLLAVRNDEELGKLLAGVTIAHGGVLPNINTVLLPKKTAEKEPKSPKKAAKSPKKA

SEQ ID NO: 25152 - protein, 149 aa, Phaseolus vulgaris
METTGKIKKGAGGRKGGGPKKKPVSRSVKAGLQFPVGRIGRYLKKGRYAQRVGSGAPIYLAAVLEYLAAEVLELAGNAARDNKKNRIIPRHVLLAVRNDEELGKLLAGVTIAHGGVLPNINPVLLPKKTEKASKEPKSPSKATKSPRKS

SEQ ID NO: 25153 - protein, 149 aa, Amorphophallus konjac
MDTAGKVKKGAGGRKGGGPKKKPVSRSVKAGLQFPVGRIGRYLKKGRYSQRVGTGAPVYLAAVLEYLAAEVLELAGNAAKDNKKNRIIPRHVLLAVRNDDELGRLLSGVTIAHGGVLPNINPVLLPKKSEKASKEPKSPGKATKSPKKA

SEQ ID NO: 25154 - protein, 150 aa, Musa acuminata
MDGGGSKVKKGAAGRRGGGPKKKPVSRSVKAGLQFPVGRIGRFLKKGRYAQRVGAGAPVYLAAVLEYLAAEVLELAGNAARDNKKNRIIPRHVLLAIRNDEELGKLLAGVTIAHGGVLPNINPVLLPKKTDKGGKEPKSPSKATKSPKKD

SEQ ID NO: 25155 - protein, 149 aa, Phaseolus vulgaris
MDTTGKIKKGAGGRKGGGPKKKAVSRSVKAGLQFPVGRIGRFLKKGRYAQRVGSGAPVYLAAVLEYLAAEVLELAGNAARDNKKNRIIPRHVLLAVRNDEELGKLLSGVTIAHGGVLPNINPVLLPKKSDKASKEPKSPSKATKSPRKA

SEQ ID NO: 25156 - protein, 145 aa, Chrysanthemum coronarium
KVKKGAAGRKAGGPRKKSVTRSVKAGLQFPVGRIGRYLKKGRYALRVGTGAPVYLAAVLEYLAAEVLELAGNAARDNKKTRIIPRHVLLAIRNDEELGKLLSGVTIAHGGVLPNINPVLLPKKTAAKEPTPKSPSKVGKSPKKAA

SEQ ID NO: 25157 - protein, 145 aa, Cichorium intybus
KVKKGAAGRKAGGPKKKPVTKSVKAGLQFPVGRIGRYIKKGRYAKRVGTGAPVYLAAVLEYLAAEVLELAGNAARDNKKTRIIPRHVLLAVRNDEELGKLLAGVTIAHGGVLPNINPILLPKKSLEKATKEPKSPAKSAKSPKKA

SEQ ID NO: 25158 - protein, 150 aa, Echinacea purpurea
METGGKMKKGAAGRKAGGPKKKPVTRSVKAGLQFPVGRIGRYLKVGRYAKRVGTGAPVYLAAVLEYLAAEVLELAGNAARDNKKNRINPRHVLLAVRNDDELGKLLAGVTIAHGGVLPNINPVLLPKKSHEKATKEPKSPSKSTKSPKKA

SEQ ID NO: 25159 - protein, 150 aa, Fagopyrum esculentum
MDTTNKVKKGVAGRKAGGPKKKSVTRSVKAGLQFPVGRIGRYLKNGRYARRVGSGAPVYLAAILEYLAAEVLELAGNAARDNKKTRIIPRHLLLAVRNDEELGKLLSGVTIAHGGVLPNINPVLLPNKIAEKALKEPKSPSKAVKSPKKA

SEQ ID NO: 25160 - protein, 150 aa, Flaveria ramosissima
METGGKLKKGAAGRKAGGPKKKPVTRSVKAGLQFPVGRIGRYLKVGRYAKRVGTGAPVYLAAVLEYLAAEVLELAGNAARDNKKNRIIPRHVLLAVRNDDELGKLLAGVTIAHGGVLPNINPVLLPKKSHDKATKEPKSPSKSTKSPKKA

SEQ ID NO: 25161 - protein, 150 aa, Flaveria ramosissima
METTGKLKKGAAGRKAGGPEKKPVTRSVKAGLQFPVGRIGRYLNVGRYAKRVGTGAPVYLAAVLEYLAAEVLELAGNAARDNKKNRIIPRHVLLAIRNDDELGKLLAGVTIAHGGVLPNINPVLLPKRVHDKATKEPKSPSKSTKSPKKA

SEQ ID NO: 25162 - protein, 150 aa, Orobanche aegyptiaca
MDASAKVKKGAGGRKGGGPKKKPVSRSVKAGLQFPVSRIGRYLKKGRYSQRVGTGAPVYLAAVLEYLAAEVLELAGNAARDNKKNRIIPRHLLLAVRNDEELGKLLGGVTIAHGGVIPNINPILLPKKSDKVAEKTPKSPAKATKSPKKA

SEQ ID NO: 25163 - protein, 158 aa, Secale cereale
MDVSGTGAGAKGKKGAAGRKAGGPRKKSVTRSVKAGLQFPVGRIGRYLKKGRYAQRVGTGAPVYLAAVLEYLAAELLELAGNAAKDNKKSRIIPRHLLLAVRNDEELGKLLAGVTIAHGGVIPKINPVLLPKRTAEKEAKEPKSPKKTTKSPKKTTKA

SEQ ID NO: 25164 - protein, 150 aa, Helianthus annuus
METTGKAKKGAAGRKAGGPRKKSVTRSVKAGLQFPVGRIGRYLKHGRYAKRVGTGAPVYLAAVLEYLAAEVLELAGNAARDNKKNRITPRHVLLAIRNDDELGKLLAGVTIAHGGVLPNINPVLLPKKSAAAAKETKSPVKPGKSPKKAA

SEQ ID NO: 25165 - protein, 144 aa, Tragopogon dubius
MEKKGAGGRKAGGPKKKPVSRSVKAGLQFPVSRLGRYLKKGRYAKRVGTGAPVYLAAVLEYLAAEVLELAGNAARDNKKSRIIPRHVLLAVRNDEELGKLLSGVTIAHGGVLPNINPVLLPKKTVEKEGKEPKSPKKAAKSPKK

SEQ ID NO: 25166 - protein, 150 aa, Triphysaria pusilla
MEATPKAKKGAAGRKAGGPKKKSVSRSVKAGLQFPVGRIGRFLKKGRYSERVGSGAPVYMAAVLEYLAAEVLELAGNAARDNKKSRIIPRHLLLAVRNDEELGKLLAGVTIAHGGVIPNINPVLLPKKSDKVAEKAPKSPSKAAKSPRKA

SEQ ID NO: 25167 - protein, 150 aa, Triphysaria pusilla
MEATPKAKKGAAGRKAGGPKKKSVSRSVKAGLQFPVGRIGRFLKKGRYSQRVGSGAPVYMAAVLEYLAAEVLELAGNAARDNKKSRIIPRHLLLAVRNDEELGKLLAGVTIAHGGVIPNINPVLLPKKSDKVAEKAPKSPLKATKSPRKA

SEQ ID NO: 25168 - protein, 150 aa, Triphysaria pusilla
METGGKVKKGAAGRKVGGPKKKSVTRSVKAGLQFPVGRIGRFLKKGRYAQRVGSGAPVYLAAVLEYLAAEVLELAGNAARDNKKSRIIPRHLLLAVRNDEELGKLLAGVTIAHGGVIPNINPVLLPKKSDKVAEKAPKSPLKATKSPRKA

SEQ ID NO: 25169 - protein, 150 aa, Triphysaria pusilla
MEATPKAKKGAAGRKAGGPKKKSVSRSVKAGLQFPVGRIGRFLKKGRYSQRVGSGAPVYMAAVLEYLAAEVLELAGNAARDNKKSRIIPRHLLLAVRNDEELGKLLAGVTIAHGGVIPNINPVLLPKKSDKVAEKAPKSPSKATKSPRKA

SEQ ID NO: 25170 - protein, 149 aa, Tripterygium wilfordii
MDTGGKLKKGAGGRKGGGPKSKPVSRSVKAGLQFPVGRIGRYLKKGRYSQRVGSGAPVYLAAVLEYLAAEVLELAGNAARDNKKNRIIPRHLLLAVRNDEELGKLLSGVTIAHGGVLPNINPVLLPKKTDKASKEPKSPSKATKSPKKA

SEQ ID NO: 25171 - protein, 153 aa, Chrysanthemum coronarium
METGGKKKGAAGRKGPGGGPRKKSVTRSVKAGLQFPVGRIGRYLKKGRYAKRVGTGAPVYLAAVLEYLAAEVLELAGNAARDNKKTRIIPRHVLLAIRNDEELGKLLSGVTIAHGGVLPNINPVLLPKKSATKESTPKSPAKAAKSPKKAAAA

SEQ ID NO: 25172 - protein, 153 aa, Momordica charantia
METGGKLKKGAGGRKGGGPKKKPVSRSVKAGLQFPVGRIGRYLKNGRYARRVGTGAPVYLAAVLEYLAAEVLELAGNAARDNKKNRIIPRHVLLAIRNDEELGKLLAGVTIAHGGVLPNINPVLLPKKSEKAVTKEPKSPSKVTKATKSPKKA

SEQ ID NO: 25173 - protein, 154 aa, Lippia dulcis
METTGKVKKGAGGRKGGGPKKKAVSRSVRAGLQFPVGRIGRYLKKGRYAQRIGTGAPVYMAAVLEYLAAEVLELAGNAARDNKKNRIIPRHVLLAVRNDEELGKLLQGVTIAHGGVLPNINPVLLPKKTGGADKAAKEPKSPSKAGKSPKKAAA

SEQ ID NO: 25174 - protein, 153 aa, Rosmarinus officinalis
MEAAAKPKKGAAGRRGGGPKKKPVSRSVRAGLQFPVGRIGRYLKKGRYAQRVGTGAPVYMAAVLEYLAAEVLELAGNAARDNKKNRIIPRHVLLAVRNDEELGKLLQGVTIAHGGVLPNINPVLLPKKTGGDKATKEPKSPAKAAKSPKKAAA

SEQ ID NO: 25175 - protein, 156 aa, Triticum aestivum
MDASATGAGAKGKKGAAGRKAGGPRKKAVARSVKAGLQFPVGRIGRFLKKGRYAQRVGMGAPVYLASVLEYLAAELLELAGNAAKDNKKSRIIPRHLLLAIRNDQELGRLLAGVTIAHGGVLPNINPVLLPKKTAEKEPKSPKKAAKSPKKADKKA

SEQ ID NO: 25176 - protein, 148 aa, Arnica chamissonis
MEATGKAKKGAGGRKGGGPRKKAVTRSIRAGLQFPVGRIGRYLKNGRYAKRVGTGAPVYLAAVLEYLAAEVLELAGNAARDNKKNRIIPRHVLLAIRNDDELGKLLSGVTIAHGGVLPNINPVLLPKKTAAKEPKSPAKSTKSPKKAA

SEQ ID NO: 25177 - protein, 152 aa, Daucus carota
MEGGGKVKKGAAGRKAGGPKKKPVSRSVKAGLTFPVGRIGRFLKKGRYAQRVGTGAPVYLAAVLEYLAAEVLELAGNAARDNKKSRIIPRHLLLAIRNDEELGKLLAGVTIAHGGVLPNINPVLLPKKSEKASQESTKSPSKATKSPRKAAA

SEQ ID NO: 25178 - protein, 148 aa, Centaurea maculosa
  Sequence also found in Organisms: Cirsium arvense
MESTGKAKKGAGGRKGGGPRKKAVTRSIRAGLQFPVGRIGRYLKNGRYAKRVGTGAPVYLAAVLEYLAAEVLELAGNAARDNKKNRIIPRHVLLAIRNDDELGKLLAGVTIAHGGVLPNINPILLPKKTAAKEPKSPSKATKSPKKAD

SEQ ID NO: 25179 - protein, 152 aa, Chrysanthemum coronarium
METGGKKKGAAGRKGPGGGPRKKSVTRSVKAGLQFPVGRIGRYLKKGRYAKRVGTGAPVYLAAVLEYLAAEVLELAGNAARDNKKTRIIPRHVLLAIRNDEELGKLLSGVTIAHGGVLPNINPVLLPKKSATKESTPKSPAKAAKSPKKVAA

SEQ ID NO: 25180 - protein, 148 aa, Cyclamen graecum
MESTGKAKKGFGGRKGGGPKKKPVSRSVKAGLQFPVGRIGRYLKKGRYSQRVGTGAPIYLAAVLEYLAAEVLELAGNAARDNKKNRIIPRHVLLAIRNDEELGKLLAGVTIAHGGVLPNINPILLPKKTADKEPASPAKKATKSPKKA

SEQ ID NO: 25181 - protein, 147 aa, Flaveria ramosissima
MEATGKAKKGAGGRKSGDRKKAVTRSIRAGLQFPVGRIGRYLKNGRYAKRVGTGAPVYLAAVLEYLAAEVLELAGNAARDNKKNRIIPRHVLLAIRNDDELGKLLAGVTIAHGGVLPNINPVLLPKKTAAKEPKSPAKATKSPKKAA

SEQ ID NO: 25182 - protein, 153 aa, Mimulus guttatus
MEAGGVKAKKGAAGRKAGGPKKKSVSRSTKAGLQFPVGRIGRYLKKGRYSERVGSGAPVYLAAVLEYLAAEVLELAGNAARDNKKNRITPRHFLLAVRNDEELGKLLAGVTIAYGGVLPNINPVLLPKKNEKVGENENAAKSPSKATKSPKKA

SEQ ID NO: 25183 - protein, 153 aa, Allium cepa
MEGGGKMKKGAAGRKGPSGPRKKSVTRSVKAGLQFPVGRIGRYLKKGRYAQRVGTGAPVYLAAVLEYLAAEVLELAGNAAKDNKKNRIIPRHVLLAIRNDEELGKLLGGVTIAHGGVLPNINPVLLPKKTAAKESDTSKSPKKTAAKTPKKAA

SEQ ID NO: 25184 - protein, 153 aa, Allium cepa
MEGGGKMKKGAAGRKGPSGPRKKSVTRSIKAGLQFPVGRIGRYLKKGRYAQRVGTGAPVYLAAVLEYLAAEVLELAGNAAKDNKKNRIIPRHVLLAIRNDEELGKLLGGVTIAHGGVLPNINPVLLPKKTAAKESETPKSPKKTAAKTPKKAA

SEQ ID NO: 25185 - protein, 144 aa, Helianthus annuus
MESKKGAGGRKAGGPKKKPVSRSVKAGLQFPVGRLGRYLKKGRYARRVGTGAPVYLAAVLEYLAAEVLELAGNAARDNKKNRIIPRHVLLAVRNDEELGKLLAGVTIAHGGVLPNINPVLLPKKAAAKEATKSPAKVTKSPKKA

SEQ ID NO: 25186 - protein, 148 aa, Helianthus annuus
MESTGKVKKGAAGRKAGGPRKKAVTRSVKAGLQFPVGRIGRFLKKGRYAQRVGSGAPVYLAAVLEYLAAEVLELAGNAARDNKKNRIIPRHVLLAIRNDEELGKLLGGVTIAHGGVLPNINPILLPKKTAAKEPKSPSKATKSPKKAK

SEQ ID NO: 25187 - protein, 156 aa, Triticum aestivum
MDASATGAGAKSKKGAAGRKAGGPRKKSVTRSVKAGLQFPVGRIGRYLKNGRYAKRVGTGAPVYLAAVLEYLAAELLELAGNAAKDNKKSRIVPRHLLLAVRNDQELGRLLAGVTIAHGGVLPNINPVLLPKKTAEKEPKSPKKAAKSPKKAEKKA

SEQ ID NO: 25188 - protein, 152 aa, Rosmarinus officinalis
METGGKVKKGAAGRKGGGPKKKPVSRSTRAGLQFPVGRIGRYLKKGRYSQRVGTGAPVYMAAVLEYLAAEVLELAGNAARDNKKNRIIPRHVLLAIRNDEELGKLLAGVTIAHGGVLPNINPVLLPKKTEKATTKETKSPAKATKSPKKAAA

SEQ ID NO: 25189 - protein, 152 aa, Pisum sativum
MDASTKVKKGAGGRKGGGPRKKSVTRSVRAGLQFPVSRIGRFLKKGRYAQRVGTGAPVYLAAVLEYLAAEVLELAGNAARDNKKNRISPRHLLLAVRNDEELGKLLAGVTIAHGGVLPNINPVLLPKRTESASSSAKEPKSPSKAKKTPKKA

SEQ ID NO: 25190 - protein, 153 aa, Lupinus angustifolius
MDATSGKSKKGAGGRKGGGPRKKSVTRSIRAGLQFPVGRIGRYLKKGRYAQRVGTGAPVYLAAVLEYLAAEVLELAGNAARDNKKNRIIPRHVLLAVRNDEELGKLLSGVTIAHGGVIPNINPVLLPKKNEKVVAAKEPKSPSKATKSPRKAA

SEQ ID NO: 25191 - protein, 144 aa, Scabiosa columbaria
MDTGAKSKKGAAGRKLGGPKKKPVSRSVKSGLQFPVGRIGRYLKKGRYAQRVGTGAPVYLAAVLEYLAAEVLELAGNAARDNKKNRIIPRHVLLAIRNDEELGKLLSGVTIAHGGVLPNINPILLPKKTAAKEPKSPSKATKST

SEQ ID NO: 25192 - protein, 153 aa, Silene vulgaris
MDSTGGKGKKGAAGRKGTGPKKKPVSRSVKAGLQFPVGRIGRYLKKGRYAQRVGSGAPVYLSAVLEYLAAEVLELAGNAARDNKKNRIIPRHVLLAVRNDDELGKLLAGVTIAHGGVLPNINPVLLPKKAAEKSPKEPKSPSKATKSPKKAAA

SEQ ID NO: 25193 - protein, 212 aa, Zea mays
MARPRSVAAAAPLLLLLAAAAAGLVSAASPAASDFVRKSCRTTQYPSVCEQSLASYGGSPPPRSPRELARAALSVSADRARAASAYVGRLCGASNGKGAKKGSGSGSGSASAGPVRDCLDNLADSVGHLRDAAQEMGGAGMGRAGTPAFRWHLSNVQTWCSAALTDEDTCLDGLSSRAVDAGTRAAIRGKVVEVAQVTSNALALVNKVGPGY

SEQ ID NO: 25194 - protein, 202 aa, Sorghum bicolor
MARLLLLLAAAAAAAFLAVEAASPVASDFIRKSCRATQYPSVCEQSLASYGGTPPPRSPRELARAALSVSADRARAASAYVGRLCGAGTGAKKGSGSRPAAAGPVRDCLENLADSVGHLRDAAQEMGGAGMSRSGTPAFKWHLSNVQTWCSAALTDENTCLDGLSSRGVDAGTRAAIRGKVVEVAQVTSNALALVNKVGPGY

SEQ ID NO: 25195 - protein, 279 aa, Solanum tuberosum
MAKDIEVATEYAPKDYQDPPPAPLIDPEELGKWSFYRAIIAEFIATLLFLYITVLTVIGYKSQSSTDQCGGVGILGIAWAFGGMIFVLVYCTAGISGGHINPAVTFGLFLARKVSLVRAIMYIVAQCLGAICGCGLVKSFQKAYYVKYGGGANMLSDGYSTGTGLGAEIIGTFVLVYTVFAATDPKRNARDSHVPVLAPLPIGFAVFMVHLATIPVTGTGINPARSFGAAVIYGHHKAWNDQWIFWVGPFIGAAIAAFYHQFILRAGAVKALGSFRSNA

SEQ ID NO: 25196 - protein, 279 aa, Solanum phureja
MAKDVEVATEYAPKDYQDPPPAPLIDPEELGKWSFYRAIIAEFIATLLFLYITVLTVIGYKSQNSTDQCGGVGILGIAWAFGGMIFVLVYCTAGISGGHINPAVTFGLFLARKVSLVRAIMYIVAQCLGAICGCGLVKCFQKAYYVKYGGGANMLNDGYSTGTGLGAEIIGTFVLVYTVFAATDPKRNARDSHVPVLAPLPIGFAVFMVHLATIPVTGTGINPARSFGAAVIYGHHKAWNDQWIFWVGPFIGAAIAAFYHQFILRAGAVKALGSFRSNA

SEQ ID NO: 25197 - protein, 279 aa, Capsicum annuum
MPKDVEVGTEYAPKDYQDPPPAPLIDPEELGKWSFYRAIIAEFIATLLFLYITVLTVIGYKSQSATDQCGGVGILGIAWAFGGMIFVLVYCTAGISGGHINPAVTFGLFLARKVSLVRAIMYIVAQCLGAICGCGLVKAFQKAYYFRHGGGANTLNDGYSTGTGLGAEIIGTFVLVYTVFAATDPKRNARDSHVPVLAPLPIGFAVFMVHLATIPVTGTGINPARSFGAAVIYGKDKAWDDQWIFWVGPFIGAAIAAFYHQFILRAGAVKALGSFRSNA

SEQ ID NO: 25198 - protein, 279 aa, Solanum phureja
MGKDIEVGTEYAPKDYQDPPPAPLIDPEELGKWSFYRAIIAEFIATLLFLYITVLTVIGYKSQNSTDQCGGVGILGIAWAFGGMIFVLVYCTAGISGGHINPAVTFGLFLARKVSLVRAIMYIVAQCLGAICGCGLVKSFQKAYYVQYGGGANKLNDGYSTGTGLGAEIIGTFVLVYTVFAATDPKRNARDSHVPVLAPLPIGFAVFMVHLATIPVTGTGINPARSFGAAVIYGHHKAWNDQWIFWVGPFIGAAIAAFYHQFILRAGAVKALGSFRSNA

SEQ ID NO: 25199 - protein, 279 aa, Solanum melongena
MAKDIEVGTEYAPKDYQDPPPAPLIDPEELGKWSFYRAIIAEFIATLLFLYITVLTVIGYKSQSETDKCGGVGILGIAWAFGGMIFVLVYCTAGISGGHINPAVTFGLFLARKVSLVRAIMYIVAQCLGAICGCGLVKSFQKAYYVKYGGGANSLNDGYSTGAGLGAEIIGTFVLVYTVFAATDPKRNARDSHVPVLAPLPIGFAVFMVHLATIPVTGTGINPARSFGAAVIFGKDKPWDDQWIFWVGPFIGAAIAAFYHQFILRAGAVKALGSFRSNA

SEQ ID NO: 25200 - protein, 283 aa, Nicotiana benthamiana
MAKDTEVGTEYAPKDYHDPPPAPLIDPEELGKWSFYRAIIAEFIATLLFLYITVLTVIGYKSQIDPDHNGEQCGGVGILGIAWAFGGMIFVLVYCTAGISGGHINPAVTFGLFLARKVSLVRAIMYILAQCLGAICGCGLVKAFQKAYYVKYGGGANTLNDGYSTGTGLGAEIIGTFVLVYTVFAATDPKRNARDSHVPVLAPLPIGFAVFMVHLATIPVTGTGINPARSFGAAVIYGKNKAWDDQWIFWVGPFIGAAIAAFYHQFILRAGAVKALGSFRSNA

SEQ ID NO: 25201 - protein, 269 aa, Solanum lycopersicum
MHQKIYQDPPPAPLIDPEELGKWSFYRAIIAEFIATLLFLYITVLTVIGYKSQSSTDQCGGVGILGIAWAFGGMIFVLVYCTAGISGGHINPAVTFGLFLARKVSLVRAIMYIVAQCLGAICGCGLVKAFQKAYYVKYGGGANTLNDGYSTGTGLGAEIIGTFVLVYTVFAATDPKRNARDSHVPVLAPLPIGFAVFMVHLATIPVTGTGINPARSFGAAVVYGHNKAWDDQWIFWVGPFIGAAIAAFYHQFILRAGAVKALGSFRSNA

SEQ ID NO: 25202 - protein, 283 aa, Nicotiana benthamiana
MAKDTEVGTEYAPKDYQDPPPAPLIDPEELGKWSFYRAIIAEFIATLLFLYITVLTVIGYKSQIDPDHKGEECGGVGILGIAWAFGGMIFVLVYCTAGISGGHINPAVTFGLFLARKVSLVRAIMYMLAQCLGAICGCGLVKAFQKAYYVKYGGGANTLNDGYTTGTGLGAEIIGTFVLVYTVFAATDPKRNARDSHVPVLAPLPIGFAVFMVHLATIPVTGTGINPARSFGAAVIYGKDKAWDDQWIFWVGPFIGAAIAAFYHQFILRAGAVKALGSFRSNA

SEQ ID NO: 25203 - protein, 283 aa, Petunia hybrida
MAKDIEVATEYAPKDYQDPPPAPLIDPEELGKWSFYRAIIAEFIATLLFLYITVLTVIGYKSQSDITANGDQCGGVGILGIAWAFGGMIFVLVYCTAGISGGHINPAVTFGLFLARKVSLVRAIAYIVAQCLGAICGCGLVKAFQSAYYVKYGGGANTLAEGYNTGTGLGAEIIGTFVLVYTVFAATDPKRNARDSHVPVLAPLPIGFAVFMVHLATIPVTGTGINPARSFGAAVIYGKDKAWDDQWIFWVGPFIGAAIAAFYHQFILRAGAVKALGSFRSNA

SEQ ID NO: 25204 - protein, 283 aa, Nicotiana benthamiana
MGKDIEVGTEYAPKDYQDPPPAPLIDPEELGKWSFYRAIIAEFIATLLFLYITVLTVIGYKSQIDPDHKGEECGGVGILGIAWAFGGMIFVLVYCTAGISGGHINPAVTFGLFLARKVSLVRAIMYMLAQCLGAICGCGLVKAFQKAYYVKYGGGANTLNDGYTTGTGLGAEIIGTFVLVYTVFAATDPKRNARDSHVPVLAPLPIGFAVFMVHLATIPVTGTGINPARSFGAAVIYGKDKAWDDQWIFWVGPFIGAAIAAFYHQFILRAGAVKALGSFRSNA

SEQ ID NO: 25205 - protein, 278 aa, Nicotiana tabacum
EVGTEYAPKDYQDPPPAPLIDPEELGKWSFYRAIIAEFIATLLFLYITVLTVIGYKSQTDPDHNGEQCGGVGILGIAWAFGGMIFVLVYCTAGISGGHINPAVTFGLFLARKVSLVRAIMYMLAQCLGAICGCGLVKAFHKAYYVKYGGGANMLNDGYSTGTGLGAEIIGTFVLVYTVFAATDPKRNARDSHLPVLAPLPIGFAVFMVHLATIPVTGTGINPARSFGAAVIYGKDKAWDDQWIFWVGPFIGAAIAAFYHQFILRAGAVKALGSFRSNA

SEQ ID NO: 25206 - protein, 283 aa, Petunia hybrida
MAKDIEYGEYNAPKDYQDPPPAPLIDTEELGKWSFYRAIIAEFIATLLFLYITVLTVIGYKSQSDTTHNGDQCGGVGILGIAWAFGGMIFVLVYCTAGISGGHINPAVTFGLFLARKISLIRAVLYMVAQCLGAICGCGLVKAFQKAYYVKYGGGANELADGYSTGTGLGAEIIGTFVLVYTVFSATDPKRNARDSHVPVLAPLPIGFAVFMVHLATIPVTGTGINPARSFGAAVIYGKEKAWDDQWIFWVGPFIGAAIAAIYHQYILRAGAVKALGSFRSNA

SEQ ID NO: 25207 - protein, 281 aa, Solanum phureja
MAKDMEYGNDQYAPSKDYQDPPPAPLIDPEELGKWSFYRAIIAEFIATLLFLYITVLTVIGYKSQSDGDQCGGVGILGIAWAFGGMIFVLVYCTAGISGGHINPAVTFGLFLARKVSLVRAIFYIVAQCLGAICGCGLVKLFQKAYYVKYGGGANELAVGYNTATGLGAEIIGTFVLVYTVFSATDPKRNARDSHVPVLAPLPIGFAVFMVHLATIPITGTGINPARSFGAAVIYGKNKSWDDQWIFWVGPFIGAAIAALYHQYILRAGASKSINSFRSNA

SEQ ID NO: 25208 - protein, 285 aa, Capsicum annuum
MAKDIEYGNDQYAPNKDYQDPPPAPLIDPEELGKWSFYRAIIAEFIATLLFLYITVLTVIGYKSQSDTKHNGDQCGGVGILGIAWAFGGMIFILVYCTAGISGGHINPAVTFGLFLARKVSLVRAVMYIVAQCLGAICGCGLVKSFQKAYYVKYGGGANELADGYNTATGLGAEIIGTFVLVYTVFSATDPKRNARDSHVPVLAPLPIGFAVFMVHLATIPITGTGINPARSFGAAVIYGKEKSWDDQWIFWVGPFIGAAIAALYHQFILRAGAAKALGSHRSNA

SEQ ID NO: 25209 - protein, 281 aa, Solanum lycopersicum
MAKDMEYGNDQYAPSKDYQDPPPAPLIDPEELGKWSFYRAIIAEFIATLLFLYITVLTVIGYKSQSDGDQCGGVGILGIAWAFGGMIFVLVYCTAGISGGHINPAVTFGLLLARKVSLVRAIFYIVAQCLGAICGCGLVKLFQKAYYVKYGGGANELAVGYNIATGLGAEIIGTFVLVYTVFSATDPKRNARDSHVPVLAPLPIGFAVFMVHLATIPITGTGINPARSFGAAVIYGKNKSWDDQWIFWVGPFIGAAIAAIYHQYILRAGASKSINSFRSNA

SEQ ID NO: 25210 - protein, 285 aa, Amsonia hubrichtii
MAKDMEVGGTEYATKDYQDPPPAPLIDPEELTKWSFYRAIIAEFIATLLFLYITVLTVIGYNSQTDEKSGGDQCGGVGILGIAWAFGGMIFILVYCTAGISGGHINPAVTFGLFLARKVSLVRAIMYMVAQCLGAICGCGLVKAFQRAYYVRYGGGANMLNDGYNTGTGLGAEIIGTFVLVYTVFSATDPKRNARDSHVPVLAPLPIGFAVFMVHLATIPITGTGINPARSFGAAVIYGKEKAWDDQWIFWVGPFVGAAIAALYHQYVLRAGAVKALGSFKSTTY

SEQ ID NO: 25211 - protein, 283 aa, Fraxinus spp
MAKNIEVGDPEFTAKDYQDPPPAPLIDPEELTKWSFYRAIIAEFIATLLFLYITVLTVIGYKSQSATDECGGVGILGIAWAFGGMIFILVYCTAGISGGHINPAVTFGLFLARKVSLVRAIMYMVAQCLGAICGCGLVKAFQRAYYVRYGGGANGLEVGYSTGTGLAAEIIGTFVLVYTVFSATDPKRSARDSHVPVLAPLPIGFAVFMVHLATIPITGTGINPARSFGAAVIYGKDKAWDDQWIFWAGPFIGAAIAAFYHQYILRAGAVKALGSFRSSASTY

SEQ ID NO: 25212 - protein, 285 aa, Nicotiana tabacum
MAKDIEYGTDQYAPNKDYQDPPPAPLIDAEELGKWSFYRAIVAEFIATLLFLYITVLTVIGYKSQSDTKHNGDACGGVGILGIAWAFGGMIFVLVYCTAGISGGHINPAVTFGLFLARKISLARAVMYMIAQCLGAICGCGLVKAFQKSYYVNYGGGANELATGYSTGTGLAAEIIGTFVLVYTVFSATDPKRNARDSHVPVLAPLPIGFAVFMVHLATIPITGTGINPARSFGAAVIYGKEKAWDDQWIFWVGPFIGAAIAALYHQYILRAGAVKALGSFRSNA

SEQ ID NO: 25213 - protein, 284 aa, Cichorium intybus
MGKDIEVGSHEYGAKDYQDPPPAQLFDAEELTKWSFYRAIIAEFIATLLFLYITVLTVIGYKSQTDPAHSTDQCGGVGILGIAWAFGGMIFVLVYCTAGISGGHINPAVTFGLFLARKVSLPRAVMYIVAQCLGAICGCGLVKAFQKTYYTTYGGGANELADGYSKGTGLGAEIIGTFVLVYTVFSATDPKRNARDSHVPVLAPLPIGFAVFMVHLATIPITGTGINPARSFGAAVMYGKDKAWDDQWIFWVGPMIGAAIAAFYHQYVLRAAAVKALGSFRSNA

SEQ ID NO: 25214 - protein, 283 aa, Olea europaea
MVKDVEVGGPEFTTKDYQDPPPAPLIDPEELTKWSFYRAIIAEFVATLLFLYITVLTVIGYKSQSATDECGGVGILGIAWAFGGMIFVLVYCTAGISGGHINPAVTFGLFLARKVSLIRAIMYMVAQCVGAICGCGLVKAFQRAYYVRYGGGANELGDGYSTGTGLAAEIIGTFVLVYTVFSATDPKRSARDSHVPVLAPLPIGFAVFMVHLATIPITGTGINPARSFGAAVIYGKDKAWDDQWIFWAGPFIGAAIAALYHQYILRAGAVKALGSFRSSASAY

SEQ ID NO: 25215 - protein, 277 aa, Panax ginseng
MGKDIVVAEHGLDYEDPPAAPLFDSEELTKWSFYRAIIAEFIATLLFLYITVLTVIGYKSQTESDQCGGVGILGIAWAFGGMIFVLVYCTAGISGGHINPAVTFGLFLARKVSLVRAVMYVVAQCLGAICGVGLVKSFQKSYYVRYGGGANELADGYSTGTGLGAEIIGTFVLVYTVFSATDPKRNARDSHVPVLAPLPIGFAVFMVHLATIPITGTGINPARSFGTAVMYGKEKAWDDQWIFWVGPFIGAAIAAFYHQFILRAAAVKALGSFRSNA

SEQ ID NO: 25216 - protein, 284 aa, Vaccinium corymbosum
MAKDIEGGEFTTKDYHDPPPAPLIDPEELILWSFYRAIIAEFIATLLFLYITVLTVIGYKSQTDPAKNGDACGGVGILGIAWAFGGMIFVLVYCTAGISGGHINPAVTFGLFLARKVSLVRAIMYMVAQCLGAICGCGLVKAFQKAYYVKYGGGANELSAGYNTGTGLGAEIIGTFVLVYTVFSATDPKRNARDSHVPVLAPLPIGFAVFMVHLATIPVTGTGINPARSFGAAVIYGQQKAWDDQWIFWVGPFIGAAIAAFYHQYILRAAAVKAFGSFKSTAYN

SEQ ID NO: 25217 - protein, 284 aa, Camellia sinensis
MAKDIEVGGGEYAAKDYQDPPPALLIDAEELTLWSLYRATIAEFVATLLFLYITVLTVIGYKSQTDPTKTTDACGGVGILGIAWAFGGMIFVLVYCTAGISGGHINPAVTFGLLLARKVSLVRAILYIVAQCLGAICGCGLVKAFQKAYYVEYGGGANELSSGYSTGTGLAAEIIGTFVLVYTVFSATDPKRNARDSHVPVLAPLPIGFAVFMVHLATIPITGTGINPARSFGATVVYGKQKAWDDQWIFWVGPFIGAAIAAFYHQYILRAAAVKALGSSRSNA

SEQ ID NO: 25218 - protein, 280 aa, Triphysaria pusilla
MAKDMEVGGNEYNAKDYQDPPPAPLIDPDELGKWSLYRAVIAEFIATLLFLYITVLTVIGYKAQSATNECAGVGILGIAWAFGGMIFVLVYCTAGISGGHINPAVTFGLFLARKVSLVRAVLYIVAQCLGAICGCGLVKAFQSSYYIRYGGGANEVADGISNGTGLAAEIIGTFVLVYTVFSATDPKRSARDSHVPVLAPLPIGFAVFMVHLATIPVTGTGINPARSFGAAVIYGKEKAWDDQWIFWVGPFIGAAIAAIYHQYILRAGAVKALGSFRSTS

SEQ ID NO: 25219 - protein, 284 aa, Cichorium intybus
MGKDIEVGSHEYGAKDYQDPPPAQLFDAEELTKWSFYRAIIAEFIATLLFLYITVLTVIGYKAQTDPAHSSDQCGGVGILGIAWAFGGMIFVLVYCTAGISGGHINPAVTFGLFLARKVTLPRAVMYIVAQCLGAICGCGLVKAFQKTYYTTYGGGANELADGYSKGTGLGAEIIGTFVLVYTVFSATDPKRNARDSHVPVLAPLPIGFAVFMVHLATIPITGTGINPARSFGAAVMYGKDKAWDDQWIFWVGPMIGAAIAAFYHQFVLRAAAVKALGSFRSNA

SEQ ID NO: 25220 - protein, 284 aa, Cichorium intybus
MGKDIEVGSHEYGAKDYQDPPPAQLFDAEELTKWSFYRAIIAEFIATLLFLYITVLTVIGYKAQTDPAHSSDQCGGVGILGIAWAFGGMIFVLVYCTAGISGGHINPAVTFGLFLARKVTLPRAVMYIVAQCLGAICGCGLVKAFQKTYYHTYGGGANELADGYSKGTGLGAEIIGTFVLVYTVFSATDPKRNARDSHVPVLAPLPIGFAVFMVHLATIPITGTGINPARSFGAAVMYGKDKAWDDQWIFWVGPMIGAAIAAFYHQFVLRAAAVKALGSFRSNA

SEQ ID NO: 25221 - protein, 284 aa, Cichorium intybus
MVKDVEVGGHDYSAKDYQDPPPAELFDAEELTKWSFYRAIIAEFIATLLFLYITVLTVIGYKSQTDPAHSSDQCGGVGILGIAWAFGGMIFVLVYCTAGISGGHINPAVTFGLFLARKVSLPRAVMYIVAQCLGAICGCGLVKAFQKTYYTTYGGGANELADGYSKGTGLGAEIIGTFVLVYTVFSATDPKRNARDSHVPVLAPLPIGFAVFMVHLATIPITGTGINPARSYGAAVMYGKDKAWDDQWIFWVGPMIGAAIAAFYHQFVLRAAAVKALGSFRSNA

SEQ ID NO: 25222 - protein, 284 aa, Cichorium intybus
MGKDIEVGSHEYGAKDYQDPPPAQLFDAEELTKWSFYRAIIAEFIATLLFLYITVLTVIGYKAQTDPAHSSDQCGGVGILGIAWAFGGMIFVLVYCTAGISGGHINPAVTFGLFLARKVSLPRAVMYIVAQCLGAICGCGLVKSFQKTYYSTYGGGANELADGYSKGTGLGAEIIGTFVLVYTVFSATDPKRNARDSHVPVLAPLPIGFAVFMVHLATIPITGTGINPARSFGAAVMYGKDKAWDDQWIFWVGPMIGAAIAAFYHQFVLRAAAVKALGSFRSNA

SEQ ID NO: 25223 - protein, 283 aa, Orobanche aegyptiaca
MAKDTEVGATTEYAAKDYHDPPPAPLIDPEELGKWSLYRAVIAEFIATLLFLYITVLTVIGYKSQSAADECGGVGILGIAWAFGGMIFVLVYCTAGISGGHINPAVTFGLFLARKVSLVRAVLYIVAQCLGAICGCGLVKAFQKSYYVTYGGGANSLADGYSTGTGLAAEIIGTFVLVYTVFSATDPKRSARDSHVPILAPLPIGFAVFMVHLATIPITGTGINPARSFGAAVIFGKDKAWDDQWIFWVGPLIGATIAAIYHQYVLRAGAVKALGSFRSSSYS

SEQ ID NO: 25224 - protein, 284 aa, Helianthus annuus
MAKDIEVASHEYGAKDYQDPPPADLIDPEELTKWSFYRAIIAEFVATLLFLYITVLTVIGYKSQTDPDHSTDQCGGVGILGIAWAFGGMIFVLVYCTAGISGGHINPAVTFGLFLARKVTLPRAVMYMVAQCLGAVCGCGLVKAFQKSYYTNYGGGANELADGYNKGTGLGAEIIGTFVLVYTVFSATDPKRNARDSHVPVLAPLPIGFAVFMVHLATIPITGTGINPARSFGAAVIYGKEKAWDDQWIFWVGPMIGAAIAAIYHQYILRAGAVKALGSFRSNA

SEQ ID NO: 25225 - protein, 280 aa, Triphysaria pusilla
MAKDMEVGGNEYNAKDYQDPPPAPFIDPDELGKWSLYRAVIAEFIATLLFLYITVLTVIGYKAQSATDECAGVGILGIAWAFGGMIFVLVYCTAGISGGHINPAVTFGLFLARKVSLVRAVLYIVAQCLGAICGCGLVKAFQSSYYIRYGGGANEVADGISNGTGLAAEIIGTFVLVYTVFSATDPKRSARDSHVPVLAPLPIGFAVFMVHLATIPVTGTGINPARSFGAAVIYGKQKAWDDQWIFWVGPFIGAAIAAIYHQYILRGGAVKALGSFRSTS

SEQ ID NO: 25226 - protein, 284 aa, Ambrosia trifida
MGKDVEVGGHEYGAKDYQDPPPADLFDAEELTKWSFYRAIIAEFIATLLFLYITVLTVIGYKSQTDPNHSADQCGGVGILGIAWAFGGMIFVLVYCTAGISGGHINPAVTFGLFLARKVTLPRAFMYIVAQCLGAVCGCGLVKAFQKTYYNTYGGGANELADGYSKGTGLGAEIIGTFVLVYTVFSATDPKRNARDSHVPVLAPLPIGFAVFMVHLATIPITGTGINPARSFGAAVMYGKDKAWDDQWLFWVGPMIGAAIAAFYHQYVLRAGAVKALGSFRSNA

SEQ ID NO: 25227 - protein, 285 aa, Chrysanthemum coronarium
MSKDVEVGGHDHYGAKDYQDPPPSPLFDSEELTKWSFYRAIIAEFIATLLFLYITVLTVIGYKSQVDPAHSTDQCGGVGILGIAWAFGGMIFVLVYCTAGISGGHINPAVTFGLFLARKVTLPRAFMYIVAQCLGAICGCGLVKAFQKTYYHNYGGGANELADGYSKGTGLGAEIIGTFVLVYTVFSATDPKRNARDSHVPVLAPLPIGFAVFMVHLATIPITGTGINPARSFGAAVMYGKEKAWDDQWLFWVGPMIGAAIAAFYHQYVLRAGAVKALGSFRSNA

SEQ ID NO: 25228 - protein, 284 aa, Cichorium intybus
MGKDIEVGSHEYGAKDYQDPPPAQLFDAEELTKWSFYRAIIAEFIATLLFLYITVLTVIGYKAQTDPAHSSDQCGGVGILGIAWAFGGMIFVLVYCTAGISGGHINPAVTFGLFLARKVTLPRAVMYIVAQCLGAICGCGLVKAFQKTYYHTYGGGANELADGYSKGTGLGAEIIGTFVLVYTVFSATDPKRNARDSHVPVLAPLPIGFAVFMVHLATIPITGTGINPARSFGAAVMYGKDKAWDDQWIFWVGPMIGAAIAAFYHQYVLRAAAVKALGSFRSNA

SEQ ID NO: 25229 - protein, 282 aa, Flaveria ramosissima
MAKDIEGAEYGAKDYQDPPPAELFDAEELRKWSFYRAIIAEFIATLLFLYITVLTVIGYKSQTDPDHSADQCGGVGILGIAWAFGGMIFVLVYCTAGISGGHINPAVTFGLFLARKVTLPRAVMYMVAQCLGAVCGCGLVKAFQKSYYNAYGGGANELADGYSKGTGLGAEIIGTFVLVYTVFSATDPKRNARDSHVPVLAPLPIGFAVFMVHLATIPITGTGINPARSFGAAVMYGKEKAWDDQWLFWVGPMIGAAIAAFYHQYVLRAGAVKALGSFRSNA

SEQ ID NO: 25230 - protein, 282 aa, Flaveria ramosissima
MAKDIEGAEYGAKDYQDPPPAELFDAEELTKWSFYRAIIAEFIATLLFLYITVLTVIGYKSQTDPDHSADQCGGVGILGIAWAFGGMIFVLVYCTAGISGGHINPAVTFGLFLARKVTLPRAVMYMVAQCLGAVCGCGLVKAFQKSYYNAYGGGANELADGYSKGTGLGAEIIGTFVLVYTVFSATDPKRNARDSHVPVLAPLPIGFAVFMVHLATIPITGTGINPARSFGAAVMYGKEKAWDDQWLFWVGPMIGAAIAAFYHQYVLRAGAVKALGSFRSNA

SEQ ID NO: 25231 - protein, 285 aa, Rosmarinus officinalis
MAKDIEVGGTEYANKDYQDPPPAPLIDPEELTQWSFYRAIIAEFVATLLFLYITVLTVIGYISQTDEKSGGDQCGGVGILGIAWAFGGMIFILVYCTAGISGGHINPAVTFGLFLARKVSLVRAIMYMVAQCLGAICGCGLVKAFQRAYYVRHGGGANVLNDGYNAGTGLGAEIIGTFVLVYTVFSATDPKRNARDSHVPVLAPLPIGFAVFMVHLATIPITGTGINPARSFGAAVIYGKQKAWDDHWIFWVGPFIGAAIAALYHQYVLRAAAVKSLGSFKSTTY

SEQ ID NO: 25232 - protein, 283 aa, Artemisia annua
MSKDVEVGGHDHYGAKDYQDPPPSPLFDPEELTKWSFYRAIIAEFIATLLFLYITVLTVIGYKSQVDPAHSTDQCGGVGILGIAWAFGGMIFVLVYCTAGISGGHINPAVTFGLFLARKVTLPRAFMYIVAQCLGAICGCGLVKAFQKTYYHTYGGGANELADGYSKGTGLGAEIIGTFVLVYTVFSATDPKRNARDSHVPVLAPLPIGFAVFMVHLATIPITGTNPARSFGAAVMYGKEKAWDDQWLFWVGPMIGAAIAAFYHQYVLRAGAVKALGSFRSNA

SEQ ID NO: 25233 - protein, 285 aa, Helianthus annuus
MAKDIEVASHHEYGAKDYQDPPPADLIDPEELTKWSFYRAIIAEFVATLLFLYITVLTVIGYKSQTDPDHSTDQCGGVGILGIAWAFGGMIFVLVYCTAGISGGHINPAVTFGLFLARKVTLPRAVMYMVAQCLGAVCGCGLVKAFQKSYYTNYGGGANELADGYNKGTGLGAEIIGTFVLVYTVFSATDPKRNARDSHVPVLAPLPIGFAVFMVHLATIPITGTGINPARSFGAAVIYGKEKAWDDQWIFWVGPMIGAAIAAIYHQYILGAGAVKALGSFRSNA

SEQ ID NO: 25234 - protein, 285 aa, Chrysanthemum coronarium
MSKDVEVGGHDHYGAKDYQDPPPSPLFDSEELTKWSFYRAIIAEFIATLLFLYITVLTVIGYKSQVDPAHSTDQCGGVGILGIAWAFGGMIFVLVYCTAGISGGHINPAVTFGLFLARKVTLPRAFMYIVAQCLGAICGCGLVKAFQKTYYHTYGGGANELADGYSKGTGLGAEIIGTFVLVYTVFSATDPKRNARDSHVPVLAPLPIGFAVFMVHLATIPITGTGINPARSFGAAVMYGKEKAWDDQWLFWVGPMIGAAIAAFYHQYVLRAGAIKALGSFRSNA

SEQ ID NO: 25235 - protein, 285 aa, Chrysanthemum coronarium
MSKDVEVGGHDHYGAKDYQDPPPSPLFDSEELTKWSFYRAIIAEFIATLLRLYITVLTVIGYKSQVDPAHSTDQCGGVGILGIAWAFGGMIFVLVYCTAGISGGHINPAVTFGLFLARKVTLPRAFMYIVAQCLGAICGCGLVKAFQKTYYHNYGGGANELADGYSKGTGLGAEIIGTFVLVYTVFSATDPKRNARDSHVPVLAPLPIGFAVFMVHLATIPITGTGINPARSFGAAVMYGTEKAWDDQWLFWVGPMIGAAIAAFYHQYVLRAGAVKALGSFRSNA

SEQ ID NO: 25236 - protein, 285 aa, Chrysanthemum coronarium
MSKDVEVGGHDHYGAKDYQDPPPSPLFDSEELTKWSFYRAIIAEFIATLLFLYITVLTVIGYKSQVDPTHSTDQCGGVGILGIAWAFGGMIFVLVYCTAGISGGHINPAVTFGLFLARKVTLPRAFMYIVAQCLGAICGCGLVKAFQKTYYHNYGGGANELADGYSKGTGLGAEIIGTFVLVYTVFSATDPKRNARDSHVPVLAPLPIGFAVFMVHLATIPITGTGINPARSFGAAVMYGKEKAWDDQWLFWVGPMIGAAIAAFYHQYVLRAGAIKALGSFRSNA

SEQ ID NO: 25237 - protein, 283 aa, Rosmarinus officinalis
MTKDVEAVGGHDYGAKDYQDPPPAPLIDMEELGKWSLYRAAIAEFIATLLFLYVTVLTVIGYKSQSAADQCGGVGILGIAWAFGGMIFVLVYCTAGISGGHINPAVTFGLLLARKVSLVRAVLYIVAQCLGAICGCGLVKAFQKTYYIQYGGGANELSDGYSTGTGVAAEIIGTFVLVYTVFSATDPKRNARDSHVPVLAPLPIGFAVFMVHLATIPVTGTGINPARSFGAAVIYGKDKAWDDQWIFWVGPFVGAAIAAIYHQFVLRAGAVKALGSFRSSSYN

SEQ ID NO: 25238 - protein, 284 aa, Helianthus annuus
MGKDVEVGGHEYGAKDYQDPPPAALFDAEELTKWSFYRAIIAEFIATLLFLYITVLTVIGYKSQTDPAHSPDQCGGVGILGIAWAFGGMIFVLVYCTAGISGGHINPAVTFGLFLARKVTLPRAFMYIVAQCLGAVCGCGLVKAFQKTYYNTYGGGANELADGYSKGTGLGAEIIGTFVLVYTVFSATDPKRNARDSHVPVLAPLPIGFAVFMVHLATIPITGTGINPARSFGAAVMYGKEKAWDDQWLFWVGPMIGAAVAAFYHQYVLRAGAVKALGSFRSNA

SEQ ID NO: 25239 - protein, 283 aa, Ambrosia trifida
GKDVEVGGHEYGAKDYQDPPPADLFDAEELTKWSFYRAIIAEFIATLLFLYITVLTVIGYKSQTDPNHSADQCGGVGILGIAWAFGGMIFVLVYCTAGISGGHINPAVTFGLFLARKVTLPRAFMYIVAQCLGAVCGCGLVKAFQKTYYNTYGGGANELADGYSKGTGLGAEIIGTFVLVYTVFSATDPKRNARDSHVPVLAPLPIGFAVFMVHLATIPITGTGINPARSFGAAVMYGKDKAWDDQWLFWVGPMIGAAIAAFYHQYVLRAGAVKALGSFRSNA

SEQ ID NO: 25240 - protein, 284 aa, Cichorium intybus
MGKDIEVGSHEYGAKDYQDPPPAQLFDAEELTKWSFYRAIIAEFIATLLFLYITVLTVIGYKAQTDPAHSSDQCGGVGILGIAWAFGGMIFVLVYCTAGISGGHINPAVTFGLFLARKVTLPRAVLYIVAQCLGAICGCGLVKAFQKTYYHTYGGGANELADGYSKGTGLGAEIIGTFVLVYTVFSATDPKRNARDSHVPVLAPLPIGFAVFMVHLATIPITGTGINPARSFGAAVMYGKDKAWDDQWIFWVGPMIGAAIAAFYHQYVLRAAAVKALGSFRSNA

SEQ ID NO: 25241 - protein, 284 aa, Cichorium intybus
MGKDVEAGAHDYSAKDYQDPPPAELFDAEELTKWSFYRAIIAEFIATLLFLYITVLTVIGYKSQTDPAHSSDQCGGVGILGIAWAFGGMIFVLVYCTAGISGGHINPAVTFGLFLARKVTLPRAVMYIVAQCLGAICGCGLVKAFQKTYYTTYGGGANELADGYSKGTGLGAEIIGTFVLVYTVFSATDPKRNARDSHVPVLAPLPIGFAVFMVHLATIPITGTGINPARSFGAAVMYGKDKAWDDQWIFWVGPMIGAAIAAFYHQYVLRAAAVKALGSFRSNA

SEQ ID NO: 25242 - protein, 284 aa, Echinacea purpurea
MGKDVEVGSHEYGAKDYQDPPPADLFDADELTKWSFYRAIIAEFIATLLFLYITVLTVIGYKSQTDPAHSSDQCGGVGILGIAWAFGGMIFVLVYCTAGISGGHINPAVTFGLFLARKVTLPRAFMYIVAQCLGAVCGCGLVKAFQKTYYNTYGGGANELADGYSKGTGLGAEIIGTFVLVYTVFSATDPKRNARDSHVPVLAPLPIGFAVFMVHLATIPITGTGINPARSFGAAVMYGKEKAWDDQWLFWVGPMIGAAIAAFYHQYVLRAGAVKALGSFRSNA

SEQ ID NO: 25243 - protein, 284 aa, Echinacea purpurea
MGKDVEVGSHEYGAKDYQDPPPADLFDADELTKWSFYRAIIAEFIATLLFLYITVLTVIGYKSQTDPAHSSDQCGGVGILGIAWAFGGMIFVLVYCTAGISGGHINPAVTFGLFLARKVTLPRAFMYIVAQCLGAVCGCGLVKAFQKTYYHAYGGGANELADGYSKGTGLGAEIIGTFVLVYTVFSATDPKRNARDSHVPVLAPLPIGFAVFMVHLATIPITGTGINPARSFGAAVMYGKEKAWDDQWLFWVGPMIGAAIAAFYHQYVLRAGAVKALGSFRSNA

SEQ ID NO: 25244 - protein, 282 aa, Flaveria ramosissima
MAKDIEGAEYGAKDYQDPPPAELFDAEELRKWSFYRAIIAEFIATLLFLYITVLTVIGYKSQTDPDHSADECGGVGILGIAWAFGGMIFVLVYCTAGISGGHINPAVTFGLFLARKVTLPRAVMYMVAQCLGAVCGCGLVKAFQKSYYNAYGGGANELADGYSKGTGLGAEIIGTFVLVYTVFSATDPKRNARDSHVPVLAPLPIGFAVFMVHLATIPITGTGINPARSFGAAVMYGKEKAWDDQWIFWVGPMIGAAIAAIYHQYVLRAGAVKALGSFRSNA

SEQ ID NO: 25245 - protein, 282 aa, Flaveria ramosissima
MAKDIEVAEYGAKDYEDPPPAELFDAEELTKWSFYRAIIAEFIATLLFLYITVLTVIGYKSQTDPDHSADQCGGVGILGIAWAFGGMIFVLVYCTAGISGGHINPAVTFGLFLARKVTLPRAVMYMVAQCLGAVCGCGLVKAFQKSYYNAYGGGANELADGYSKGTGLGAEIIGTFVLVYTVFSATDPKRNARDSHVPVLAPLPIGFAVFMVHLATIPITGTGINPARSFGAAVMYGKEKAWDDQWLFWVGPMIGAAIAAFYHQYVLRAGAVKALGSFRSNA

SEQ ID NO: 25246 - protein, 282 aa, Flaveria ramosissima
MAKDIEVAEYGAKDYQDPPPAELFDAEELTKWSFYRAVIAEFIATLLFLYITVLTVIGYKSQTDPDHSADQCGGVGILGIAWAFGGMIFVLVYCTAGISGGHINPAVTFGLFLARKVTLPRAVMYMVAQCLGAVCGCGLVKAFQKSYYNAYGGGANELADGYSKGTGLGAEIIGTFVLVYTVFSATDPKRNARDSHVPVLAPLPIGFAVFMVHLATIPITGTGINPARSFGAAVMYGKEKAWDDQWLFWVGPMIGAAIAAFYHQYVLRAGAVKALGSFRSNA

SEQ ID NO: 25247 - protein, 282 aa, Flaveria ramosissima
MAKDIEGAEYGAKDYADPPPAELFDAEELTKWSFYRAIIAEFIATLLFLYITVLTVIGYKSQTDPDHSADQCGGVGILGIAWAFGGMIFVLVYCTAGISGGHINPAVTFGLFLARKVTLPRAVMYMVAQCLGAVCGCGLVKAFQKSYYNAYGGGANELADGYSKGTGLGAEIIGTFVLVYTVFSATDPKRNARDSHVPVLAPLPIGFAVFMVHLATIPITGTGINPARSFGAAVMYGKEKAWDDQWLFWVGPMIGAAIAAFYHQYVLRAGAVKALGSFRSNA

SEQ ID NO: 25248 - protein, 284 aa, Prunus mume
MAKDSEVGGGHNRFSGKDYQDPPPAPLIDAEELGQWSFYRAIIAEFIATLLFLYITVLTVIGYKSQSDGDQCGGVGILGIAWAFGGMIFVLVYCTAGISGGHINPAVTFGLFLARKVSLVRAILYMVAQSLGAICGVGLVKAFQKAYFTKYGGGANGLADGYSQGTGLAAEIIGTFVLVYTVFSATDPKRNARDSHVPVLAPLPIGFAVFIVHLATIPITGTGINPARSLGAAVIYDNDKAWDDQWIFWVGPFIGAAIAAFYHQYILRAGAVKALGSFRSSSNI

SEQ ID NO: 25249 - protein, 284 aa, Helianthus annuus
MAKDIEVASHEYGAKDYQDPPPADLIDPEELTRWSFYRAIIAEFVATLLFLYITVLTVIGYQSQTDPDHSTDQCGGVGILGIAWAFGGMIFVLVYCTAGISGGHINPAVTFGLFLARKVTLPRAVMYMVAQCLGAVCGCGLVKAFQKSYYTNYGGGANELADGYNKGTGLGAEIIGTFVLVYTVFSATDPKRNARDSHVPVLAPLPIGFAVFMVHLATIPITGTGINPARSFGAAVIYGKEKAWDDQWIFWVGPMIGAAIAAIYHQYILRAGAVKALGSFRSNA

SEQ ID NO: 25250 - protein, 281 aa, Daucus carota
MAKDGEVAEQSGFSSKDYHDPPPAAFIGTDELTKWSFYRALIAEFIATLLFLYITVLTVIGYKSQSSTDQCGGVGLLGIAWAFGGMIFVLVYCTAGISGGHINPAVTFGLFLARKVSLIRAVMYMVAQCLGAICGVGLVKAFQKSYYNRYGGGANELADGYNKGTGLGAEIIGTFVLVYTVFSATDPKRNARDSHVPVLAPLPIGFAVFMVHLATIPITGTGINPARSFGAAVIYNKEKAWDDQWIFWVGPFIGAAIAAFYHQFILRAAAVKALGSFRSNA

SEQ ID NO: 25251 - protein, 277 aa, Petroselinum crispum
MGKDIEVAEHGRDYQDPPPVDFFDAEELGSWSFYRAIIAEFVATLLFLYITVLTVIGYKAQSDTDQCGGVGLLGIAWAFGGMIFVLVYCTAGISGGHINPAVTFGLFLARKVSLVRAVMYMIAQCLGAICGVGLVKAFQKSYYIRYGGGANELADGYNKGTGLGAEIIGTFVLVYTVFSATDPKRNARDSHVPVLAPLPIGFAVFMVHLATIPITGTGINPARSFGAAVIYGKEKAWDDQWIFWVGPFIGAAIAAFYHQYILRAAAVKALGSFRSNA

SEQ ID NO: 25252 - protein, 284 aa, Centaurea maculosa
MGKDIEVGGHDYGAKDYQDPPPAPLFDSEELTKWSFYRAIIAEFVATLLFLYITVLTVIGYKSQTDPIHSPDQCGGVGILGIAWAFGGMIFVLVYCTAGISGGHINPAVTFGLFLARKVTLPRAVMYIVAQCLGAICGCGLVKAFQKTYYDNYGGGANELADGYNKGTGLGAEIIGTFVLVYTVFSATDPKRNARDSHVPVLAPLPIGFAVFMVHLATIPITGTGINPARSFGAAVIYGKDKAWDDQWLFWVGPMIGAAIAAIYHQYVLRAGAVKALGSFRSNA

SEQ ID NO: 25253 - protein, 285 aa, Chrysanthemum coronarium
MSKDVEVGGHDHYGAKDYQDPPPAALFDSEELSKWSFYRAIIAEFIATMLFLYITVLTVIGYKSQVDPAHSKDQCGGVGILGIAWAFGGMIFVLVYCTAGISGGHINPAVTFGLFLARKVTLPRAFMYIVAQCLGAICGCGLVKAFQKTYYHNYGGGANELADGYSTGTGLGAEIIGTFVLVYTVFSATDPKRNARDSHVPVLAPLPIGFAVFMVHLATIPITGTGINPARSFGAAVMYGKEKAWDDQWLFWVGPMIGAAIAAFYHQYVLRAGAIKALGSFRSNA

SEQ ID NO: 25254 - protein, 285 aa, Chrysanthemum coronarium
MSKDVEVGGHDHYGAKDYQDPPPSPLFDSEELTKWSFYRAIIAEFIATMLFLYITVLTVIGYKSQVDPAHSTDQCGGVGILGIAWAFGGMIFVLVYCTAGISGGHINPAVTFGLFLARKVTLPRAFMYIVAQCLGAICGCGLVKAFQKTYYHNYGGGANELADGYSKGTGLGAEIIGTFVLVYTVFSATDPKRNARDSHVPVLAPLPIGFAVFMVHLATIPITGTGINPARSFGAAVMYGTEKAWDDQWLFWAGPMIGAAIAAFYHQYVLRAGAVKALGSFRSNA

SEQ ID NO: 25255 - protein, 285 aa, Chrysanthemum coronarium
MSKDVEVGGHDHYGAKDYQDPPPAALFDSEELTKWSFYRAIIAEFIATMLFLYITVLTVIGYKSQVDPAHSKDQCGGVGILGIAWAFGGMIFVLVYCTAGISGGHINPAVTFGLFLARKVTLPRAFMYIVAQCLGAICGCGLVKAFQKTYYHNYGGGANELADGYSKGTGLGAEIIGTFVLVYTVFSATDPKRNARDSHVPVLAPLPIGFAVFMVHLATIPITGTGINPARSFGAAVMYGKEKAWDDQWLFWVGPMIGAAIAAFYHQYVLRAGAVKALGSFRSNA

SEQ ID NO: 25256 - protein, 285 aa, Chrysanthemum coronarium
MSKDVEVGGHDHYGAKDYQDPPPSPLFDSEELTKWSFYRAIIAEFIATLLFLYITVLTVIGYKSQVDPAHSTDQCGGVGILGIAWAFGGMIFVLVYCTAGISGGHINPAVTFGLFLASKVTLPRAFMYIVAQCLGAICGCGLVKAFQKTYYHNYGGGANELADGYSKGTGLGAEIIGTFVLVYTVFSATDPKRNARDSHVPVLAPLPIGFAVFMVHLATIPITGTGINPARSFGAAVMYGKEKAWDDQWLFWVGPMIGAAIAAFYHQYVLRAGAIKALGSFRSNA

SEQ ID NO: 25257 - protein, 284 aa, Cirsium arvense
MGKDIEVGGHDYGAKDYQDPPPAPLFDSEELSKWSFYRAIIAEFVATLLFLYITVLTVIGYKSQTDPIHSPDQCGGVGILGIAWAFGGMIFVLVYCTAGISGGHINPAVTFGLFLARKVTLPRAVMYIVAQCLGAICGCGLVKAFQKTYYDDYGGGANELADGYNKGTGLGAEIIGTFVLVYTVFSATDPKRNARDSHVPVLAPLPIGFAVFMVHLATIPITGTGINPARSFGAAVIYGKDKAWDDQWLFWVGPMIGAAIAAIYHQYVLRAGAVKALGSFRSNA

SEQ ID NO: 25258 - protein, 284 aa, Cirsium arvense
MGKDIEVGGHDYGAKDYQDPPPAPLFDGEELTKWSFYRAIIAEFVATLLFLYITVLTVIGYKSQTDPIHSPDQCGGVGILGIAWAFGGMIFVLVYCTAGISGGHINPAVTFGLFLARKVTLPRAVMYIVAQCLGAICGCGLVKAFQKTYYDDYGGGANELADGYNKGTGLGAEIIGTFVLVYTVFSATDPKRNARDSHVPVLAPLPIGFAVFMVHLATIPITGTGINPARSFGAAVIYGKDKAWDDQWLFWVGPMIGAAIAAIYHQYVLRAGAVKALGSFRSNA

SEQ ID NO: 25259 - protein, 284 aa, Prunus persica
MAKDIEVGGGQHRFSGKDYQDPPPAPLIDAEELGQWSFYRAIIAEFIATLLFLYITVLTVIGYKSQSEGDQCGGVGILGIAWAFGGMIFVLVYCTAGISGGHINPAVTFGLFLARKVSLVRAILYMVAQSLGAICGVGLVKAFQNAYFTKYGGGANGLADGYSQGTGLAAEIIGTFVLVYTVFSATDPKRNARDSHVPVLAPLPIGFAVFIVHLATIPITGTGINPARSLGAAVIYNNDKAWDDQWIFWVGPFIGAAIAAFYHQYILRAGAVKALGSFRSSSNI

SEQ ID NO: 25260 - protein, 282 aa, Helianthus annuus
GKDVEVGGHEYGAKDYQDPPPADLFDAEELTKWSFYRAIIAEFIATLLFLYITVLTVIGYKSQTDPAHSSDQCGGVGILGIAWAFGGMIFVLVYCTAGISGGHINPAVTFGLFLARKVTLPRAFMYIVAQCLGAICGCGLVKAFQKTYYNTYGGGANELADGYSKGTGLGAEIIGTFVLVYTVFSATDPKRNARDSHVPVLAPLPIGFAVFMVHLATIPITGTGINPARSFGAAVMYGKEKAWDDQWLFWVGPMIGAAIAAFYHQFVLRAGAVKALGSSRSM

SEQ ID NO: 25261 - protein, 281 aa, Daucus carota
MGKEEVSEQTHEYSGKDYQDPPPAAFIGLDELGKWSFYRAVIAEFIATLLFLYITVLTVIGYKSQSATDQCGGVGLLGIAWAFGGMIFVLVYCTAGISGGHINPAVTFGLFLARKVSLIRAVMYMVAQCLGAICGVGLVKAFQKSYYNKYGGGANELADGYNKGTGLGAEIIGTFVLVYTVFSATDPKRNARDSHVPVLAPLPIGFAVFMVHLATIPITGTGINPARSFGAAVIYNKDKAWDDQWIFWVGPFIGAAIAAFYHQYILRAAALKALGSFRSNA

SEQ ID NO: 25262 - protein, 281 aa, Daucus carota
MVKDGEVAEQSGFSSKDYHDPPPAAFIGTDELTKWSFYRALIAEFIATLLFLYITVLTVIGYKSQSSTDQCGGVGLLGIAWAFGGMIFVLVYCTAGISGGHINPAVTFGLFLARKVSLIRAVMYMVAQCLGAICGVGLVKAFQKSYYNRYGGGANELADGYNKGTGLGAEIIGTFVLVYTVFSATDPKRNARDSHVPVLAPLPIGFAVFMVHLATIPITGTGINPARSFGAAVIYNKEKAWDDQWIFWVGPFIGAAIAAFYHQFILRAAAVKALGSFRSNA

SEQ ID NO: 25263 - protein, 281 aa, Daucus carota
MGKDGEVAEQSGFSSKDYHDPPPAAFIGTDELTKWSFYRALIAEFIATLLFLYITVLTVIGYKSQSSTDQCGGVGLLGIAWAFGGMIFVLVYCTAGISGGHINPAVTFGLFLARKVSLIRAVMYMVAQCLGAICGVGLVKAFQKSYYNRYGGGANELADGYNKGTGLGAEIIGTFVLVYTVFSATDPKRNARDSHVPVLAPLPIGFAVFMVHLATIPITGTGINPARSFGAAVIYNKEKAWDDQWIFWVGPFIGAAIAAFYHQFILRAAAVKALGSFRSNA

SEQ ID NO: 25264 - protein, 287 aa, Citrus clementina
MAKDIEVGGQGEFHAKDYHDPPPAPLIDAEELTKWSFYRAIIAEFIATLLFLYITVLTVIGYKSQTDANHGGDGCGGVGILGIAWAFGGMIFVLVYCTAGISGGHINPAVTFGLFLARKVSLVRAVMYMVAQCLGAICGCGLVKAFQKSYYTRYGGGANELADGYSTGTGLGAEIIGTFVLVYTVFSATDPKRNARDSHVPVLAPLPIGFAVFMVHLATIPVTGTGINPARSLGAAVIYKKDKAWDDQWIFWVGPFIGAAIAAFYHQFILRASASKALGSFKSSSNI

SEQ ID NO: 25265 - protein, 281 aa, Petroselinum crispum
MGKEEVSEQAHEYSGKDYQDPPPAAFIGIDELGKWSFYRALIAEFIATLLFLYITVLTVIGYKSQSATDQCGGVGLLGIAWAFGGMIFVLVYCTAGISGGHINPAVTFGLFLARKVSLIRAVMYMVAQCLGAICGVGLVKAFQKSYYNKYGGGANELADGYNKGTGLGAEIIGTFVLVYTVFSATDPKRNARDSHVPVLAPLPIGFAVFMVHLATIPITGTGINPARSFGAAVIYNKDKAWDDQWIFWVGPFIGAAIAAFYHQYILRAAALKALGSFRSNA

SEQ ID NO: 25266 - protein, 285 aa, Chrysanthemum coronarium
MSKDVEVGGHDHYGAKDYQDPPPAALFDSEELTKWSFYRAIIAEFIATMLFLYITVLTVIGYKSQVDPAHSKDQCGGVGILGIAWAFGGMIFVLVYCTAGISGGHINPAVTFGLFLARKVTLPRAFMYIVAQCLGAICGCGLVKAFQKTYYHNYGGGANELADGYSKGTGLGAEIIGTFVLVYTVFSATDPKRNARDSHVPVLAPLPIGFAVFMVHLATIPITGTGINPARSFGAAVMYGTEKAWDDQWLFWAGPMIGAAIAAFYHQYVLRAGAVKALGSFRSNA

SEQ ID NO: 25267 - protein, 276 aa, Utricularia gibba
MAKDIEVGGEIAKDYQDPPPAPLIDPEELGKWSLYRAVIAEFIATLLFLYVTVLTVIGYKSQSATDACGGVGILGIAWAFGGMIFVLVYCTAGISGGHINPAVTFGLFLARKVSLVRAVLYIIAQCLGAICGCGLAKAFQTAHYNEYGGGANGLSSGYSIGTGLAAEIIGTFVLVYTVFSATDPKRNARDSHVPVLAPLPIGFAVFMVHLATIPVTGTGINPARSFGAAVIFGKAWDNHWIFWVGPLIGAFVAMLYHQFILRAGAVKALGSFKSSY

SEQ ID NO: 25268 - protein, 284 aa, Cyclamen graecum
MTKDIEVGPGEYASKDYEDPPPAPLIDAEELTKWSLYRATIAEFVATLLFLYITVLTVIGYKSQTDLKKNLDGCGGVGILGIAWAFGGMIFVLVYCTAGISGGHINPAVTFGLFLARKVSLVRAILYIVAQCLGAICGCGLVKAFQKSYYTQYGGGANELSDDYNTGTGLGAEIIGTFVLVYTVFSATDPKRSARDSHVPVLAPLPIGFAVFMVHLATIPITGTGINPARSFGAAVIYGKQKAWDDQWIFWVGPFIGAAIAAFYHQYILRAAAVKAIGSFRSTT

SEQ ID NO: 25269 - protein, 284 aa, Flaveria ramosissima
MGKDVEVGAHEYGAKDYQDPPPAELFDAEELTKWSFYRAVIAEFIATLLFLYITVLTVIGYKSQTDPDHSADQCGGVGILGIAWAFGGMIFVLVYCTAGISGGHINPAVTFGLFLARKVTLPRAVMYMVAQCLGAVCGCGLVKAFQKSYYNAYGGGANELADGYSKGTGLGAEIIGTFVLVYTVFSATDPKRNARDSHVPVLAPLPIGFAVFMVHLATIPITGTGINPARSFGAAVMYGKEKAWDDQWIFWVGPMIGAAVAAIYHQYVLRAGAVKALGSFRSNA

SEQ ID NO: 25270 - protein, 281 aa, Quercus alba
MAGKDIEGFPSKDYHDPPPAPLVDAEELTQWSFYRAIIAEFIATLLFLYITVLTVIGYKSQVDHSTDPCTGVGILGIAWAFGGMIFVLVYCTAGISGGHINPAVTFGLFLARKVSLVRAILYMVAQCLGAICGCGLVKAFQRAYYSKYGGGANGLNDGYSKGTGLAAEIIGTFVLVYTVFSATDPKRNARDSHVPVLAPLPIGFAVFMVHLATIPITGTGINPARSFGAAVIYNEKKAWDDQWLFWVGPFIGAAIAAFYHQYILRAGAIKALGSFRSSSAM

SEQ ID NO: 25271 - protein, 284 aa, Primula obconica
MAKDIEVGPGEYASKDYQDPPPAPLFDSDELTKWSLYRAVIAEFIATLLFLYITVLTVIGYKSQTDPTKNPDGCGGVGILGIAWAFGGMIFVLVYCTAGISGGHINPAVTFGLFLARKVSLVRAVLYIVAQCLGAICGCALVKSFQKTYYNTYGGGANELNDGYNIGTGLGAEIIGTFVLVYTVFSATDPKRSARDSHVPVLAPLPIGFAVFMVHLATIPVTGTGINPARSFGAAVIYGKQKSWDDQWIFWVGPFVGAAIAAFYHQYILRAAAVKALGSFRSTA

SEQ ID NO: 25272 - protein, 283 aa, Tripterygium wilfordii
MAKDVEVQPEFSAKDYTDPPPTPLFDLEELTKWSFYRALIAEFIATLLFLYITVLTVIGYKSQTDPNLNTDQCGGVGILGIAWAFGGMIFILVYCTAGISGGHINPAVTFGLFLGRKVSLIRAVMYMVAQCLGAICGCGLVKGFQKAYYNRYGGGANTLADGYNKGTGLGAEIIGTFVLVYTVFSATDPKRNARDSHVPVLAPLPIGFAVFMVHLATIPITGTGINPARSFGAAVIYNKEKAWDDQWIFWVGPFIGAAIAAFYHQVILRAAAIKALGSFRSNA

SEQ ID NO: 25273 - protein, 283 aa, Valeriana officinalis
MTKDVEVAEYTGGKDYQDPPPVSLFDSEELTKWSFYRAIIAEFIATLLFLYITVLTVIGYKSQTDPLKGTDQCGGVGILGIAWAFGGMIFVLVYCTAGISGGHINPAVTFGLFLARKVSLCRAVLYMIAQCLGAICGCGLVKAFQKTYYNTYGGGANELAPGYSKGTGLGAEIIGTFVLVYTVFSATDPKRNARDSHVPVLAPLPIGFAVFMVHLATIPITGTGINPARSFGAAVIYGREKAWDDQWIFWVGPFIGAAIAAIYHQFVLRAAAVKALGSFRSNA

SEQ ID NO: 25274 - protein, 281 aa, Malus domestica
MAKDVEGAEHGEFATKDYHDPPPTPLFDAEELTKWSFYRALIAEFIATLLFLYITVLTVIGYKSQSEADQCGGVGILGIAWAFGGMIFVLVYCTAGISGGHINPAVTFGLFLARKVSLIRAVLYIIAQCLGAICGVGLVKAFQKSYYMKYGGGANELSAGYNKGTGLGAEIIGTFVLVYTVFSATDPKRNARDSHVPVLAPLPIGFAVFIVHLATIPITGTGINPARSFGAAVIYNKDKAWDDQWIFWLGPFIGAAIAAFYHQYILRAGAIKALGSFRSNA

SEQ ID NO: 25275 - protein, 279 aa, Daucus carota
KDGEVAEQSGFSSKDYHDPPPAAFIGTDELTKWSFYRALIAEFIATLLFLYITVLTVIGYKSQSSTDQCGGVGLLGIAWAFGGMIFVLVYCTAGISGGHINPAVTFGLFLARKVSLIRAVMYMVAQCLGAICGVGLVKAFQKSYYNRYGGGANELADGYNKGTGLGAEIIGTFVLVYTVFSATDPKRNARDSHVPVLAPLPIGFAVFMVHLATIPITGTGINPARSFGAAVIYNKEKAWDDQWIFWVGPFIGAAIAAFYHQFILRAAAVKALGSFRSNA

SEQ ID NO: 25276 - protein, 286 aa, Eucalyptus grandis
MAKDMEVGGGHGSFQSKDYQDPPPAPLVDAEELGQWSFYRAIIAEFIATLLFLYITVLTVIGYKSQVETSGDQCGGVGILGIAWAFGGMIFVLVYCTAGISGGHINPAVTFGLFLARKVSLVRAVLYMVAQCLGAVCGCGLVKQFQKAYYIEQGGGANGLSEGYSTGTGLAAEIIGTFVLVYTVFSATDPKRNARDSHVPVLAPLPIGFAVFMVHLATIPITGTGINPARSFGAAVMYGKQKAWDEQWIFWVGPFIGAAIAAFYHQYILRAGAAKALGSFRSSSVV

SEQ ID NO: 25277 - protein, 286 aa, Manihot esculenta
MAKDVEVAENPGEFSGKDYHDPPPAPLIDVEELGKWSFYRALIAEFIATLLFLYITVLTVIGYKSQTDPAKNSDACGGVGILGIAWAFGGMIFILVYCTAGISGGHINPAVTFGLFLARKVSLIRALLYMVAQCLGAICGCGLVKAFQKAYYNRYGGGANELSSGYSKGTGLGAEIIGTFVLVYTVFAATDPKRNARDSHVPVLAPLPIGFAVFMVHLATIPITGTGINPARSFGAAVIYNKDKAWDDQWIFWVGPFIGAAIAAFYHQYILRAAAIKALGSFRSNA

SEQ ID NO: 25278 - protein, 284 aa, Arnica chamissonis
MAKDIEVGSHEYGSKDYQDPPPADLFDADELTKWSFYRAIIAEFIATLLFLYITVLTVIGYKSQTDPKNNADQCGGVGILGIAWAFGGMIFVLVYCTAGISGGHINPAVTFGLFLARKVTLPRAFMYIVAQCLGAMCGCGLVKAFQKSHYNTYGGGANELADGYTKGTGLGAEIIGTFVLVYTVFSATDPKRNARDSHVPVLAPLPIGFAVFMVHLATIPITGTGINPARSFGAAVMYGKDKAWDDQWLFWVGPMIGAAIAAFYHQYVLRAAAVKALGSFRSNA

SEQ ID NO: 25279 - protein, 285 aa, Cyclamen graecum
MAKDIGVGPGGGYAPKDYQDPPPAPLIDAEELTKWSLYRATIAEFIATLLFLYITVLTVIGYKSQTDPSKNPDGCGGVGILGIAWAFGGMIFVLVYCTAGISGGHINPAVTFGLFLARKVSLARAILYIVAQCLGAVCGCGLVKAFQKSYYTQYGGGANTVQDGYSNRTGLGAEIIGTFVLVYTVFSATDPKRSARDSHVPVLAPLPIGFAVFMVHLATIPITGTGINPARSFGAAVIYGKQQPWDDQWIFWAGPFIGAAIAAFYHQYILRAGAVKALGSFRSTA

SEQ ID NO: 25280 - protein, 283 aa, Euphorbia peplus
MGKDIEVSGGSKDYQDPPPAPLIDADELTQWSFYRAIIAEFIATLLFLYITVLTVIGYKSQTDPAKNADACGGVGILGIAWAFGGMIFVLVYCTAGISGGHINPAVTFGLFLARKVSLIRAIMYMVAQCLGAICGCGLVKAFQKAYYNRYGGGANELADGYSTGTGLGAEIIGTFVLVYTVFSATDPKRSARDSHVPVLAPLPIGFAVFMVHLATIPVTGTGINPARSFGAAVIYNQDKAWDDQWIFWVGPFIGAAIAAFYHQYVLRAGAIKALGSFRSSSNI

SEQ ID NO: 25281 - protein, 283 aa, Rosmarinus officinalis
MTKDVEAVGGHDYGAKDYQDPPPAQLIDMEELGKWSLYRAAIAEFIATLLFLYVTVLTVIGYKSQSAASQCGGVGILGIAWAFGGMVFVLVYCTAGISGGHINPAVTFGLLLARKVSLVRAVLYIVAQCLGAICGCGLVKAFQKTYYVQYGGGANELSDGYSTGTGVAAEIIGTFVLVYTVFSATDPKRNARDSHVPVLAPLPIGFAVFMVHLATIPVTGTGINPARSFGAAVIYGKDKAWDDQWIFWVGPFVGAAIASIYHQFVLRAGAVKALGSFRSSSYN

SEQ ID NO: 25282 - protein, 280 aa, Amaranthus tuberculatus
MGKDMDVGGAMVKDYQDPPPSPLIDAEELGKWSFYRAVIAEFIATLLFLYITVLTVIGHKAQNEADQCNGVGLLGIAWAFGGMIFVLVYCTAGISGGHINPAVTFGLLLARKLTLVRAILYMVAQCLGAICGVGLVKAFQSAYYNKYGGGANTLADGYSTGTGLGAEIIGTFVLVYTVFSATDPKRSARDSHVPVLAPLPIGFAVFMVHLATIPVTGTGINPARSFGAAVIYNSSKAWDDQWIFWVGPFIGAAIAAIYHQYILRAGFVKALGSFRSSSNV

SEQ ID NO: 25283 - protein, 281 aa, Lippia dulcis
MTKDVEGGAAEYSVKDYQDPPPAPLIDAEELGKWSLYRAVIAEFIATLLFLYITVLTVIGYKSQSAADECGGVGILGIAWAFGGMIFILVYCTAGISGGHINPAVTFGLLLARKVSLVRAVLYIVAQCLGAICGCGLVKAFQKSYYIRHGGGANTLADGYSTGTGLAAEIIGTFVLVYTVFSATDPKRSARDSHVPVLAPLPIGFAVFMVHLATIPITGTGINPARSFGAAVIFGSDQAWDDQWIFWVGPLIGAAIAAIYHVLVLRAGAVKALGSFRSSSY

SEQ ID NO: 25284 - protein, 284 aa, Eucalyptus grandis
MGKDLEGAQPPLAARDYQDPPPAPLVDPEELGKWSFYRALIAEFIATMLFLYITVLTVIGYKSQTDPTMNGSDCGGVGILGIAWAFGGMIFVLVYCTAGISGGHINPAVTFGLFLARKVSLVRAVMYMVAQCLGAICGCGLVKAFQRAYYTRYGGGANELADGYSKGVGLGAEIVGTFVLVYTVFSATDPKRNARDSHVPVLAPLPIGFAVFMVHLATIPITGTGINPARSFGAAVIYNKDKAWDDQWMFWVGPFIGAAIAAFYHQYILRAGAVKALGSFRSNA

SEQ ID NO: 25285 - protein, 283 aa, Helianthus annuus
GKDVEVGGHEYGAKDYQDPPPADLFDAKELTKWSFYRAIIAEFIATLLFLYITVLTVIGYKSQTDPAHSPDQCGGVGILGIAWAFGGMIFVLVYCTAGISGGHINPAVTFGLFLARKVTLPRAFMYIVAQCLGAICGCGLVKAFQKPSSNTYGGGPNELADAYSKGTGLGAEIIGTFVLVYTVFSATDPKRNARDSHVPVLAPLPIGFAVFMVHLATIPITGTGINPARSFGAAVMYGKDKAWDDQWLFWVGPMIGAAIAAFYHQYVLRAGAVKALGSFRSNA

SEQ ID NO: 25286 - protein, 283 aa, Theobroma cacao
  Sequence also found in Organisms: Pteridium aquilinum
MAKDIEVGGQFQAKDYHDPPPAPLVDAEELTKWSFYRAIIAEFIATLLFLYITVLTVIGYKSQIDKGGDECGGVGILGIAWAFGGMIFILVYCTAGISGGHINPAVTFGLFLARKVSLVRAILYMAAQCLGAICGCGLVKAFQKSYYNRYGGGANSLADGYSTGTGLGAEIIGTFVLVYTVFSATDPKRNARDSHVPVLAPLPIGFAVFMVHLATIPITGTGINPARSFGAAVMYNQDKPWDDQWIFWVGPFIGAAIAAIYHQYILRAAAAKALGSFRSSSAM

SEQ ID NO: 25287 - protein, 275 aa, Chrysanthemum coronarium
DHYGAKDYQDPPPSPLFDSEELTKWSFYRAIIAEFIATMLFLYITVLTVIGYKSQVDPAHSKDQCGGVGILGIAWAFGGMIFVLVYCTAGISGGHINPAVTFGLFLARKVTLPRAFMYIVAQCLGAICGCGLVKAFQKTYYHNYGGGANELADGYSTGTGLGAEIIGTFVLVYTVFSATDPKRNARDSHVPVLAPLPIGFAVFMVHLATIPITGTGINPARSFGAAVMYGTEKAWDDQWLFWVGPMIGAAIAAFYHQYVLRAGAVKALGSFRSNA

SEQ ID NO: 25288 - protein, 284 aa, Mimulus guttatus
MAKDIEGGAAAHEYGAKDYHDPPPAPLIDSEELTKWSLYRAVIAEFTATLLFLYITVLTVIGYKSQSAADGCGGVGILGIAWAFGGMIFVLVYCTAGISGGHINPAVTFGLFLARKVSLVRAVLYIIAQCLGAICGCGLVKAFQKSYYVEHGGGANELALGYSKGTGLAAEIIGTFVLVYTVFSATDPKRSARDSHVPVLAPLPIGFAVFMVHLATIPITGTGINPARSFGAAVIYGKDKAWDDQWIFWVGPFIGAAIAAIYHQYILRAGAVKALGSFRSSSYN

SEQ ID NO: 25289 - protein, 283 aa, Ananas comosus
MTKDIEVGPGEYASKDYEDPPPAPLIDAEELTKWSLYRATIAEFVATLLFLYITVLTVIGYKSQTDLKKNLDGCGGVGILGIAWAFGGMIFVLVYCTAGISGGHINPAVTFGLFLARKVSLVRAILYIVAQCLGAICGCGLVKAFQKSYTQYGGGANELSDDYNTGTGLGAEIIGTFVLVYTVSSATDPKRSARDSHVPVLAPLPIGFAVFMVHLATIPITGTGINPARSFGAAVIYGKQKAWDDQWIFWVGPFIGAAIAAFYHQYILRAAAVKAIGSFRSTT

SEQ ID NO: 25290 - protein, 283 aa, Valeriana officinalis
MTKDVEVADYTGGKDYQDPPPVSLFDSEELTKWSFYRAIIAEFIATLLFLYITVLTVIGYKSQTDPLKGTDQCGGVGILGIAWAFGGMIFVLVYCTAGISGGHINPAVTFGLFLARKVSLCRAVLYMIAQCLGAICGCGLVKAFQKTYYNTYGGGANELAPGYSKGTGLGAEIIGTFVLVYTVFSATDPKRNARDSHVPVLAPLPIGFAVFMVHLATIPITGTGINPARSLGAAVIYGREKAWDDQWIFWVGPFIGAAIAAIYHQFVLRAAAVKALGSFRSNA

SEQ ID NO: 25291 - protein, 281 aa, Daucus carota
MGKEEVAEATHEYSGKDYQDPPPADFIGIDDLGKWSFYRALIAEFIATLLFLYITVLTVIGYKSQSATDECGGVGLLGIAWAFGGMIFILVYCTAGISGGHINPAVTFGLFLARKVSLIRAVMYMVAQCLGAICGVGLVKAFQKSYYNKYGGGANELADGYNKGTGLGAEIIGTFVLVYTVFSATDPKRNARDSHVPVLAPLPIGFAVFMVHLATIPITGTGINPARSFGAAVIYNKDKAWDDQWIFWVGPFIGAAIAAFYHQYILRAAAIKALGSFRSNA

SEQ ID NO: 25292 - protein, 289 aa, Fraxinus spp
SELLSLISANGKDVEVGAEYTTKDYQDPPPALLIDPEELTKWSFYRAIIAEFIATLLFLYITVLTVIGYKSQSAADECGGVGILGIAWAFGGMIFILVYCTAGISGGHINPAVTLGLFLARKVSLIRAIMYMVAQCLGAICGCGLVKAFQKSYYVKFGGGANGLAEGYSNGTGLAAEIIGTFVLVYTVFSATDPKRNARDSHVPVLAPLPIGFAVFMVHLATIPITGTGINPARSLGAAVIYGKDEAWDDQWIFWVGPFIGAAIAAFYHQYILRAGAVKALGSFRSTAY

SEQ ID NO: 25293 - protein, 281 aa, Prunus persica
MAKDVEGAEHGEFAAKDYHDPPPTPFFDPEELTKWSFYRALIAEFVATLLFLYITVLTVIGYKSQSSGDQCGGVGILGIAWAFGGMIFVLVYCTAGISGGHINPAVTFGLFLARKVSLPRAVLYIVAQSLGAICGVGLVKAFQKTYYEEYGGGANELAAGYNKGTGLGAEIIGTFVLVYTVFSATDPKRNARDSHVPVLAPLPIGFAVFIVHLATIPITGTGINPARSFGAAVIYNKDKAWDDQWIFWLGPFIGAAIAALYHQYILRAGAIKALGSFRSNA

SEQ ID NO: 25294 - protein, 286 aa, Vinca minor
MAKDVEVAGGAEYVTKDYQDPPPAPLIYPEELIQWSFYRAIIAEFIATLLFLYITVLTVIGYSSQSDEKNGGDQCGGVGILGIAWAFGGMIFILVYCTAGISGGHINPAVTFGLFLARKVTLVRAIMYMLAQCLGAICGCGLVKAFQRAYYLRYGGGANMLNDGYNTGTGLGAEIIGTFVLVYTVFSATDPKRNARDSHVPVLAPLPIGFAVFMVHLATIPITGTGINPARSFGAAVIYGKQKSWDDHWIFWVGPFIGAAIAALYHQYVLRASAAKAMGSFKSTAY

SEQ ID NO: 25295 - protein, 285 aa, Conyza canadensis
MSKDIEVGGHDQYGARDYQDPPPAALFDSEELTKWSFYRAIIAEFVATLLFLYVTVLTVIGYKSQVDPAHSPDQCGGVGILGIAWAFGGMIFVLVYCTAGISGGHINPAVTFGLFLARKVTLPRAFMYIVAQCLGAICGCGLVKAFQKTYYTTYGGGANELADGYNKGTGLGAEIIGTFVLVYTVFSATDPKRNARDSHVPVLAPLPIGFAVFMVHLATIPITGTGINPARSFGAAVIYGKDKAWDDQWLFWIGPMIGAAIAAFYHQYVLRAGAVKALGSFRSNA

SEQ ID NO: 25296 - protein, 285 aa, Malus domestica
MGKDIEVGGGYSAKDYQDPPPEPLIDAEELGKWSFYRAIIAEFIATLLFLYITVLTVIGYKSQTDTALNGDQCGGVGILGIAWAFGGMIFVLVYCTAGISGGHINPAVTFGLLLARKVSLVRAILYMTAQSLGAICGVGLVKAFQSSYYTKYGGGANELADGYSTGTGLGAEIVGTFVLVYTVFSATDPKRNARDSHVPVLAPLPIGFAVFIVHLATIPITGTGINPARSLGAAVIYNNDKAWNDQWIFWVGPFIGAAIAALYHQYILRAGAVKALGSFRSSPNI

SEQ ID NO: 25297 - protein, 284 aa, Cynara scolymus
MAKDVGVGGHDYTARDYQDPPPADLFDAEELTKWSFYRAIIAEFVATLLFLYITVLTVIGYKSQTDPIHSSDQCGGVGILGIAWAFGGMIFVLVYCTAGISGGHINPAVTFGLLLARKVSLPRAVMYIVAQCLGAICGCGLVKAFQKTYYDNYGGGANALADGYSKGTGFGAEIIGTFVLVYTVFSATDPKRNARDSHVPVLAPLPIGFAVFMVHLATIPITGTGINPARSFGAAVIYGKAKAWDDQWLFWVGPMIGAAIAAIYHQYVLRAGAVKALGSFRKHA

SEQ ID NO: 25298 - protein, 283 aa, Rosa hybrid cultivar
MAKDVEVAERGSFSAKDYHDPPPAPLFDSVELTKWSFYRAVIAEFIATLLFLYITVLTVIGYKSQSETDDCGGVGILGIAWAFGGMIFILVYCTAGISGGHINPAVTFGLFLARKVSLVRAVMYIVAQSLGAIAGVGLVKAFQSSYYKKFGGGANTLADGYSTGVGLSAEIIGTFVLVYTVFSATDPKRSARDSHVPVLAPLPIGFAVFMVHLATIPITGTGINPARSLGAAVILDDKKAWDDQWIFWVGPFIGAAIAAFYHQFILRAGAVKALGSFRSNPHN

SEQ ID NO: 25299 - protein, 281 aa, Prunus mume
MAKDVEGAEHGEFAAKDYHDPPPTPFFDAEELTKWSFYRALIAEFVATLLFLYITVLTVIGYKSQSSGDQCGGVGILGIAWAFGGMIFVLVYCTAGISGGHINPAVTFGLFLARKVSLPRAVLYIVAQSLGAICGVGLVKAFQKTYYEEYGGGANELAAGYNKGTGLGAEIIGTFVLVYTVFSATDPKRNARDSHVPVLAPLPIGFAVFIVHLATIPITGTGINPARSFGAAVIYNKDKAWDDQWIFWLGPFIGAAIAALYHQYILRAGAIKALGSFRSNA

SEQ ID NO: 25300 - protein, 287 aa, Lotus japonicus
MAKDVEVAERGSFSSKDYHDPPPAPLIDAEELTKWSFYRAVIAEFIATLLFLYITVLTVIGYKVQSDVKNGGDDCGGVGILGIAWAFGGMIFILVYCTAGISGGHINPAVTFGLFLARKVSLIRAILYMVAQCLGAICGVGLVKAFQKSHYNKYGGGANSLNDGYSTGTGLGAEIIGTFVLVYTVFSATDPKRSARDSHVPVLAPLPIGFAVFMVHLATIPVTGTGINPARSFGAAVIFNQSKPWDDHWIFWVGPFIGAAIAAFYHQFILRAGAVKALGSFRSNPTV

SEQ ID NO: 25301 - protein, 288 aa, Manihot esculenta
MAKDIEVGGHGSDFQAKDYHDPPPAPLIDAEELTQWSFYRAIIAEFIATLLFLYITVLTVIGYKSQTDPTKNADACGGVGILGIAWAFGGMIFILVYCTAGISGGHINPAVTFGLFLARKVSLVRAVLYMVAQCLGAICGCGLVKAFQKAYYNRYGGGANELADGYSTGTGLGAEIIGTFVLVYTVFSATDPKRNARDSHVPVLAPLPIGFAVFMVHLATIPVTGTGINPARSLGAAVIYNQDKAWDDQWIFWVGPFIGAAIAAFYHQYILRASAAKALGSFRSSSNI

SEQ ID NO: 25302 - protein, 286 aa, Phaseolus vulgaris
MAKHDVEGGSFSAKDYHDPPPAPLIDAQELTQWSFYRALIAEFIATLLFLYITVLTVIGYKSQSDAITAGGDLCGGVGILGIAWAFGGMIFILVYCTAGISGGHINPAVTFGLFLARKVSLIRAIMYMVAQCLGAICGVGLVKAFQKAYYTRYGGGANELSEGYSTGVGLGAEIIGTFVLVYTVFSATDPKRNARDSHVPVLAPLPIGFAVFMVHLATIPVTGTGINPARSLGAAVIYNKEKAWDDQWIFWVGPFIGAAIAAFYHQFILRAGAAKALGSFRSNPTI

SEQ ID NO: 25303 - protein, 281 aa, Vaccinium corymbosum
MSKDVEVAEQPEYQPKDYQDPPPAPLVDAEELIKWSFYRAVIAEFIATLLFLYITVLTVIGYKSQSAADQCGGVGFLGIAWAFGGMIFVLVYCTAGISGGHINPAVTFGLFLARKVSLIRAVSYMVAQCLGAICGVGLVKGFQKGYYDTYGGGANEVQPGYNKGTALGAEIIGTFVLVYTVFSATDPKRSARDSHVPVLAPLPIGFAVFMVHLATIPITGTGINPARSFGAAVIFNKSKAWDDQWIFWVGPFVGAAIAAFYHQFILRAAAIKALGSFRSNA

SEQ ID NO: 25304 - protein, 281 aa, Daucus carota
MGKEEVAEATHEYSGKDYQDPPPADFIGIDDLGKWSFYRALIAEFIATLLFLYITVLTVIGYKSQSATDECGGVGLLGIAWAFGGMIFILVYCTAGISGGHINPAVTFGLFLARKVSLIRAVMYMVAQCLGAICGVGLVKAFQKSYYNRYGGGANELADGYNKGTGLGAEIIGTFVLVYTVFSATDPKRNARDSHVPVLAPLPIGFAVFMVHLATIPITGTGINPARSFGAAVIYNKDKAWDDQWIFWVGPFIGAAIAAFYHQYILRAAAIKALGSFRSNA

SEQ ID NO: 25305 - protein, 288 aa, Hevea brasiliensis
MAKDVEVGGQGGEFQAKDYNDPPPAPLIDAEEFTQWSFYRAIIAEFIATLLFLYITVLTVIGYKSQTDPAKNADPCGGVGILGIAWAFGGMIFILVYCTAGISGGHINPAVTLGLFLARKVSLVRAILYMAAQCLGAICGCGLVKAFQKAYYNRYGGGANELADGYSKGTGLGAEIIGTFVLVYTVFSATDPKRNARDSHVPVLAPLPIGFAVFMVHLATIPVTGTGINPARSFGAAVIYNQDKAWDDQWIFWVGPFIGAAIAAFYHQYILRAAAVKALGSFRSTSNI

SEQ ID NO: 25306 - protein, 287 aa, Citrus sinensis
MAKDIEVGREGEFHDKDYHDPPPAPLIGAEELTRWSFYRAIIAEFIATLLFLYITVLTVIGHKSQTDAKHGGDGCGGVGILGIAWAFGGMIFVLVYCTAGISGGHINPAVTFGLFLARKVSLVRAVMYMVAQCLGAICGCGLVKAFQKSYYTRYGGGANELADGYSTGTGLGAEIIGTFVLVYTVFSATDPKRNARDPHVPVLAPLPIGFAVFMVHLATIPVTGTGINPARSLGAAVIYNKDKAWDDQWIFWVGPFIGAAIAAFYHQFILRASASKALGSFKSSSNI

SEQ ID NO: 25307 - protein, 281 aa, Petroselinum crispum
MGKEEVAEQGQEYSGKDYQDPPPADFIGIDDLGKWSFYRALIAEFIATLLFLYITVLTVIGYKSQSAADQCGGVGLLGIAWAFGGMIFILVYCTAGISGGHINPAVTFGLFLARKVSLIRAVMYMVAQCLGAICGVGLVKAFQKSYYNRYGGGANELADGYNKGTGLGAEIIGTFVLVYTVFSATDPKRNARDSHVPVLAPLPIGFAVFMVHLATIPITGTGINPARSFGAAVIYNQDKAWDDQWMFWVGPFIGAAIAAFYHQYILRAAAIKALGSFRSNA

SEQ ID NO: 25308 - protein, 287 aa, Cajanus cajan
MAKDVEVTERGSFSGKDYHDPPPAPLIDAEELTKWSFYRALIAEFIATLLFLYITVLTVIGYKHQSDLKAGGDLCGGVGILGIAWAFGGMIFILVYCTAGISGGHINPAVTFGLFLARKVSLIRAIMYMVAQCLGAICGVGLVKAFQKSYFNKYGGGANSLADGYNKGTGLGAEIIGTFVLVYTVFSATDPKRNARDSHVPVLAPLPIGFAVFMVHLATIPVTGTGINPARSLGAAVIYNQDKPWDDHWIFWVGPFIGAAIAAFYHQFILRAGAVKALGSFRSNPNV

SEQ ID NO: 25309 - protein, 285 aa, Glycine max
MAKHDVEGGSFSAKDYHDPPPAPLIDAEELTQWSFYRALIAEFIATLLFLYITVLTVIGYKSQSDVKAGGDVCGGVGILGIAWAFGGMIFILVYCTAGISGGHINPAVTFGLFLARKVSLIRAIMYMVAQCLGAMCGVGLVKAFQKAYYNRYGGGANELSEGYSTGVGLGAEIIGTFVLVYTVFSATDPKRNARDSHVPVLAPLPIGFAVFMVHLATIPVTGTGINPARSFGAAVMYNQKKAWDDQWIFWVGPFIGAAIAAFYHQFILRASAAKAVGSFRSNPTI

SEQ ID NO: 25310 - protein, 285 aa, Populus trichocarpa
MAKDMEVAEAGSFSAKDYHDPPPAPLFDAKELTKWSFYRALIAEFIATLLFLYITVLTVIGYKSQIDGSADSCGGVGILGIAWAFGGMIFVLVYCTAGISGGHINPAVTFGLFIARKVSLIRAVMYMVAQCLGAICGVGLVKAFQKSYYKKYGGGANTLADGFSTGTGLGAEIIGTFVLVYTVFSATDPKRSARDSHVPVLAPLPIGFAVFMVHLATIPITGTGINPARSLGAAVIYNQDKAWDDHWIFWVGPFAGAAIAAFYHQFILRAGAVKALGSFRSAQRF

SEQ ID NO: 25311 - protein, 285 aa, Glycine max
MAKHDVEGGSFAAKDYHDPPPAPLIDAEELTQWSFYRALIAEFIATMLFLYITVLTVIGYKSQSDVKAGGDVCGGVGILGIAWAFGGMIFILVYCTAGISGGHINPAVTFGLFLARKVSLIRAIMYMVAQCLGAICGVGLVKAFQKAYYNRYGGGANELSEGYSTGVGLGAEIIGTFVLVYTVFSATDPKRNARDSHVPVLAPLPIGFAVFMVHLATIPVTGTGINPARSLGAAVMYNQQKAWDDHWIFWVGPFIGAAIAAFYHQFILRASAAKALGSFRSNPTI

SEQ ID NO: 25312 - protein, 285 aa, Eschscholzia californica
MGKDIEVSEQSGFTTKDYSDPPPAPLFDLEELSKWSFYRALIAEFIATLLFLYITVLTVIGYKSQVAISGDECGGVGILGIAWAFGGMIFVLVYCTAGISGGHINPAVTFGLFLARKVSLIRAVLYMVAQCLGAICGVGLVKAFQKAYYVRYGGGANELAHGYSKGTGLAAEIIGTFVLVYTVFSATDPKRSARDSHIPVLAPLPIGFAVFMVHLATIPITGTGINPARSFGAAVIYNKDKAWDDQWIFWVGPFIGAAIAAFYHQFILRAAAVKALGSFRSNAHN

SEQ ID NO: 25313 - protein, 286 aa, Papaver somniferum
MGKDIEPSHEQGGGYAAKDYHDPPPAPFFDMDELTKWSFYRALIAEFIATLLFLYITVLTVIGYKSQIAGGDDCGGVGILGIAWAFGGMIFVLVYCTAGISGGHINPAVTFGLFLARKVSLIRAVLYMVAQCLGAICGVGLVKAFQKSYYVQFGGGANELNDGYSTGTGLAAEIIGTFVLVYTVFSATDPKRSARDSHIPVLAPLPIGFAVFMVHLATIPITGTGINPARSFGAAVIYNKNKAWDDQWIFWVGPFIGAAIAAFYHQFILRAAAVKALGSFRSNAHN

SEQ ID NO: 25314 - protein, 284 aa, Fragaria vesca
MGRDIEVGGFAAKDYQDPPPTPLIDPEEFGKWSFYRAIIAEFVATLLFLYITVLTVIGYKSQSDTLKGGDQCGGVGILGIAWAFGGMIFVLVYCTAGISGGHINPAVTFGLFLARKVSLPRAVLYIVAQCLGAICGCGLVKSFQSALYSNYGGGANGLADGYSEGTGLAAEIIGTFVLVYTVFSATDPKRNARDSHVPVLAPLPIGFAVFMVHLATIPITGTGINPARSFGAAVIYNNEKAWDDHWIFWVGPFIGAAIAALYHQNILRAGAAKASGSFRSSSNV

SEQ ID NO: 25315 - protein, 279 aa, Taraxacum officinale
MTKDVPEQGSLSAKDYHDPPPAPFIDPEELTKWSFYRALIAEFIATLLFLYITVLTVIGYKSQTDPALNADQCGGVGILGIAWAFGGMIFVLVYCTAGISGGHINPAVTFGLFLARKVSLIRAIMYMVAQCLGAICGVGLVKAFHKSYYVRYGGGANELADGYNTGTGLGAEIIGTFVLVYTVFSATDPKRSARDSHVPVLAPLPIGFAVFMVHLATIPITGTGINPARSLGAAVIYNKAKAWDDQWIFWVGPFIGAAIAAFYHQFILRAGAIKALGSF

SEQ ID NO: 25316 - protein, 284 aa, Eucalyptus grandis
MTKHAAEHGSFSAKDYQDPPPAPLIDPVELGKWSFYRALIAEFIATLLFLYITVLTVIGYKSQTDDKKPGTDACGGVGILGIAWAFGGMIFVLVYCTAGISGGHINPAVTFGLFLARKVSLVRAIMYMVAQCLGAICGVGLVKLFQKSYYEQYGGGANMLAEGYKTRVGLGAEIIGTFVLVYTVFSATDPKRSARDSHVPVLAPLPIGFAVFMVHLATIPITGTGINPARSLGAAVIYNKDKAWDDQWIFWVGPFIGAAIAAFYHQFILRAGAVKALGSFRSNP

SEQ ID NO: 25317 - protein, 281 aa, Castanea mollissima
MAAKDIEGFPSKDYHDPPPAPLVDAEELTQWSFYRAIIAEFIATLLFLYITVLTVIGYKSQVDHSTDPCTGVGILGIAWAFGGMIFVLVYCTAGISGGHINPAVTFGLFLARKVSLVRAILYMVAQCLGAICGCGLVKAFQRAFYSKYGGGANELALGYSKGTGLAAEIIGTFVLVYTVFSATDPKRNARDSHVPVLAPLPIGFAVFMVHLATIPITGTGINPARSFGAAVIYNEKKAWDDQWLFWVGPFIGAAIAAFYHQYILRAGAIKALGSFRSSSAM

SEQ ID NO: 25318 - protein, 272 aa, Cichorium intybus
SAKDYQDPPPAQLFDAEELTKWSFYRAIIAEFIATLLFLYITVLTVIGYKAQTDPAHSSDQCGGVGILGIAWAFGGMIFVLVYCTAGISGGHINPAVTFGLFLARKVTLPRAVLYIVAQCLGAICGCGLVKAFQKTYYHTYGGGANELADGYSKGTGLGAEIIGTFVLVYTVFSATDPKRNARDSHVPVLAPLPIGFAVFMVHLATIPITGTGINPARSFGAAVMYGKDKAWDDQWIFWVGPMIGAAIAAFYHQYVLRAGAVKALGSFRSNA

SEQ ID NO: 25319 - protein, 284 aa, Eucalyptus grandis
MGKDMESGEPPFGARDYQDPPPAPLVDPEELGKWSFYRALIAEFIATMLFLYITVLTVIGYKSQVDPALNGTECDGVGILGIAWAFGGMIFVLVYCTAGISGGHINPAVTFGLFLARKVSLVRAVMYMVAQCLGAICGCGLVKAFQKARYTRYGGGANELSDGYSKGVGLGAEIIGTFVLVYTVFSATDPKRNARDSHVPVLAPLPIGFAVFMVHLATIPVTGTGINPARSLGAAVMYNKDKAWDDQWMFWVGPFIGAAIAAFYYQYILRAGAVKAFGSSRSNA

SEQ ID NO: 25320 - protein, 277 aa, Valeriana officinalis
EVAEFTAKDYQDPPPVSLFDSEELTKWSFYRAIIAEFIATLLFLYITVLTVIGYKSQTDPLKGTDQCGGVGILGIAWAFGGMIFVLVYCTAGISGGHINPAVTFGLFLARKVSLCRAVLYMIAQCLGAICGCGLVKAFQKTYYNSYGGGANELALGYSKGTGLAAEIIGTFVLVYTVFSATDPKRNARDSHVPVLAPLPIGFAVFMVHLATIPITGTGINPARSFGAAVIYGREKAWDDQWIFWVGPFIGAAIAAIYHQFILRAAALKALGSFRSNA

SEQ ID NO: 25321 - protein, 281 aa, Rosa hybrid cultivar
MAKDVEGAEHSEFAAKDYHDPPPTPLFDAEELTKWSFYRALIAEFIATLLFLYITVLTVIGYKEQSKLDQCGGVGILGIAWAFGGMIFVLVYCTAGISGGHINPAVTFGLFLARKVSLLRAVLYIVAQCLGAISGVGLVKAWQKTLYVEHGGGANELSPGYSKGIGLAAEIIGTFVLVYTVFSATDPKRNARDSHVPVLAPLPIGFAVFMVHLATIPITGTGINPARSFGAAVIYNQDKAWDDQWMFWVGPFIGAAIAAFYHQFVLRAGAIKALGSFRSNA

SEQ ID NO: 25322 - protein, 285 aa, Eucalyptus grandis
MAKDVEVAEPAEFAAKDYHDPPPAPLFDAEELTKWSFYRALIAEFIATLLFLYITVLTVIGYKSQTDPALKGTDCDGVGILGIAWAFGGMIFILVYCTAGISGGHINPAVTFGLFLARKVSLIRAVSYMVAQCLGAICGCGLVKAFQKAYYTRYGGGANEVQPGYSKGTALGAEIIGTFVLVYTVFSATDPKRNARDSHVPVLAPLPIGFAVFMVHLATIPVTGTGINPARSFGAAVMYGHDKAWDDQWIFWVGPFLGAAAAAFYYQFVLRAAAIKALGSFRSNA

SEQ ID NO: 25323 - protein, 287 aa, Cannabis sativa
MVKDVEVGGQQGYSAKDYQDPPPAPLFDAEELGQWSFYRAIIAEFVATLLFLYITVLTVIGYKSQTDPAKSADACGGVGILGIAWAFGGMIFVLVYCTAGISGGHINPAVTFGLFLARKVSLVRTILYIVAQCLGAICGCGLVKAFQSAYYDKYGGGANSLADGYSTGTGLAAEIIGTFVLVYTVFSATDPKRSARDSHVPVLAPLPIGFAVFMVHLATIPITGTGINPARSFGAAVIFNQEKPWNDHWIFWVGPFIGAAIAAFYHQFVLRAAAVKALGSFRSTNTM

SEQ ID NO: 25324 - protein, 285 aa, Taraxacum officinale
MGKDVEVGGGHEYTAKDYQDPPPAAFFDAEELTKWSFYRAIIAEFVAALLFLYITVLTVIGYKAQTDPLHSDDQCGGVGILGIAWAFGGMIFVLVYCTAGISGGHINPAVTFGLFLARKVTFPRAVLYIVAQCLGAICGCGLVKAFQKTYYNTYGGGANELADGYNKGTGLGAEIIGTFVLVYTVFSATDPKRNARDSHVPVLAPLPIGFAVFMVHLATIPITGTGINPARSFGAAVMYGKDKAWDDQWIFWVGPMIGAAIAAFYHMFVFRAAAVKALGSFRSNA

SEQ ID NO: 25325 - protein, 285 aa, Panax ginseng
MTKDVEVAEHGSFSTKDYHEPPPVALFDPDELTQWSFYRALIAEFIATFLFLYITVLTVIGYKSQIDPTNDGDQCGGVGILGIAWAFGGMIFVLVYCTAGISGGHINPAVTFGLFLARKVSLVRAIMYMVAQCLGAICGVGLVKAFQKSYYQRYGGGANGLNDGYSTGTGLAAEIIGTFVLVYTVFSATDPKRNARDSHVPVLAPLPIGFAVFMVHLATIPITGTGINPARSFGAAVIYNEDEAWDDQWLFWVGPFIGAAIAAFYHQFILRAGAIKALGSFRSNA

SEQ ID NO: 25326 - protein, 279 aa, Guizotia abyssinica
MTKDVEVAEHHGGKDYHDPPPAPLIDAEELTKWSFYRALIAEFIATLLFLYVTVLTVIGYKSQSATDECGGVGILGIAWAFGGMIFILVYCTAGISGGHINPAVTFGLFLARKVSLIRALGYMVAQCLGAICGVGLVKAFQSSYYNKFGGGANELSADYNKGTGLGAEIIGTFVLVYTVFSATDPKRSARDSHVPVLAPLPIGFAVFMVHLATIPITGTGINPARSFGAAVIYNNEKAWDDQWIFWVGPFVGAAIAAFYHQFVLRAAAIKALGSFRSNA

SEQ ID NO: 25327 - protein, 285 aa, Quercus alba
MAKDVEVAERGEYSAKDYHDPPPAPLIDPEELTQWSFYRALIAEFIATLLFLYITVLTVIGYKSQTDPLKNADQCGGVGILGIAWAFGGMIFVLVYCTAGISGGHINPAVTFGLFLARKVSLIRAVLYMVAQCLGAICGVGLVKAFQKSLYTRYGGGANELAAGYNKGTGLGAEIIGTFVLVYTVFSATDPKRNARDSHVPVLAPLPIGFAVFMVHLATIPITGTGINPARSFGAAVIFNQSKAWDDHWIFWVGPFVGAAIAAFYHQFILRAAAIKALGSFRSNA

SEQ ID NO: 25328 - protein, 283 aa, Tabernaemontana elegans
MAKNIEVGGPEYATKDYQDPPPEPLIDPEELTKWSFYRAVIAEFIATLLFLYVTVLTVIGYKSQTDLKSGGDQCGGVGILGIAWAFGGMIFVLVYCTAGISGGHINPAVTFGLFLARKVSLIRAIMYIVAQCLGAICGCGLVKAFQRAYYVRYGGGANGVSAGYSRGTGLAVEIIGTFILVYTVFSATDPKRNARDSHVPVLAPLPIGFAVFMVHLATIPITGTGINPARSFGASVIYSKAWDNHWIFWVGPFIGAAITALYHQYVLRAGAVKALGSFKSTTY

SEQ ID NO: 25329 - protein, 269 aa, Cichorium intybus
DYQDPPPAQLFDAEELTKWSFYRAIIAEFIATLLFLYITVLTVIGYKAQTDPAHSSDQCGGVGILGIAWAFGGMIFVLVYCTAGISGGHINPAVTFGLFLARKVTLPRAVMYIVAQCLGAICGCGLVKAFQKTYYHTYGGGANELADGYSKGTGLGAEIIGTFVLVYTVFSATDPKRNARDSHVPVLAPLPIGFAVFMVHLATIPITGTGINPARSFGAAVMYGKDKAWDDQWIFWVGPMIGAAIAAFYHQYVLRAAAVKALGSFRSNA

SEQ ID NO: 25330 - protein, 283 aa, Flaveria ramosissima
MTKDVEVAEHHSGKDYQDPPPAPLIDPEELTKWSFYRAVIAEFIATLLFLYVTVLTVIGYKSQTDPNLNTDQCGGVGILGIAWAFGGMIFILVYCTAGISGGHINPAVTFGLFLARKVSLIRALLYMVAQCLGAICGVGLVKAFQSSYYNRYGGGANELADGYNKGTGLGAEIIGTFVLVYTVFSATDPKRSARDSHVPVLAPLPIGFAVFMVHLATIPITGTGINPARSFGAAVIYNNEKAWDDQWIFWVGPFVGAAAAAFYHQFVLRAAAIKALGSFRSNA

SEQ ID NO: 25331 - protein, 282 aa, Mimulus guttatus
MAKEVECAEPAAEFAAKDYHDPPPAPLIDYDELTKWSFYRALIAEFIATLLFLYITVLTVIGYKSQSEYDQCGGVGILGIAWAFGGMIFVLVYCTAGISGGHINPAVTFGLFLARKVSLIRAVLYMVAQCLGAICGVGFVKAFQKSHYNKFGGGANTLALGYNKGTGLGAEIIGTFVLVYTVFSATDPKRSARDSHVPVLAPLPIGFAVFMVHLATIPITGTGINPARSFGAAVIFNNEKAWDDHWIFWVGPFIGAAIAAIYHQFVLRAGAIKALGSFRSNA

SEQ ID NO: 25332 - protein, 282 aa, Papaver somniferum
MGKDEVAEHGEFSAKDYHDPPPTPFFDADELKKWSFYRAIIAEFVATLLFLYITVLTVIGYKAQSETDDCGGVGILGIAWAFGGMIFVLVYCTAGVSGGHINPAVTFGLFLARKVSLPRAVLYMVAQCLGAICGVGLVKAFQSAYYVKFGGGANTLSLGYSKGTGLAAEIIGTFVLVYTVFSATDPKRNARDSHVPVLAPLPIGFAVFMVHLATIPVTGTGINPARSFGAAVILNDEKAWDDQWIFWVGPFIGAAIAAIYHQFILRAGAIKALGSFRSSARV

SEQ ID NO: 25333 - protein, 282 aa, Papaver somniferum
MGKDEVAEHGEFSAKDYHDPPPTPFFDADELKKWSFYRAIIAEFVATLLFLYITVLTVIGYKAQSETDDCGGVGILGIAWAFGGMIFVLVYCTAGVSGGHINPAVTFGLFLARKVSLPRAVLYMVAQCLGAICGVGLVKAFQSAYYVKFGGGANTLALGYSKGTGLAAEIIGTFVLVYTVFSATDPKRNARDSHVPVLAPLPIGFAVFMVHLATIPVTGTGINPARSFGAAVILNDEKAWDDQWIFWVGPFIGAAIAAIYHQFILRAGAIKALGSFRSSARV

SEQ ID NO: 25334 - protein, 282 aa, Papaver somniferum
MGKDEVAEHGEFSAKDYHDPPPTPFFDADEFKKWSFYRAIIAEFVATLLFLYITVLTVIGYKSQSETDDCGGVGILGIAWAFGGMIFVLVYCTAGVSGGHINPAVTFGLFLARKVSLPRAVLYMVAQCLGAICGVGLVKAFQSAYYVKFGGGANTLAAGYSKGTGLAAEIIGTFVLVYTVFSATDPKRNARDSHVPVLAPLPIGFAVFMVHLATIPVTGTGINPARSFGAAVIFNEEKAWDDQWIFWVGPFIGAAIAAIYHQFILRAGAIKALGSFRSSARV

SEQ ID NO: 25335 - protein, 282 aa, Papaver somniferum
MGKDEVAEHGEFSAKDYHDPPPTPFFDADEFKKWSFYRAIIAEFVATLLFLYITVLTVIGYKSQSETDDCGGVGILGIAWAFGGMIFVLVYCTAGVSGGHINPAVTFGLFLARKVSLPRAVLYMVAQCLGAICGVGLVKAFQSAYYVKFGGGANTLSAGYSKGTGLAAEIIGTFVLVYTVFSATDPKRNARDSHVPVLAPLPIGFAVFMVHLATIPVTGTGINPARSFGAAVIFNEEKAWDDQWIFWVGPFIGAAIAAIYHQFILRAGAIKALGSFRSSARV

SEQ ID NO: 25336 - protein, 280 aa, Amaranthus tuberculatus
MGKDMDVGGAMVKDYQDPPPSPLIDAEELGKWSFYRAVIAEFIATLLFLYITVLTVIGHKAQNEADQCNGVGLLGIAWAFGGMIFVLVYCTAGISGGHINPAVTFGLLLARKVTLIRAILYMVAQCLGAICGVGLVKAFQSGYYTKYGGGANTLADGYSKGTGLGAEIIGTFVLVYTVFSATDPKRNARDSHVPVLAPLPIGFAVFMVHLATIPVTGTGINPARSFGAAVIFNSSQAWDDHWIFWVGPFIGAAIAAIYHQYILRAGFVKALGSFRSSSNV

SEQ ID NO: 25337 - protein, 281 aa, Panax ginseng
MGKDGEVTEHAEYGAKDYQDPPPAAFIGTDELSKWSLYRAVIAEFIATLLFLYITVLTVIGYKSQSATDECGGVGLLGIAWAFGGMIFILVYCTAGISGGHINPAVTFGLFLARKVSLIRALLYMVAQCLGAISGVGLVKAFQKSLYNRYGGGANELADGYNKGTGLGAEIIGTFVLVYTVFSATDPKRNARDSHVPVLAPLPIGFAVFMVHLATIPITGTGINPARSFGAAVIYNKEKAWDDQWIFWVGPFIGAAIAAFYHQYILRAAAIKALGSFRSNA

SEQ ID NO: 25338 - protein, 281 aa, Panax ginseng
MGKDGEVTEHAEYGSKDYQDPPPAAFIGTDELSKWSLYRAVIAEFIATLLFLYITVLTVIGYKSQSATDECGGVGLLGIAWAFGGMIFILVYCTAGISGGHINPAVTFGLFLARKVSLIRALLYMVAQCLGAISGVGLVKAFQKSLYNRYGGGANELADGYNKGTGLGAEIIGTFVLVYTVFSATDPKRNARDSHVPVLAPLPIGFAVFMVHLATIPITGTGINPARSFGAAVIYNKEKAWDDQWIFWVGPFIGAAIAAFYHQYILRAAAIKALGSFRSNA

SEQ ID NO: 25339 - protein, 281 aa, Panax ginseng
MGKDGEVTEQSEFSAKDYHDPPPAAFIGTDELTKWSLYRAVIAEFIATLLFLYITVLTVIGYKSQSATDECGGVGLLGIAWAFGGMIFVLVYCTAGISGGHINPAVTFGLFLARKVSLIRAVFYMVAQCLGAICGVGLVKAFQKSLYNRHGGGANELADGYNKGTGLGAEIIGTFVLVYTVFSATDPKRNARDSHVPVLAPLPIGFAVFMVHLATIPITGTGINPARSFGAAVIYGKQKAWDDQWIFWVGPFIGAAIAAFYHQYILRAAAIKALGSFRSNA

SEQ ID NO: 25340 - protein, 285 aa, Cichorium intybus
MTKDVPEQGSFSAKDYHDPPPAPLIDPEELTKWSFYRALIAEFIATLLFLYITVLTVIGYKSQTDPALNLDQCGGVGILGIAWAFGGMIFVLVYCTAGISGGHINPAVTFGLFLARKVSLIRAIGYMVAQCLGAICGVGLVKAFHKSYYMRYGGGANELADGYNKGTGLGAEIIGTFVLVYTVFSATDPKRSARDSHVPVLAPLPIGFAVFMVHLATIPITGTGINPARSLGAAVIYNKDKAWDDQWIFWVGPFIGAAIAAFYHQFILRAGAIKALGSFRSSTQV

SEQ ID NO: 25341 - protein, 284 aa, Cucumis melo
MSKDLEAGGFAVKDYQDPPPAPLIDAEELTQWSFYRAIIAEFVATLLFLYVTVLTVIGYSSQSDTKSGGQICGGVGILGIAWAFGGMIFVLVYCTAGISGGHINPAVTFGLFLARKVSLIRAILYMVAQCLGAICGCALVKSFQKALYNGYGGGANSLADGYSTGTGLAAEIIGTFVLVYTVFSATDPKRNARDSHVPVLAPLPIGFAVFMVHLATIPITGTGINPARSFGAAVIYNKDKAWDDQWIFWVGPFIGAAIAAIYHQIVLRAGAVKALGSFRSSTAV

SEQ ID NO: 25342 - protein, 285 aa, Populus trichocarpa
MGKDIEVGGEFIAKDYHDPPPAPLIDAEELTQWSLYRAIIAEFIATLLFLYITVLTVIGYKSQTDTTKNSDGCGGVGILGIAWAFGGMIFVLVYCTAGISGGHINPAVTFGLFLARKVSLVRAVLYMVAQCLGAICGCGLVKAFQKSYYTKYGGGVNELATGFSKGTGLGAEIIGTFVLVYTVFSATDPKRNARDSHVPVLAPLPIGFAVFMVHLATIPITGTGINPARSFGAAVIYNKDKAWDDHWIFWVGPFIGAAIAALYHQYVLRAAAVKALGSFRSSSNI

SEQ ID NO: 25343 - protein, 286 aa, Fagus grandifolia
MTKDVEVAEQGEYSAKDYHDPPPAPLIDAEELTQWSFYRALIAEFIATLLFLYITVLTVIGYKSQIDTANGPDAACGGVGILGIAWAFGGMIFVLVYCTAGISGGHINPAVTFGLFLARKVSLVRAVLYMVAQCLGAISGVGLVKAFQKSHYNRYGGGANELQAGYNKGVGLGAEIIGTFVLVYTVFSATDPKRNARDSHVPVLAPLPIGFAVFMVHLATIPITGTGINPARSFGAAVIYNQDKAWDDQWIFWVGPFIGAAIAAFYHQFILRAAAIKALGSFRSNA

SEQ ID NO: 25344 - protein, 286 aa, Castanea mollissima
MTKDVEVVEQGGEYSAKDYHDPPPAPLIDPEELTQWSFYRALIAEFIATLLFLYITVLTVIGYKSQTDPAKNADQCGGVGILGIAWAFGGMIFVLVYCTAGISGGHINPAVTFGLFLARKVSLIRAVLYMVAQCLGAICGVGLVKAFQKSLYTRYGGGANELQAGYNKGTGLGAEIIGTFVLVYTVFSATDPKRNARDSHVPVLAPLPIGFAVFMVHLATIPITGTGINPARSLGAAVIYNKTKAWDDQWLFWVGPFIGAAIAAFYHQYILRAAAIKALGSFRSNA

SEQ ID NO: 25345 - protein, 285 aa, Gerbera hybrid cultivar
MTKDVPEQGSFSAKDYHDPPPAPFIDPAELTKWSFYRAIIAEFIATLLFLYITVLTVIGYKSQTDPAKNLDQCGGVGILGIAWAFGGMIFVLVYCTAGISGGHINPAVTFGLFLARKVSLIRALMYMVAQCLGAICGVGLVKAFHKTYYNNYGGGANELADGYNKGTGLGAEIIGTFVLVYTVFSATDPKRSARDSHVPVLAPLPIGFAVFMVHLATIPITGTGINPARSLGAAVIYNKDKAWDDQWIFWVGPFIGAAIAAFYHQFILRAGAVKALGSFRSSTQV

SEQ ID NO: 25346 - protein, 285 aa, Panax ginseng
MTKDVEVAEHGSFSTKYYHEPPPVALFDPDELTQWSFYRALIAEFIATFLFLYITVLTVIGYKSQIDPTNDGDQCGGVGILGIAWAFGGMIFVLVYCTAGISGGHINPAVTFGLFLARKVSLVRAIMYMVAQCLGAICGVGLVKAFQKSYYQRYGGGANGLNDGYSTGTGLAAEIIGTFVLVYTVFSATDPKRNARDSHVPVLAPLPIGFAVFMVHLATIPITGTGINPARSFGAAVIYNEDEAWDDQWLFWVGPFIGAAIAAFYHQFILRAGAIKALGSFRSNA

SEQ ID NO: 25347 - protein, 251 aa, Solanum phureja
NSTDCSFYRAIIAEFIATLLFLYITVLTVIGYKSQNSTDQCGGVGILGIAWAFGGMIFVLVYCTAGISGGHINPAVTFGLFLARKVSLVRAIMYIVAQCLGAICGCGLVKSFQKAYYVQYGGGANKLNDGYSTGTGLGAEIIGTFILVYTVFAATDPKRNARDSHVPILAPLPIGFAVFMVHLATIPVTGTGINPARSFGAAVIYGDHKAWNDQWIFWVGPFIGAAIAAFYHQFILRAGAVKALGSFRSNA

SEQ ID NO: 25348 - protein, 285 aa, Tripterygium wilfordii
MAKDIAEQGSFSAKDYHDPPPAPLFDAVELTKWSFYRALIAEFIATLLFLYITVLTVIGYKSQTDHALNADACGGVGILGIAWAFGGMIFVLVYCTAGISGGHINPAVTFGLFLARKVSLVRAVMYMVAQCLGAISGVALVKAFQKSFYKRYGGGANTLADGYSTGTGLAAEIIGTFVLVYTVFSATDPKRNARDSHVPVLAPLPIGFAVFMVHLATIPITGTGINPARSLGAAVIYNQDKAWDDQWIFWVGPFIGAAIAAFYHQFILRAGAAKALGSFRSNPSV

SEQ ID NO: 25349 - protein, 283 aa, Rosmarinus officinalis
MTKEVEEHGSHGAKDYHDPPPAPLIDAEELTKWSFYRALIAEFIATLLFLYITVLTVIGYKSQSATDECGGVGILGIAWAFGGMIFILVYCTAGISGGHINPAVTFGLLLARKVSLIRAVMYMVAQCLGAICGVGLVKAFQSSYYKKYGGGANELSLGYSTGVGLGAEIIGTFVLVYTVFSATDPKRNARDSHVPVLAPLPIGFAVFMVHLATIPITGTGINPARSLGAAVIYNQDKAWDDHWIFWVGPFIGAAIAAFYHQFILRAGAAKALGSFRSSTSHHV

SEQ ID NO: 25350 - protein, 283 aa, Aquilegia formosa
MGKDVEVAEHGEFSAKDYHDPPPAPLFDAKELASWSFYRAIIAEFIATLLFLYITVLTVIGYKSQSLNDPCGGVGILGIAWAFGGMIFVLVYCTAGISGGHINPAVTFGLFLARKVSLIRAVMYMIAQCLGAICGVGFVKAFQKTYYETYGGGANELAQGYNKGTGLAAEIIGTFVLVYTVFSATDPKRSARDSHVPVLAPLPIGFAVFMVHLATIPITGTGINPARSFGAAVIYNKEKAWDDQWIFWVGPFIGAAIAAFYHQFILRAAAIKALGSFRSNAHN

SEQ ID NO: 25351 - protein, 280 aa, Flaveria ramosissima
EVAGGHEYGGRDYQDPPPADLFDAEELTKWSFYRAVIAEFIATLLFLYITVLTVIGYKSQTDPAHASDQCGGVGILGIAWAFGGMIFVLVYCTAGISGGHINPAVTFGLFLARKVTLPRAFMYIVAQCLGAVCGCGLVKAFQKTYYNTYGGGANELADGYSKGTGLGAEIIGTFVLVYTVFSATDPKRNARDSHVPVLAPLPIGFAVFMVHLATIPITGTGINPARSFGAAVMCGKDKAWDDQWLFWVGPMIGAAIAAFYHQYVLRAGAVKALGSHRSNA

SEQ ID NO: 25352 - protein, 282 aa, Papaver somniferum
MGKDEVAEHGEFSAKDYHDPPPTPFFDADELKKWSFYRAIIAEFVATLLFLYITVLTVIGYKAQSEADDCGGVGILGIAWAFGGMIFVLVYCTAGVSGGHINPAVTFGLFLARKVSLPRAVLYMVAQCLGAICGVGLVKAFQSAYYVKHGGGANTLSAGYSKGTGLAAEIIGTFVLVYTVFSATDPKRNARDSHVPVLAPLPIGFAVFMVHLATIPVTGTGINPARSFGAAVILNDEKAWDDQWIFWVGPFIGAAIAAIYHQFILRAGAIKALGSFRSSARV

SEQ ID NO: 25353 - protein, 276 aa, Valeriana officinalis
VAEFTAKDYQDPPPVSLFDSEELTKWSFYRAIIAEFIATLLFLYITVLTVIGYKSQTDPLKGTDQCGGVGILGIAWAFGGMIFVLVYCTAGISGGHINPAVTFGLFLARKVSLCRAVLYMIAQCLGAICGCGLVKAFQKTYYNTYGGGANELASGYSKGTGLAAEIIGTFVLVYTVFSATDPKRNARDSHVPVLAPLPIGFAVFMVHLATIPITGTGINPARSFGAAVIYGREKAWDDQWIFWVGPFIGAAIAAIYHQFILRAAALKALGSFRSNA

SEQ ID NO: 25354 - protein, 288 aa, Euonymus alatus
MAKDIEASGPGSGFQSKDYQDPPPAPLIDVDELTQWSLYRAVIAEFIATLLFLYITVLTVIGYKSQTDPALNTDQCGGVGILGIAWAFGGMIFVLVYCTAGISGGHINPAVTFGLFLARKVSMIRAILYMAAQCLGAICGCGLVKAFQKAYYTRYGGGANELADGYSTGTGLGAEIIGTFVLVYTVFSATDPKRNARDSHIPVLAPLPIGFAVFMVHLATIPITGTGINPARSFGAAVIYNKEKAWDDQWLFWVGPFIGAAIAAIYHQYILRAGAVKALGSFRSSSKV

SEQ ID NO: 25355 - protein, 288 aa, Euonymus alatus
MAKDIEASGPGSGFQSKDYQDPPPAPLIDADELTQWSLYRAVIAEFIATLLFLYITVLTVIGYKSQTDPALNTDQCGGVGILGIAWAFGGMIFVLVYCTAGISGGHINPAVTFGLFLARKVSMIRAILYMAAQCLGAICGCGLVKAFQKAYYTRYGGGANELADGYSTGTGLGAEIIGTFVLVYTVFSATDPKRNARDSHIPVLAPLPIGFAVFMVHLATIPITGTGINPARSFGAAVIYNKEKAWDDQWLFWVGPFIGAAIAAIYHQYILRAGAVKALGSFRSSSKV

SEQ ID NO: 25356 - protein, 286 aa, Manihot esculenta
MAKGITEPGSFSSKDYHDPPPAPLIDPAELTQWSFYRALIAEFIATLLFLYITVLTVIGYKSQTDPSLKNSDSCGGVGILGIAWAFGGMIFVLVYCTAGISGGHINPAVTFGLFLARKVSLVRAVMYMVAQCLGAISGVGLVKAFQRSHYKRYGGGANTLADGYSTGVGLGAEIIGTFVLVYTVFSATDPKRSARDSHVPVLAPLPIGFAVFMVHLATIPITGTGINPARSLGAAVIYNQDKAWDDQWIFWVGPFIGAAIAAFYHQFILRAGAVKALGSFRSNPTV

SEQ ID NO: 25357 - protein, 287 aa, Vaccinium corymbosum
MAKDMEVAEQGSFSAKDYHDPPPAPLIDAVELASWSFYRALIAEFIATLLFLYITVLTVIGYKSQSDPTKTTDPCSGVGILGIAWAFGGMIFVLVYCTAGISGGHINPAVTFGLFLARKVSLIRAVMYMVAQCLGAICGVGLVKAFQKSYYDQYGGGANTLALGYSKGTGLAAEIIGTFVLVYTVFSATDPKRSARDSHVPVLAPLPIGFAVFMVHLATIPITGTGINPARSLGAAVIYNKEKAWDDQWMFWVGPFIGAAIAAFYHQFILRAGAIKALGSFRSNPHA

SEQ ID NO: 25358 - protein, 287 aa, Vaccinium corymbosum
MAKDMEVAEQGSFSAKDYHDPPPAPLIDAVELASWSFYRALIAEFIATLLFLYITVLTVIGYKSQSDPTKTTDPCSGVGILGIAWAFGGMIFVLVYCTAGISGGHINPAVTFGLFLARKVSLIRAVMYMVAQCLGAICGVGLVKAFQKSYYDQYGGGANTLALGYSKGTGLAAEIIGTFVLVYTVFSATDPKRSARDSHVPVLAPLPIGFAVFMVHLATIPITGTGINPARSLGAAVIYNKEKAWDDQWMFWVGPFIGAAIAAFYHQFILRAGAIKALGSFRSNPHT

SEQ ID NO: 25359 - protein, 286 aa, Manihot esculenta
MAKDVEVAENPGEFSAKDYHDPPPAPLIDIEELGQWSLYRALIAEFIATLLFLYITVLTVIGYKSQTDPAKNSDACGGVGILGIAWAFGGMIFILVYCTAGISGGHINPAVTLGLFLGRKVSLIRALLYMVAQCLGAICGCGLVKAFQKAYYNRYGGGANELSSGYSKGTGLGAEIIGTFVLVYTVFSATDPKRNARDSHVPVLAPLPIGFAVFMVHLATIPITGTGINPARSFGAAVIYNEDKAWDDHWIFWVGPFIGAAIAAFYHQYILRAAAIKALGSFRSNA

SEQ ID NO: 25360 - protein, 287 aa, Linum usitatissimum
MAKDVEGQVPGFQTKDYQDPPPAPLIDAEELTQWSLYRAVIAEFIATLLFLYITVLTVIGYKSQVDPNKPSVDPCGGVGILGIAWAFGGMIFVLVYCTAGISGGHINPAVTFGLFLARKVSLVRAVLYMVAQCLGAICGCGLVKAFQKSYYTRYGGGANELSAGYNKGTGLGAEIIGTFVLVYTVFSATDPKRNARDSHVPVLAPLPIGFAVFMVHLATIPVTGTGINPARSFGAAVIYNQDKAWDDQWMFWVGPFIGAAIAAIYHQYILRAGAIKALGSFRSSANN

SEQ ID NO: 25361 - protein, 287 aa, Platanus occidentalis
MGKDVEVTEQSEFSAKDYHDPPPAPLIDAEELTKWSFYRALIAEFIATLLFLYITVLTVIGYKSQSDTTMNGDECGGVGILGIAWSFGGMIFILVYCTAGISGGHINPAVTFGLFLARKVSLIRAVMYMVAQCLGAICGVGLVKGFQKSYYVRYGGGANELASGYSKGVGLAAEIIGTFVLVYTVFSATDPKRSARDSHVPVLAPLPIGFAVFMVHLATIPITGTGINPARSFGAAVIYNKDKAWDDQWIFWVGPFIGAAIAAFYHQFILRAGAIKALGSFRSNPRV

SEQ ID NO: 25362 - protein, 286 aa, Papaver somniferum
MGKDIEPSHEQGGGYSAKDYHDPPPAPFLGIEELTKWSFYRALIAEFIATLLFLYITVLTVIGYKSQIAGGDDCGGVGILGIAWAFGGMIFVLVYCTAGISGGHINPAVTFGLFLARKVSLIGAVLYMVAQCLGAICGVGLVKAFQKSYYVRFGGGANELSDGYSTGTGLAAEIIGTFVLVYTVFSATDPKRSARDSHIPVLAPLPIGFAVFMVHLATIPITGTGINPARSFGAAVIYNKNKAWDDQWIFWVGPFIGAAIAAFYHQFILRAAAVKALGSFRSNAHN

SEQ ID NO: 25363 - protein, 285 aa, Populus trichocarpa
MGKDVEVRGEFIAKDYHDPPPAPLIDAEELTQWSLYRAIIAEFIATLLFLYITVLTVIGYKSQTDTTKNSDACGGVGILGIAWAFGGMIFVLVYCTAGISGGHINPAVTFGLFLARKVSLVRAVLYMVAQCLGAICGCGLVKAFQKSYYTNYGGGANELAAGFSKGTGLGAEIIGTFVLVYTVFSATDPKRNARDSHVPVLAPLPIGFAVFMVHLATIPITGTGINPARSFGAAVIYNKDKAWDDHWIFWVGPFIGAAIAALYHQYVLRAAAVKALGSFRSSSNI

SEQ ID NO: 25364 - protein, 285 aa, Euonymus alatus
MAKDVEVQENPEFSAKDYTDPPPTPLFDLEELTKWSFYRAAIAEFVATLLFLYITVLTVIGYKSQTDPNLNTDQCGGVGILGIAWAFGGMIFILVYCTAGISGGHINPAVTFGLFLARKLSLIRAVTYMVAQCLGAICGCGLVKGFQKSYYTRYGGGANELADGYNKGVGLGAEIIGTFVLVYTVFAATDPKRNARDSHVPVLAPLPIGFAVFMVHLATIPITGTGINPARSFGAAVIYNKEKAWDDQWMFWVGPFIGAAIAAFYHQFILRAAAIKALGSFRSNS

SEQ ID NO: 25365 - protein, 285 aa, Petroselinum crispum
MTKDVEVAEKGSFSGKDYVEPPPVPLVDPHELTKWSFYRALIAEFIATLLFLYITVLTVIGYKSQTDLDAGGDQCGGVGILGIAWAFGGMIFVLVYCTAGISGGHINPAVTFGLFLARKVSLIRALMYMVAQCLGAICGVGLVKAFQQPYYKRYGGGANELADGYSKGTGLAAEIIGTFVLVYTVFSATDPKRNARDSHVPVLAPLPIGFAVFMVHLATIPITGTGINPARSLGAAVIYNQDKAWDDHWLFWVGPFIGAAIAAFYHQFILRAGAVKALGSFRSNA

SEQ ID NO: 25366 - protein, 284 aa, Platanus occidentalis
MGKDIEVSELPAKDYQDPPPAPLIDAEELTKWSFYRALIAEFIATLLFLYITVLTVIGYKSQVDPAKNGDECGGVGILGIAWSFGGMIFILVYCTAGISGGHINPAVTFGLFLARKVSLVRAVMYMVAQCLGAICGVGLVKAFQKSYYVNYGGGANELAPGYSKGVGLAAEIIGTFVLVYTVFSATDPKRSARDSHIPVLAPLPIGFAVFMVHLATIPITGTGINPARSLGAAVIYNKEKAWDDQWIFWVGPFIGAAIAAIYHQFILRAGAIKALGSFRSNPHN

SEQ ID NO: 25367 - protein, 283 aa, Ambrosia trifida
MTKDVEVAEHQGGKDYHDPPPAPLIDGEELTKWSFYRALIAEFIATLLFLYVTVLTVIGYKVQTDPKLNTDQCGGVGILGIAWAFGGMIFVLVYCTAGISGGHINPAVTFGLFLARKVSLIRALGYMVAQCLGAICGVGLVKAFQSSYYNRYGGGANELADGYNKGTGLGAEIIGTFVLVYTVFSATDPKRSARDSHVPVLAPLPIGFAVFMVHLATIPITGTGINPARSLGAAVIYNNEKAWDDQWIFWVGPFLGAAAAAFYHQFVLRAGAIKALGSFRSNA

SEQ ID NO: 25368 - protein, 281 aa, Theobroma cacao
  Sequence also found in Organisms: Pteridium aquilinum
MAKEGEHGFHAKDYVDPPPAPLIDAAELKKWSFYRALIAEFIATLLFLYITVLTVIGNKSQVGTSNDSCAGVGILGIAWAFGGMIFILVYCTAGISGGHINPAVTFGLFVARKVSLIRAIAYMVAQSLGAICGVGLVKAFQKSFYNRYGGGANTLSDGYSTGTGLGAEIIGTFVLVYTVFSATDPKRKARDSHVPVLAPLPIGFAVFMVHLATIPVTGTGINPARSFGAAVIYNNKKAWDDHWIFWVGPMIGAAIAAFYHQFILRAGAAKALGSFRSQTHV

SEQ ID NO: 25369 - protein, 267 aa, Chrysanthemum coronarium
QDPPPAALFDSEELTKWSFYRAIIAEFIATMLFLYITVLTVIGYKSQVDPAHSKDQCGGVGILGIAWAFGGMIFVLVYCTAGISGGHINPAVTFGLFLARKVTLPRAFMYIVAQCLGAICGCGLVKAFQKTYYHNYGGGANELADGYSKGTGLGAEIIGTFVLVYTVFSATDPKRNARDSHVPVLAPLPIGFAVFMVHLATIPITGTGINPARSFGAAVMYGKEKAWDDQWLFWVGPMIGAAIAAFYHQYVLRAGAVKALGSFRSNA

SEQ ID NO: 25370 - protein, 283 aa, Cucumis sativus
MGKDVEVAEQGEFQSKDYQDPPPAPLIDPEELTKWSLYRAAIAEFIATLLFLYVTVLTVIGYSHGRATDADPCSGVGILGIAWAFGGMIFILVYCTAGISGGHINPAVTFGLFLARKVSLVRALLYIIAQCAGAICGCGLVKAFQSAYYVRYNGGANMLSDGYNKGTGLGAEIIGTFVLVYTVFSATDPKRNARDSHVPVLAPLPIGFAVFMVHLATIPITGTGINPARSFGAAVIFNKEKAWDDQWIFWVGPFIGAAIAAIYHQYVLRAGAIKALGSFRSNA

SEQ ID NO: 25371 - protein, 283 aa, Echinacea purpurea
MTKDVEVAEHHSGKDYHDPPPAPLIDGEELTKWSFYRALIAEFIATLLFLYVTVLTVIGYKSQTDPNLNTDQCGGVGILGIAWAFGGMIFILVYCTAGISGGHINPAVTFGLFLARKVSLIRALGYMIAQCLGAICGVGLVKAFQSSYYNRYGGGANTLADGYDKGTGLGAEIIGTFVLVYTVFSATDPKRNARDSHVPVLAPLPIGFAVFMVHLATIPITGTGINPARSFGAAVIYNDEKAWDDHWLFWVGPFLGAAAAAFYHQFILRAAAAKALGSFRSNA

SEQ ID NO: 25372 - protein, 289 aa, Cajanus cajan
MAKHDVEVAERGSFSAKDYHDPPPAPLIDAEELTKWSFYRALIAEFIATLLFLYITVLTVIGYKSQSDVKAGGDVCGGVGILGIAWAFGGMIFILVYCTAGISGGHINPAVTFGLFLARKVSLIRAILYMVAQCLGAICGVGLVKAFQKAYYNRYGGGANELSAGYSTGVGLGAEIVGTFVLVYTVFSATDPKRSARDSHVPVLAPLPIGFAVFMVHLATIPVTGTGINPARSLGAAVMYNQQKAWDDHWIFWVGPFIGAAIAAFYHQFILRAGAAKALGSFRSNPSTL

SEQ ID NO: 25373 - protein, 282 aa, Papaver somniferum
MGKDEVAEHGEFSAKDYHDPPPAPFFDADEFKKWSFYRAIIAEFVATLLFLYITVLTVIGYKSQSEADDCGGVGILGIAWAFGGMIFVLVYCTAGVSGGHINPAVTFGLFLARKVSLPRAVLYMVAQCLGAICGVGLVKAFQSAHYVKFGGGANTLAAGYSKGTGLAAEIIGTFVLVYTVFSATDPKRSARDSHVPVLAPLPIGFAVFMVHLATIPVTGTGINPARSFGAAVIFNEEKAWDDQWIFWVGPFIGAAIAAIYHQFILRAGAIKALGSFRSSARV

SEQ ID NO: 25374 - protein, 282 aa, Papaver somniferum
MGKDEVAEHGEFSAKDYHDPPPTPFFDADEFKKWSFYRAIIAEFVATLLFLYITVLTVIGYKSQSETDDCGGVGILGIAWAFGGMIFVLVYCTAGVPGGHINPAVTFGLFLARKVSLPRAVLYMVAQCLGAICGVGLVKAFQSAYYVKFGGGANTLAAGYSKGTGLAAEIIGTFVLVYTVFSATDPKRSARDSHVPVLAPLPIGFAVFMVHLATIPVTGTGINPARSFGAAVIFNEEKAWDDQWIFWVGPFIGAAIAAIYHQFILRAGAIKALGSFRSSARV

SEQ ID NO: 25375 - protein, 283 aa, Helianthus annuus
MTKEVEVAAHHSGKDYHDPPPAPLIDAEELTKWSFYRALIAEFVATLLFLYVTVLTVIGYKSTTDPNLDADQCGGVGILGIAWAFGGMIFILVYCTAGISGGHINPAVTFGLFLARKVSLIRAIMYMVAQCLGAICGVGLVKAFQSAYYDRYGGGANTLADGYSKGTGLGAEIIGTFVLVYTVFSATDPKRNARDSHVPVLAPLPIGFAVFMVHLATIPITGTGINPARSFGAAVIYNDEKAWDDHWLFWVGPFLGAAAAAFYHQFVLRAAAAKALGSFRSNA

SEQ ID NO: 25376 - protein, 283 aa, Tragopogon dubius
MTKDVEVAEHHGGKDYHDPPPAPLIDAAELTKWSFYRALIAEFIATLLFLYVTVLTVIGYKIQTDPALNTDQCGGVGILGIAWAFGGMIFILVYCTAGISGGHINPAVTFGLFLARKVSLIRAVLYMVAQCLGAICGVGLVKAFQSSYYNRYGGGANELAAGYSKGTGLGAEIIGTFVLVYTVFSATDPKRSARDSHVPVLAPLPIGFAVFMVHLATIPITGTGINPARSFGAAVIYNNEKAWDDQWIFWVGPFIGAAIAAFYHQFVLRAAAIKALGSFRSNA

SEQ ID NO: 25377 - protein, 288 aa, Centaurea maculosa
  Sequence also found in Organisms: Cirsium arvense
MTKDVEVAEHHGGSDYAAKDYHDPPPAPLIDGEELTKWSFYRAVIAEFVATLLFLYITVLTVIGYKSQTDPTLNTDQCGGVGILGIAWAFGGMIFVLVYCTAGISGGHINPAVTFGLFLARKVSLIRAVAYMIAQCLGAICGVGLVKAFQSSYYNRYGGGANELADGYNKGTGLGAEIIGTFVLVYTVFSATDPKRSARDSHVPVLAPLPIGFAVFMVHLATIPITGTGINPARSFGAAVIYNNEKAWDDQWIFWVGPFIGAAAAAFYHQFVLRAAAIKALGSFRSNA

SEQ ID NO: 25378 - protein, 280 aa, Amaranthus tuberculatus
MVKDIEVGGGIGKDYQDPPPSPLIDGEELTKWSFYRAVIAEFIATMLFLYITVLTVIGHKSQNQADQCNGVGLLGIAWAFGGMIFVLVYCTAGISGGHINPAVTFGLLLARKVTLIRAILYMVAQCLGAICGVGLVKAFQSGYYTKFGGGANTLADGYSKGTGLGAEIIGTFVLVYTVFSATDPKRNARDSHVPVLAPLPIGFAVFMVHLATIPVTGTGINPARSFGAAVIFNSSQAWDDHWIFWVGPFIGAAIAAIYHQYILRAGFVKALGSFRSSSNV

SEQ ID NO: 25379 - protein, 287 aa, Citrus clementina
MAKDIEVGREGEFHDKDYHDNPPAPLIGAEELTRWSFYRAIIAEFIATLLFLYITVLTVIGHKSQTDAKHGGDGCGGVGILGIAWAFGGMIFVLVYCTAGISGGHINPAVTFGLFLARKVSLVRAVMYMVAQCLGAICGCGLVKAFQKSYYTRYGGGANELADGYSTGAGLGAEIIGTFVLVYTVFSATDPKRKARDPHVPVLAPLSIGFAVFMVHLATIPVTGTGINPARSFGPAVIYNKDKAWDDQWIFWVGPFIGAAIAAFYHQFILRASAAKALGSRRSSPNI

SEQ ID NO: 25380 - protein, 285 aa, Humulus lupulus
MVKDVEAGGQHGYSAKDYQDPPPAPLFDAEELGQWSFYRAIIAEFVATLLFLYITILTVIGYKSQVDPAHSSDACGGVGILGIAWAFGGMIFVLVYCTAGISGGHINPAVTFGLFLARKVSLVRTILYIAAQCLGAICGCGLVKAFQSAYYDLYGGGANSLAHGYSTGTGLAAEIIGTFVLVYTVFSATDPKRSARDSHVPVLAPLPIGFAVFMVHLATIPITGTGINPARSFGAAVIYGEAWNGHWIFWVGPFIGAAIAAFYHQFVLRAAAVKALGSFRSANTM

SEQ ID NO: 25381 - protein, 287 aa, Scabiosa columbaria
MAKDAEVAEHGSFSAKDYHDPPPAPLIDRAELTKWSFYRAIIAEFIATLLFLYITVLTVIGHKSQSDPAKTEDQCNGVGILGIAWAFGGMIFVLVYCTAGISGGHINPAVTFGLFLARKVSLIRAVMYMVAQCLGAICGVALVKAFQEPYYKMYGGGANTLAEGYSKGTGLAAEIIGTFVLVYTVFSATDPKRSARDSHVPVLAPLPIGFAVFMVHLATIPITGTGINPARSLGAAVIYNKEKAWDDQWLFWVGPFIGAAIAAFYHQFILRAGAVKALGSFRSNPHN

SEQ ID NO: 25382 - protein, 278 aa, Silene vulgaris
MSNEMEGEVVKDYQDPPPSPLFDTEELTKWSFYRALIAEFVATLLFLYITVLTVIGYKSQSATDDCGGVGILGIAWAFGGMIFILVYCTAGISGGHINPAVTFGLLLGRKLSLVRAILYMVAQCLGAICGVGLVKAFQSAYYDRFGGGANELAVGYSKGTGLGAEIIGTFVLVYTVFSATDPKRSARDSHVPVLAPLPIGFAVFMVHLATIPVTGTGINPARSFGAAVIYNNKKAWDDHWIFWVGPFIGAAIAAIYHQYILRAGFVKALGSFRSSSNV

SEQ ID NO: 25383 - protein, 285 aa, Ambrosia trifida
MTKDVPEQGSFSAKDYHDPPPAPFIDPAELTKWSFYRALIAEFIATLLFLYITVLTVIGYKSTTDPALKLDQCGGVGILGIAWAFGGMIFVLVYCTAGISGGHINPAVTFGLFLARKVSLVRAVMYMVAQCLGAICGVGLVKAFNKSLYNRYGGGANELADGYNTGTGLGAEIIGTFVLVYTVFSATDPKRSARDSHVPVLAPLPIGFAVFMVHLATIPITGTGINPARSLGAAVIYNKDKAWDDQWIFWVGPFVGAAIAAFYHQFILRAGAVKALGSFRSSTHV

SEQ ID NO: 25384 - protein, 285 aa, Arnica chamissonis
MTKDVPEQGSFSAKDYHDPPPAPLIDPGELTKWSFYRAVIAEFIATLLFLYITVLTVIGYKSTTDPALNADQCGGVGILGIAWAFGGMIFVLVYCTAGISGGHINPAVTFGLFLARKVSLIRAIMYMVAQCLGAICGVGLVKAFNKSLYNRYGGGANELADGYNKGTGLGAEIIGTFVLVYTVFSATDPKRSARDSHVPVLAPLPIGFAVFMVHLATIPITGTGINPARSLGAAVIYNKDKAWDDQWIFWVGPFVGAAIAAFYHQFILRAGAVKALGSFRSSTHV

SEQ ID NO: 25385 - protein, 285 aa, Daucus carota
MTKDVEVAEQGSFSGKDYVEPPPVPLVDPHELTKWSFYRALIAEFVATLLFLYITVLTVIGYKSQTDLDAGGDQCGGVGILGIAWAFGGMIFVLVYCTAGISGGHINPAVTFGLFLARKVSLIRALMYMVAQCLGAICGVGLVKAFQQPYYKRYGGGANELADGYSKGTGLAAEIIGTFVLVYTVFSATDPKRNARDSHVPVLAPLPIGFAVFMVHLATIPITGTGINPARSLGAAVIYNQDKAWDDHWLFWVGPFIGAAIAAFYHQFILRAGAVKALGSFRSNA

SEQ ID NO: 25386 - protein, 285 aa, Chrysanthemum coronarium
MTKDVPEQGSFSAKDYHDPPPAPLIDPGELAKWSFYRALIAEFIATLLFLYITVLTVIGYKSTTDPALNADQCGGVGILGIAWAFGGMIFVLVYCTAGISGGHINPAVTFGLFLARKVSLIRAIMYMVAQCLGAICGVGLVKAFNKSLYNRYGGGANSLADGYNKGTGLGAEIIGTFVLVYTVFSATDPKRSARDSHVPVLAPLPIGFAVFMVHLATIPITGTGINPARSFGAAVIYNKEKIWDDQWIFWVGPFIGAAIAAFYHQFILRAGAIKALGSFRSSTPN

SEQ ID NO: 25387 - protein, 286 aa, Euphorbia peplus
MGKDVEVAEPAAEFSAKDYHDPPPAPLIDMEELGKWSFYRAVIAEFIATLLFLYITVLTVIGYKSQTDPLLNKDACGGVGILGIAWSFGGMIFILVYCTAGISGGHINPAVTFGLFLGRKVSLIRAVLYIIAQCLGAICGCGLVKAFQKSYYHRYGGGANELSSGYSKGTGLGAEIIGTFVLVYTVFSATDPKRSARDSHVPVLAPLPIGFAVFMVHLATIPITGTGINPARSFGAAVIYNEDKAWDDQWIFWVGPFIGAAVAAFYHQFVLRAAAIKALGSFRSNA

SEQ ID NO: 25388 - protein, 285 aa, Flaveria ramosissima
MTKDVPEQGSFSAKDYHDPPPAPLIDPEELSKWSFYRAIIAEFIATLLFLYITVLTVIGYKSTTDPALNADQCGGVGILGIAWAFGGMIFVLVYCTAGISGGHINPAVTFGLFLARKVSLIRAFMYMVAQCLGAICGVGLVKAFNKSLYNRYGGGANELADGYNKGTGLGAEIIGTFVLVYTVFSATDPKRSARDSHVPVLAPLPIGFAVFMVHLATIPITGTGINPARSLGAAVIYNNEKAWDDQWIFWVGPFVGAAIAAFYHQFILRAGAIKALGSFRSSSHV

SEQ ID NO: 25389 - protein, 285 aa, Flaveria ramosissima
MTKDVPEQGSFSAKDYHDPPPAPLIDPEELTKWSFYRAVIAEFIATLLFLYITVLTVIGYKSTTDPALNTDQCGGVGILGIAWAFGGMIFVLVYCTAGISGGHINPAVTFGLFLARKVSLIRAFMYMVAQCLGAICGVGLVKAFNKSLYNRYGGGANELADGYNKGTGLGAEIIGTFVLVYTVFSATDPKRSARDSHVPVLAPLPIGFAVFMVHLATIPITGTGINPARSLGAAVIYNNEKAWDDQWIFWVGPFVGAAIAAFYHQFILRAGAIKALGSFRSSSHV

SEQ ID NO: 25390 - protein, 286 aa, Panax ginseng
MTKDVEVAEHGSFSGKDYHEPPPVALIDPDELTKWSFYRALIAEFIATLLFLYITVLTVIGYKSQTDPTKVGVDQCGGVGILGIAWAFGGMIFVLVYCTAGISGGHINPAVTFGLFLARKVSLIRAVMYMVAQCLGAICGVGLVKAFQQPYYKRYGGGANELADGYSKGTGLAAEIIGTFVLVYTVFSATDPKRNARDSHVPVLAPLPIGFAVFMVHLATIPITGTGINPARSLGAAVIYNQDKAWDDHWLFWVGPFIGAAIAAFYHQFILRAGAVKALGSFRSNA

SEQ ID NO: 25391 - protein, 285 aa, Tripterygium wilfordii
MAKDVEVQENPEFSAKDYTDPPPTPFFDLEELTKWSFYRALIAEFIATLLFLYITVLTVIGYKSQTDPNLNTDQCGGVGILGIAWAFGGMIFILVYCTAGISGGHINPAVTFGLLLGRKVSLIRAVLYMVAQCLGAICGVGLVKGFQKSYYNRYGGGANMLADGYNKGVGLGAEIIGTFVLVYTVFSATDPKRNARDSHVPVLAPLPIGFAVFMVHLATIPITGTGINPARSFGAAVIYNKEKAWDDQWIFWVGPFIGAAIAAFYHQFILRAAAIKALGSFRSNA

SEQ ID NO: 25392 - protein, 285 aa, Citrullus lanatus
MGKDVEVAEQGEFQSKDYQDPPPAPLIDPEELTKWSLYRAAIAEFIATLLFLYVTVLTVIGYSHQSDPSVSTDPCNGVGILGIAWAFGGMIFILVYCTAGISGGHINPAVTFGLFLARKVSLVRALLYIIAQCAGAICGCGLVRAFQSAYYVRYNGGANMLSNGYNKGTGLGAEIIGTFVLVYTVFSATDPKRNARDSHVPVLAPLPIGFAVFMVHLATIPITGTGINPARSFGAAVIFNKEKAWDDQWIFWVGPFIGAAIAAIYHQYVLRAGAIKALGSFRSNA

SEQ ID NO: 25393 - protein, 284 aa, Vitis vinifera
MTKDVEVAEHGSFSAKDYHDPPPAPLFDSVELTKWSFYRALIAEFIATLLFLYITVLTVIGYKSQTAGGDPCGGVGILGIAWSFGGMIFILVYCTAGISGGHINPAVTFGLFLARKVSLIRAILYMVAQCLGAICGVGLVKAFQSAYYDRYGGGANELSTGYSKGTGLGAEIIGTFVLVYTVFSATDPKRSARDSHVPVLAPLPIGFAVFMVHLATIPITGTGINPARSLGAAVIYNNEKAWDDQWIFWVGPFIGAAIAAFYHQFILRAGAVKALGSFRSTTHV

SEQ ID NO: 25394 - protein, 283 aa, Helianthus annuus
MTKEVEVAEHHSGKDYHDPPPAPLIDAAELTKWSFYRALIAEFVATLLFLYVTVLTVIGYKSTTDPDLDADQCGGVGILGIAWAFGGMIFILVYCTAGISGGHINPAVTFGLFLARKVSLIRAIMYMVAQCLGAICGVGLVKAFQSAYYDRYGGGANTLADGYSKGTGLGAEIIGTFVLVYTVFSATDPKRNARDSHVPVLAPLPIGFAVFMVHLATIPITGTGINPARSFGAAVIYNDAKAWDDHWLFWVGPFLGAAAAAFYHQFVLRAAAAKALGSFRSNA

SEQ ID NO: 25395 - protein, 283 aa, Echinacea purpurea
MTKDVEVAEHHSGKDYHDPPPAPLIDGEELTKWSFYRALIAEFIATLLFLYVTVLTVIGYKSQTDPNLNTDQCGGVGILGIAWAFGGMIFILVYCTAGISGGHINPAVTFGLFLARKVSLIRALGYMIAQCLGAICGVGLVKAFQSSYYNRYGGGANELADGYNKGTGLGAEIIGTFVLVYTVFSATDPKRSARDSHVPVLAPLPIGFAVFMVHLATIPITGTGINPARSFGAAVIYNKEKAWDDQWIFWVGPFVGAAAAAFYHQFVLRAAALKALGSFRSNA

SEQ ID NO: 25396 - protein, 288 aa, Eschscholzia californica
MGKDIEVTDPQSGGGFTTKDYSDPPPAPFFDFEELSKWSFYRALIAEFVATLLFLYITVLTVIGYKSQVAIGGDECGGVGILGIAWAFGGMIFVLVYCTAGISGGHINPAVTFGLFLARKVSLIRAVLYMVAQCLGAICGVGLVKAFQKAYYVRFGGGANELAAGYSKGTGLAAEIIGTFVLVYTVFSATDPKRSARDSHIPVLAPLPIGFAVFMVHLATIPITGTGINPARSFGAAVIYNKDKAWDDQWIFWVGPFIGAAIAAFYHQFILRAGAVKALGSFRSNAHN

SEQ ID NO: 25397 - protein, 283 aa, Flaveria ramosissima
MTKDVEVAEHHSGKDYHDPPPAPLIDSDELTKWSFYRAVIAEFIATLLFLYVTVLTVIGYKSQTDPNLNTDQCGGVGILGIAWAFGGMIFILVYCTAGISGGHINPAVTFGLFLARKVSLIRALLYMVAQCLGAICGVGLVKAFQSSYYNRYGGGANELADGYNKGTGLGAEIIGTFVLVYTVFSATDPKRSARDSHVPVLAPLPIGFAVFMVHLATIPITGTGINPARSFGAAVIYNNEKAWDDQWIFWVGPFVGAAAAAFYHQFVLRAAAIKALGSFRSNA

SEQ ID NO: 25398 - protein, 283 aa, Flaveria ramosissima
MTKDVEVAEHQSGKDYHDPPPAPLIDSDELTKWSFYRAVIAEFIATLLFLYVTVLTVIGYKSQTDPNLNTDQCGGVGILGIAWAFGGMIFILVYCTAGISGGHINPAVTFGLFLARKVSLIRALLYMVAQCLGAICGVGLVKAFQSSYYNRYGGGANELAEGYNKGTGLGAEIIGTFVLVYTVFSATDPKRSARDSHVPVLAPLPIGFAVFMVHLATIPITGTGINPARSFGAAVIYNNEKAWDDQWIFWVGPFVGAAAAAFYHQFILRAAAIKALGSFRSNA

SEQ ID NO: 25399 - protein, 283 aa, Flaveria ramosissima
MTKDVEVAEHHGGKDYHDPPPAPLIDAEELTKWSFYRAVIAEFIATLLFLYVTVLTVIGYKSQTDPNLNMDQCGGVGILGIAWAFGGMIFILVYCTAGISGGHINPAVTFGLFLARKVSLIRALLYMVAQCLGAICGVGLVKAFQSSYYNRYGGGANELADGYNKGTGLGAEIIGTFVLVYTVFSATDPKRSARDSHVPVLAPLPIGFAVFMVHLATIPITGTGINPARSFGAAVIYNNEKAWDDQWIFWVGPFVGAAAAAFYHQFVLRAAAIKALGSFRSNA

SEQ ID NO: 25400 - protein, 283 aa, Flaveria ramosissima
MTKDVEVAEHHGGKDYHDPPPAPLIDPEELTQWSFYRALIAEFIATLLFLYVTVLTVIGYKSQTDPNLNTDQCGGVGILGIAWAFGGMIFVLVYCTAGISGGHINPAVTFGLFLARKVSLIRALLYMVAQCLGAICGVGLVKAFQSSYYNRYGGGANELAPGYNKGTGLGAEIIGTFVLVYTVFSATDPKRSARDSHVPVLAPLPIGFAVFMVHLATIPITGTGINPARSFGAAVIYNDDKAWDDQWIFWVGPFLGAAAAAFYHQFVLRAAAIKALGSFRCNA

SEQ ID NO: 25401 - protein, 288 aa, Gerbera hybrid cultivar
MTKDVEVAEHHGGAEFAGKDYHDPPPAALFDADELGKWSFYRALIAEFIATLLFLYVTVLTVIGYKSQTDPNLNTDQCGGVGILGIAWAFGGMIFILVYCTAGISGGHINPAVTFGLFLARKVSLIRALGYMIAQCLGAICGVGLVKAFQSSYYNRYGGGANELADGYNKGTGLGAEIIGTFVLVYTVFSATDPKRNARDSHVPVLAPLPIGFAVFMVHLATIPITGTGINPARSFGAAVIYNNDKAWDDQWIFWVGPFIGAAIAAFYHQFVLRAAAIKALGSFRSNA

SEQ ID NO: 25402 - protein, 287 aa, Lupinus angustifolius
MTKDVEITERGSFSGKDYHDPPPTPFIDVEEFTKWSFYRALIAEFIATLLFLYITVLTVIGYKSQSDVKAHGDICGGVGILGIAWAFGGMIFVLVYCTAGISGGHINPAVTFGLFLARKVSLPRAILYIVAQCLGAISGVGLVKAFNKSLYTRYGGGANSLNEGYSTGTGLGAEIIGTFVLVYTVFSATDPKRNARDSHVPVLAPLPIGFAVFMVHLATIPVTGTGINPARSFGAAVIYNQSKPWDDHWIFWVGPFVGAAIAAFYHQFILRAGAAKALGSFRSNPTV

SEQ ID NO: 25403 - protein, 285 aa, Centaurea maculosa
MTKDVPEQGSFSAKDYHDPPPAPFIDPAELTKWSFYRAIIAEFVATLLFLYITVLTVIGYKAQTDPAKNLDQCGGVGILGIAWAFGGMIFVLVYCTAGISGGHINPAVTFGLFLARKVSLIRALLYMVAQCLGAICGVGLVKAFHKTYYNNYGGGANELADGYNKGTGLGAEIIGTFVLVYTVFSATDPKRSARDSHVPVLAPLPIGFAVFMVHLATIPITGTGINPARSLGAAVIYNKEKAWDDQWIFWVGPFIGAAIAAFYHQFILRAGAVKALGSFRSSSHV

SEQ ID NO: 25404 - protein, 285 aa, Helianthus annuus
MTKDVPEQGSFSAKDYHDPPPAPFIDPEELTKWSFYRALIAEFIATLLFLYITVLTVIGYKSTTDPKLNADQCGGVGILGIAWAFGGMIFVLVYCTAGISGGHINPAVTFGLFLARKVSLIRAVMYMVAQCLGAICGVGLVKAFNKSLYNRYGGGANELADGYNTGTGIGAEIIGTFVLVYTVFSATDPKRSARDSHVPVLAPLPIGFAVFMVHLATIPITGTGINPARSLGAAVIYNKDKAWDDQWIFWVGPFVGAAIAAFYHQFILRAGAVKALGSFRSSTHV

SEQ ID NO: 25405 - protein, 286 aa, Aristolochia fimbriata
MGKDVEVGEQQGGEFTAKDYTDPPPAPLIDVEELTKWSFYRALIAEFIATLLFLYITVATVIGYKSQVDPAKNADGCGGVGILGIAWAFGGMIFILVYCTAGISGGHINPAVTFGLFLARKVSLIRAVMYMVAQCLGAICGVGLVKGFQKSYYVRYGGGANELADGYNKGTGLGAEIIGTFVLVYTVFAATDPKRNARDSHVPVLAPLPIGFAVFMVHLATIPITGTGINPARSFGAAVIYNKEKAWDDQWIFWVGPFIGAAVAAAYHQYVLRAQAIKALGSFRSN

SEQ ID NO: 25406 - protein, 285 aa, Chrysanthemum coronarium
MTKDVPEQGSFSAKDYHDPPPAPLFDPGELTKWSFYRALIAEFIATLLFLYITVLTVIGYKSTTDPGLTTDPCGGVGILGIAWAFGGMIFVLVYCTAGISGGHINPAVTFGLFLARKVSLIRAIMYMVAQCLGAICGVGLVKAFNKSLYNRYGGGANSLADGYNKGTGLGAEIIGTFVLVYTVFSATDPKRSARDSHVPVLAPLPIGFAVFMVHLATIPITGTGINPARSFGAAVIYNKEKIWDDQWIFWVGPFIGAAIAAFYHQFILRAGAIKALGSFRSSTPN

SEQ ID NO: 25407 - protein, 285 aa, Chrysanthemum coronarium
MTKDVPEQGSFSAKDYHDPPPAPLIDPGELAKWSFYRALIAEFIATLLFLYITVLTVIGYKSTTDPALNADQCGGVGILGIAWAFGGMIFVLVYCTAGISGGHINPAVTFGLFLARKVSLIRAIMYMVAQCLGAICGVGLVKAFNKSLYNRYGGGANSLADGYNKGTGLGAEIIGTFVLVYTVFSATDPKRSARDSHVPVLAPLPIGFAVFMVHLATIPITGTGINPARSLGAAVIYNNEKIWDDQWIFWVGPFIGAAIAAFYHQFILRAGAIKALGSFRSSTQV

SEQ ID NO: 25408 - protein, 286 aa, Panax ginseng
MTKGVEVAEHGSFSGKDYHEPPPVALIDPDELTKWSFYRALIAEFIATLLFLYITVLTVIGYKSQTDHTKVGVDQCGGVGILGIAWAFGGMIFVLVYCTAGISGGHINPAVTFGLFLARKVSLIRAVMYMVAQCLGAICGVGLVKAFQQPYYKRYGGGANELADGYSKGTGLAAEIIGTFVLVYTVFSATDPKRNARDSHVPVLAPLPIGFAVFMVHLATIPITGTGINPARSLGAAVIYNQDKAWDDHWLFWVGPFIGAAIAAFYHQFILRAGAVKALGSFRSNA

SEQ ID NO: 25409 - protein, 278 aa, Plantago ovata
MVKEEGSYGAKDYHDPPPAPLFDMEELSKWSFYRALIAEFIATLLFLYVTVLTVIGHSSQSAGDHCGGVGILGIAWAFGGMIFVLVYCTAGISGGHINPAVTFGLFLARKVSLIRAVMYMVAQCLGAICGVGLVKAFQTSLYTRYGGGANSLNAGYSTGTGLAAEIIGTFVLVYTVFSATDPKRSARDSHVPVLAPLPIGFAVFMVHLATIPITGTGINPARSLGAAVIYNKDKPWSDHWIFWVGPFIGAAIAAFYHQFILRAGAVKALGSFRSGSQI

SEQ ID NO: 25410 - protein, 285 aa, Gossypium hirsutum
MANDVEVGSEFQAKDYHDPPPAPLVDAQELTQWSFYRAIIAEFIATLLFLYITVLTVIGYKSQVDPDKGGQDCDGVGILGIAWAFGGMIFILVYCTAGISGGHINPAVTFGLFLARKVSLVRAILYMAAQCLGAICGCGLVKAFQKSYYNKYGGGANSLADGYSTGTGLAAEIIGTFVLVYTVFSATDPKRNARDSHVPVLAPLPIGFAVFMVHLATIPITGTGINPARSFGAVVMFNQDKPWDDHWIFWVGPFIGAAIAAIYHQYILRAGAAKALGSFRSSSAM

SEQ ID NO: 25411 - protein, 271 aa, Panax ginseng
SEFSAKDYHDPPPAAFIGTDELTKWSLYRAVIAEFIATLLFLYITVLTVIGYKSQSATDECGGVGLLGIAWAFGGMIFVLVYCTAGISGGHINPAVTFGLFLARKVSLIRAVFYMVAQCLGAICGVGLVKAFQKSLYNRHGGGANELADGYNKGTGLGAEIIGTFVLVYTVFSATDPKRNARDSHVPVLAPLPIGFAVFMVHLATIPITGTGINPARSFGAAVIYGKQKAWDDQWIFWVGPFIGAAIAAFYHQYILRAAAIKALGSFRSNA

SEQ ID NO: 25412 - protein, 283 aa, Arnica chamissonis
MTKDVEVAEHHTGKDYHDPPPAPLIDGEELTKWSFYRALIAEFVATLLFLYVTVLTVIGYKSQTDPKLDLDQCGGVGILGIAWAFGGMIFILVYCTAGISGGHINPAVTFGLFLARKVSLIRALGYMIAQCLGAICGVGLVKAFQSSYYNRYGGGANELAPGYNKGTGLGAEIIGTFVLVYTVFSATDPKRSARDSHVPVLAPLPIGFAVFMVHLATIPITGTGINPARSFGAAVIYNNDKAWDDQWIFWVGPFLGAAIAAFYHQFVLRAGAIKALGSFRSNA

SEQ ID NO: 25413 - protein, 289 aa, Fagus grandifolia
MAKDIDVGGQPGGFSAKDYHDPPPAPLIDAEEFVQWSFYRAIIAEFIATLLFLYITVLTVIGYKSQVDPTKPNVDECGGVGILGIAWAFGGMIFVLVYCTAGISGGHINPAVTFGLFLARKVSLVRAILYMVAQCLGAICGCALVKAFQKSYYSRYGGGANELALGYSKGTGLAAEIIGTFVLVYTVFSATDPKRNARDSHVPVLAPLPIGFAVFMVHLATIPITGTGINPARSFGAAVIYNEKKAWDDQWLFWVGPFIGAAIAAIYHQFILRAGAIKALGSFRSSSNV

SEQ ID NO: 25414 - protein, 283 aa, Chrysanthemum coronarium
MTKDVEVAEHHGGKDYVEPPPAPLFDADELTKWSFYRALIAEFVATLLFLYVTVLTVIGYKSSTDPLLDLDQCGGVGILGIAWAFGGMIFVLVYCTAGISGGHINPAVTFGLFLARKVSLIRAVMYMVAQCLGAICGVGLVKAFQSSYYNRYGGGANTLADGYNKGTGLGAEIIGTFVLVYTVFSATDPKRSARDSHVPVLAPLPIGFAVFMVHLATIPITGTGINPARSFGAAVIYNNEKAWDDQWIFWVGPFLGAAAAAFYHQFVLRAGAIKALGSFRSNA

SEQ ID NO: 25415 - protein, 283 aa, Chrysanthemum coronarium
MTKDMPEQASLTAKDYHDPPPAKFFDSKELTKWSFYRALIAEFIATLLFLYITVLTVIGYKSQIAHGNDACGGVGVLGIAWAFGGMIFVLVYCTAGISGGHINPAVTFGLFLARKVSLPRAIMYMVAQCLGAICGVGLVKSFHKTYYNTFGGGANELADGYNKGTGLGAEIIGTFVLVYTVFSATDPKRNARDSHVPVLAPLPIGFAVFMVHLATIPITGTGINPARSFGAAVIYNREKAWDDQWIFWVGPFIGAAIAAFYHQFILRAGAVKALGSFRSTTHV

SEQ ID NO: 25416 - protein, 278 aa, Flaveria ramosissima
GPGGEYSGKDYQDPPPAPLFDPEELTKWSFYRALIAEFVATLLFLYVTVLTVIGYKSQTDPNLNTDQCGGVGILGIAWAFGGMIFILVYCTAGISGGHINPAVTFGLFLARKVSLIRALGYMVAQCLGAICGVGLVKAFQSSYYNRYGGGANELADGYNKGTGLGAEIIGTFVLVYTVFSATDPKRSARDSHVPVLAPLPIGFAVFMVHLATIPITGTGINPARSFGAAVIYNKEKAWDDQWIFWVGPFIGAFAAAVYHQFILRAAAIKALGSFRSNA

SEQ ID NO: 25417 - protein, 289 aa, Setaria italica
MGKDDVIESGAGGGEFAAKDYTDPPPAPLIDAAELGSWSLYRAVIAEFIATLLFLYITVLTVIGYKHQTDPNVAGTDACGGVGILGIAWAFGGMIFVLVYCTAGISGGHINPAVTFGLFLARKVSLVRALLYIVAQCLGAICGVGLVKAFQSAYFDRYGGGANSLASGYSRGTGLGAEIIGTFVLVYTVFSATDPKRNARDSHVPVLAPLPIGFAVFMVHLATIPVTGTGINPARSLGAAVIYNKDKPWDDHWIFWVGPFAGAAIAAFYHQYILRAGAIKALGSFRSNA

SEQ ID NO: 25418 - protein, 283 aa, Parthenium argentatum
MTKDVEVAEHHGGKDYHDPPPAPLIDGEELTKWSFYRALIAEFIATLLFLYVTVLTVIGYKSQTDPNLNADQCGGVGILGIAWAFGGMIFILVYCTAGISGGHINPAVTFGLFLARKVSLIRALGYMVAQCLGAICGVGLVKAFQSSYYNRYGGGANELADGYNKGTGLGAEIIGTFVLVYTVFSATDPKRSARDSHVPVLAPLPIGFAVFMVHLATIPITGTGINPARSFGAAVIYNNEKAWDDQWIFWVGPFVGAAAAAFYHQFVLRAAAIKALGSFKSNA

SEQ ID NO: 25419 - protein, 283 aa, Thalictrum flavum
MGKDIEVSEPGEFSAKDYHDPPPAPLFDAKELASWSFYRAIIAEFVATLLFLYITVLTVIGYKTQSAKDQCDGVGILGIAWAFGGMIFVLVYCTAGISGGHINPAVTFGLFLARKVSLIRAVAYMVAQCLGAICGVGFVKAFQKTYYHVQGGGANQLAAGYNKGTGLAAEIIGTFVLVYTVFSATDPKRSARDSHVPVLAPLPIGFAVFMVHLATIPITGTGINPARSFGAAVIYNEEKAWDDQWIFWVGPFIGAAIAAFYHQFILRAAAIKALGSFRSNAHN

SEQ ID NO: 25420 - protein, 287 aa, Rosmarinus officinalis
MAKDVGAADHGSFTAKDYHDPPPAPLIDPEELTKWSFYRALIAEFIATLLFLYITVLTVIGYKSQTDPHLNTDPCNGVGVLGIAWAFGGMIFVLVYCTAGISGGHINPAVTFGLFLARKVSLIRAVMYMVAQCLGAICGVGLVKAFQNAYFHRYGGGANELQDGYSTGVGLAAEIIGTFVLVYTVFSATDPKRSARDSHVPVLAPLPIGFAVFMVHLATIPVTGTGINPARSLGSAVIYNRSKAWDDHWIFWVGPFIGAAIAAFYHQFILRAGAVKALGSFRSSSHV

SEQ ID NO: 25421 - protein, 281 aa, Amsonia hubrichtii
MAKDIAEHGSFTTKDYHDPPPAPLIDPAELTKWSFYRALIAEFIATLLFLYITVLTVIGYNRQTKADQCDGVGVLGIAWAFGGMIFVLVYCTAGISGGHINPAVTFGLFLARKVSLIRAVMYMVAQSLGAICGVGLVKAFQKAYFDRYGGGANELKEGYSIGVGLAAEIIGTFVLVYTVFSATDPKRSARDSHVPVLAPLPIGFAVFMVHLATIPVTGTGINPARSLGSAVIYNHKKAWDDHWIFWVGPFIGAAIAAFYHQFILRAGAVKALSSFRSGSHV

SEQ ID NO: 25422 - protein, 286 aa, Chrysanthemum coronarium
MTKDVPEQGSFSAKDYHDPPPAPLIDPAELTKWSFYRALIAEFIATLLFLYITVLTVIGYKSTTDPHLKNVDPCGGVGILGIAWAFGGMIFVLVYCTAGISGGHINPAVTFGLFLARKVSLIRAIMYMVAQCLGAICGVGLVKAFNKSLYNRYGGGANSLADGYNKGTGLGAEIIGTFVLVYTVFSATDPKRSARDSHVPVLAPLPIGFAVFMVHLATIPITGTGINPARSFGAAVIYNKEKIWDDQWIFWVGPFIGAAIAAFYHQFILRAGAIKALGSFRSSTPN

SEQ ID NO: 25423 - protein, 287 aa, Trifolium pratense
MAKDVEVTERGSFSNKDYHDPPPAPLFDAEELTKWSFYRALIAEFIATLLFLYVTVLTVIGYSIQTDVKAGGDVCGGVGILGIAWAFGGMIFVLVYCTAGISGGHINPAVTFGLFLARKVSLIRAIMYMVAQCLGAIAGVGLVKAFQKSYFVRYGGGANFLHDGYSTGVGLGAEIIGTFVLVYTVFSATDPKRSARDSHVPVLAPLPIGFAVFMVHLATIPVTGTGINPARSLGSAVIYNKDKPWDDHWIFWVGPFIGAAIAAFYHQFILRAGAIKALGSFRSNPTV

SEQ ID NO: 25424 - protein, 287 aa, Euphorbia peplus
MAKDTEVTERASFSAKDYQDPPPAPLFDAGELGKWSFYRAIIAEFIATLLFLYITVLTVIGYKSQTDPDLGLDQCGGVGILGIAWSFGGMIFILVYCTAGISGGHINPAVTFGLLLARKVSLVRAVMYMVAQCLGAIAGVGLVKAFQSSYYTRYGGGANTLADGYSKGVGLSAEIIGTFVLVYTVFSATDPKRSARDSHVPVLAPLPIGFAVFMVHLATIPITGTGINPARSLGAAVIYNKEKAWDDQWMFWVGPFIGAAIASFYHQFILRAGAAKALGSFRSTPTV

SEQ ID NO: 25425 - protein, 288 aa, Fraxinus spp
MTKDAGVAEHGSFTAKDYHDPPPAPLIDAKELTKWSFYRALIAEFVATLLFLYITVLTVIGYKSQIDTDLNGDQCGGVGILGIAWAFGGMIFILVYCTAGISGGHINPAVTFGLFLARKVSLIRAVMYMVAQCLGAICGVGLVKAFQKSYYKKYGGGANELADGISTGVGLAAEIIGTFVLVYTVFSATDPKRSARDSHVPVLAPLPIGFAVFMVHLATIPITGTGINPARSLGAAVIYDQDKAWDDHWIFWVGPFIGAAVAAFYHQFILRAGAVKALGSFRSNASHH

SEQ ID NO: 25426 - protein, 281 aa, Mimulus guttatus
MAKDVAEQGSFGAKDYHDPPPAPLIDAEELTKWSFYRAVIAEFIATLLFLYITVATVIGYKSQAAVDECGGVGILGIAWAFGGMIFVLVYCTAGISGGHINPAVTFGLFLARKVSLVRAVMYMVAQCLGAICGVGLVKAFQSSLYKKYGGGANGLSADYSTGVGLAAEIIGTFVLVYTVFSATDPKRSARDSHVPVLAPLPIGFAVFMVHLATIPITGTGINPARSLGAAVILNNDAGWNDHWIFWVGPFIGAAIAAFYHQFILRAGAVKALGSFRSSNHV

SEQ ID NO: 25427 - protein, 287 aa, Primula obconica
MSKEVETTGTEQPEFSSKDYQDPPPAQLLDLDELTKWSFYRAIIAEFIATLLFLYITVLTVIGYKSQSDTFAGGDQCGGVGLLGISWAFGGMIFILVYCTAGISGGHINPAVTFGLFLARKVSLIRALFYMVAQCLGAICGVGLVKAFQKSYYDRYGGGANEVQLGYNKGTALGAEIIGTFVLVYTVFSATDPKRNARDSHVPVLAPLPIGFAVFMVHLATIPVTGTGINPARSFGAAVIYNKDKAWDDQWIFWVGPFIGAAVAAFYHQFVLRAAAIKALGSFRSNA

SEQ ID NO: 25428 - protein, 287 aa, Prunus mume
MAKDVEVAERGSFSAKDYHDPPPAPLFDAVELTKWSFYRALIAEFIATLLFLYVTVLTVIGYKSQTDTAVNADACGGVGILGIAWAFGGMIFVLVYCTAGISGGHINPAVTFGLFLARKVSLVRAVLYMVAQSLGAIAGVALVKAFQKSYYTKYGGGANELSQGYSTGVGLGAEIIGTFVLVYTVFSATDPKRSARDSHVPVLAPLPIGFAVFIVHLATIPITGTGINPARSLGAAVIYNKKKAWDDQWIFWVGPFIGAAIAAFYHQFILRAGAVKALGSFRSNPHV

SEQ ID NO: 25429 - protein, 287 aa, Camellia sinensis
MAKEVEETVVTEQEFSAKDYHDPPPAPLVDVVELTKWSFYRAIIAEFIATLLFLYITVLTVIGYKSQTDPIKNADQCGGVGILGIAWAFGGMIFVLVYCTAGISGGHINPAVTFGLFLARKVSLIRALLYMVAQCSGAICGVGLVKAFQRAYYDRYGGGANEVAPGYNKGTALGAEIIGTFVLVYTVFSATDPKRSARDSHVPVLAPLPIGFAVFMVHLATIPVTGTGINPARSFGAAVIYNQKKAWDDHWIFWVGPFVGAAIAAFYHQFILRAAAIKALGSFRSNA

SEQ ID NO: 25430 - protein, 288 aa, Tripterygium wilfordii
MAKDIEASGPGAEFQSKDYQDPPPAPLIDAEEFTQWSLYRAVIAEFIATLLFLYITVLTVIGYKSQTDPAMNTDECGGVGILGIAWAFGGMIFVLVYCTAGISGGHINPAVTFGLLLARKVSLVRAVLYIAAQCLGAICGCGLVKAFQKSYYTRYGGGANELADGYNKGTGLGAEIIGTFVLVYTVFSATDPKRNARDSHVPVLAPLPIGFAVFMVHLATIPITGTGINPARSFGAAVIYNKEKAWDDQWLFWVGPFVGAAIAAIYHQYILRAGAIKALGSFRSSSKI

SEQ ID NO: 25431 - protein, 285 aa, Centaurea maculosa
MTKDVPEQGSFSAKDYHDPPPAPFIDPAELTKWSFYRAIIAEFVATLLFLYITVLTVIGYKAQTDPAKNLDQCGGVGILGIAWAFGGMIFVLVYCTAGISGGHINPAVTFGLFLARKVSLIRAVLYMVAQCLGAICGVGLVKAFHKTYYNNYGGGANELADGYNKGTGLGAEIIGTFVLVYTVFSATDPKRSARDSHVPVLAPLPIGFAVFMVHLATIPITGTGINPARSLGAAVIYNKEKAWDDQWIFWVGPFIGAAIAAFYHQFILRAGAIKALGSFRSSSHV

SEQ ID NO: 25432 - protein, 285 aa, Gossypium hirsutum
MAKDVEVGGEFQAKDYHDPPPAPLVDAQELTQWSFYRAIIAEFIATLLFLYITVLTVIGYKSQVDPDKGGQDCDGVGILGIAWAFGGMIFILVYCTAGISGGHINPAVTFGLFLARKVSLVRAILYMAAQCLGAICGCGLVKAFQKSYYNKYGGGANSLADGYSTGTGLAAEIIGTFVLAYTVLSATDPKRNARDSHVPVLAPLPIGFTVFMVHLATIPITGTGINPARSFGAAVMFNQDKPWDDHWIFWVGPFIGAAIAATYHQYILRAGAAKALGSFRSSSAM

SEQ ID NO: 25433 - protein, 285 aa, Flaveria ramosissima
MTKDVPEQGSFSAKDYHDPPPAPLIDPEEFSKWSFYRAVIAEFIATLLFLYITVLTVIGYKSTTDPALNADQCGGVGILGIAWAFGGMIFVLVYCTAGISGGHINPAVTFGLFLARKVSLIRAFMYMVAQCLGAICGVGLVKAFNKSLYNRYGGGANELADGYNKGTGLGAEIIGTFVLVYTVFSATDPKRSARDSHVPVLAPLPIGFAVFMVHLATIPITGTGINPARSLGAAVIYNNEKAWDDQWIFWVGPFVGAAIAAFYHQFILRAGAIKALGSFRSSSHV

SEQ ID NO: 25434 - protein, 285 aa, Flaveria ramosissima
MTKDVPEQGSFSAKDYHDPPPAPLIDPEELSKWSFYRAVIAEFIATLLFLYVTVLTVIGYKSTTDPALTTDQCGGVGILGIAWAFGGMIFVLVYCTAGISGGHINPAVTFGLFLARKVSLIRAFMYMVAQCLGAICGVGLVKALNKSLYNRYGGGANELADGYNKGTGLGAEIIGTFVLVYTVFSATDPKRSARDSHVPVLAPLPIGFAVFMVHLATIPITGTGINPARSLGAAVIYNNEKAWDDQWIFWVGPFVGAAIAAFYHQFILRAGAIKALGSFRSSSHV

SEQ ID NO: 25435 - protein, 284 aa, Citrullus lanatus
MSKDLEAGGFAAKDYQDPPPAPLIDAEEFAQWSFYRAIIAEFVATLLFLYVTVLTVIGYSSQSDTKNGGQICGGVGILGIAWAFGGMIFVLVYCTAGISGGHINPAVTFGLFLARKVSLIRAILYMVAQCLGAICGCALVKSFQKAHYNEYGGGANSLADGYGTGTGLAAEIIGTFVLVYTVFSATDPKRNARDSHVPVLAPLPIGFAVFMVHLATIPITGTGINPARSFGAAVIFNKDKPWDDQWIFWVGPFIGAAIAAIYHQIVLRAGAVKALGSFRSSTAV

SEQ ID NO: 25436 - protein, 284 aa, Citrullus lanatus
MAKDSDAGGFAAKDYHDPPPAPFIDANEFTQWSFYRAIIAEFIATLLFLYVTVLTVIGYSSQSDIKNGGQICGGVGILGIAWAFGGMIFVLVYCTAGISGGHINPAVTFGLFLARKVSLVRAVLYMVAQCLGAICGCALVKSFQKGLYNRYGGGANSLADGYSTGTGLGAEIIGTFVLVYTVFSATDPKRSARDSHVPVLAPLPIGFAVFMVHLATIPVTGTGINPARSFGAAVVFNQSKPWNDHWIFWVGPFIGAAIAAFYHQFILRAGAVKALGSFRSTHSV

SEQ ID NO: 25437 - protein, 284 aa, Taraxacum officinale
MTKDVAEQGSTLSAKDYHDPPPAAFIDPKELTKWSFYRALIAEFVATLLFLYITVLTVIGYKSGIDKGSDACGGVGVLGIAWAFGGMIFVLVYCTAGISGGHINPAVTFGLFLARKVSLPRAILYMVAQCLGAICGVGLVKAFHKTYYNTYGGGANELADGYNKGTGLGAEIIGTFVLVYTVFSATDPKRSARDSHVPVLAPLPIGFAVFMVHLATIPITGTGINPARSFGAAVIYNKAKAWDDQWIFWVGPFIGAAIAAFYHQFILRAGAAKALGSFRSSTHV

SEQ ID NO: 25438 - protein, 284 aa, Cichorium intybus
MTKDVEVAEHHGGKDYHDPPPAPFFDAEELTKWSFYRALIAEFVATLLFLYVTVLTVIGYKSQTDPTLPGVDECGGVGILGIAWAFGGMIFILVYCTAGISGGHINPAVTFGLFLARKVSLIRAVLYMVAQCLGAICGVGLVKAFQSSYYNRYGGGANELADGYNKGTGLGAEIIGTFVLVYTVFSATDPKRSARDSHVPVLAPLPIGFAVFMVHLATIPITGTGINPARSFGAAVIYNNAKAWDDQWIFWVGPFIGAAIAAFYHQFVLRAGAIKALGSFRSNA

SEQ ID NO: 25439 - protein, 290 aa, Amorphophallus konjac
MGKEVEEHHGGEFTAKDYTDPPPAPLIDPDELGKWSFYRALIAEFIATLLFLYVTVLTVIGHKSSTDPDKVSPDAANCGGVGILGIAWAFGGMIFILVYCTAGISGGHINPAVTFGLFLARKVSLVRAILYMVAQCLGAICGVGLVKGFQKAYYTRYGGGANTLNSGYSKGTGLAAEIIGTFVLVYTVFAATDPKRNARDSHVPVLAPLPIGFAVFMVHLATIPITGTGINPARSFGAAVIYNKEKAWDDQWIFWVGPFIGAAIAAAYHQYVLRAGAIKALGSFRSNPHV

SEQ ID NO: 25440 - protein, 284 aa, Cleome gynandra
MAKDVEVQETSATVKDYTDPPPAPLIDLEELTKWSFYRAVIAEFIATLLFLYVTVLTVIGYNVQTDTKAGGEDCGGVGILGIAWAFGGMIFILVYCTAGISGGHINPAVTFGLFVARKVSLVRALMYMVAQCLGAICGCGLVKGFQKSYYNRYGGGANALASGYNKGTGLGAEIIGTFVLVYTVFAATDPKRNARDSHVPVLAPLPIGFAVFMVHLATIPITGTGINPARSFGAAVIYNKDKPWDDQWIFWVGPFIGALAAAVYHQYVLRAAAIKALGSFRSNA

SEQ ID NO: 25441 - protein, 282 aa, Artemisia annua
MTKDVEVAEHHGGKDYHEPPPAPLFDADELTKWSFYRALIAEFVATLLFLYVTVLTVIGYKSTTDITLNADQCGGVGILGIAWAFGGMIFVLVYCTAGISGGHINPAVTFGLFLARKVSLIRAVMYMAQCLGAICGVGLVKAFQSSYYNRYGGGANTLADGYNKGTGLGAEIIGTFVLVYTVFSATDPKRSARDSHVPVLAPLPIGFAVFMVHLATIPITGTGINPARSFGAAVIYNDEKAWDDQWIFWVGPFLGAAAAAFYHQFVLRAGAIKALGSFRSNA

SEQ ID NO: 25442 - protein, 289 aa, Theobroma cacao
MAKEVETAEQGGGEFSAKDYHDPPPAPLIDAEELFKWSFYRALIAEFIATLLFLYVSVLTVIGYKVQTDTLKNTVDADCGGVGILGIAWAFGGMIFILVYCTAGISGGHINPAVTFGLFLGRKVSLIRAIMYMVAQCLGAICGCGLVKAFQKTYYNTYGGGANELQPGYNKGTGLGAEIIGTFVLVYTVFSATDPKRSARDSHVPVLAPLPIGFAVFMVHLATIPITGTGINPARSFGAAVIYNREKAWDDQWIFWVGPFIGAAIAAFYHQYILRAAAIKALGSFRSNA

SEQ ID NO: 25443 - protein, 263 aa, Chrysanthemum coronarium
PSPLFDSEELTKWSFYRAIIAEFIATLLFLYITVLTVIGYKSQVDPAHSTDQCGGVGILGIAWAFGGMIFVLVYCTAGISGGHINPAVTFGLFLARKVTLPRAFMYIVAQCLGAICGCGLVKAFQKTYYHNYGGGANELADGYSKGTGLGAEIIGTFVLVYTVFSATDPKRNARDSHVPVLAPLPIGFAVFMVHLATIPITGTGINPARSFGAAVMYGKEKAWDDQWLFWVGPMIGAAIAAFYHQYVLRAGAIKALGSFRSNA

SEQ ID NO: 25444 - protein, 289 aa, Cirsium arvense
MTKDVEVAEHHGGGSDYAAKDYQDPPPAPLIDGEELTKWSFYRAVIAEFVATLLFLYVTVLTVIGYKSQTDPTLNTDQCGGVGILGIAWAFGGMIFVLVYCTAGISGGHINPAVTFGLFLARKVSLIRAVAYMVAQCLGAICGVGLVKAFQSSYYNRYGGGANELAPGYNKGTGLGAEIIGTFVLVYTVFSATDPKRSARDSHVPVLAPLPIGFAVFMVHLATIPITGTGINPARSLGAAVIYNNEKAWDDQWIFWVGPFLGAAAAAFYHQFVLRAAAIKALGSFRSNA

SEQ ID NO: 25445 - protein, 282 aa, Gossypium hirsutum
  Sequence also found in Organisms: Gossypium raimondii
MAKEGENSTFHARDYVDPPPAPLIDASELKKWSFYRALIAEFIATMLFLYITVLTVIGHKSQVATSPDACSGVGLLGIAWAFGGMIFILVYCTAGISGGHINPAVTFGLFLARKVSLIRAIAYMVAQSLGAICGVGLVKAFQSAYYNRYGGGANTLADGYSTGTGLGAEIIGTFVLVYTVFSATDPKRKARDSHVPVLAPLPIGFAVFMVHLATIPITGTGINPARSIGAAVIFNSKKAWDDHWIFWVGPMIGAAIAAFYHQFILRAGAAKALGSFRSQTHV

SEQ ID NO: 25446 - protein, 283 aa, Echinacea purpurea
MTKDTEVAEHHHGKDYHDPPPAPLIDAKELTKWSFYRALIAEFVATLLFLYVTVLTVIGYKSTTDPDLDADQCGGVGILGIAWAFGGMIFILVYCTAGISGGHINPAVTFGLFLARKVSLIRAVSYMVAQCLGAICGVGLVKAFQSSYYNRYGGGANTLADGYDKGTGLGAEIIGTFVLVYTVFSATDPKRNARDSHVPVLAPLPIGFAVFMVHLATIPITGTGINPARSFGAAVIYNDEKAWDDHWLFWVGPFLGAAAAAFYHQFILRAAAAKALGSFRSNA

SEQ ID NO: 25447 - protein, 288 aa, Olea europaea
MTKDAGVAEHGSFTTKDYHDPPPAPLIDAEELTKWSFYRAIIAEFIATLLFLYITVLTVIGYKSQTDPDLKGDQCDGVGILGIAWAFGGMIFILVYCTAGISGGHINPAVTFGLFLARKVSLIRAVMYMVAQCLGAICGVGLVKAFQKSYYKKYGGGANVLADGISTGVGLAAEIIGTFVLVYTVFSATDPKRSARDSHVPVLAPLPIGFAVFMVHLATIPITGTGINPARSLGAAVIYDQHKAWDDHWIFWVGPFIGAAVAAFYHQFILRAGAAKALGSFRSSASHH

SEQ ID NO: 25448 - protein, 283 aa, Senecio madagascariensis
MTKDVEVAEHHGGKDYQDPPPAPFFDADELTKWSFYRAIIAEFVATLLFLYVTVLTVIGYKAGTDPTLNTDQCGGVGILGIAWAFGGMIFVLVYCTAGISGGHINPAVTFGLFLARKVSLIRAIAYMVAQCLGAICGVGFVKAFQSSYYNRYGGGANSLADGYNKGTGLGAEIIGTFVLVYTVFSATDPKRSARDSHVPVLAPLPIGFAVFMVHLATIPITGTGINPARSFGAAVIFNNDKVWDDQWIFWLGPFIGAAIAAFYHQFVLRAGAIKALGSFRSNA

SEQ ID NO: 25449 - protein, 288 aa, Silene vulgaris
MSKDMEVAEQQPEYTTKDYHDPPPAPLFDMEELRKWSFYRAIIAEFVATLLFLYITVLTVIGYKSETDLNAGGDQCGGVGILGIAWAFGGMIFILVYCTAGISGGHINPAVTFGLFLARKVSLIRAFAYMVAQCLGAICGVGLVKAFQKAYYVRYGGGANEMAPGYNKGTGLGAEIIGTFVLVYTVFAATDPKRSARDSHVPVLAPLPIGFAVFMVHLATIPITGTGINPARSFGAAVIYNQEKSWNEHWIFWVGPFIGAAIAAFYHQYILRAGAIKALGSFRSSAAN

SEQ ID NO: 25450 - protein, 283 aa, Valeriana officinalis
MAKTTEVAEQGSFSAKDYHDPPPAPLIDPAELTKWSFYRAIIAEFIATLLFLYITVLTVIGYNVQNQSDDCGGVGVLGIAWAFGGMIFVLVYCTAGISGGHINPAVTFGLFLARKVSLIRAVMYMVAQCLGAICGVGLVKALQSAEYKRHGGGANMLNPGYNKGTGLAAEIIGTFVLVYTVFSATDPKRSARDSHVPVLAPLPIGFAVFMVHLATIPITGTGINPARSLGAAVIYNKEKAWDDQWLFWVGPFIGAAIAAFYHQFVLRAGAVKALGSFRSNPHV

SEQ ID NO: 25451 - protein, 285 aa, Artemisia annua
MTKDVPEQGSFSAKDYHDPPPAPLIDPGELTKWSFYRALIAEFIATLLFLYITVLTVIGYKSTTDPKLNADPCGGVGILGIAWAFGGMIFVLVYCTAGISGGHINPAVTFGLFLARKVSLIRALMYMVAQCLGAICGVGLVKAFNKSLYNRYGGGANSLADGYNKGTGLGAEIIGTFVLVYTVFSATDPKRSARDSHVPVLAPLPIGFAVFMVHLATIPITGTGINPARSLGAAVIYNKEKIWDDQWIFWVGPFIGAAIAAFYHQFILRAGAIKALGSFRSSTPN

SEQ ID NO: 25452 - protein, 285 aa, Manihot esculenta
MVKDVTEQGSFSGKDYHDPPPTPLFDAAELTKWSFYRALIAEFIATLLFLYITILTVIGYKSQTDPAKNADSCGGVGILGIAWAFGGMIFILVYCTAGISGGHINPAVTFGLFLARKVSLVRAVMYMVAQCLGAIAGAGLVKGFQNSYYKRYGGGANSLADGYSTGTGLGAEIIGTFVLVYTVFSATDPKRNARDSHVPVLAPLPIGFAVFMVHLATIPITGTGINPARSLGAAVIYNQDKPWDDHWIFWVGPFIGAAIAAFYHQFILRAGAVKALGSFRSNPTV

SEQ ID NO: 25453 - protein, 287 aa, Musa acuminata
MAKDIEVAEQGEYTAKDYTDPPPAPLVDVEELTKWSLYRAAIAEFIATMLFLYVTVLTVIGYKHQSDPNVNPTDAACSGVGILGIAWAFGGMIFILVYCTAGISGGHINPAVTFGLFLARKVSLVRAFLYMVAQCLGAICGVGLVKGFQKAYFVRYGGGANELSDGYSKGTGLGAEIIGTFVLVYTVFAATDPKRSARDSHVPVLAPLPIGFAVFMVHLATIPITGTGINPARSFGAAVIYNKDKAWDDQWIFWVGPAIGAAIAAAYHQYVLRASGVKALGSFRSSA

SEQ ID NO: 25454 - protein, 284 aa, Chrysanthemum coronarium
MTKDVAEHHGAKDYHDPPPAPLFDADELTKWSFYRALIAEFIATLLFLYVTVLTVIGYKSTTDPTLPGVDECGGVGILGIAWAFGGMIFVLVYCTAGISGGHINPAVTFGLFLARKVSLPRAIMYMVAQCLGAICGVGLVKSFHKTYYNTFGGGANELADGYNKGTGLGAEIIGTFVLVYTVFSATDPKRNARDSHVPVLAPLPIGFAVFMVHLATIPITGTGINPARSFGAAVIYNKEKAWDDQWIFWVGPFIGAAIAAFYHQFILRAGAVKALGSFRSTTHV

SEQ ID NO: 25455 - protein, 285 aa, Gossypium raimondii
MGKDIESSVEQGSGKDYHDPPPAPLIDAEELTKWSFYRAVIAEFIATLLFLYVTVLTVIGYKVQTDPLKNTVDPDCGGVGILGIAWAFGGMIFILVYCTAGISGGHINPAVTFGLFLGRKVSLIRAIMYMVAQCLGAICGCGLVKAFQKTYYNNYGGGANELQSGFNKGTGLGAEIIGTFVLVYTVFSATDPKRNARDSHVPVLAPLPIGFAVFMVHLATIPVTGTGINPARSFGAAVIYNKEKAWDDQWIFWVGPFIGAAIAAFYHQYILRAAAIKAFGSSRSN

SEQ ID NO: 25456 - protein, 284 aa, Nicotiana benthamiana
MAKNVGSEGSFTTKDYQDPPPAPLIDPEELTQWSFYRALIAEFIATLLFLYITVLTVIGYKSQSATATDPCAGVGILGIAWAFGGMIFVLVYCTAGISGGHINPAVTFGLFLARKVSLIRAVMYMVAQCLGAICGVGLVKALQSAYYHRYDGGVNMLSDGYSHGVGLSAEIIGTFVLVYTVFSATDPKRNARDSHVPVLAPLPIGFAVFMVHLATIPITGTGINPARSLGAAVIFNQHKAWKDHWIFWVGPFIGATIAAFYHQFILRAGAAKALGSFRSSTCQV

SEQ ID NO: 25457 - protein, 287 aa, Allium cepa
MGVDAGEKGTEFTSKDYQDPPPAPLIDIEELTKWSLYRAVIAEFIATLLFLYITVATVIGYKHQSDTTLPGNTDGACSGVGILGISWAFGGMIFVLVYCTAGISGGHINPAVTFGLFLARKVSLVRAVLYMIAQCLGAICGVGFVKAFQSAYYSRYGGGANELNSGYTKGTGLAAEIIGTFVLVYTVFAATDPKRNARDSHVPVLAPLPIGFAVFMVHLATIPITGTGINPARSFGAAVIYNKDKAWDDQWIFWVGPFIGAAIAAAYHQYVLRAGAVKALGSFKSNP

SEQ ID NO: 25458 - protein, 278 aa, Silene vulgaris
MGKELEGEVGKDYHDPPPSPLFDMAEMGKWSFYRAVIAEFVATLLFLYITVLTVIGYKSQSATDDCGGVGILGIAWAFGGMIFILVYCTAGISGGHINPAVTFGLLLARKLSLVRAVLYMVAQCLGAICGVGLVKAFQSAYYDRFGGGANELAVGYSKGTGLGAEIIGTFVLVYTVFSATDPKRSARDSHVPVLAPLPIGFAVFMVHLATIPVTGTGINPARSFGAAVIYNNKKAWDDHWMFWVGPFIGAAIAAIYHQYILRAGFVKALGSFRSSSNV

SEQ ID NO: 25459 - protein, 284 aa, Cucumis melo
MAKDSDAGAFAAKDYHDPPPAPFIDPHEFTQWSFYRAIIAEFIATLLFLYVTVLTVIGYSSQSDIKHNGQICGGVGILGIAWAFGGMIFVLVYCTAGISGGHINPAVTFGLFLARKVSLVRAVLYMVAQCLGAICGCALVKSFQKGLYIRYGGGANSLADGYSTGTGLAAEIIGTFVLVYTVFSATDPKRSARDSHIPVLAPLPIGFAVFMVHLATIPVTGTGINPARSFGAAVVLNESKPWNDHWIFWVGPFIGAAIAAFYHQFILRAGAVKALGSFRSTQSV

SEQ ID NO: 25460 - protein, 284 aa, Cucurbita pepo
MAKDSEAGGFAAKDYHDPPPAPLIDVEEFTQWSFYRAIIAEFIATLLFLYVTVLTVIGYSSQSDVDHGGHICGGVGILGIAWAFGGMIFVLVYCTAGISGGHINPAVTFGLFLARKVSLVRAVLYMVAQCVGAICGCALVKSFQKGLYNRYGGGANSLAEGYSTGTGLAAEIIGTFVLVYTVFSATDPKRSARDSHIPVLAPLPIGFAVFMVHLATIPITGTGINPARSFGAAVVFNHSKPWNDHWIFWVGPFIGALIAAFYHQFILRAGAVKALGSFRSTHSV

SEQ ID NO: 25461 - protein, 285 aa, Echinacea purpurea
MTKDVAEHGSFSAKDYHDPPPAPLIDPKELTKWSFYRALIAEFIATLLFLYITVLTVIGYKSTTDPALNADQCGGVGILGIAWAFGGMIFVLVYCTAGISGGHINPAVTFGLFLARKVSLIRAVMYMVAQCLGAICGVGLVKAFNKSLYNRYGGGANELAAGYNKGTGLGAEIIGTFVLVYTVFSATDPKRSARDSHVPVLAPLPIGFAVFMVHLATIPITGTGINPARSLGAAVIYNKEKAWDDQWIFWVGPFVGAAIAAFYHQFILRAGAVKALGSFRSSTHV

SEQ ID NO: 25462 - protein, 283 aa, Fagopyrum esculentum
MSSKDMAGSGEQGSFSHKDYHDPPPAPLIDSVELGKWSFYRALIAEFIATLLFLYITVLTVIGYKSQSSTDACSGVGILGIAWAFGGMIFVLVYCTAGISGGHINPAVTFGLFLARKVSLIRAIAYMVAQSLGAICGVGLVKAFQSSYYDRYGGGANELAAGYNKGTGLGAEIIGTFVLVYTVFSATDPKRNARDSHVPVLAPLPIGFAVFMVHLATIPITGTGINPARSLGAAVIYNQKKAWDDQWIFWVGPFIGAAIAAFYHQFVIRGGAKTLGSFRSSSA

SEQ ID NO: 25463 - protein, 282 aa, Gossypium raimondii
MVKDVETAAGRDYHDPPPAPLIDAEELTQWSFYRALIAEFIATLLFLYVTVLTVIGYKVQTDPLKNTVDPDCGGVGILGIAWAFGGMIFILVYCTAGISGGHINPAVTFGLFLGRKVSLVRAVMYMVAQCLGAICGCGLVKWFQKSYYNTYGGGANELQDGFNKGTGLGAEIIGTFVLVYTVFSATDPKRNARDSHVPVLAPLPIGFAVFMVHLATIPITGTGINPARSFGAAVIYNKDKAWDDQWMFWVGPFIGAAIAANYHQYILRAGAMKALGSFRSNA

SEQ ID NO: 25464 - protein, 283 aa, Cichorium intybus
MTKDLAEEGSFSAKDYHDPPPAAFIDPKELTKWSLYRAVIAEFVATLLFLYITVLTVIGYKSQIDKGGDPCGGVGVLGIAWAFGGMIFVLVYCTAGISGGHINPAVTFGLFLARKVSLPRAILYMAAQCLGAICGVGLVKAFNKTYYNNYGGGANELADGYNKGTGLGAEIIGTFVLVYTVFSATDPKRNARDSHVPVLAPLPIGFAVFMVHLATIPITGTGINPARSFGAAVIYNKEKAWDDQWIFWVGPFIGAAIAAFYHQFILRAAAAKALGSFRSSTHV

SEQ ID NO: 25465 - protein, 289 aa, Arnica chamissonis
MTKDVEVAEHHGGGGEYAAKDYQDPPPAPFFDAEELTKWSFYRALIAEFVATLLFLYVTVLTVIGYKSQTDPSLNTDQCGGVGILGIAWAFGGMIFILVYCTAGISGGHINPAVTFGLFLARKVSLIRALGYMIAQCLGAICGVGLVKAFQSSYYNRYGGGANELADGYNKGTGLGAEIIGTFVLVYTVFSATDPKRSARDSHVPVLAPLPIGFAVFMVHLATIPITGTGINPARSFGAAVIYNKDKAWDDQWIFWVGPFIGAFAAALYHQFVLRAGAIKALGSFRSNA

SEQ ID NO: 25466 - protein, 289 aa, Fagus grandifolia
MAKDVEVAEHGHGSFPAKDYHDPPPAPLMDAVELTKWSFYRALIAEYVATLLFLYVTVLTVIGYKSQIDPDLKGDACGGVGILGIAWAFGGMIFVLVYCTAGISGGHINPAVTFGLFLARKVSLPRAVMYMVAQCLGAISGVGLVKAFQKAYYMKYGGGANTLSDGYSTGVGLGAEIVGTFVLVYTVFSATDPKRNARDSHVPVLAPLPIGFAVFIVHLATIPITGTGINPARSLGAAVIYNKDTAWDDQWIFWVGPFIGAAIAAFYHQFILRAGAVKALGSFRSTTHV

SEQ ID NO: 25467 - protein, 283 aa, Cichorium intybus
MTKDVAEEGSFSAKDYHDPPPAAFIDPKELTKWSLYRAVIAEFVATLLFLYITVLTVIGYKSQIDKGGDPCGGVGVLGIAWAFGGMIFVLVYCTAGISGGHINPAVTFGLFLARKVSLPRAILYMAAQCLGAICGVGLVKAFNKTYYNNYGGGANELADGYNKGTGLGAEIIGTFVLVYTVFSATDPKRNARDSHVPVLAPLPIGFAVFMVHLATIPITGTGINPARSFGAAVIYNKEKAWDDQWIFWVGPFIGAAIAAFYHQFILRAAAAKALGSFRSSTHV

SEQ ID NO: 25468 - protein, 289 aa, Echinochloa colona
MGKDDVIESGAGGGEFAAKDYTDPPPAPLIDAAELGSWSLYRAVIAEFIATLLFLYITVLTVIGYKHQTDTQGANGDACGGVGVLGIAWAFGGMIFVLVYCTAGISGGHINPAVTFGLFLARKVSLVRAVLYIVAQCLGAICGVGLVKAFQSAYFDRYGGGANSLASGYSRGTGLGAEIIGTFVLVYTVFSATDPKRNARDSHVPVLAPLPIGFAVFMVHLATIPVTGTGINPARSLGAAVIYNKSKPWDDHWIFWVGPLVGAAIAAFYHQYILRAGAIKALGSFRSNA

SEQ ID NO: 25469 - protein, 287 aa, Trifolium pratense
MAKDIEVSERGSFSNKDYHDPPPAPLFDAEELTKWSFYRALIAEFIATLLFLYVTVLTVIGYSIQTDVKAGGDVCGGVGILGIAWAFGGMIFVLVYCTAGISGGHINPAVTFGLFLARKVSLIRAIMYMVAQCLGAIAGVGLVKAFQKSYFDRYGGGANFLHDGYSTGVGLGAEIVGTFVLVYTVFSATDPKRSARDSHVPVLAPLPIGFAVFMVHLATIPVTGTGINPARSLGSAVIYNKDKPWDDHWIFWVGPFIGAAIAAFYHQFILRAGAVKALGSFRSNPTV

SEQ ID NO: 25470 - protein, 287 aa, Chelidonium majus
MGKDVEVAEQGEFSAKDYHDPPPPAFIGTHELTTWSFYRAIIAEFVATLLFLYITVLTVIGYKSQIDPKNGGDECGGVGILGIAWAFGGMIFILVYCTAGISGGHINPAVTFGLFLARKVSLIRAVMYIVAQSLGAICGVGLVKAFQKAYYVRYGGGANELAAGYSKGTGLAAEIIGTFVLVYTVFSATDPKRNARDSHVPVLAPLPIGFAVFMVHLATIPITGTGINPARSFGAAVIYNKEKAWDDQWIFWVGPFIGAAIAAAYHQYILRAGALKALGSFRSTAHT

SEQ ID NO: 25471 - protein, 287 aa, Trifolium pratense
MAKDVEVTERGSFSNKDYHDPPPAPLFDAEELTKWSFYRALIAEFIATLLFLYVTVLTVIGYSIQTDVKAGGDVCGGVGILGIAWAFGGMIFVLVYCTAGISGGHITPAVTFGLFLARKVSLIRAIMYMVAQCLGAIAGVGLVKAFQKSYFVRYGGGANFLHDGYSTGVGLGAEIIGTFVLVYTVFSATGPKRSARDSHVPVLASLPIGFAVFMVHLATIPVTGTGINPARSLGSAVIYNKDKPWDDHWIFWVGPFIGAAIAAFYHQFILRAGAVKALGSFRSNPTV

SEQ ID NO: 25472 - protein, 288 aa, Silene vulgaris
MSKDMELAEQQPEYTTKDYHDPPPAPLFDMEELRKWSFYRAIIAEFVATLLFLYITVLTVIGYKSETDLNAGGDQCGGVGILGIAWAFGGMIFILVYCTAGISGGHINPAVTFGLFLARKVSLIRAFAYMVAQCLGAICGVGLVKAFQKAYYVRYGGGANEMAPGYNKGTGLGAEIIGTFVLVYTVFAATDPKRSARDSHVPVLAPLPIGFAVFMVHLATIPITGTGINPARSFGAAVIYNQEKSWNEHWIFWVGPFIGAAIAAFYHQYILRAGAIKALGSFRSSAAN

SEQ ID NO: 25473 - protein, 285 aa, Cleome gynandra
MAKDVEGGAGDGFQARDYQDPPPAPLVDAEELTKWSFYRALIAEFIATLLFLYITVLTVIGYKSQTDTTTGGEDCGGVGILGIAWAFGGMIFILVYCTAGISGGHINPAVTFGLFLARKVSLVRAVLYMVAQCLGAICGVGLVKAFQSAYYDRYGGGANSLSDGYSKGTGLAAEIIGTFVLVYTVFSATDPKRNARDSHVPVLAPLPIGFAVFMVHLATIPITGTGINPARSLGAAVIYNKDKPWDDHWIFWVGPFIGAAIAAFYHQFVLRASGSKSLGSFRSAS

SEQ ID NO: 25474 - protein, 286 aa, Mimulus guttatus
MAKDVECADPPAGFSAKDYHDPPPAPLFDCGELTQWSFYRALIAEFIATLLFLYVTVLTVIGYKVQSDAVHGGDQCGGVGILGIAWAFGGMIFILVYCTAGISGGHINPAVTFGLFLGRKVSLIRAVLYMVAQCLGAICGVGLVKAFQKSYYVRYGGGANTLAHGYNTGVGLGAEIIGTFVLVYTVFSATDPKRNARDSHVPVLAPLPIGFAVFMVHLATIPITGTGINPARSFGAAVIFNNDKAWDDQWIFWVGPFVGAAIAAFYHQFILRAAAIKALGSFRSHA

SEQ ID NO: 25475 - protein, 284 aa, Citrullus lanatus
MSKDIEAGGRGGFSGKDYEDPPPAPLIDAQEFAQWSFYRAIIAEFVATLLFLYVTVLTVIGYKVQSDDKNGGEICGGVGILGIAWAFGGMIFVLVYCTAGISGGHINPAVTFGLFLARKVSLVRAVLYMVAQCLGAICGCALVKAFQNAHYNKYGGGANSLSDGYSTGTGLAAEIIGTFVLVYTVFSATDPKRNARDSHVPVLAPLPIGFAVFMVHLATIPITGTGINPARSFGAAVVFNQSKPWDDQWIFWVGPFIGAAIAAIYHQFILRAGAAKALGSFSTS

SEQ ID NO: 25476 - protein, 289 aa, Eucalyptus grandis
MAKDDEVVEQQGGEFHGKDYRDPPPAPLVDAEELVKWSFYRAVIAEFVATLLFLYITVLTVIGYSRQSDTTHGGDQCDGVGLLGIAWAFGGMIFVLVYCTAGISGGHINPAVTFGLFLARRVSLVRAILYMVAQCLGAVCGCGLVKAFQRAYYKRYGGGANMLQAGYSKGTGLGAEIIGTFVLVYTVLSATDPKRSARDSHVPVLAPLPIGFAVFMVHLATIPITGTGINPARSFGAAVMYNKEKAWDDQWIFWVGPFIGAAIAAFYHQHVLRAAAIKALGSFRSSSAL

SEQ ID NO: 25477 - protein, 282 aa, Chrysanthemum coronarium
MTKDAAEHHGAKDYHDPPPAPLFDADELTKWSFYRALIAEFIATLLFLYVTVLTVIGYKSTTDPTLPDVDECGGVGILGIAWAFGGMIFVLVYCTAGISGGHINPAVTFGLFLARKVSLIRAVMYMLAQCLGAICGVGLVKAFQSSYYNRYGGGANTLADGYNKGTGLGAEIIGTFVLVYTVFSATDPKRSARDSHVPVLAPLPIGFAVFMVHLATIPITGTGINPARSFGAAVIYNNEKAWDDQWIFWVGPFLGAAAAAFYHQFVLRAGAIKALGSFRSNA

SEQ ID NO: 25478 - protein, 283 aa, Cichorium intybus
MTKDVAEEGSFSSKDYHDPPPAAFIDPKELTKWSLYRAVIAEFVATLLFLYITVLTVIGYKSQIDKGGDPCGGVGVLGIAWAFGGMIFVLVYCTAGISGGHINPAVTFGLFLARKVSLPRAILYMAAQCLGAICGVGLVKAFNKTYYNNYGGGANELADGYNKGTGLGAEIIGTFVLVYTVFSATDPKRSARDSHVPVLAPLPIGFAVFMVHLATIPITGTGINPARSFGAAVIYNKEKAWDDQWIFWVGPFIGAAIAAFYHQFILRAAAAKALGSFRSSTHV

SEQ ID NO: 25479 - protein, 289 aa, Echinochloa colona
MGKDDVIESGAGGGEFAAKDYTDPPPAPLIDAAELGSWSLYRAVIAEFIATLLFLYITVLTVIGYKHQTDVQGAGGDACGGVGVLGIAWAFGGMIFVLVYCTAGISGGHINPAVTFGLFLARKVSLVRAVLYIVAQCLGAICGVGLVKAFQSAYFDRYGGGANSLASGYSRGTGLGAEIIGTFVLVYTVFSATDPKRNARDSHVPVLAPLPIGFAVFMVHLATIPVTGTGINPARSLGAAVIYNKSKPWDDHWIFWVGPLVGAAIAAFYHQYILRAGAIKALGSFRSNA

SEQ ID NO: 25480 - protein, 290 aa, Tabernaemontana elegans
MAKDLGVAEHGSFTAKDYHDPPPEPLIDPEELTKWSFYRALIAEFIATLLFLYVTVLTVIGYKSQIAPHDSLPAGDPCGGVGILGIAWAFGGMIFVLVYCTAGISGGHINPAVTFGLFLARKVSLIRAVMYMVAQSLGAICGVGLVKAFQKAYFDRYGGGANELQPGYSTGVGLAAEIIGTFVLVYTVFSATDPKRNARDSHVPVLAPLPIGFAVFMVHLATIPVTGTGINPARSLGSAVIYNQKKAWDDHWIFWVGPFIGAAIAAFYHQFILRAGAVKALGSFRSSSHV

SEQ ID NO: 25481 - protein, 288 aa, Musa acuminata
MAKDEEAAAGHGEYAVKDYTDPPPAPLIDWEELTKWSLYRAAIAEFIATMLFLYVTVATVIGYKHQSDPNVNPTDAACSGVGILGIAWAFGGMIFILVYCTAGISGGHINPAVTFGLFLARKVSLIRALLYMIAQCLGAICGVGLVKGFQKAFFVRYGGGANELSDGYSKGTGLAAEIIGTFVLVYTVFSATDPKRSARDSHVPVLAPLPIGFAVFMVHLATIPITGTGINPARSFGAAVIYNKDKAWDDQWIFWVGPLIGAAIAAAYHQYILRAGAVKALGSFRSNA

SEQ ID NO: 25482 - protein, 284 aa, Cannabis sativa
MTKDIEVTGTHKDYHDPPPAAFFDTAELGKWSFYRALIAEFVATLLFLYITVLTVIGYKSQIDPKAGGDQCGGVGILGIAWAFGGMIFVLVYCTAGISGGHINPAVTFGLLLARKVSLIRAVLYMVAQSLGAIAGVGLVKAFQSAYYVRYGGGANELADGYSTGVGLGAEIVGTFVLVYTVFSATDPKRVARDSHVPVLAPLPIGFAVFMVHLATIPVTGTGINPARSLGAAVIYNNEKAWDDHWMFWVGPFIGAAIAAFYHQFILRAGAAKALGSFRSGSHHV

SEQ ID NO: 25483 - protein, 285 aa, Chrysanthemum coronarium
MTKDMPEQEQGSFTAKDYHDPPPAKFFDSQELTKWSFYRALIAEFIATLLFLYITVLTVIGYKSQIANGNDACGGVGVLGIAWAFGGMIFILVYCTAGISGGHINPAVTFGLFLARKVSLPRAIMYMVAQCLGAICGVGLVKSFHKTYYNTFGGGANELADGYNKGTGLGAEIIGTFVLVYTVFSATDPKRSARDSHVPVLAPLPIGFAVFMVHLATIPITGTGINPARSFGAAVIYNKEKAWDDQWIFWVGPFIGAAIAAFYHQFILRAGAAKALGSFRSATHV

SEQ ID NO: 25484 - protein, 286 aa, Chrysanthemum coronarium
MTKDVPEQGSFSAKDYHDPPPAPLIDPAELTKWSFYRALIAEFIATLLFLYITVLTVIGYKSTTDPILKNVDPCGGVGILGIAWAFGGMIFVLVYCTAGISGGHINPAVTFGLFLARKVSLIRAFGYMVAQCLGAICGVGLVKAFNKSLYNRYGGGANSLADGYNKGTGLGAEIIGTFVLVYTVFSATDPKRSARDSHVPVLAPLPIGFAVFMVHLATIPITGTGINPARSLGAAVIYNNEKIWDDQWIFWVGPFIGAAIAAFYHQFILRAGAIKALGSFRSSTQV

SEQ ID NO: 25485 - protein, 285 aa, Chrysanthemum coronarium
MTKDVPEQGSFSAKDYHDPPPAPLFDPGELTKWSFYRALIAEFIATLLFLYITVLTVIGYKSTTDPLLKADPCGGVGILGIAWAFGGMIFVLVYCTAGISGGHINPAVTFGLFLARKVSLIRAFGYMVAQCLGAICGVGLVKAFNKSLYNRYGGGANSLADGYNKGTGLGAEIIGTFVLVYTVFSATDPKRSARDSHVPVLAPLPIGFAVFMVHLATIPITGTGINPARSLGAAVIYNKEKIWDDQWIFWVGPFIGAAIAAFYHQFILRAGAIKALGSFRSSTQV

SEQ ID NO: 25486 - protein, 285 aa, Cirsium arvense
MTKDVPEQGSFSAKDYHDPPPAPFIDPGELTKWSFYRAVIAEFVATLLFLYITVLTVIGYKAQTDPAKNLDQCGGVGILGIAWAFGGMIFVLVYCTAGISGGHINPAVTFGLFLARKVSLIRAFMYMVAQCLGAICGVGFVKLFHKTYYNNYGGGANELAAGYNKGTGLGAEIIGTFVLVYTVFSATDPKRSARDSHVPVLAPLPIGFAVFMVHLATIPITGTGINPARSLGAAVIYNKEKAWDDQWIFWVGPFIGAAIAAFYHQFILRAGAIKALGSFRSSSHV

SEQ ID NO: 25487 - protein, 287 aa, Cyclamen graecum
  Sequence also found in Organisms: Ananas comosus
MSKEVEVAEAGAEFSGKDYEDPPPAELIDLEEITKWSFYRAIIAEFVATLLFLYVTVLTVIGYKSQSDTNTPTGDICGGVGILGIAWAFGGMIFILVYCTAGISGGHINPAVTFGLFLARKVSLIRALLYMVAQCAGAICGVGLVKAFQKSYYNRYGGGANEVQLGYNKGTALGAEIIGTFVLVYTVFSATDPKRSARDSHVPVLAPLPIGFAVFMVHLATIPVTGTGINPARSFGAAVIYNEEKAWDDQWIFWVGPFIGAAVAAFYHQFILRAAAIKALGSFRSNS

SEQ ID NO: 25488 - protein, 286 aa, Humulus lupulus
MTKDLEVTERGSFSHKDYHDPPPAALFDTAELGKWSFYRALIAEFVATLLFLYITVLTVIGYKSQIDPKNNDPCGGVGILGIAWAFGGMIFVLVYCTAGISGGHINPAVTFGLLLARKVSLIRAVLYMVAQSLGAIAGVGLVKAFQSAFYVKYGGGANELAEGYSTGVGLGAEIVGTFVLVYTVFSATDPKRVARDSHVPVLAPLPIGFAVFMVHLATIPVTGTGINPARSLGAAVIYNNEKAWDDHWIFWVGPFIGAAIAAFYHQFILRAGAAKALGSFRSGSNV

SEQ ID NO: 25489 - protein, 290 aa, Panicum virgatum
MGKDDVIEGGAGGGEFAAKDYTDPPPAPLIDAAELGSWSLYRAMIAEFIATLLFLYITVATVIGYKHQTDAAASGADAACGGVGVLGIAWAFGGMIFVLVYCTAGISGGHINPAVTFGLFLARKVSLVRALLYMVAQCLGAICGVGLVKAFQSAYFDRYGGGANSLASGYSRGTGLGAEIIGTFVLVYTVFSATDPKRNARDSHVPVLAPLPIGFAVFMVHLATIPVTGTGINPARSLGAAVIYNKDKPWDDHWIFWVGPFVGAAIAAFYHQYILRAGAIKALGSFRSNA

SEQ ID NO: 25490 - protein, 285 aa, Amsonia hubrichtii
MAKDIAEHGSFTTKDYHDPPPAPLIDPAELTKWSFYRALIAEFIATLLFLYITVLTVIGYKSQTDADLHLDQCGGVGVLGIAWAFGGMIFVLVYCTAGISGGHINPAVTFGLLLARKVSLIRAVMYMVAQSLGAICGVGLVKAFQKAYFDRYGGGANELQKGYSIGVGLAAEIIGTFVLVYTVFSATDPKRSARDSHVPVLAPLPIGFAVFMVHLATIPVTGTGINPARSLGSAVIYNQKKAWDDHWIFWAGPFIGAAIAAFYHQFILRAGAVKALSSFRSGSHV

SEQ ID NO: 25491 - protein, 285 aa, Cocos nucifera
MRKDMEAGAEFTAKDYTDPPPAPLVDAEELTKWSLYRAVIAEFIATLLFLYITVATVIGYKHQSDPNVTGPDAACSGVGILGIAWAFGGMIFVLVYCTAGISGGHINPAVTFGLFLARKVSLIRALLYMIAQCLGAICGVGLVKAFQKAYYNRYGGGVNELSSGYSKGTGLAAEIIGTFVLVYTVFSATDPKRSARDSHVPVLAPLPIGFAVFMVHLGTIPITGTGINPARSFGPAVIYNNDKAWDDQWIFWVGPFIGAAIATAYHQYILRAGAVKALGSFRSNA

SEQ ID NO: 25492 - protein, 285 aa, Elaeis guineensis
MRKDMEAGAEFMAKDYTDPPPAPLVDAEELTKWSLYRAVIAEFIATLLFLYITVATVIGYKHQSDPNVSGPDAACDGVGILGIAWAFGGMIFVLVYCTAGISGGHINPAVTFGLFLARKVSLIRALLYMIAQCLGAICGVGLVKAFQKAYYNRYGGGVNELSSGYSKGTGLAAEIIGTFVLVYTVFSATDPKRSARDSHVPVLAPLPIGFAVFMVHLATIPITGTGINPARSLGPAVIYNNDKAWDDQWIFWVGPFIGAAIAAAYHQYILRAGAIKALGSFRSNA

SEQ ID NO: 25493 - protein, 284 aa, Centaurea maculosa
MTKDVEVAEQHHGAKDYHDPPPSPLFDADELTKWSFYRALIAEFVATLLFLYVTVLTVIGYKSQTDPLLNTDQCGGVGILGIAWAFGGMIFILVYCTAGISGGHINPAVTFGLFLARKVSLIRAVGYMVAQCLGAICGVGLVKAFQSSYYNRYGGGANTLADGYNKGTGLGAEIIGTFVLVYTVFSATDPKRSARDSHVPVLAPLPIGFAVFMVHLATIPITGTGINPARSFGAAVIFNDEKAWDDQWIFWVGPFIGAFAAAVYHQFVLRAAAIKALGSFRSNA

SEQ ID NO: 25494 - protein, 289 aa, Cichorium intybus
MTKDVEVAEHHGGGSEYAAKDYHDPPPAPLFDAEELTKWSFYRALIAEFVATLLFLYVTVLTVIGYKSQTDPALNLDQCGGVGILGIAWAFGGMIFILVYCTAGISGGHINPAVTFGLFLARKVSLIRAVGYMIAQCLGAICGVGLVKAFQSSYYDRYGGGANELADGYNKGTGLGAEIIGTFVLVYTVFSATDPKRSARDSHVPVLAPLPIGFAVFMVHLATIPITGTGINPARSFGAAVIYNKAKAWDDQWIFWVGPFIGAFAAAVYHQFVLRAAAIKALGSFRSNA

SEQ ID NO: 25495 - protein, 289 aa, Amaranthus tuberculatus
MTKDVEAVSEQPRSSEYSAKDYHDPPPTPFIDMEEFGKWSFYRAIIAEFVATLLFLYITVLTVIGYKSQTDTTAGGDDCGGVGILGIAWAFGGMIFILVYCTAGISGGHINPAVTFGLFLARKVSLPRAFLYMVAQCLGAICGVGLVKAFQKAYYVRYGGGVNQMSPGYNKGTGLGAEIIGTFVLVYTVFAATDPKRNARDSHVPVLAPLPIGFAVFMVHLATIPVTGTGINPARSFGAAVIFNHEKSWNEHWIFWVGPFVGAAIAAFYHQYILRAGAIKALGSFRSTA

SEQ ID NO: 25496 - protein, 284 aa, Ambrosia trifida
MTKDIEVSEHHHSGKDYHDPPPAPLFDAKELTKWSFYRALIAEFVATLLFLYVTVLTVIGYKSTTDPALGTDQCGGVGTLGIAWAFGGMIFILVYCTAGISGGHINPAVTFGLFLARKVSLIRAVSYMVAQCLGAICGVGLVKAFQSSYYNRYGGGANTLADGYNKGTGLGAEIIGTFVLVYTVFSATDPKRNARDSHVPVLAPLPIGFAVFMVHLATIPITGTGINPARSFGAAVIFNDEKAWDDHWLFWVGPFLGAAAAAFYHQFILRAAAAKALGSFRSNA

SEQ ID NO: 25497 - protein, 289 aa, Flaveria ramosissima
MTKDVEVAEHHGPGGEYSGKDYQDPPPAPFFDADELTKWSFYRALIAEFVATLLFLYVTVLTVIGYKSQTDPDLNTDQCGGVGILGIAWAFGGMIFILVYCTAGISGGHINPAVTFGLFLARKVSLIRALGYMVAQCLGAICGVGLVKAFQSSYYNRYGGGANELADGYNKGTGLGAEIIGTFVLVYTVFSATDPKRSARDSHVPVLAPLPIGFAVFMVHLATIPITGTGINPARSFGAAVIYNNEKAWDDQWIFWVGPFIGAFAAAVYHQFVLRAAAIKALGSFRSNA

SEQ ID NO: 25498 - protein, 280 aa, Conyza canadensis
MTKDVVAEQGSFSAKDYHDPPPAPLIDPAELTKWSFYRAIIAEFIATLLFLYITVLTVIGYKSTTDPALAADQCGGVGILGIAWAFGGMIFVLVYCTAGISGGHINPAVTFGLFLARKVSLIRAFMYMVAQGVGLVKALNKGLYNKYGGGANTLADGYNKGTGLGAEIIGTFVLVYTVFSATDPKRSARDSHVPVLAPLPIGFAVFMVHLATIPITGTGINPARSLGAAVIYNKDKAWDDQWIFCVGPFIGAAIAAFYHQFILRAGAVKALGSFRSSTHV

SEQ ID NO: 25499 - protein, 287 aa, Cicer arietinum
MAKNVEVAERGSFSNKDYHDPPPAPFIDAAELTKWSFYRALIAEFIATLLFLYVTVLTVIGYSIQTDIKAGGDVCGGVGILGIAWAFGGMIFVLVYCTAGISGGHINPAVTFGLFLARKVSLIRAIMYIVAQCLGAICGVGLVKAFQSAYFDRYGGGANFLHDGYSTGVGLGAEIVGTFVLVYTVFSATDPKRSARDSHVPVLAPLPIGFAVFMVHLATIPVTGTGINPARSLGSAVILNQDKPWDDHWIFWVGPFAGAAIAAFYHQFILRAGAVKALGSFRSNPTV

SEQ ID NO: 25500 - protein, 287 aa, Cleome gynandra
MTKDAAEHGSFSGKDYHDPPPAPLFDAAELGKWSFYRALIAEFIATLLFLYITVLTVIGYKSQTDVTLNAGADQCGGVGILGIAWAFGGMIFILVYCTAGISGGHINPAVTFGLFLARKVSLVRAVMYIVAQCLGAICGVGLVKSFQSSYYTRYGGGANSLADGYSVGVGVGAEIIGTFVLVYTVFSATDPKRNARDSHVPVLAPLPIGFAVFMVHLATIPITGTGINPARSLGAAVIYNHDKAWDDHWIFWVGPFAGAAIAAFYHQFVLRAAAAKALGSFRSQSHV

SEQ ID NO: 25501 - protein, 287 aa, Scabiosa columbaria
MTKDVETTHEHGEYAAKDYQDPPPAALFDADELTKWSFYRAIIAEFVATLLFLYITVATVIGYKSQTDPNKPGVDPCGGVGILGIAWAFGGMIFILVYCTAGISGGHINPAVTFGLFLARKVSLVRAVMYMIAQCLGAICGVGFVKAFQSSYYDRYGGGANELSAGYNKGTGLAAEIIGTFVLVYTVFSATDPKRNARDSHVPVLAPLPIGFAVFMVHLATIPITGTGINPARSFGAAVIYNKEKAWDDQWMFWVGPFIGAAIAAIYHQYILRAAALKALGSFRSNA

SEQ ID NO: 25502 - protein, 284 aa, Cucumis melo
MPKDIEAGGRGGFSGKDYEDPPPAPLIDAHEFAKWSFYRAIIAEFVATLLFLYVTVLTVIGYKVQSDVKNGGEICGGVGILGIAWAFGGMIFVLVYCTAGISGGHINPAVTFGLFLARKVSLVRAILYMAAQSLGAICGCALVKAFQNGHYTEYGGGANSLADGYSTGTGLAAEIIGTFVLVYTVFSATDPKRNARDSHVPVLAPLPIGFAVFMVHLATIPITGTGINPARSFGAAVVFNRSKPWDDQWIFWVGPFIGAAIAAIYHQFVLRAGAAKALGSFSSS

SEQ ID NO: 25503 - protein, 291 aa, Flaveria ramosissima
MTKDVPEQGSFSAKDYHDPPPAPLIDPEELSKWSFYRAVIAEFIATLLFLYITVLTVIGYKSTTDPALNADQCGGVGILGIAWAFGGMIFVLVYCTAGISGGHINPAVTFGLFLARKVSLIRAFMYMVAQCLGAICGVGLVKAFNKSLYNRYGGGANELADGYNKGTGLGAEIIGTFVLVYTVFSATDPKRSARDSHVPVLAPLPIGFAVFMVHLATIPITGTGINPARSLGAAVIYNNEKAWDDQWIFWVGPFVGAAIAAFYHQFILRAGAIKALGSFRSSSHVCRFVRL

SEQ ID NO: 25504 - protein, 286 aa, Humulus lupulus
MTKDVEVTEGGEFPAKDYHDPPPTPLFDADELTKWSFYRALIAEFIATLLFLYITVLTVIGYKSQTDPNLPNVDECGGVGILGIAWAFGGMIFILVYCTAGISGGHINPAVTFGLFLARKVSLLRAVLYMVAQCLGAICGVGLVKAFQSSYYNRYGGGANTMAAGYSKGVGLGAEIIGTFVLVYTVFSATDPKRNARDSHVPVLAPLPIGFAVFMVHLATIPITGTGINPARSFGAAVIFNSEKAWNEHWIFWVGPFIGAAIAAFYHQFVLRAAAIKALGSFRSNA

SEQ ID NO: 25505 - protein, 282 aa, Chrysanthemum coronarium
MTKDAAEHHGAKDYHDPPPAPLFDADELTKWSFYRALIAEFIATLLFLYVTVLTVIGYKSTTDPTLPGVDECGGVGILGIAWAFGGMIFVLVYCTAGISGGHINPAVTFGLFLARKVSLIRAVMYMLAQCLGAICGVGLVKAFQSSLYNRYGGGANTLADGYNKGTGLGAEIIGTFVLVYTVFSATDPKRSARDSHVPVLAPLPIGFAVFMVHLATIPITGTGINPARSFGAAVIYNDDKAWDDHWIFWVGPFLGAAAAAFYHQFVLRAGAIKALGSFRSNA

SEQ ID NO: 25506 - protein, 284 aa, Cirsium arvense
MTKDVEVAEQHHGAKDYHDPPPSPLFDADELTKWSFYRALIAEFVATLLFLYVTVLTVIGYKSQTDPLLNTDQCGGVGILGIAWAFGGMIFILVYCTAGISGGHINPAVTFGLFLARKVSLIRAVGYMIAQCLGAICGVGLVKAFQSSYYNRYGGGANTLADGYNKGTGLGAEIIGTFVLVYTVFSATDPKRSARDSHVPVLAPLPIGFAVFMVHLATIPITGTGINPARSFGAAVIFNDEKAWDDQWIFWVGPFIGAFAAAVYHQFVLRAAAIKALGSFRSNA

SEQ ID NO: 25507 - protein, 289 aa, Taraxacum officinale
MTKDVEVAEHHGGAGEYGAKDYHDPPPAPFFDAEELTKWSFYRALIAEFVATLLFLYITVLTVIGYKVQTDPALDTDQCGGVGILGIAWAFGGMIFILVYCTAGISGGHINPAVTFGLFLARKVSLIRAVGYMIAQCLGAICGVGLVKAFQSSYYDRYGGGANELADGYNKGTGLGAEIIGTFVLVYTVFSATDPKRSARDSHVPVLAPLPIGFAVFMVHLATIPITGTGINPARSFGAAVIYNKAKAWDDQWIFWVGPFIGAFAAAVYHQFVLRAAAIKALGSFRSNA

SEQ ID NO: 25508 - protein, 288 aa, Echinochloa colona
MAKDIEASGPEAGEFSAKDYTDPPPAPLIDAEELTKWSLYRAVIAEFIATLLFLYITVATVIGYKHQSDPAASGADAACGGVGILGIAWAFGGMIFILVYCTAGISGGHINPAVTFGLFLARKVSLVRAVLYIIAQCLGGICGVGLVKGFQSAYYVRYGGGANELSAGYSKGTGLAAEIIGTFVLVYTVFSATDPKRNARDSHVPVLAPLPIGFAVFMVHLATIPVTGTGINPARSLGAAVVYNNNKAWSDQWIFWVGPFIGAAIAALYHQIVLRASARGYGSFRSNA

SEQ ID NO: 25509 - protein, 286 aa, Petunia hybrida
MAKNVGSEGSFTTKDYQDPPPAPLIDPAELTQWSFYRALIAEFIATLLFLYITVLTVIGYKSESDPAKNADPCSGVGILGIAWAFGGMIFILVYCTAGISGGHINPAVTFGLFLARKVSLIRAVMYMVAQCLGAICGVGLVKAFQSAYYHRYDGGANMLSDGYSKSVGLSAEIIGTFVLVYTVFSATDPKRNARDSHVPVLAPLPIGFAVFMVHLATIPITGTGINPARSLGAAVIFNQDKAWKDHWIFWVGPFIGAAIAAFYHQFILRAGAAKALGSFRSSTSQA

SEQ ID NO: 25510 - protein, 287 aa, Festuca arundinacea
  Sequence also found in Organisms: Lolium multiflorum
MAKDEVVESGGDFAAKDYTDPPPAPLIDAAELASWSLYRAVIAEFIATLLFLYITVATVIGYKHQTDVSVNGTDAPCGGVGILGIAWAFGGMIFVLVYCTAGISGGHINPAVTFGLFLARKVSLVRALLYMIAQCLGAMCGVGLVKAFQSAYFQRYGGGANTLAAGYSKGTGLAAEIIGTFVLVYTVFSATDPKRSARDSHVPVLAPLPIGFAVFMVHLATIPITGTGINPARSLGAATIYNNEKAWDDQWIFWVGPMVGAAIAAFYHQYILRAGAIKALGSFRSNA

SEQ ID NO: 25511 - protein, 287 aa, Chrysanthemum coronarium
MTKDVEVAEHHGGEYTSKDYHDPPPAPFFDAEELTKWSFYRALIAEFVATLLFLYVTVLTVIGYKSQTDPKLNLDQCGGVGILGIAWAFGGMIFILVYCTAGISGGHINPAVTFGLFVARKVSLIRALGYMIAQCLGAICGVGLVKAFQSSYYNRYGGGANTLADGYNKGTGLGAEIIGTFVLVYTVFSATDPKRSARDSHVPVLAPLPIGFAVFMVHLATIPITGTGINPARSFGAAVIFNDDKAWDDQWIFWVGPFIGAFAAALYHQFVLRAAAIKALGSFRSNA

SEQ ID NO: 25512 - protein, 287 aa, Chrysanthemum coronarium
MTKDVEVAEHHGGEYTSKDYHDPPPAPFFDAEELTKWSFYRALIAEFVATLLFLYVTVLTVIGYKSQTDPTLNLDQCGGVGILGIAWAFGGMIFILVYCTAGISGGHINPAVTFGLFVARKVSLIRALGYMIAQCLGAICGVGLVKAFQSSYYNRYGGGANTLADGYNKGTGLGAEIIGTFVLVYTVFSATDPKRSARDSHVPVLAPLPIGFAVFMVHLATIPITGTGINPARSFGAAVIFNDDKAWDDQWIFWVGPFIGAFAAALYHQFVLRAAAIKALGSFRSNA

SEQ ID NO: 25513 - protein, 287 aa, Cucumis sativus
MPKDIEAGAHGGFSGKDYEDPPPAPLIDPHEFAQWSFYRAIIAEFVATLLFLYVTVLTVIGYKVQSDVKNGGETCGGVGILGIAWAFGGMIFVLVYCTAGISGGHINPAVTFGLFLARKVSLVRAILYMAAQSLGAICGCALVKAFQNAHYTEYGGGANSLADGYSTGTGLAAEIIGTFVLVYTVFSATDPKRNARDSHVPVLAPLPIGFAVFMVHLATIPITGTGINPARSFGAAVIFNKDKPWDDQWIFWVGPFIGAAIAAIYHQVVLRAGAVKALGSFRSSTAV

SEQ ID NO: 25514 - protein, 272 aa, Lippia dulcis
MTKDQVSEHGSYGAKDYHDPPPAPLFDGEELTKWSFYRALIAEFIATLLFLYITVCTVIGYKSQTVTDECGGVGILGIAWAFGGMIFILVYCTAGISGGHINPAVTFGLFLARKVSLVRAVMYMVAQCLGAICGVGLVKAFQSSYYKRFDGGINGLSDGYSTGVGLAAEIIGTFVLVYTVFSATDPKRSARDSHVPVLAPLPIGFAVFMVHLATIPITGTGINPARSLGAAVILNNDKAWDKHWIFWVGPFIGAAIAAFYHQFILRAGAVKA

SEQ ID NO: 25515 - protein, 285 aa, Arabidopsis lyrata
MAKDDDVQEGGAPAARDYRDPPPAPLLDMEEIRKWSLYRAVIAEFVATLLFLYVSVLTVIGYKAQTDATAGGVDCGGVGILGIAWAFGGMIFVLVYCTAGISGGHINPAVTVGLFLARKVSLVRTVLYIVAQCLGAICGCGLVKAFQSSYYTRYGGGANELADGYNKGTGLGAEIIGTFVLVYTVFSATDPKRSARDSHVPVLAPLPIGFAVFMVHLATIPITGTGINPARSFGAAVIYNNEKAWDDQWIFWVGPMIGAAAAAFYHQFILRAAAIKALGSFRSFA

SEQ ID NO: 25516 - protein, 296 aa, Chrysanthemum coronarium
MSKDVEVGGHDHYGAKDYQDPPPSPLFDSEELTKWSFYRAIIAEFIATMLFLYITVLTVIGYKSQVDPTHSTDQCGGVGILGIAWAFGGMIFVLVYCTAGISGGHINPAVTFGLFLARKVTLPRAFMYIVAQCLGAICGCGLVKAFQKTYYHTYGGGANELADGYSKGTGLGAEIIGTFVLVYTVFSATDPKRNARDSHVPVLAPLPIGFAVFMVHLATIPITGTGINPARSFGAAVMYGKEKAWDDQWLFWVGPMIGAAIAAFYHQYVLRAGAVKGCEIFQEQCLDQEHEICKCI

SEQ ID NO: 25517 - protein, 290 aa, Flaveria ramosissima
SSSSFTTNDKDVEVAEHHSGKDYHDPPPAPLIDSDELTKWSFYRAVIAEFIATLLFLYVTVLTVIGYKSQTDPNLNTDQCGGVGILGIAWAFGGMIFILVYCTAGISGGHINPAVTFGLFLARKVSLIRALLYMVAQCLGAICGVGLVKAFQSSYYNRYGGGANELADGYNKGTGLGAEIIGTFVLVYTVFSATDPKRSARDSHVPVLAPLPIGFAVFMVHLATIPITGTGINPARSFGAAVIYNNEKAWDDQWIFWVGPFVGAAAAAFYHQFVLRAAAIKALGSFRSNA

SEQ ID NO: 25518 - protein, 285 aa, Gossypium raimondii
MAKDIEVGGEFQAKDYHDPPPAPLVDAQELAKWSFYRAVIAEFIATLLFLYITVLTVIGYKTQTDPAKGGEDCGGVGILGIAWAFGGMIFILVYCTAGISGGHINPAVTFGLFLARKVSLVRAIFYMGAQCLGAICGCGLVKAFQNSYYNQYGGGANSLAEGYSTGTGLAAEIIGTFVLVYTVFSATDPKRNARDSHIPVLAPLPIGFAVFMVHLATIPITGTGINPARSLGAAVIFNQDKIWDDHWIFWVGPFIGAAIAAIYHQFVLRASGAKALGSFRSSSAM

SEQ ID NO: 25519 - protein, 289 aa, Amaranthus tuberculatus
MTKDVEAVTEQSAQPEFSAKDYHDPPPAPLIDLEELTKWSFYRAIIAEFVATLLFLYITILTVIGYKSQTDTTAGGDDCGGVGILGIAWAFGGMIFILVYCTAGISGGHINPAVTFGLFLARKVSLPRAFLYMVAQCLGAICGVGLVKGFQKAYYVRYGGGVNQMSPGYNKGTGLGAEIIGTFVLVYTVFAATDPKRSARDSHVPVLAPLPIGFAVFMVHLATIPITGTGINPARSFGAAVIYNHEKSWHEHWIFWVGPFVGAAIAAFYHQYILRAAAIKALGSFRSTA

SEQ ID NO: 25520 - protein, 278 aa, Ambrosia trifida
VAPEHHSGKDYHDPPPAPLFDAKELTKWSFYRALIAEFVATLLFLYVTVLTVIGHKSTTDPALDADQCGGVGILGIAWAFGGMIFILVYCTAGISGGHINPAVTFGLFLARKVSLIRAVSYMVAQCLGAICGVGLVKAFQSSYYNRYGGGANTLSDGYNKGTGLGAEIIGTFVLVYTVFSATDPKRNARDSHVPVLAPLPIGFAVFMVHLATIPITGTGINPARSFGAAVIYNDDKAWDDHWLFWVGPFLGAAAAAFYHQFILRAAAVKALGSFRSNA

SEQ ID NO: 25521 - protein, 283 aa, Brassica oleracea
MAKDLEVQEGRAARDYQDPPPAPLFDMEELGKWSLYRAVIAEFVATLLFLYVSILTVIGYKAQTDASAGGADCGGVGILGIAWAFGGMIFVLVYCTAGISGGHINPAVTFGLFLARKVSLVRTVLYIVAQCLGAICGCGLVKAFQSSYYNRYGGGANQLADGYNKGTGLGAEIIGTFVLVYTVFSATDPKRSARDSHIPVLAPLPIGFAVFMVHLATIPITGTGINPARSFGAAVIYNQEKAWDDQWIFWVGPMIGAAAAALYHQFVLRAAGIKSLGSFRSSA

SEQ ID NO: 25522 - protein, 282 aa, Chrysanthemum coronarium
MTKDAAEHHGAKDYHDPPPAPLFDADELTKWSFYRALIAEFIATLLFLYVTVLTVIGYKSTTDPTLPGVDECGGVGILGIAWAFGGMIFVLVYCTAGISGGHINPAVTFGLFLARKVSLIRAVMYMLAQCLGAICGVGLVKAFQSSLYNRYGGGANTLADGYNKGTGLGAEIIGTFVLVYTVFSATDPKRSARDSHVPVLAPLPIGFAVFMVHLATIPITGTGINPARSFGAAVIYNNDKAWDDHWMFWVGPFLGAAAAAFYHQFVLRAGAIKALGSFRSNA

SEQ ID NO: 25523 - protein, 271 aa, Flaveria ramosissima
MTKDVPEQGSFSAKDYHDPPPAPLIDPEELSKWSFYRAIIAEFIATLLFLYITVLTVIGYKSTTDPALNADQCGGVGILGIAWAFGGMIFVLVYCTAGISGGHINPAVTFGLFLARKVSLIRAFMYMVAQCLGAICGVGLVKAFNKSLYNRYGGGANELADGYNKGTGLGAEIIGTFVLVYTVFSATDPKRSARDSHVPVLAPLPIGFAVFMVHLATIPITGTGINPARSLGAAVIYNNEKAWDDQWIFWVGPFVGAAIAAFYHQFILRAG

SEQ ID NO: 25524 - protein, 284 aa, Linum usitatissimum
MTKEGVVAERGSFSAKDYHDPPPAPFFGAAELGKWSFYRALIAEFIATLLFLYITVLTVIGYKFQSDGDACGGVGILGIAWAFGGMIFVLVYCTAGISGGHINPAVTFGLFLARKVSLIRAVMYMVAQCLGAICGVGLVKAFQKSHYTRYGGGANSLSTDYSTGTGVGAEIIGTFVLVYTVFSATDPKRSARDSHVPVLAPLPIGFAVFMVHLATIPITGTGINPARSFGAAVIFNESKPWDDHWIFWVGPFAGAALAAFFHQFILRAGAVKALGSFRSSASAV

SEQ ID NO: 25525 - protein, 287 aa, Brassica juncea
MAKDVEAVSGEGFQTRDYQDPPPAPLFDPEELTKWSFYRAVIAEFVATLLFLYITVLTVIGYKIQTDSTAGGVDCGGVGILGIAWAFGGMIFILVYCTAGISGGHINPAVTFGLLLARKVSLVRAILYMVAQCLGAICGVGFVKAFQSSYYVRYGGGANSLAEGYSTGTGLAAEIIGTFVLVYTVFSATDPKRSARDSHVPVLAPLPIGFAVFMVHLATIPITGTGINPARSFGAAVIFNESKPWDDHWIFWVGPFVGAAIAAFYHQFVLRASGSKSLGSFRSAANV

SEQ ID NO: 25526 - protein, 287 aa, Artemisia annua
MTKDTPEQEQEQGSFTAKDYHDPPPAKFFDSKELTKWSFYRALIAEFIATLLFLYITVLTVIGYKSQIANGNDACGGVGILGIAWAFGGMIFVLVYCTAGISGGHINPAVTFGLFLARKVSLPRAIMYMVAQCLGAICGVGLVKSFHKTYYNTYGGGANELADGYNKGTGLGAEIIGTFVLVYTVFSATDPKRNARDSYVPVLAPLPIGFAVFMVHLATIPITGTGINPARSFGAAVIYNKEKAWDDQWIFWVGPFIGAAIAAFYHQFILRAGAAKALGSFRSATHI

SEQ ID NO: 25527 - protein, 288 aa, Catharanthus roseus
MAKESGVAEHGSFTTKDYHDPPPAALIDPEELTKWSFYRALIAEFIATLLFLYITVLTVIGHKRQTDPDLANFDPCNGVGILGISWAFGGMIFVLVYCTAGISGGHINPAVTFGLFLARKVSLIRAVMYMVAQCLGAICGVGLVKAFQKSYFHKYGGGANELQAGHSVGVGLAAEIIGTFVLVYTVFSATDPKRNARDSHVPVLAPLPIGFAVFMVHLATIPVTGTGINPARSLGSAVIYNDSKAWDDHWIFWVGPFIGAAIAAFYHQFILRAGAVKALGSFRSSSHV

SEQ ID NO: 25528 - protein, 286 aa, Echinacea purpurea
MTKDVPEEQGSYSAKDYQDPPPAPLVDPVELTKWSFYRALIAEFIATLLFLYITVLTVIGYKSSTDPALDADQCGGVGILGIAWAFGGMIFILVYCTAGISGGHINPAVTFGLFLARKVSLFRAVGYIVAQCLGAICGVGLVKAFNKSLYNRYGGGANELADGYNTGTGLGAEIIGTFVLVYTVFSATDPKRSARDSHVPILAPLPIGFAVFMVHLATIPITGTGINPARSLGAAVIYNKAKAWDDQWIFWVGPLIGATIAAFYHQFVLRAGGYKALESYRSSTHV

SEQ ID NO: 25529 - protein, 287 aa, Vicia sativa
MAKDIEVAERGSFSNKDYHDPPPAPLIDAEELTKWSFYRALIAEFIATLLFLYVTVLTVIGYSIQTDVKAGGDECGGVGILGIAWAFGGMIFVLVYCTAGISGGHINPAVTFGLLLARKVSLVRAVMYMVAQSLGAICGVGLVKAFQSAYFVRYGGGANFLHDGYSTSVGIGAEIVGTFVLVYTVFSATDPKRSARDSHVPVLAPLPIGFAVFMVHLATIPVTGTGINPARSLGSAVILNEEKIWNDHWIFWVGPFVGAAIAAFYHQFILRAGAAKALGSFRSSNAN

SEQ ID NO: 25530 - protein, 285 aa, Raphanus sativus
MAKDVEGAEGFAARDYQDPPPTPFFDAEELTKWSSYRAVIAEFVATLLFLYATVLTVIGYKISSDTKAGGDECGGVGILGISWAFGGMIFILVYCTAGISGGHINPAVTFGLFLARKVSLVRAVLYMVAQCLGAICGVGFVKAFQSSHYVRYGGGANSLADGYSTGTGLAAEIIGTFVLVYTVFSATDPKRNARDSHVPVLAPLPIGFAVFMVHLATIPITGTGINPARSFGAAVIYNESKPWDDHWIFWVGPFIGAAIAAFYHQFVLRASGSKSLGSFRSAANV

SEQ ID NO: 25531 - protein, 284 aa, Helianthus annuus
MTKDDSGSSPAKDYHDPPSVPLMDPHELTKWSFYRALIAEFIATFLFLYITVLTVIGYKSTTDPAALNADQCGGVGILGIAWAFGGMIFVLVYCTAGISGGHINPAVTFGLFLARKVSLIRAIMYMVAQCLGAICGVGLVKAFNKSLYNRYGGGANELAAGYSKGTGLGAEIIGTFVLVYTVFSATDPKRSARDSHIPVLAPLPIGFAVFMVHLATIPITGTGINPARSLGAAVIYGKEKAWDDQWIFWVGPLVGATIAAFYHQFILRAGAVKAFASFRSSTHV

SEQ ID NO: 25532 - protein, 285 aa, Brassica juncea
MAKEVEGAEGFAARDYEDPPPTPFFDAEELTKWSLYRAVIAEFVATLLFLYVTVLTVIGYKISSDTKAGGDECGGVGILGISWAFGGMIFILVYCTAGISGGHINPAVTFGLFLARKVSLVRAVLYMVAQCLGAICGVGFVKAFQSAYYVRYGGGANSLADGYSTGTGLAAEIIGTFVLVYTVFSATDPKRNARDSHVPVLAPLPIGFAVFMVHLATIPITGTGINPARSFGAAVIYNESKPWDDHWIFWVGPFIGAAIAAFYHQFVLRASGSKSLGSFRSAASV

SEQ ID NO: 25533 - protein, 286 aa, Quercus alba
MTKDVAEHGSFPAKDYHDPPPAPLFDPVELTKWSFYRALIAEFVATLLFLYVTVLTVIGYKSQIDPALKGDACGGVGILGIAWAFGGMIFVLVYCTAGISGGHINPAVTFGLFLARKVSLIRAVLYMVAQCLGAICGVALVKAFQSAYYVKYGGGANSLSDGYSTGVGLGAEIVGTFVLVYTVFSATDPKRKARDSHVPVLAPLPIGFAVFIVHLATIPVTGTGINPARSLGAAVIYNNDTAWKDHWLFWVGPFIGAALAAFYHQFILRAGAAKALGSFRSNSSHV

SEQ ID NO: 25534 - protein, 285 aa, Cajanus cajan
MAKDVEVQEQGEYSSKDYQDPPPAPLIDPEELTKWSFWRALIAEFIATLLFLYITVLTIIGYKSQTDPSKKGTECDGVGILGIAWSFGGMIFILVYCTAGISGGHINPAVTFGLFLGRKVSLIRALLYMVAQCAGAICGAGLAKGFQTAYYDRYGGGANSVADGYNKGTALGAEIIGTFVLVYTVFSATDPKRNARDSHVPVLAPLPIGFAVFMVHLATIPITGTGINPARSFGAAVIYNEDKIWDDQWIFWVGPIVGAAVAAFYHQYILRAAAIKALGSFRSNA

SEQ ID NO: 25535 - protein, 285 aa, Cajanus cajan
MAKDMEGEGHVGLAHKDYQDPPPAPFFDPAELRKWSFYRALIAEFVATLLFLYITILTVIGYNHQTDSTADLCNGVGILGIAWAFGGMIFVLVYCTAGISGGHINPAVTFGLFLARKVSLVRAVAYMVAQCLGAISGVGLVKGFQSSYYNRYKGGANTLSHGYSKGTGLGAEIIGTFLLVYTVFSATDPKRKARDSHVPVLAPLPIGFAVFMVHLATIPITGTGINPARSLGPAVIYNNQKAWDDQWIFWVGPFIGAAIAAIYHQYVLRAHAVKALGSFRSSTNL

SEQ ID NO: 25536 - protein, 290 aa, Secale cereale
MAKDEVTETGGGGDFAAKDYTDPPPAPLIDAAELASWSLYRAVIAEFIATLLFLYITVATVIGYKHQTDPAVNSAADAACGGVGVLGIAWAFGGMIFVLVYCTAGISGGHINPAVTFGLFLARKVSLVRALLYMIAQCLGAMCGVGLVKAFQSAYFVRYGGGANTLAAGYSKGTGLAAEIIGTFVLVYTVFSATDPKRSARDSHVPVLAPLPIGFAVFMVHLATIPITGTGINPARSLGAAVIYNKEKAWDDQWIFWVGPMIGAAIAALYHQYILRAGAIKALGSFRSNA

SEQ ID NO: 25537 - protein, 290 aa, Amorphophallus konjac
MGKEVEEHHGGEFTAKDYTDPPPAPLIDPDELGKWSFYRALIAEFIATLLFLYVTVLTVIGHKSSTDPDKVSPDAANCGGVGILGIAWAFGGMIFILVYCTAGISGGHINPAVTFGLFLARKVSLVRAVLYMVAQCLGAICGVGLVKGFQKAYYNRYGGGANFLADGYSKGTGLAAEIIGTFVLVYTVFAATDPKRNARDSHVPVLAPLPIGFAVFMVHLATIPITGTGINPARSFGAAVIYNKSKPWDDHWIFWVGPFLGAAIAAAYHQYVLRAGAIKALGSYRSNPHV

SEQ ID NO: 25538 - protein, 289 aa, Cirsium arvense
MTKDPVTEPEQEPPSGKDYHDPPPVAFVDPTELTKWSFYRALIAEFIATLLFLYITVLTVIGYKSQTDMDKPGADACGGVGILGIAWAFGGMIFVLVYCTAGISGGHINPAVTFGLFLARKVSLFRAILYMVAQCLGAICGVGLVKAFHKTYYNDYGGGANELAEGYNKGTGLGAEIIGTFVLVYTVFSATDPKRNARDSHIPVLAPLPIGFAVFMVHLATIPITGTGINPARSFGAAVIYNKEKAWDDQWIFWVGPFIGAAIAAFYHEFVLKAGAVKALGSFRSSTHV

SEQ ID NO: 25539 - protein, 290 aa, Linum usitatissimum
MAKDVEAADKPAAEFSAKDYHDPPPAPIFDLEELTRWSFYRALIAEFIATLLFLYITVLTVIGYKSQTDPLTNKASDAACGGVGVLGIAWAFGGMIFILVYCTAGISGGHINPAVTFGLFLGRKVSLIRALGYMMAQCLGAICGCGLVKGFQKAYYVRYGGGANELASGYNKGTGLGAEIIGTFVLVYTVFSATDPKRSARDSHVPVLAPLPIGFAVFMVHLATIPITGTGINPARSFGAAVIYNQDKAWDDQWIFWVGPFIGAAIAALYHQYILRAAAIKALGSFRSNA

SEQ ID NO: 25540 - protein, 288 aa, Chrysanthemum coronarium
MTKDVEVAEHHGGEYGAKDYHDPPPAPFFDAEELTKWSFYRALIAEFVATLLFLYVTVLTVIGYKSTTDPNIPDVDQCGGVGILGIAWAFGGMIFVLVYCTAGISGGHINPAVTFGLFVARKVSLIRAVGYMIAQCLGAICGVGLVKAFQSSHYNRYGGGANTLADGYNKGTGLGAEIIGTFVLVYTVFSATDPKRSARDSHVPVLAPLPIGFAVFMVHLATIPITGTGINPARSFGAAVILNDDKAWDDQWIFWVGPFIGAFAAALYHQFVLRAAAIKALGSFRSNA

SEQ ID NO: 25541 - protein, 283 aa, Chrysanthemum coronarium
MTKDVEVAEHHGGKDYVEPPPAPLFDADELTKWSFYRALIAEFVATLLFLYVTVLTVIGYKSSTDPLLDLDQCGGVGILGIAWAFGGMIFVLVYCTAGISGGHINPAVTFGLFVARKVSLIRAVGYMIAQCLGAICGVGLVKAFQSSHYNRYGGGANTLADGYNKGTGLGAEIIGTFVLVYTVFSATDPKRSARDSHVPVLAPLPIGFAVFMVHLATIPITGTGINPARSFGAAVILNDDKAWDDQWIFWVGPFIGALAAALYHQFVLRAAAIKALGSFRSNA

SEQ ID NO: 25542 - protein, 288 aa, Chrysanthemum coronarium
MTKDVEVAEHHGGEYGAKDYHDPPPAPFFDAEELTKWSFYRALIAEFVATLLFLYVTVLTVIGYKSTTDPNIPDVDQCGGVGILGIAWAFGGMIFVLVYCTAGISGGHINPAVTFGLFVARKVSLIRAVGYMIAQCLGAICGVGLVKAFQSSHYNRYGGGANTLADGYNKGTGLGAEIIGTFVLVYTVFSATDPKRSARDSHVPVLAPLPIGFAVFMVHLATIPITGTGINPARSFGAAVILNDDKAWDDQWIFWVGPFIGALAAALYHQFVLRAAAIKALGSFRSNA

SEQ ID NO: 25543 - protein, 282 aa, Cyclamen graecum
  Sequence also found in Organisms: Ananas comosus
MAKGADVPESGFSGKDYQDPPPAPFIDPGELTKWSFFRALIAEFIATLLFLYIGTTTVIGYSSQSEHDMCGGVGILGIAWAFGGMIFVLVYCTAGISGGHINPAVTFGLFLARKVSLIRAVGYMVAQCGGAICGVGLAKSFQKSYFNTFGGGANFLQDGYSKGTGLGAEIIGTFVLVYTVFSATDPKRSARDSHVPVLAPLPIGFAVFLIHLATIPITGTGINPARSFGAAVIINRENIWDDQWIFWVGPFIGAAIAAFYHQFILRAGAVKALGSFRSSSHA

SEQ ID NO: 25544 - protein, 283 aa, Nicotiana benthamiana
MGKDVEAATEFSAKDYTDPPPAPLIDFEELKQWSFYRAAIAEFIATLLFLYVTVLTVIGYKHQSDVDANGDVCGGVGILGIAWAFGGMIFVLVYCTAGISGGHINPAVTFGLFLARKVSLIRALVYMVAQCLGAICGVGFVKAFQSAYYDRYGGGANQMAPGHTKGVGLAAEIIGTFVLVYVVFSATDPKRSARDSHVPVLAPLPIGFAVFMVHLATIPITGTGINPARSFGAAVIYNQDKAWDEHWIFWVGPFIGAFAAAAYHQYILRAGAAKALGSFRSNA

SEQ ID NO: 25545 - protein, 282 aa, Ananas comosus
MAKGADVPESGFSGKDYQDPPPAPFIDPGELTKWSFFRALIAEFIATLLFLYIGTTTVIGYSSQSEHDMCGGVGILGIAWAFGGMIFVLVYCTAGISGGHINPAVTFGLFLARKVSLIRAVGYMVAQCGGAICGVGLAKSFQKSYFNTFGGGANFLQDGYSKGTGLGAEIIGTFVLVYTVFSATDPKRSARDSHVPVLAPLPIGFAVFLIHLATIPITGTGINPARSFGAAVIINREKIWDDQWIFWVGPFIGAAIAAFYHQFILRAAAVKALGSFRSGSRV

SEQ ID NO: 25546 - protein, 285 aa, Brassica oleracea
MAKDAEGAEGFAARDYQDPPPTPFFDAEELTRWSLYRAVIAEFVATLLFLYVTVLTVIGYKISSDTAAGGVECGGVGILGIAWAFGGMIFILVYCTAGISGGHINPAVTFGLFLARKVSLIRAVLYMVAQCLGAICGVGFVKAFQSSYYVRYGGGANSLADGYSTGTGLAAEIIGTFVLVYTVFSATDPKRNARDSHVPVLAPLPIGFAVFMVHLATIPITGTGINPARSFGAAVIYNESKPWDDHWIFWVGPFIGAAIAAFYHQFVLRASGSKSLGSFRSAANV

SEQ ID NO: 25547 - protein, 287 aa, Arabidopsis lyrata
MAKDVEAVPGEGFQTRDYHDPPPAPFIDGAELKKWSFYRAVIAEFVATLLFLYITVLTVIGYKIQSDTTAGGVDCGGVGILGIAWAFGGMIFILVYCTAGISGGHINPAVTFGLFLARKVSLPRAILYIVAQCLGAICGVGFVKAFQSSYYDRYGGGANSLADGYSTGTGLAAEIIGTFVLVYTVFSATDPKRSARDSHVPVLAPLPIGFAVFMVHLATIPITGTGINPARSFGAAVIFNKSKPWDDHWIFWVGPFIGAAIAAFYHQFVLRASGSKSLGSFRSAANV

SEQ ID NO: 25548 - protein, 285 aa, Brassica juncea
MAKEVEGAEGFAARDYEDPPPTPFFDAEELTKWSLYRAVIAEFVATLLFLYVTVLTVIGYKISSDTKAGGDECGGVGILGISWAFGGMIFILVYCTAGISGGHINPAVTFGLFLARKVSLVRAVLYMVAQCLGAICGVGFVKAFQSSYYVRYGGGANSLADGYSTGTGLAAEIIGTFVLVYTVFSATDPKRNARDSHVPVLAPLPIGFAVFMVHLATIPITGTGINPARSFGAAVIYNESKPWDDHWIFWVGPFIGAAIAAFYHQFVLRASGSKSLGSFRSAANV

SEQ ID NO: 25549 - protein, 287 aa, Brassica oleracea
MAKDVEAVAGEGFQSRDYQDPPPAPLFDPEELTKWSFYRAVIAEFVATLLFLYITVLTVIGYKIQTDSTAGGVDCGGVGILGIAWAFGGMIFILVYCTAGISGGHINPAVTFGLLLARKVSLVRAILYMVAQCLGAICGVGFVKAFQSSYYVRYGGGANSLADGYSTGTGLAAEIIGTFVLVYTVFSATDPKRSARDSHVPVLAPLPIGFAVFMVHLATIPITGTGINPARSLGAAVIFNESKPWDDHWIFWLGPFIGAAIAAVYHQFVLRASGSKSLGSFRSAANV

SEQ ID NO: 25550 - protein, 285 aa, Brassica napus
MAKDVEGAEGFAARDYEDPPPTPFFDAEELTKWSLYRAVIAEFVATLLFLYVTVLTVIGYKISSDTKAGGDECGGVGILGISWAFGGMIFILVYCTAGISGGHINPAVTFGLFLARKVSLVRAVLYMVAQCLGAICGVGFVKAFQSAYYVRYGGGANSLADGYSTGTGLAAEIIGTFVLVYTVFSATDPKRNARDSHVPVLAPLPIGFAVFMVHLATIPITGTGINPARSFGAAVIFNESKPWNDHWIFWVGPFIGAAIAAFYHQFVLRASGSKSLGSFRSAANV

SEQ ID NO: 25551 - protein, 291 aa, Gossypium raimondii
MTKDIETTAEQGGGAEFSAKDYQDPPPAPLIDLEELTKWSLYRAAIAEFIATLLFLYVTVLTVIGYKVQTDPVKNTIDPDCGGVGILGIAWAFGGMIFILVYCTAGISGGHINPAVTFGLFVGRKVSLIRALLYMVAQCLGAICGCGLVKAFQKTYYNSYGGGANELQDGFNKGTGLGAEIIGTFVLVYTVFSATDPKRSARDSHVPVLAPLPIGFAVFMVHLATIPITGTGINPARSFGAAVIYNQEKAWDDQWIFWVGPFIGAFVAAFYHQYILRAAAIKALGSFRSNA

SEQ ID NO: 25552 - protein, 286 aa, Quercus alba
MTKDVAEHGSFPAKDYHDPPPAPLFDPVELTKWSFYRALIAEFVATLLFLYVTVLTVIGYKSQIDPALKGDACGGVGYLGIAWAFGGMIFVLVYCTAGISGGHINPAVTFGLFLARKVSLIRAVLYMVAQCLGAICGVALVKAFQSAYYVKYGGGANSLSDGYSTGVGLGAEIVGTFVLVYTVFSATDPKRKARDSHVPVLAPLPIGFAVFIVHLATIPVTGTGINPARSLGAAVIYNNDTAWKDHWLFWVGPFIGAALAAFYHQFILRAGAAKALGSFRSNSSHV

SEQ ID NO: 25553 - protein, 286 aa, Quercus alba
MTKDVAEHGSFPAKDYHDPPPAPLFDPVELTKWSFYRALIAEFVATLLFLYVTVLTVIGYKSQIDPALKGDACGGVGILGIAWAFGGMIFVLVYCTAGISGGHINPAVTFGLFLARKVSLIRAVLYMVAQCSGAICGVALVKAFQSAYYVKYGGGANSLSDGYSTGVGLGAEIVGTFVLVYTVFSATDPKRKARDSHVPVLAPLPIGFAVFIVHLATIPVTGTGINPARSLGAAVIYNNDTAWKDHWLFWVGPFIGAALAAFYHQFILRAGAAKALGSFRSNSSHV

SEQ ID NO: 25554 - protein, 287 aa, Avena sativa
MAKGEVVESGGDFAAKDYTDPPPAPLIDAAELASWSLYRAVIAEFIATLLFLYITVATVIGYKHQADATVNGTDAACGGVGILGIAWAFGGMIFVLVYCTAGISGGHINPAVTFGLFLARKVSLVRALLYMIAQCLGAMCGVGLVKAFQSAYFHRYGGGANSLATGYSKGTGLAAEIIGTFVLVYTVFSATDPKRSARDSHVPVLAPLPIGFAVFMVHLATIPITGTGINPARSLGAAVIYNNDKAWDDQWMFWVGPMVGAAIAAFYHQYILRAGAIKALGSFRSNA

SEQ ID NO: 25555 - protein, 287 aa, Avena sativa
MAKDEVVESGGDFAAKDYTDPPPAPLIDAAELASWSLYRAVIAEFIATLLFLYITVATVIGYKHQTDATVNGTDAACGGVGILGIAWAFGGMIFVLVYCTAGISGGHINPAVTFGLFLARKVSLVRALLYMIAQCLGAMCGVGLVNAFQSAYFHRYGGGANSLAAGYSKGTGLAAEIIGTFVLVYTVFSATDPKRSARDSHVPVLAPLPIGFAVFMVHLATIPITGTGINPARSLGAAVIYNNDKAWDDQWMFWVGPMVGAAIAAFYHQYILRAGAIKALGSFRSNA

SEQ ID NO: 25556 - protein, 287 aa, Eutrema halophilum
MAKDVEAVPGEGFQTRDYQDPPPAPLFDPEELTKWSFYRAVIAEFVATLLFLYITVLTVIGYKIQSDTTAGGVDCGGVGILGIAWAFGGMIFILVYCTAGISGGHINPAVTFGLLLARKVSLVRAILYMVAQCLGAICGVGFVKAFQSSYYIRYGGGANSLAEGYSTGTGLAAEIIGTFVLVYTVFSATDPKRSARDSHVPVLAPLPIGFAVFMVHLATIPITGTGINPARSFGAAVIFNESKPWDDHWIFWVGPFIGAAIAAIYHQFVLRASGSKSLGSFRSAANV

SEQ ID NO: 25557 - protein, 285 aa, Eutrema halophilum
MAKDVEGAEGFPARDYEDPPPTPFFDAEELTKWSLYRAVIAEFVATLLFLYVTVLTVIGYKIQSDTTAGGVDCGGVGILGIAWAFGGMIFILVYCTAGISGGHINPAVTFGLFLARKVSLIRAVLYMVAQCLGAICGVGFVKAFQSSYYVRYGGGANSLAEGYSTGTGLAAEIIGTFVLVYTVFSATDPKRNARDSHVPVLAPLPIGFAVFMVHLATIPITGTGINPARSFGAAVIYNESKPWDDHWIFWVGPFIGAAIAAFYHQFVLRASGSKSLGSFRSAANV

SEQ ID NO: 25558 - protein, 287 aa, Trigonella foenum-graecum
MAKDIETEPQGGVPHKDYQDPPPAPLFDTAELRLWSFYRALIAEFVATLLFLYVTVLTVIGYNSQTDPAHNGTNCDGVGILGIAWAFGGMIFVLVYCTAGISGGHINPAVTFGLFLARKVSLIRAVLYMVAQCLGAICGVGLVKAFQKGYYNRYKGGANMLNDGYSKGTGLGAEIIGTFVLVYTVFSATDPKRSARDSHVPVLAPLPIGFAVFMVHLATIPITGTGINPARSFGAAVIYNNQKAWDDQWIFWVGPFIGAAIAAIYHQFVLRAQAAKALSSFRSSSNL

SEQ ID NO: 25559 - protein, 285 aa, Brassica rapa
MAKDLEVQEGGAMAARDYQDPPPAPLFDMEELGKWSLYRAVIAEFVATLLFLYVSILTVIGYKAQTDANAGGVDCGGVGILGIAWAFGGMIFVLVYCTAGISGGHINPAVTVGLFLARKVSLVRTVLYIVAQCLGAICGCGLVKAFQSSYYNRYGGGANQLADGYNKGTGLGAEIIGTFVLVYTVFSATDPKRSARDSHIPVLAPLPIGFAVFMVHLATIPITGTGINPARSFGAAVIYNQEKAWDDQWIFWVGPMIGAAAAALYHQFVLRAAGIKSLGSFRSSA

SEQ ID NO: 25560 - protein, 285 aa, Brassica oleracea
MAKDLEVQEGGPTAARDYVDPPPAPLLDMEELGKWSLYRAVIAEFVATLLFLYVSVLTVIGYKAQTDANAGGVDCGGVGILGIAWAFGGMIFVLVYCTAGVSGGHINPAVTFGLFLARKVSLVRTLLYIVAQCLGAICGCGLVKAFQSSYYTRYGGGANELADGYNKGTGLGAEIIGTFVLVYTVFSATDPKRSARDSHIPVLAPLPIGFAVFMVHLATIPITGTGINPARSFGAAVIYNQEKAWDDQWIFWVGPMIGAAAAALYHQFVLRAAGIKSLGSFRSSA

SEQ ID NO: 25561 - protein, 273 aa, Gossypium hirsutum
GRDYHDPPPAPLIDSEELTQWSFYRALIAEFIATLLFLYVTVLTVIGYRVQTDPLKNTVDPDCGGVGILGIAWAFGGMIFILVYCTAGISGGHINPAVTFGLFLGRKVSLVRAVMYMVAQCLGAICGCGLVKGFQKSYYNTYGGGANELQDGFNKGTGLGAEIIGTFVLVYTVFSATDPKRNARDSHVPVLAPLPIGFAVFMVHLATIPITGTGINPARSFGAAVIYNKDKAWDDQWMFWVGPFIGAAIAAIYHQYILRAGAMKALGSFRSNA

SEQ ID NO: 25562 - protein, 290 aa, Gossypium raimondii
MAKEGENSTSHAGDYVVPPPVPYVDPPPVPLIDASELKKWSFYRAMIAEFTATMLFLYITVLTVIGHKSQVATSPDACSGVGLLGIAWAFGGMIFILVYCTAGISGGHINPAVTFGLFLARKVSLIRAIAYMVAQSLGAICGVGLVKAFQSAYYNRYGGGANTLADGYSTGTGLGAEIIGTFVLVYTVFSATDPKRKARDSHVPVLAPLPIGFAVFMVHLATIPITGTGINPARSIGAAVVFNNKKAWDDHWIFWVGPMIGAAIAAFYHQFILRAGAAKALGSFRSQTHV

SEQ ID NO: 25563 - protein, 285 aa, Ananas comosus
MAKDAGEGGEFAAKDYADPPPAALVDAAELGRWSLYRAAIAEFVATLLFLYVTVATVIGYKHQSDPNLSPDAACAGVGILGIAWAFGGMIFILVYCTAGISGGHINPAVTFGLLLARKVSLVRALLYMVAQCLGAVCGVGLVKGFQKAFFVRYGGGANELAAGYSKGTGLAAEIIGTFVLVYTVFSATDPKRSARDSHVPVLAPLPIGFAVFMVHLATIPITGTGINPARSFGAAVIYNQDKAWDDQWIFWAGPFIGAAIAAAYHQYVLRAGAVKALSSFRSFNA

SEQ ID NO: 25564 - protein, 281 aa, Utricularia gibba
GSVEVGTPYAARDYSDPPPALLLDPEELGKWSLYRAAIAEFVATLLFLYITVLTVIGYKRQSSGDACGGVGILGIAWAFGGMIFVLVYCTAGISGGHINPAVTFGLFLARKVSLVRAVLYMIAQCSGAICGCGLVKAFQRTYYDDYGGGANGLSSAYSAGAGLGAEIIGTFVLVYTVFSATDPKRNARDSHVPVLAPLPIGFAVFMVHLATIPVTGTGINPARSLGAAVVYGRAWHDHWIFWVGPFTGAGIAMLFHQCILRAGAANALGSHSQRSAASSSY

SEQ ID NO: 25565 - protein, 288 aa, Oryza sativa
MAKDIEASAPEGGEFSAKDYTDPPPAPLIDVEELTKWSLYRAVIAEFIATLLFLYITVATVIGYKHQSDATVNTTDAACSGVGILGIAWAFGGMIFILVYCTAGISGGHINPAVTFGLFLARKVSLIRAVLYIIAQCLGAICGVGLVKGFQSSYYARYGGGANELSDGYSKGTGLGAEIIGTFVLVYTVFSATDPKRNARDSHIPVLAPLPIGFAVFMVHLATIPITGTGINPARSLGAAVIYNKDKAWDDQWIFWVGPLIGAAIAAAYHQYVLRASAAKLGSYRSNA

SEQ ID NO: 25566 - protein, 288 aa, Zea mays
MAKDIEASGPEAGEFSAKDYTDPPPAPLVDAEELTQWSLYRAVIAEFIATLLFLYITVATVIGYKHQTDASASGPDAACGGVGILGIAWAFGGMIFILVYCTAGISGGHINPAVTFGLFLARKVSLVRALLYIIAQCLGAICGVGLVKGFQSAYYVRYGGGANELSDGYSKGTGLAAEIIGTFVLVYTVFSATDPKRSARDSHVPVLAPLPIGFAVFMVHLATIPITGTGINPARSLGAAVIYNKDKAWDDQWIFWVGPLIGAAIAAAYHQYVLRASATKLGSYRSNA

SEQ ID NO: 25567 - protein, 283 aa, Brassica rapa
MAKDLEVQEGRAARDYQDPPPAPLFDMEELGKWSLYRAVIAEFVATLLFLYVSILTVIGYKAQTDASAGGADCGGVGILGIAWAFGGMIFVLVYCTAGISGGHINPAVTFGLFLARKVSLVRTVLYIVAQCLGAICGCGLVKAFQSSYYNRYGGGANQLAEGYNKGTGLGAEIIGTFVLVYPVFAATDPKRSARDSHIPVLAPLPIGFAAFMVHLATIPITGTGINPARSFGAAVIYNQEKAWDDQWIFWVGPMIGAAAAALYHQFVLRAAGIKSLGSFRSSA

SEQ ID NO: 25568 - protein, 288 aa, Setaria italica
MAKDIEASGPEAGEFSAKDYSDPPPAPLIDAEELTKWSLYRAAIAEFVATLLFLYITVATVIGYKHQTDAAASGPDAACGGVGILGIAWAFGGMIFILVYCTAGISGGHINPAVTFGLFLARKVSLVRAVLYIIAQCLGAICGVGLVKGFQSAYFVRYGGGANELSAGYSKGTGLAAEIIGTFVLVYTVFSATDPKRSARDSHVPVLAPLPIGFAVFMVHLATIPITGTGINPARSLGAAVIYNNDKAWDDQWIFWVGPLIGAAIAAAYHQYVLRASAAKLGSFRSNA

SEQ ID NO: 25569 - protein, 288 aa, Tabernaemontana elegans
MAKDVEAVVAAEQTEFSAKDYHDPPPAPFLDMEELTKWSFYRALIAEFVATLLFLYVCVLTVIGYKHQTDPTAGGDDCGGVGILGIAWAFGGMIFILVYCTAGISGGHINPAVTFGLFLARKVSLLRAFFYMVAQCLGAICGVGLVKAFQKAFYNRYNGGANVVAPGYTIGVGLAAEIIGTFVLVYTVFSATDPKRNARDSHVPVLAPLPIGFAVFMVHLATIPITGTGINPARSFGAAVIYGADKAWDDQWIFWVGPFIGAAIAALYHQYILRASALKALGSFRSNA

SEQ ID NO: 25570 - protein, 287 aa, Triphysaria pusilla
MTKDVEYAPQAAPEYSAKDYHDPPPAPLFDFDELTKWSFYRAVIAEFIATLLFLYVTVLTVIGYSHQTDAAQGGEPCGGVGILGIAWAFGGMIFILVYCTAGISGGHINPAVTFGLFLGRKVSLIRAVLYMVAQCLGAVCGVGFVKAFQKTYYNSYGGGANMLAAGYSKGVGLGAEIIGTFVLVYTVFSATDPKRSARDSHVPVLAPLPIGFAVFMVHLATIPITGTGINPARSFGAAVIYNNDKAWDDHWIFWVGPFVGAAIAAFYHQFILRAAAIKALGSFRSNA

SEQ ID NO: 25571 - protein, 285 aa, Acacia harpophylla
MTKDVEVQEQGEFSAKDYHEPPPAPLIDPEELGKWSFYRALIAEFVATLLFLYVTVLTIIGQNSSTDPNKGKTDCDGVGILGIAWAFGGMIFILVYCTAGISGGHINPAVTFGLFLGRKVSLIRAFLYMVAQCAGAICGTGLAKAFQKAYYDQYGGGANVVQQGYSKGTALGAEIIGTFVLVYTVFAATDPKRNARDSHVPVLAPLPIGFAVFMVHLATIPVTGTGINPARSFGAAVIYNRDKAWNDQWIFWVGPAIGALAAAIYHQYILRAGAIKALGSFRSNN

SEQ ID NO: 25572 - protein, 287 aa, Cicer arietinum
MGKDVEVQEQGGEYSAKDYQDPPPAPLFDPAELTKWSLYRAVIAEFIATLLFLYITVLTIIGYSRQTDTTITGNTECDGVGVLGIAWAFGGMIFVLVYCTAGISGGHINPAVTFGLFLGRKVSLIRAVLYIIAQCLGAICGAGLAKGFQKSYYNRYHGGVNLVSDGYSKGTALGAEIIGTFVLVYTVFSATDPKRSARDSHVPVLAPLPIGFAVFMVHLATIPVTGTGINPARSFGPAVIYNNDKAWDDQWIYWVGPFIGAAIAAFYHQFILRATAIKALGSFRSNP

SEQ ID NO: 25573 - protein, 287 aa, Cicer arietinum
MGKDVEVQEQGGEYSAKDYQDPPPAPLFDPAELTKWSLYRAVIAEFIATLLFLYITVLTIIGYSRQTDTTIAGNTECDGVGVLGIAWAFGGMIFVLVYCTAGISGGHINPAVTFGLFLGRKVSLIRAVLYIIAQCLGAICGAGLAKGFQKSYYNRYHGGVNLVSDGYSKGTALGAEIIGTFVLVYTVFSATDPKRSARDSHVPVLAPLPIGFAVFMVHLATIPVTGTGINPARSFGPAVIYNNEKAWDDQWIYWVGPFIGAAIAAFYHQFILRATAIKALGSFRSNP

SEQ ID NO: 25574 - protein, 287 aa, Eutrema parvulum
MAKDVEAVSGEGFQTRDYQDPPPAPLFDPEELTKWSFYRAVIAEFVATLLFLYITVLTVIGYKIQTDDTAGGVDCGGVGILGIAWAFGGMIFILVYCTAGISGGHINPAVTFGLLLARKVSLVRAILYMVAQCLGAICGVGFVKAFQSSYYIRYGGGANSLAEGYSTGTGLAAEIIGTFVLVYTVFSATDPKRSARDSHVPVLAPLPIGFAVFMVHLATIPITGTGINPARSFGAAVIFNESKPWDDHWIFWVGPFIGAAIAAFYHQFVLRASGSKSLGSFRSAANV

SEQ ID NO: 25575 - protein, 291 aa, Gossypium hirsutum
MTKDIETTAEQGGGAEFSAKDYHDPPPAPLIDMEELTKWSLYRAAIAEFIATLLFLYVTVLTVIGYKVQTDPVKNTIDPDCGGVGILGIAWAFGGMIFILVYCTAGISGGHINPAVTFGLFVGRKVSLIRALLYMVAQCLGAICGCGLVKAFQKTYYNSYGGGANELQDGFNKGTGLGAEIIGTFVLVYTVFSATDPKRSARDSHVPVLAPLPIGFAVFMVHLATIPITGTGINPARSFGAAVIYNQEKAWDDQWIFWVGPFIGAFVAAFYHQYILRAAAIKALGSFRSNA

SEQ ID NO: 25576 - protein, 281 aa, Lotus japonicus
MAKDTEVQEQGEYSAKDYQDPPPTPLFDPEELTKWSFYRALIAEFIATLLFLYVTVLTVIGHSRLNSADPCDGAGILGIAWAFGGMIFILVYCTAGISGGHINPAVTFGLFIGRKVSLIRALLYIVAQCLGAISGVGLAKAFQKSFYNRYGGAANFVQPGYSNGTALGAEIIGTFVLVYTVFSATDPKRNARDSHVPVLAPLPIGFAVFMVHLATIPVTGTGINPARSFGAAVIYNEDKIWDDHWIFWVGPFIGALAAAIYHQYILRAAAIKALGSFRSNN

SEQ ID NO: 25577 - protein, 285 aa, Brassica juncea
MAKEVEGAEGFATRDYEDPPPTPFFDAEELTKWSLYRAVIAEFVATLLFLYVTVLTVIGYKISSDTKAGGDECGGVGILGISWAFGGMIFILVYCTAGISGGHINPAVTFGLFLARKVSLVRAVLYMVAQCLGAICGVGFVKAFQSSYYVRYGGGANSLADGYSTGTGLAAEIIGTFVLVYTVFSATDPKRNARDSHVPVLAPLPIGFAVFMVHLATIPITGTGINPARSFGAAVIFNESKPWDDHWIFWVGPFIGAAIAAFYHQFVLRASGSKSLGSFRSAANV

SEQ ID NO: 25578 - protein, 285 aa, Brassica napus
MAKDAEGAEGFAARDYQDPPPTPFFDAEELTRWSLYRAVIAEFVATLLFLYVTVLTVIGYKISSDTAAGGVECGGVGILGIAWAFGGMIFILVYCTAGISGGHINPAVTFGLFLARKVSLIRAVLYMVAQCLGAICGVGFVKAFQSSYYVRYGGGANSLADGYSTGTGLAAEIIGTFVLVYTVFSATDPKRNARDSHVPVLAPLPIGFAVFMVHLATIPITGTGINPARSFGAAVIYNESKPWDDHWIFWVGPFIGGAIAAFYHQFVLRASGSKSLGSFRSAANV

SEQ ID NO: 25579 - protein, 291 aa, Allium cepa
MANKEVDVPETKDTQFTAKDYTDPPPAPLFDMGELTKWSLYRAVIAEFVATLLFLYITVATVIGYSHQSDATIPGNTDAHCSGVGVLGIAWAFGGMIFVLVYCTAGISGGHINPAVTFGLFLARKVSLIRALLYMIAQCLGAICGVGFVKAFQSAYYSRYGGGANTLNAGYSKGTGLAAEIIGTFVLVYTVFAATDPKRSARDSHVPVLAPLPIGFAVFMVHLATIPITGTGINPARSFGAAVIYNKDKAWDDQWIFWVGPFIGAAIAAAYHQYVLRAGAVKALGSFRSNA

SEQ ID NO: 25580 - protein, 284 aa, Allium cepa
MTKDVEASYAAKDYTDPPPAPLIDSHELTTWSLYRAVIAEFVATLLFLYITVATVIGYKHQSDATLPDNVDAACSGVGVLGIAWAFGGMIFILVYCTAGISGGHINPAVTFGLFLARKVSLVRAVLYMCAQCLGAICGVALVKAFQSGFYDKYGGGANGLSDGYSTGTGLAAEIIGTFVLVYTVFSATDPKRNARDSHVPVLAPLPIGFAVFMVHLATIPITGTGINPARSLGAAAVYNKAKAWDDQWIFWVGPFIGAAIAAAYHQIVLRAGAVKALGSSRSVS

SEQ ID NO: 25581 - protein, 285 aa, Brassica oleracea
MAKDLEVQEGGAMAARDYQDPPPAPLFDMEELGKWSLYRAVIAEFVATLLFLYVSILTVIGYKAQTDANAGGVDCGGVGILGIAWAFGGMIFVLVYCTAGISGGHINPAVTVGLFIARKVSLVRTVLYIVAQCLGAICGCGLVKAFQSSYYNRYGGGANQLADGYNKGTGLGAEIIGTFVLVYTVFSATDPKRSARDSHIPVLAPLPIGFAVFMVHLATIPITGTGINPARSFGAAVIYNQEKAWDDQWIFWVGPMIGAAAAALYHQFVLRAAGIKSLGSFRSSA

SEQ ID NO: 25582 - protein, 272 aa, Echinochloa colona
AKDYSDPPPAPLIDAEELTKWSLYRAVIAEFIATLLFLYITVATVIGYKHQSDPAASGADAACGGVGILGIAWAFGGMIFILVYCTAGISGGHINPAVTFGLFLARKVSLVRAVLYIIAQCLGGICGVGLVKGFQSAYYVRYGGGANELSSGYSRGTGLAAEIIGTFVLVYTVFSATDPKRNARDSHVPVLAPLPIGFAVFMVHLATIPVTGTGINPARSLGAAVVYNNNKAWSDQWIFWVGPFIGAAIAALYHQIVLRASARGYGSFRSNA

SEQ ID NO: 25583 - protein, 282 aa, Elaeis guineensis
MGKDVEAEFTAKDYTDPPPAPLIDAEELAKWSLYRAVIAEFIATLLFLYITVATVIGYKHQSDPNVGGTDAACSGVGILGIAWAFGGMIFILVYCTAGISGGHINPAVTFGLFLARKVSLIRALLYMIAQCLGAICGVGLVKSFQKAYYNRYGGGANELSSGYSKGTGLAAEIIGTFVLVYTVFSATDPKRNARDSHVPVLAPLPIGFAVFMVHLATIPITGTGINPARSFGAAVIYNEDKAWDHQWIFWVGPFIGAAIAAAYYQYVLRASAGKPLGSYRSG

SEQ ID NO: 25584 - protein, 288 aa, Secale cereale
KDEVTETGGGGDFAAKDYTDPPPAPLIDAAELASWSLYRAVIAEFIATLLFLYITVATVIGYKHQTDPAVNSAADAACGGVGVLGIAWAFGGMIFVLVYCTAGISGGHINPAVTFGLFLARKVSLVRALLYMIAQCLGAMCGVGLVKAFQSAYFVRYGGGANTLAAGYSKGTGLAAEIIGTFVLVYTVFSATDPKRSARDSHVPVLAPLPIGFAVFMVHLATIPITGTGINPARSLGAAVIYNKEKAWDDQWIFWVGPMIGAAIAALYHQYILRAGAIKALGSFRSNA

SEQ ID NO: 25585 - protein, 285 aa, Eutrema halophilum
MAKDLEVQEGGATAARDYADPPPAPLLDMEELRKWSLYRAVIAEFVATLLFLYVSILTVIGYKAQTDASAGGVDCGGVGILGIAWAFGGMIFVLVYCTAGVSGGHINPAVTFGLFLARKVSLVRTVLYIVAQCLGAICGCGFVKAFQSSYYTRYGGGANELADGYNKGTGLGAEIIGTFVLVYTVFSATDPKRSARDSHIPVLAPLPIGFAVFMVHLATIPITGTGINPARSFGAAVIYNQEKAWDDQWIFWVGPMIGAAAAALYHQFVLRAAAIKALGSFRSSA

SEQ ID NO: 25586 - protein, 261 aa, Helianthus annuus
MAKDIEVASHEYGAKDYQDPPPADLIDPEELTKWSFYRAIIAEFVATLLFLYITVLTVIGYKSQTDPDHSTDQCGGVGILGIAWAFGGMIFILVYCTAGISGGHINPAVTFGLFLARKVTLPRAVMYMVAQCLGAVCGCGLVKAFQKSYYTNYGGGANELADGYNKGTGLGAEIIGTFVLVYTVFSATDPKRNARDSHVPVLAPLPIGFAVFMVHLATIPITGTGINPARSFGAAVIYGKEKAWDDQWIFWVGPMIGAAIA

SEQ ID NO: 25587 - protein, 289 aa, Trifolium pratense
MAKDFETEPQAGGGLPNKDYQDPPPAPLFDTTEFSQWSFYRALIAEFVATLLFLYVTILTVIGYNSQTDPAHNGTHCDGVGILGIAWAFGGMIFVLVYCTAGISGGHINPAVTFGLFLARKVSLIRAVLYIVAQCLGAICGVGLVKAFQKGYYNRYKGGANMLNDGYSKGTGLGAEIIGTFVLVYTVFSATDPKRNARDSHVPVLAPLPIGFAVFIVHLATIPITGTGINPARSFGAAVIYNNEKAWDDQWIFWVGPFIGAAIAAIYHQFVLRAQAAKALGSFRSSSNL

SEQ ID NO: 25588 - protein, 284 aa, Vigna unguiculata
MAKDIETEVRTELTHKDYYDPPPTPFYDAAELRKWSFYRALIAEFVATLLFLYVTILTVIGYNHQIHVGDSCEGVGILGIAWAFGGMIFVLVYCTAGISGGHVNPAVTFGLFLARKVSLVRAIAYMVAQCLGAICGVGLVKAFQKSYYNRYKGGVNLLSDGYSKGAGLGAEIIGTFVLVYTVFSATDPKRKARDSHVPVLAPLPIGFAVFMVHLATIPVTGTGINPARSFGPAVIFNNEKAWDDQWIFWVGPFIGAAIAAVYHQYVLRAQAAKALGSFRSSPHL

SEQ ID NO: 25589 - protein, 272 aa, Arnica chamissonis
MTKDVPEQGSFSAKDYHDPPPAPFIDPEELTKWSFYRALIAEFIATLLFLYITVLTVIGYKSTTDPALNADQCGGVGILGIAWAFGGMIFVLVYCTAGISGGHINPAVTFGLFLARKVSLIRAFMYMVAQCLGAICGVCLVKAFNKSLYNRYGGGANELAAGYNKGTGLGAEIIGTFVLVYTVFSATDPKRSARDSHVPVLAPLPIGFAVFMVHLATIPITGTGINPARSLGAAVIYNKDKAWDDQWIFWVGPFVGAAIAAFYHQFILRAGA

SEQ ID NO: 25590 - protein, 289 aa, Trifolium pratense
MAKDFETEPQAGGGLPNKDYQDPPPAPLFDTTEFAQWSFYRALIAEFVATLLFLYVTVLTVIGYNSQTDPAHNGTHCDGVGILGIAWAFGGMIFVLVYCTAGISGGHINPAVTFGLFLARKVSLIRAVLYMVAQCLGAICGVGLVKAFQKSYYNRYKGGANMLNDGYSKGTGLGAEIIGTFVLVYTVFSATDPKRSARDSHVPVLAPLPIGFAVFIVHLATIPITGTGINPARSFGAAVIYNNEKAWDDQWIFWVGPFIGAAIAAIYHQFVLRAQAVKALGSFRSSSNL

SEQ ID NO: 25591 - protein, 288 aa, Cajanus cajan
MAKDVEQVTEQGGEYSAKDYTDPPPAPLIDPEELTKWSLYRAAIAEFIATLLFLYITVLTIIGYKRQTDTNIPGNTECDGVGILGIAWAFGGMIFILVYCTAGISGGHINPAVTFGLFLGRKVSLVRALLYIIAQCAGAISGAGLAKGFQKSYYNRYGGGVNLVSDGYNKGTALGAEIIGTFVLVYTVFSATDPKRNARDSHVPVLAPLPIGFAVFMVHLATIPVTGTGINPARSFGPAVIFNEDKAWDDQWIYWVGPFIGAAVAAFYHQYILRAAAIKALGSFRSNA

SEQ ID NO: 25592 - protein, 285 aa, Arabidopsis thaliana
MAKDVEGPEGFQTRDYEDPPPTPFFDADELTKWSLYRAVIAEFVATLLFLYITVLTVIGYKIQSDTKAGGVDCGGVGILGIAWAFGGMIFILVYCTAGISGGHINPAVTFGLFLARKVSLIRAVLYMVAQCLGAICGVGFVKAFQSSYYDRYGGGANSLADGYNTGTGLAAEIIGTFVLVYTVFSATDPKRNARDSHVPVLAPLPIGFAVFMVHLATIPITGTGINPARSFGAAVIYNKSKPWDDHWIFWVGPFIGAAIAAFYHQFVLRASGSKSLGSFRSAANV

SEQ ID NO: 25593 - protein, 287 aa, Musa acuminata
MAKDTEVAGRGEYGGKDYTDPPPAPLIDAEELTKWSLYRAAIAEFVATMLFLYVTVATVIGYKHQSDPNVNPADAACSGVGILGIAWAFGGMIFILVYCTAGISGGHINPAVTLGLFLARKVSLVRAFLYMVAQCLGAICGVGLVKGFQEAYFVRYGGGANELSAGYSKGTGLAAEIIGTFVLVYTVFAATDPKRNARDSHVPVLAPLPIGFAVFMVHLATIPITGTGINPARSLGAAVIYNQDKAWDDQWIFWVGPFVGAAIAAAYHQYVLRASGAKAMGSFGSNA

SEQ ID NO: 25594 - protein, 286 aa, Cirsium arvense
SNLEFWTWPKNRCCGNEYSAKDYQDPPPAAFFDAQELTKWSFYRAIIAEFIATLLFLYVIVSTIIGHKSQSVSDQCGGVGILGIAWAVGGMIFVLVYCTAGISGGHINPAVTFGLFLARKITLPRAVMYIVAQCLGAICGCGLVKAIQNTNYDNHGGGANELADGYSKGTGLGAEIIGTFVLVYTVFSATDPKRNARDSHIPVLAPLPIGFAVFLVHLATIPITGTGINPARSLGAAVIYGKDKAWDDQWLFWVGPMIGAAIAALYHQYVLRAGAVKALGSFRSNA

SEQ ID NO: 25595 - protein, 291 aa, Allium cepa
MANKEVDVPETKDTQFTAKDYTDPPPAPLFDMGELTKWSLYRAVIAEFVATLLFLYITVATVIGYSHQSDATIPGNTDAHCSGVGVLGIAWAFGGMIFVLVYCTAGISGGHINPAVTFGLFLARKVSLIRALLYMIAQCLGAICGVGFVKAFQSAYYSKYGGGANSLKDGYNKGTGLAAEIIGTFVLVYTVFAATDPKRSARDSHVPVLAPLPIGFAVFMVHLATIPITGTGINPARSFGAAVIYNKDKAWDDQWIFWVGPFIGAAIAAAYHQYVLRAGAVKALGSFRSNA

SEQ ID NO: 25596 - protein, 280 aa, Podocarpus macrophillus
MAKEGGKEVEQQGFAAKDYTDPPPAPFLDFGEFKLWSFYRAVIAEFIATLLFLYITVATVIGHKRNSDGCGSVGLLGIAWAFGGMIFVLVYCTAGISGGHINPAVTFGLFLARKVSFPRAVLYMVAQCLGAICGCGLVKGFQKSFYERYGGGANTVAHGYTKGVGLGAEIIGTFVLVYTVFSATDPKRSARDSHVPVLAPLPIGFAVFMVHLATIPITGTGINPARSFGAAVVYGHQQPWDDQWIFWVGPFVGAAVAAFYHQQILRAAAIKALGSFRSNP

SEQ ID NO: 25597 - protein, 278 aa, Taxus baccata
MAKEVDQPGFAPKDYVDPPPAALVDFNEFKLWSFYRALIAEFIATLLFLYITVATVIGHKRNADNCGSVGLLGIAWAFGGMIFVLVYCTAGISGGHINPAVTFGLFLARKVSLPRAVLYMVAQCLGAICGTGLVKAFQKSFYDTYGGGANSVAPGYSKGVGLAAEIIGTFVLVYTVFSATDPKRSARDSHVPVLAPLPIGFAVFMVHLATIPITGTGINPARSFGAAVIYGHQKTWDDHWIFWVGPFIGAAVAALYHQFILRAGAIKALGSFRSNPNV

SEQ ID NO: 25598 - protein, 285 aa, Eutrema parvulum
MAKDVEGAEGFTARDYEDPPPTPFFDAEELTKWSLYRAVIAEFVATLLFLYVTVLTVIGYKIQSDTTAGGVDCGGVGILGIAWAFGGMIFILVYCTAGISGGHINPAVTFGLFLARKVSLIRAVLYMVAQCLGAICGVGFVKAFQSSYYVRYGGGANSLADGYNTGTGLAAEIIGTFVLVYTVFSATDPKRNARDSHVPVLAPLPIGFAVFMVHLATIPITGTGINPARSFGAAVIFNESKPWDDHWIFWVGPFIGAAIAAFYHQFVLRASGSKSLGSFRSAANV

SEQ ID NO: 25599 - protein, 285 aa, Raphanus sativus
MAKDLEVQERGATAVRDYVDPPPAPLLDMEELGKWSLYRAVIAEFVATLLFLYVSVLTVIGYKAQTDANAGGVHCGGVGILGIAWAFGGMIFVLVYCTAGVSGGHINPAVTFGLFLARKVSLVRTVLYIVAQCLGAICGCGLVKAFQSSYYTRYGGGANELADGYNKGTGLGAEIIGTFVLVYTVFSATDPKRSARDSHILVLAPLPIGFAVFMVHLATIPITGTGINPARSFGAAVIYNQEKAWDDQWIFWVGPLIGAAAAALYHQFVLRAAGIKSLGSFRSSA

SEQ ID NO: 25600 - protein, 285 aa, Brassica juncea
MAKDLEVQEGGAMAARDYQDPPPAPLFDMEELRKWSLYRAVIAEFVATLLFLYVSILTVIGYKAQTDASAGGVDCGGVGILGIAWAFGGMIFVLVYCTAGISGGHINPAVTVGLFLARKVSLVRTVLYIVAQCLGAICGCGLVKAFQSSYYNRYGGGANQLAEGYNKGTGLGAEIIGTFVLVYTVFSATDPKRSARDSHIPVLAPLPIGFAVFMVHLATIPITGTGINPARSFGAAVIYNQEKAWDDQWIFWVGPMIGAAAAALYHQFVLRAAGIKSLGSFRSSA

SEQ ID NO: 25601 - protein, 289 aa, Echinochloa colona
MAKDIEAAAAAEGGEYTGKDYSDPPPAPLIDAEELTKWSLYRAVIAEFVATLLFLYITVATVIGYKHQTDAAASGADAACGGVGVLGIAWAFGGMIFILVYCTAGISGGHINPAVTFGLFLARKVSLVRAVLYIIAQCLGGICGVGLVKGFQSAYYVRYGGGANELSAGYSKGTGLAAEIIGTFVLVYTVFSATDPKRSARDSHVPVLAPLPIGFAVFMVHLATIPITGTGINPARSLGAAVIYNNDKAWDDQWIFWVGPLIGAAIAAAYHQYVLRASAAKLGSYRSNA

SEQ ID NO: 25602 - protein, 290 aa, Allium cepa
MAKDVETAEKGSGEFRTKDYTDPPPAPFFDMEELTKWSLYRAVIAEFIATLLFLYITVATVIGYSHQSDKTLPGNTDAACSGVGVLGIAWAFGGMIFVLVYCTAGISGGHINPAVTFGLFLARKVSLIRAILYMIAQCLGAICGVGFVKAFQSAYYSRYGGGANMLSVGYTKGTGLAAEIIGTFVLVYTVFSATDPKRSARDSHVPVLAPLPIGFAVFMVHLATIPITGTGINPARSFGAAVIYNKDKAWDDHWIFWVGPFIGAAIAAAYHQYVLRAGAVKALGSFRSNP

SEQ ID NO: 25603 - protein, 284 aa, Eutrema halophilum
MAKDVEGEGFTARDYEDPPPTPFFDAEELTKWSLYRAVIAEFVATLLFLYVTVLTVIGYKIQSDTAAGGVDCGGVGILGIAWAFGGMIFILVYCTAGISGGHINPAVTFGLFLARKVSLIRAVLYMVAQCLGAICGVGFVKAFQSSYYVRYGGGANSLADGYNTGTGLAAEIIGTFVLVYTVFSATDPKRNARDSHVPVLAPLPIGFAVFMVHLATIPITGTGINPARSFGAAVIFNESKPWDDHWIFWVGPFIGAAIAAFYHQFVLRASGSKSLGSFRSAANV

SEQ ID NO: 25604 - protein, 289 aa, Vinca minor
MAKEVGGVAEQGSFTTKDYHDPPPAAFFDPHELVKWSFHRALIAEFIATLLFLYITVLTVIGYKAQTDHDLGNTDPCNGVGILGISWAFGGMIFVLVYCTAGISGGHINPAVTFGLLLARKVSLIRAVLYMVAQCLGAICGVGLVKAFQKSYFVKYGGGANELQVGHSVGVGLAAEIIGTFVLVYTVFSATDPKRNARDSHVPVLAPLPIGFAVFMVHLATIPVTGTGINPARSLGSAVIYNHKKAWDDHWIFWVGPFIGAAIAAFYHQFILRAGAAKALGSFRSSSHV

SEQ ID NO: 25605 - protein, 315 aa, Arabidopsis lyrata
MSSHTNLPSPKPVPKPDHRISGTSQTKKPPSSSVAQDQQNLKCPRCNSPNTKFCYYNNYSLSQPRHFCKSCRRYWTRGGALRNVPIGGGCRKTKKSIKPNSSLNTLPSSSSSQRFFSSIMEDSSKFFPPPTTMDFQLAGLSLNKMNDLQLLNNQEVLDLRPMISSGRENTPVDVGSGLSLMGFGDYNNNHSPTAFTTAGASDGNLASSIETLSCLNQDLHWRLQQQRMAMLFGNSNEETVVVERPQPILYRNLEIVNSSSPSSPTKKGDNQTEWYFGNNSDNEGVISNNANTGGGSEWNNGIQAWTDLNHYNALP

SEQ ID NO: 25606 - protein, 314 aa, Eutrema halophilum
MSSHTTNLPSPKPDHRISGTSQTKKPPSSSVASQDQQTLKCPRCNSSNTKFCYYNNYSLSQPRHFCKSCRRYWTRGGALRNVPIGGGCRKTKKSIKPNAITPSSSSSQRFFSSIMEDSSKFFPPPTTMDFQLAGLSLNKINDLQLLNNQEVLGLRPVEQVETTPVDVGSGLSLMGFGEYNSSNHSPATFATAGANDGNLATSIETLSCLNQDLHWRLQQQRMAMLFGNSKEDTVVVERPQPILYRNLEIVNSSPSPTKKGENQTEWYFGNNNANEGVINSNDSNNNNNNNSGGSDHWNNGIQAWTDLNHYNALP

SEQ ID NO: 25607 - protein, 306 aa, Brassica oleracea
MSSHTNLHSPKPDHRTTGTPHTKKPPSSSTSQDQQTLKCPRCNSSNTKFCYYNNYSLSQPRHFCKSCRRYWTRGGALRNVPIGGGCRKTKKTFKPNSVITPSSSSSQRFFSSIMEDSTKFFPPPTTMDFQLAGLSLNKINDLQLMNNQEVLGLRPMDQVETTPVDVGSGLSLMGFGDYSNNNHSTGTFTTAGATDGNLATSIETLSSLNQDLHWRLQQQRMAMLFGSSKEETVVVERPQPILYRNLEIVNSSQSPTKKGDNQTEWYFGNNNDTEGVANNNNNTGGSEQWNNGVQAWTDLNHYNALP

SEQ ID NO: 25608 - protein, 311 aa, Eutrema parvulum
MSSHTNLHSPKPDHRISGTPHTKKPPSSSGSQDQQTLKCPRCNSSNTKFCYYNNYSLSQPRHFCKSCRRYWTRGGALRNVPIGGGCRKTKKSIKPNTITPSSSSSQRFFSSIMEDSSKFFPPPTTMDFQLAGLSLNKINDLQLLNNQEVLGLRPMEQVETTAPVDVGSGLSLMGFGDYNNTNNISPATFSTTGATDGNLATSIETLSCLNQDLHWRLQQQRMAMLFGNSKEETVVVERPQPILYRNLEIVNSSPSPMKKGDNQTEWYFGNNNDNEGVTNNNDNNNNNTGGSDQWSNGLEAWTDLNHYNALP

SEQ ID NO: 25609 - protein, 306 aa, Brassica rapa
MSSHTNLHSPKPDHRTTGTPHTKKPPSSSTSQDQQTLKCPRCKSSNTKFCYYNNSSLSQPRHFCKACRRYWTRGGALRNVPIGGGCRKTKKSFKPNAVATPSSSQRFFSSIMEDSSKFFPPPTTMDFQLAGLSLNKINDLQLMNNQEVLGLRPMDQVETTPVDVGSGLSLMGFGDYSNNNHSTGTFTTAGGTDGNLATSIETLSSLNQDLHWRLQQQRMAMLFGSSKEETVVVERPQPILYRNLDIVNSSQSPTKKGDNQTEWYFGNNNNNNDNEGVANNNNTGGSEQWNNGVQAWTDLNHYDALP

SEQ ID NO: 25610 - protein, 216 aa, Hordeum vulgare
  Sequence also found in Organisms: Pseudoroegneria spicata
MSKLQSDALREAITNITNDCREKNRKFVETIELQIGLKNYDPQKDKRFSGSVKLPHIPRPKMRVCMLGDAQHVEEAGKMGLDCMDVESLKKMNKNKKLVKKLAKKYHAFLASEAIIKQIPRLLGPGLNKAGKFPTLVSHQESLESKVNETKATVKFQLKKVLCMGVAVGHLGMEEKQIFQNVQMSVNFLVSLLKKNWQNVRCLYLKSTMGKVYRLF

SEQ ID NO: 25611 - protein, 150 aa, Zea mays
MDVSGAGGKAKKGAAGRKAGGPTKKSVSRSSRAGLQFPVSRVGRYLKKGRYAQRVGTGAPVYLAAVLEYLAAEVLELAGNAARDNKKTRIIPRHVLLAIRNDEELGKLLAGVTIAHGGVLPNIHTVLLPKKVAEKAAKEPKKAAKSPKKA

SEQ ID NO: 25612 - protein, 217 aa, Sorghum bicolor
MARPGSSAAAPLLLLLAAAAASILAAAAASPAPSDFVRKSCRATQYPSVCEQSLASYGGSPAPRSPRELARAALSVSADRARAASAYVGRLCGGSSSSAGHKKGAAARKGGAPGSAAGPVRDCLENLADSVGHLRDAAQEMGGAGMSRSGTPAFKWHLSNVQTWCSAALTDENTCLDGLSSRGVDAGTRAAIRGKVVDVAQVTSNALALVNKVGPGY

SEQ ID NO: 25613 - protein, 279 aa, Solanum lycopersicum
MAKDMEVGTEYAPKDYQDPPPAPLIDPEELGKWSFYRAIIAEFIATLLFLYITVLTVIGYKSQSSTDQCGGVGILGIAWAFGGMIFVLVYCTAGISGGHINPAVTFGLFLARKVSLVRAIMYIVAQCLGAICGCGLVKAFQKAYYVKYGGGANTLNDGYSTGTGLGAEIIGTFVLVYTVFAATDPKRNARDSHVPVLAPLPIGFAVFMVHLATIPVTGTGINPARSFGAAVVYGHNKAWDDQWIFWVGPFIGAAIAAFYHQFILRAGAVKALGSFRSNA

SEQ ID NO: 25614 - protein, 316 aa, Arabidopsis thaliana
MSSHTNLPSPKPVPKPDHRISGTSQTKKPPSSSVAQDQQNLKCPRCNSPNTKFCYYNNYSLSQPRHFCKSCRRYWTRGGALRNVPIGGGCRKTKKSIKPNSSMNTLPSSSSSQRFFSSIMEDSSKFFPPPTTMDFQLAGLSLNKMNDLQLLNNQEVLDLRPMMSSGRENTPVDVGSGLSLMGFGDFNNNHSPTGFTTAGASDGNLASSIETLSCLNQDLHWRLQQQRMAMLFGNSKEETVVVERPQPILYRNLEIVNSSSPSSPTKKGDNQTEWYFGNNSDNEGVISNNANTGGGGSEWNNGIQAWTDLNHYNALP

SEQ ID NO: 25615 - protein, 524 aa, Oryza sativa
MKKAAAGGMAPLPPSSSPPSCKAGGGGGSPRWSLLHGGGGEWGVVVRRNVVKSSSLLLLVFSTFFVFSVLRSSQTSLVPPPPPAAAGPGEPALAQSGHDVAGDDGGEHVAVAVNNVAAETQSTPDDISLPSTNSSAAAVPTTTNKAEQQQTGANNMEEKCDMSMGKWVREPKGPVYTNTTCPTLPDFKNCQKHGKDPGHLYWRWQPHGCDLPRFSPDRFLAAVRGKRLAFIGDSLARNQMDSLLCLLSQAETPTEVYRDAHDKFQTWRFAAHEFTLMVMWTEFYVHAEPVVGADGKPTPSFDIHLDRLSANWTRRLPELDYAVISGGNWFNRPNYLWEGGRRVGCVKCGGAANLTDVGVPYAVRRVVRAAVEGIARCTGCKAGLVAFLRTFSPDHFEHGAWFSGGYCNRTRPLEEDEVSPDSAAWELRRVQREEVMRVKETAAAAAAASGNARRFEVLDVTKAMMLRADGHPGAAIDKRWQKNIVSDCLHWCMPGPVDMWNEMLLQRLTEISTLDQDASIFEAP

SEQ ID NO: 25616 - protein, 379 aa, Brachypodium distachyon
MALLKAARVAEVPTLDVVVPDLAAASARILEVDAAVKKRAGGRFAVIGHRGKGMNALASPDRRLQEVKENSVRSFNEAARFPVDYVEFDVQVTKDGCPIIFHDNFIFTEEHGKISDKRVTDLQLEDFLMYGPQNRQGKNGKPLLRKMKDGRMLNWNVQSDDPLCTLQEAFAKVNPRLGFNVELKFDDYLAYQEEELSRILQAILKVVFEYAKDRPIIFSSFQPDAAQLMRKLQSTYPVYFLTNGGTEIYTDVRRNSLEEAVKLCLTSGMQGIVSEARAIFRFPAAIPKIKEADLSLLTYGTLNNVPEAVYMQHLMGVNGVIVDLVQEITEAVTDLIAVPEPDPEAKDSSSQVTRDAASTPNFTQREISFLLRLIPELVQ

SEQ ID NO: 25617 - protein, 510 aa, Brachypodium distachyon
MVAAARSTARWLLLLALVAAYHGGGASVRAAAGAGAHWLGGLSRASFPKGFVFGTATSAYQVEGMAASGGRGPSIWDAFSHIPGNVVGNTNADVTTDQYHRYKEDVNLMKGLNFDAYRFSISWSRIFPDGEGKVNEEGVAYYNNLINYLLQKGITPYINLYHADLPLALEKKYGGWLSAKTVELFADYADFCFKTFGNRVKHWFTLNEPRIACLLGYDVGSTPPQRCTKCAAGGNSATEPYIVAHNFLLAHGYAVARYRNKYQAAQQGKIGIVLDFNWYEALTNSAEDEAAAQRARDFHVGWFVDPLINGHYPQIMQDLVKERLPRFTSDEVKIVKGSADYIGINQYTASYIKGQKLVQQAPTSYSADWQVTYASLRNGKPIGPKANSDWLYIVPTGMYGCVNYLRVKYGNPAIVITENGMDQPGNLTRDEYLRDVTRVRFYRSYLAELKKAIDGGANVLGYFAWSLLDNFEWGSGYTSKFGIVYVDFNSTKLERHPKASAYWFRDMLKG

SEQ ID NO: 25618 - protein, 553 aa, Oryza sativa
MRAAVQGRAHAWTTTTTTPPGAMRGRALVLVAALLLQLLLLAAAGGAGAAATERKAHNYEDALRKSLLYFEAQRSGRLPHNQRVAWRDHSGLTDGLEQGVDLVGGYYDAGDHVKFGLPMAFTVTMLSWSMIEYGDDVEAAGELGHALEAIKWGTDYFIKAHTKPNELWAEVGDGDTDHYCWQRPEDMTTSRQAYKVDRERPGSDVAGETAAAMAAASIVFRKSNPHYASLLLHHAQQLFEFADKYRGKYDSSIAEVKSYYASVSGYKDELLWAALWLHRATGKAHYLDYVVDNADCFGGTGWAITEFSWDVKYAGVQILAARLLLRGEHEERHRSTLEQYRAKAEHYVCGCLGRNADGGADANVERSPGGMLYVRQWNNMQYVTNAAFLLAAYADYLGDDADGAVSCAGGETAGAGEVAALARAQVDYVLGTNPRGISYLVGYGAKYPNRVHHRAASIVPYKHSKEFIGCTQGFDHWFGRRSSNPNVLVGAIVGGPDRRDRFRDNRENYMQTEACTYNTAPMVGMFAKLNRMARQEREQEEVAAPARSTAADV

SEQ ID NO: 25619 - protein, 164 aa, Carthamus tinctorius
MRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATSGEGLYEGLDWLSNNIAGKA

SEQ ID NO: 25620 - protein, 148 aa, Ocimum basilicum
DAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATSGEGLYEGLDWL

SEQ ID NO: 25621 - protein, 148 aa, Cirsium arvense
LYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATSGEGLYEGLDWLSNNIAGKA

SEQ ID NO: 25622 - protein, 542 aa, Setaria italica
MAATAAAAATTPSSPLLRRAAAAPTTGHHYQLRCSAKPSPLELRHYAARLAPARALFPDRVTPFSFDADGDDHPREECGVFGVIGDPDASSLCYLGLQKLQHRGEEGAGIAASDADGKLKSVTGLGLVGDVFGDPTRLAKLPGNAAIGHVRYSTAGASSMRNVQPFLAAYRFGQLAVAHNGNLVNYQALRNKLEAQGSIFNTSSDTEVILHLIATSLSRPLLSRICDACERLAGAYSLLFLTADKLFAVRDPFGFRPLVMGRRPNGAIVFASETCALDLIDAAYEREVAPGEVVVVDRRDMSVSYACLVPHRPRKSCVFEHIYFALPNSVVFGHAVHERRSAYGRALAEESPAPTADVVIPVPDSGFYAALGFAQASGLEFQQGLIRWHYSGRSFIQPSQAIRDLAVKLKLAPVRGVITGKSVVVVDDSLVRGTTSSKIVRLLRDAGAREVHMRIASPPVIGSCLYGIDTPSEGELISNRMDLEGVRRTIGCDSLAFLSLDKLHSIYGDEAHELCDACFSRNYPVLPTVPEPVPELVSAFED

SEQ ID NO: 25623 - protein, 544 aa, Brachypodium distachyon
MAAAAAAATAAPTTTASSRLLLPRTAPVPSPIHYQLRCSAGPSLLARRHRAPAPARASPDRLTPFNYDDDSDDHPREECGVFGVVGDPDASSLCYLGLQKLQHRGEEGAGISASGDDGDIKTVTGLGLVGDVFGDPARLAGLPGRSAIGHVRYSTSGAAASLRNVQPFHAGYRFGQLAVAHNGNLVNYQSLRNKLEAQGSIFNTSSDTEVILHLIATSLSRPLLARICDACERLAGAYSLLFLTADKLFAVRDPFGFRPLVMGRRPNGAVVFASETCALDLIDAVYEREVEPGEVVVVDRRDMSMSSACLVPHRPRKSCVFEHIYFALPNSIVFGHAVHERRTAYGRALAEESPAPTADVVIPVPDSGFYAALGFAQASGLEFQQGLIRWHYSGRSFIQPTQAIRDLAVKLKLAPVRGVIAGKSVVVVDDSIVRGTTSSKIVRLLRDAGAREVHMRISSPPVIGSCLYGIDTPSEGELISNRMDIEGVRRAIGCDSLGFLSLDKLHSIYGDEAGELCDACFSRNYPVLPTVPEPVPELVSAFDD

SEQ ID NO: 25624 - protein, 544 aa, Zea mays
MAATAAAAATASTPSSPLRRRASAAPTTRHNSQLKCSIKPSQFELRHRAAGLAPARALLPDRVTPFSFDADGDDHPREECGVFGVIGDPDASSLCYLGLQKLQHRGEEGAGIVASDADGKLNSVTDLGLVGDVFRDPARLAKLPGNAAIGHVRYSTAGASSRRNVQPFLAAYRFGQLAVAHNGNLVNYQALRNKLEAQGSIFNTSSDTEVILHLISTSLSRPLLSRICDACERLAGAYSLLFMTADKLFAVRDPFGFRPLVMGRRPNGAVVFSSETCALDLIDATYEREVEPGEVVVVDRRDMSVSYACLVPHRPRKSCVFEHIYFALPNSVVFGHAVHERRTAYGRALAEESPAPTADVVIPVPDSGFYAALGFAQASGLEFQQGLIRWHYSGRSFIQPSQAIRDLAVKLKLAPVRGVITGKSVVVVDDSLVRGTTSSKIVRLLRDAGAREVHMRISSPPVVGSCLYGIDTPSEGELISNRMDLEGVRRTIGCDSLAFLSLDKLHSIYGNEAHEFCDACFSRNYPVLPTVPEPVPELVSAFED

SEQ ID NO: 25625 - protein, 547 aa, Sorghum bicolor
MAATAAATAAAATTSTPSTPLLRRAAAAPTTSHHYQLRCSTKPSQFVLRHRAARVAPARALLPDRVTPFSFDADGDDHPREECGVFGVIGDPDASSLCYLGLQKLQHRGEEGAGIVASDADGKLNSVTDLGLVGDVFRDPARLAKLPGNAAIGHVRYSTAGASSRRNVQPFLAAYRFGQLAVAHNGNLVNYQALRNKLEAQGSIFNTSSDTEVILHLISTSLSRPLLSRICDACERLAGAYSLLFLTADKLFAVRDPFGFRPLVMGRRPNGAVVFSSETCALDLIDATYEREVEPGEVVVVDRRDMSVSYACLVPHRPRKSCVFEHIYFALPNSVVFGHAVHERRSAYGRALAEESPAPTADVVIPVPDSGFYAALGFAQASGLEFQQGLIRWHYSGRSFIQPSQAIRDLAVKLKLAPVHGVITGKSVVVVDDSLVRGTTSSKIVRLLRDAGAREVHMRISSPPVVGSCLYGIDTPSEGELISNRMDLEGVRRTIGCDSLAFLSLEKLHSIYGNEAHEFCDACFSRNYPVLPTVPELVPELVSAFED

SEQ ID NO: 25626 - protein, 543 aa, Sorghum bicolor
MGIAAAAATTTTSRLLHYHAAAGTDRHHRHQLRYSASPFPLSLRCGSGRREAAAARALLPDRVTPFSYGVDEDADDHPREECGLVGVVGDPDAASLCYLGLQKLQHRGEEGAGIVAVGGDGKLKSVTGLGLVADVFGDPSRLASLPGPAAIGHVRYSTAGAAASLRNVQPFLAGYRFGQVAVAHNGNLVNYQALRNKLEARGSIFNTSSDTEVILHLIATSLSRPLLARVCDACERLAGAYSLLFLTADKLFAVRDPHGFRPLVMGRRRNGAVVFASETCALDLIDATYEREVQPGEVVVVDRRDMSVASACLVPHRPRRSCVFEHIYFALPNSVVFSHAVHERRTAFGQALAEESPAPGADVVIPVPDSGFYAALGFARASGLEFQQGLIRWHYSGRSFIQPTQAIRDLAVKLKLAPVRGVITGKSVVVVDDSLVRGTTSSKIVRLLRDAGAREVHMRIASPPVVGSCLYGIDTPSEGELISNRMDLDGVRREIGSDSLAFLSLDKLHSIYGEESGDYCDACFSRKYPVLPTLADPAVEPDE

SEQ ID NO: 25627 - protein, 543 aa, Zea mays
MGIVAAAAATTCTSRILYRYAAAGSDRHNRHHLRYYASPYPLSLRCGSGRREAAARALLPDRVTPFSYGVDEDADDHPREECGVIGVVGDPDASSLCYLGLQKLQHRGEEGAGIVAVGGDGKLKSVTGLGLVADVFADPSRLASLPGPAAIGHVRYSTAGAAASLRNVQPFLAGYRFGQVAVAHNGNLVNYQALRNKLEARGSIFNTSSDTEVILHLIATSLSRPLLARVCDACERLAGAYSLLFLTADKLFAVRDPHGFRPLVMGRRRNGAVVFASETCALDLIDATYEREVEPGEVVVVDRRDMSVASACLVPHRPRRACVFEHIYFSLPNSVVFSHAVHERRTAFGQALAEESPAPGADVVIPVPDSGFYAALGFARASGLEFQQGLIRWHYSGRSFIQPTQAIRDLAVKLKLAPVRGVITGKSVVVVDDSLVRGTTSSKIVRLLRDAGAREVHMRIASPPVVGSCLYGIDTPSEGELISNRMDLDGVRREIGSDSLAFLSLDKLHSIYGEESGNYCDACFSRKYPVLPTLADPAAEPED

SEQ ID NO: 25628 - protein, 543 aa, Setaria italica
MVAAAAAAASTSRLLLLHHRAAAGSDRHHQHQLRYAAIQYPLSLRCGSGRRGAAAGALLPDRVTPFSYGVDEDADDHPREECGLVGVVGDPDASSLCYLGLQKLQHRGEEGAGIVAVGGDGKLKSVTGLGLVADVFGDPSRLASLPGPAAIGHVRYSTAGAAASLRNVQPFLAGYRFGQVAVAHNGNLVNYQALRNKLEARGSIFNTSSDTEVILHLIATSLSRPLLARVCDACERLAGAYSLLFLTADKMFAVRDPHGFRPLVMGRRRNGAVVFASETCALDLIDATYEREVQPGEVVVVDRRDMSVASACLVPQRPRRACVFEHIYFSLPNSVVFSHAVHERRTAFGRALAEESPAPGADVVIPVPDSGFYAALGFARASGLEFQQGLIRWHYSGRSFIQPTQAIRDLAVKLKLAPVRGVIAGKSVVVVDDSLVRGTTSSKIVRLLRDAGAREVHMRIASPPVVGSCLYGIDTPSEGELISNRMDLEGVRREIGSDSLAFLSLGKLHGIYGEEAGDYCDACFSRKYPVLPTLADPAAELEE

SEQ ID NO: 25629 - protein, 386 aa, Sorghum bicolor
MASMPPPSAAGADSDQILVEVNGFTRTLILNRPKQLNALSSTMIMGLLRCFTAYEKDDGVKLLIMKGKGRAFCAGGDVAGVVRSIHKDSWKYGADFFRNEFLLNYIIATYTKPQVSLLTGIVMGGGAGVSLHGRFRVATDNTVFAMPETALGLFPDIGASYFLSRLPGFYGEYVALAGARLDGVEMLACGLATHFVHSNRLLLLEESLKKVDTSNTFAVCGIIDQFAQQPSLKESSSLNRLEIINKCFSKRTVEEIISALELEATNLADEWVATTIQSLKKASPTSLKISLRSIREGRTQTVGECLQREYRMVCHVMRGDFSRDFFEGCRAILIDKDRNPKWMPPRLEQVHDEAVEQYFSRIDDPQWEDLNLPPRRSHGRNIESKL

SEQ ID NO: 25630 - protein, 293 aa, Brachypodium distachyon
MAPLLFLLLAALALSPTFDAAAGGFYDQARVTQLSWRPRAFLYSGFLSHAECDHLVKLAKGRLQKSMVADNDSGKSVMSQVRTSSGTFLNKHEDEIISGIEKRVAAWTFLPEENAESIQVLHYEVGQKYDAHFDYFHDKNNQKLGGHRVATVLMYLTDVKKGGETVFPNAEGRHLQHKDETWSECARSGLAVKPRKGDALLFFSLHINATTDPSSLHGSCPVIEGEKWSATKWIHVRSFDNPPIVRMDVRCSDDNELCSKWAAVGECYRNPKYMIGTKDTLGFCRKSCGICDA

SEQ ID NO: 25631 - protein, 299 aa, Oryza sativa
MAPLRTLVIFLLLLLALVPALSRPDGGGGGFYDPARVTQLSWRPRAFLYSGFLSHDECDHLVNLAKGRMEKSMVADNDSGKSIMSQVRTSSGTFLSKHEDDIVSGIEKRVAAWTFLPEENAESIQILHYELGQKYDAHFDYFHDKNNLKRGGHRVATVLMYLTDVKKGGETVFPNAAGRHLQLKDETWSDCARSGLAVKPKKGDALLFFSLHVNATTDPASLHGSCPVIEGEKWSATKWIHVRSFDNPPDVSLDLPCSDENERCTRWAAVGECYRNPKYMVGTKDSLGFCRKSCGVCDA

SEQ ID NO: 25632 - protein, 218 aa, Aristolochia fimbriata
MASYRAEDDYDYLFKVVLIGDSGVGKSNLLSRFTRNEFSLESKSTIGVEFATRSLNVDGKVIKAQIWDTAGQERYRAITSAYYRGAVGALLVYDVTRHATFENVERWLKELRDHTDPNIVVMLIGNKSDLRHLVAVSTEDGKAFAEKESLYFMETSALEATNVDNAFAEVLTQIYRIVSKKAVETGDEGAAAAVPSKGERINVKDDVSALKKVGCCST

SEQ ID NO: 25633 - protein, 218 aa, Aquilegia formosa
MAAYRADDDYDYLFKVVLIGDSGVGKSNLLSRFTKNEFSLESKSTIGVEFATRSLNVDTKVIKAQIWDTAGQERYRAITSAYYRGAVGALLVYDVTRHATFENTERWLKELRDHTDPNIVVMLIGNKSDLRHLVAVSTEDGKSFAERESLYFMETSALEATNVENAFAEVLTQIYRIVSKKSMETGDDGAAANVPTKGEKLNVKDDVSALKRVGCCSS

SEQ ID NO: 25634 - protein, 218 aa, Ricinus communis
MAGYRAEDDYDYLFKVVLIGDSGVGKSNLLSRFTRNEFSLESKSTIGVEFATRSLNVDGKVIKAQIWDTAGQERYRAITSAYYRGAVGALLVYDVTRHSTFENVERWLRELRDHTDPNIVVMLIGNKSDLRHLVAVSTEDGKSFAERESLYFMETSALEATNVDNAFAEVLTQIYRIVSKKAMETGDEGAASAVPSKGEKIDVSKDVSAMKRVGCCSS

SEQ ID NO: 25635 - protein, 218 aa, Populus trichocarpa
MAGYRAEDDYDYLFKVVLIGDSGVGKSNLLSRFTRNEFSLESKSTIGVEFATRSLNVDGKVIKAQIWDTAGQERYRAITSAYYRGAVGALLVYDVTRHSTFENVERWLRELRDHTDPNIVVMLIGNKSDLRHLVAVSTEDGKSFAERESLYFMETSALEATNVDSAFAEVLTQIYRIVSKKAMETGDEAAASAVPSKGEKIDVSKDVSAMKRVGCCSS

SEQ ID NO: 25636 - protein, 218 aa, Citrullus lanatus
MAGYRAEDDYDYLFKVVLIGDSGVGKSNLLSRFTKNEFSLESKSTIGVEFATRSLNVDGKVVKAQIWDTAGQERYRAITSAYYRGAVGALLVYDVTRHSTFENVERWLRELRDHTDPNIVVMLVGNKSDLRHLVAVSTEDGKSFAEKESLYFMETSALEATNVENSFAEVLTQIYHIVSKKAMEAGEGAAAASVPSKGEKIDVGKDVSAVKKAGCCSS

SEQ ID NO: 25637 - protein, 218 aa, Gossypium hirsutum
MAGYRAEDDYDYLFKVVLIGDSGVGKSNLLSRFTRNEFSLESKSTIGVEFATRSLNVDGKVIKAQIWDTAGQERYRAITSAYYRGAVGALLVYDVTRHSTFENVERWLRELRDHTDPNIVVMLVGNKSDLRHLVAVSTEDGKSFAEKESLYFMETSALEATNVEIAFAEVLTQIYNIVSKKAMETSDDGAASAVPSKGEKIDVGKDVSAMKKGGCCSS

SEQ ID NO: 25638 - protein, 218 aa, Vitis vinifera
MAGYRAEDDYDYLFKVVLIGDSGVGKSNLLSRFTKNEFNLESKSTIGVEFATRTLNVDGKVIKAQIWDTAGQERYRAITSAYYRGAVGALLVYDVTRHATFENVDRWLKELRNHTDPNIVVMLVGNKSDLRHLVAVSTEDGKTYAERESLYFMETSALEATNVENAFAEVLTQIYRIVSKKSVEGGDEGAASSVPAKGERINVKDDASALKRVGCCSG

SEQ ID NO: 25639 - protein, 218 aa, Gossypium hirsutum
MAGYRAEDDYDYLFKVVLIGDSGVGKSNLLSRFTRNEFSLESKSTIGVEFATRSLNVDGKVIKAQIWDTAGQERYRAITSAYYRGAVGALLVYDVTRHSTFENVERWLRELRDHTDPNIVVMLIGNKSDLRHLVAVSTEDGKSFAEKESLYFMETSALEATNVENAFAEVLTQIYHIVSKKAMETSEEGNASAVPSKGEKIDVGKDVSAMKKGGCCSS

SEQ ID NO: 25640 - protein, 218 aa, Cucumis sativus
MAGYRAEDDYDYLFKVVLIGDSGVGKSNLLSRFTKNEFSLESKSTIGVEFATRSLNVDGKVVKAQIWDTAGQERYRAITSAYYRGAVGALLVYDVTRHSTFENVERWLRELRDHTDPNIVVMLVGNKSDLRHLVAVSTEDGKSFAEKESLYFMETSALEATNVENSFAEVLTQIYHIVSKKAMEAGDGTAAASVPPKGEKIDVSKDVSAVKKAGCCSS

SEQ ID NO: 25641 - protein, 218 aa, Gossypium hirsutum
  Sequence also found in Organisms: Gossypium raimondii
MAGYRAEDDYDFLFKVVLIGDSGVGKSNLLSRFTRNEFSLESKSTIGVEFATRSLNVDGKVIKAQIWDTAGQERYRAITSAYYRGAVGALLVYDVTRHSTFENVERWLRELRDHTDPNIVVMLIGNKSDLRHLVAVPTEDAKSFAEKESLYFMETSALEATNVENAFAEVLTQIYHIVSKKAMETSDEGAASAVPSKGEKIDVSKDVSAMKKGGCCSS

SEQ ID NO: 25642 - protein, 218 aa, Gossypium hirsutum
MAGYRAEDDYDYLFKVVLIGDSGVGKSNLLSRFTRNEFSLESKSTIGVEFATRSLNVDGKVIKAQIWDTAGQERYRAITSAYYRGAVGALLVYDVTRHSTFENVERWLRELRDHTDPNIVVMLVGNKSDLRHLVAVSTEDGKSFAEKESLYFMETSALEATNVEISFAEVLTQIYNVISKKAMETSDDGAASAVPSKGEKIDVGKDVSAMKKGGCCSS

SEQ ID NO: 25643 - protein, 218 aa, Gossypium raimondii
MAGYRAEDDYDYLFKVVLIGDSGVGKSNLLSRFTRNEFSLESKSTIGVEFATRSLNVDGKVIKAQIWDTAGQERYRAITSAYYRGAVGALLVYDVTRHSTFENVERWLRELRDHTDPNIVVMLVGNKSDLRHLVAVSTEDGKSFAEKESLYFMETSALEATNVEIAFAEVLTQIYNVVSKKAMETSDDGAASAVPSKGEKIDVGKDVSAMKKGGCCSS

SEQ ID NO: 25644 - protein, 218 aa, Theobroma cacao
MAGYRAEDDYDYLFKVVLIGDSGVGKSNLLSRFTRNEFSLESKSTIGVEFATRSLNVDGKVIKAQIWDTAGQERYRAITSAYYRGAVGALLVYDVTRHSTFENVERWLRELRDHTDPNIVVMLIGNKSDLRHLVAVSTEDGKSFAEKESLYFMETSALEATNVENAFAEVLTQIYHIVSKKAMETGDEGAASAVPSKGEKIDVSKDVSAMKKGGCCSS

SEQ ID NO: 25645 - protein, 218 aa, Populus trichocarpa
MAGYRAEDDYDYLFKVVLIGDSGVGKSNLLSRFTRNEFSLESKSTIGVEFATRSLNVDSKVIKAQIWDTAGQERYRAITSAYYRGAVGALLVYDVTRHSTFENVERWLRELRDHTDPNIVVMLIGNKSDLRHLVAVSTEDGKSFAERESLYFMETSALEATNVDNAFAEVLNQIYSIVSKKAMETGDNAAASAVPSKGEKIDVNKDVSAMKRVGCCSS

SEQ ID NO: 25646 - protein, 218 aa, Cucurbita pepo
MAGYRAEDDYDYLFKVVLIGDSGVGKSNLLSRFTKNEFSLESKSTIGVEFATRSLNVDSKVVKAQIWDTAGQERYRAITSAYYRGAVGALLVYDVTRHSTFENVERWLRELRDHTDPNIVVMLVGNKSDLRHLVAVSTEDGKSFAEKESLYYMETSALEATNVENAFAEVLTQIYHIVSKKAMEAGEDAAAASVPSKGEKIDVGKDVSAVKKGGCCSS

SEQ ID NO: 25647 - protein, 218 aa, Citrus sinensis
MAGYRAEDDYDYLFKVVLIGDSGVGKSNLLSRFTRNEFSLESKSTIGVEFATRSLNVDGKVIKAQIWDTAGQERYRAITSAYYRGAVGALLVYDVTRHSTFENVERWLRELRDHTDPNIVVMLIGNKSDLRHLVAVSTEDGKSFAEKESLFFMETSALEATNVDNAFAEVLTQIYRIVSKKAMETGEDGGNSAVPSKGEKIDVSKDVSAVKKGGCCST

SEQ ID NO: 25648 - protein, 217 aa, Malus domestica
MAGYRAEDDYDYLFKVVLIGDSGVGKSNLLSRFTRNEFSLESKSTIGVEFATRSLDVDGKVIKAQIWDTAGQERYRAITSAYYRGAVGALLVYDVTRNSTFESVERWLKELRDHTDPNIVVMLVGNKSDLRHLVAVSTEDGKSFAERESLYFMETSALEATNVDNAFSEVLTQIFRVVSRKAMESGNEGAASAVPQGEKIDVGKDVSAVKKGGCCST

SEQ ID NO: 25649 - protein, 128 aa, Brassica napus
  Sequence also found in Organisms: Gossypium hirsutum, Glycine max, Amborella trichopoda, Amorphophallus konjac, Aquilegia formosa, Aristolochia fimbriata, Persea americana, Brassica juncea and additional organisms as disclosed in Tables xx and yy
MQIFVKTLTGKTITLEVESSDTIDNVKAKIQDKEGIPPDQQRLIFAGKQLEDGRTLADYNIQKESTLHLVLRLRGGIIEPSLMALARKYNQDKMICRKCYARLHPRAVNCRKKKCGHSNQLRPKKKIK

SEQ ID NO: 25650 - protein, 127 aa, Brassica napus
  Sequence also found in Organisms: Chelidonium majus, Euphorbia peplus, Actinidia deliciosa, Papaver somniferum, Taxus baccata
QIFVKTLTGKTITLEVESSDTIDNVKAKIQDKEGIPPDQQRLIFAGKQLEDGRTLADYNIQKESTLHLVLRLRGGIIEPSLMALARKYNQDKMICRKCYARLHPRAVNCRKKKCGHSNQLRPKKKIK

SEQ ID NO: 25651 - protein, 127 aa, Cocos nucifera
MQIFVKTLTGKTITLEVESSDTIDNVKAKIQDKEGIPPDQQRLIFAGKQLEDGRTLADYNIQKESTLHLVLRLRGGIIEPSLMALARKYNQDKMICRKCYARLHPRAVNCRKKKCGHSNQLRPKKKI

SEQ ID NO: 25652 - protein, 126 aa, Cedrus atlantica
IFVKTLTGKTITLEVESSDTIDNVKAKIQDKEGIPPDQQRLIFAGKQLEDGRTLADYNIQKESTLHLVLRLRGGIIEPSLMALARKYNQDKMICRKCYARLHPRAVNCRKKKCGHSNQLRPKKKIK

SEQ ID NO: 25653 - protein, 125 aa, Arachis hypogaea
MQIFVKTLTGKTITLEVESSDTIDNVKAKIQDKEGIPPDQQRLIFAGKQLEDGRTLADYNIQKESTLHLVLRLRGGIIEPSLMALARKYNQDKMICRKCYARLHPRAVNCRKKKCGHSNQLRPKK

SEQ ID NO: 25654 - protein, 125 aa, Papaver somniferum
  Sequence also found in Organisms: Picea glauca
FVKTLTGKTITLEVESSDTIDNVKAKIQDKEGIPPDQQRLIFAGKQLEDGRTLADYNIQKESTLHLVLRLRGGIIEPSLMALARKYNQDKMICRKCYARLHPRAVNCRKKKCGHSNQLRPKKKIK

SEQ ID NO: 25655 - protein, 124 aa, Vaccinium corymbosum
VKTLTGKTITLEVESSDTIDNVKAKIQDKEGIPPDQQRLIFAGKQLEDGRTLADYNIQKESTLHLVLRLRGGIIEPSLMALARKYNQDKMICRKCYARLHPRAVNCRKKKCGHSNQLRPKKKIK

SEQ ID NO: 25656 - protein, 124 aa, Picea glauca
MQIFVKTLTGKTITLEVESSDTIDNVKAKIQDKEGIPPDQQRLIFAGKQLEDGRTLADYNIQKESTLHLVLRLRGGIIEPSLMALARKYNQDKMICRKCYARLHPRAVNCRKKKCGHSNQLRPK

SEQ ID NO: 25657 - protein, 123 aa, Euphorbia peplus
  Sequence also found in Organisms: Plantago ovata
KTLTGKTITLEVESSDTIDNVKAKIQDKEGIPPDQQRLIFAGKQLEDGRTLADYNIQKESTLHLVLRLRGGIIEPSLMALARKYNQDKMICRKCYARLHPRAVNCRKKKCGHSNQLRPKKKIK

SEQ ID NO: 25658 - protein, 118 aa, Epimedium sagittatum
KTITLEVESSDTIDNVKAKIQDKEGIPPDQQRLIFAGKQLEDGRTLADYNIQKESTLHLVLRLRGGIIEPSLMALARKYNQDKMICRKCYARLHPRAVNCRKKKCGHSNQLRPKKKIK

SEQ ID NO: 25659 - protein, 109 aa, Ananas comosus
SDTIDNVKAKIQDKEGIPPDQQRLIFAGKQLEDGRTLADYNIQKESTLHLVLRLRGGIIEPSLMALARKYNQDKMICRKCYARLHPRAVNCRKKKCGHSNQLRPKKKIK

SEQ ID NO: 25660 - protein, 107 aa, Cyclamen graecum
TIDNVKAKIQDKEGIPPDQQRLIFAGKQLEDGRTLADYNIQKESTLHLVLRLRGGIIEPSLMALARKYNQDKMICRKCYARLHPRAVNCRKKKCGHSNQLRPKKKIK

SEQ ID NO: 25661 - protein, 104 aa, Echinacea purpurea
NVKAKIQDKEGIPPDQQRLIFAGKQLEDGRTLADYNIQKESTLHLVLRLRGGIIEPSLMALARKYNQDKMICRKCYARLHPRAVNCRKKKCGHSNQLRPKKKIK

SEQ ID NO: 25662 - protein, 397 aa, Solanum tuberosum
MALQVAALLPSTFSIPKEGKTSATLKDSSLFGISLSDHVKSDFGSSFKIKSGRKSSLGAIRAETMIASPGVTNAPVTGKKTLRKGCVVITGASSGLGLATAKALAETGKWHVIMACRDFLKAERAAKSAGMPKENYTIMHLDLASLDSVRQFVDNFRRSGNPLDVLVCNAAVYQPTAKEPSFTAEGFELSVGTNHLGHFLLSRLLIDDLKQSDYPSKRLIIVGSITGNTNTLAGNVPPKANLGDLRGLARGLDGLNSSAMIDGGDFDGAKAYKDSKVCNMLTMQEFHRRYHEETGITFASLYPGCIATTGLFREHIPLFRLLFPPFQKFITKGFVSEAESGKRLAQVVSDPSLTKSGVYWSWNKNSSSFENQLSEEASDVEKARKVWEVSEKLLGLA

SEQ ID NO: 25663 - protein, 181 aa, Brassica napus
  Sequence also found in Organisms: Brassica juncea, Brassica oleracea, Brassica rapa
MGLSFGKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATSGEGLYEGLDWLSNNIAGKA

SEQ ID NO: 25664 - protein, 178 aa, Antirrhinum majus
MGLSFGKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATSGEGLYEGLDWLSNNIA

SEQ ID NO: 25665 - protein, 176 aa, Acacia harpophylla
MGLSFGKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATSGEGLYEGLDWLSNN

SEQ ID NO: 25666 - protein, 162 aa, Ananas comosus
LFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATSGEGLYEG

SEQ ID NO: 25667 - protein, 336 aa, Aquilegia formosa
MAPNIISTATKTVGFTKQASIPSRAFVTFLAGNGDYVKGVVGLAKGLRKVKSAYPLVVAILPDVPEEHRRILESQGCIVREIEPVYPPENQTQFAMAYYVINYSKLRIWEFVEYSKMIYLDGDIQVFENIDHLFDLPNGYFYAVMDCFCEKTWSHTPQYKLGYCQQCPNKVQWPAEMGQPPSLYFNAGMFVYEPSLSTYDDLLKQVKTTPPTPFAEQDFLNMFFKDIYKPIPLVYNLVLAMLWRHPENVELEKVKVVHYCAAGSKPWRYTGKEENMDREDIKMLVKKWWDIYDDASLDYKRSVAPSIPETGENLQPFLAALSEAGVVHYVTAPSAA
